United States Patent 8,106,174 (NUCLEIC ACID MOLECULES AND OTHER MOLECULES ASSOCIATED WITH PLANTS AND USES THEREOF FOR PLANT IMPROVEMENT) - sequence listing, part 11

SEQ ID NO: 50706 - protein, 107 aa, Sorghum bicolor
  Clone ID: LIB3480-026-P1-K1-B1.pep
LKGLYQALAISSMCLQEEASSRPLISDVVTALTFLADPNYDPPDDIKDPLPITVPNIDIETNQNETEGGKEQLQQNEEDSHERKNEEDSHERKSEEDSPERKNEEDS

SEQ ID NO: 50707 - protein, 45 aa, Sorghum bicolor
  Clone ID: LIB3480-026-P1-K1-E5.pep
HAISCALRKAIGRPLYYAAAKDVAAISGRRFQSECNAAVLITSQK

SEQ ID NO: 50708 - protein, 63 aa, Sorghum bicolor
  Clone ID: LIB3480-026-P1-K1-E8.pep
VSFRTLAGTPSQAVYHIPRPFVKPKDNLWVVFEEEMGKPDGILVQTVTRDDICLLISEHIPGT

SEQ ID NO: 50709 - protein, 70 aa, Sorghum bicolor
  Clone ID: LIB3480-026-P1-K1-F3.pep
APINHCRVTRGRNPRPTNADNPFAAGKRKADRRLQQCAAKARTPLSGLSRRWGYRRAVTAGLRRLRSSSF

SEQ ID NO: 50710 - protein, 117 aa, Sorghum bicolor
  unsure (1)..(117): unsure at all Xaa locations
  Clone ID: LIB3480-026-P1-K1-H10.pep
FRSFPVIQAPSCRGMPSLNHLLGLDGAGGVRSHFHGATHATXTLYGHRRARITIALHESPGAPPCVLLDMGVPTAKFIQDVSAAGMVRVTLECEKQQQQQHHAAAESSVRLLDEPDW

SEQ ID NO: 50711 - protein, 154 aa, Sorghum bicolor
  unsure (1)..(154): unsure at all Xaa locations
  Clone ID: LIB3480-026-P1-K1-H6.pep
IGNKGSVSVSMSIHQTPFCXVCCHLAAGEKDGYDLXRNSNVEEILRRTVFNPVNAVGMPMRIHDHERIIWLGDLNYRINLSYERTHELISKQDWDRLFERDQLKRELRKGCTFDGWFEGVISFPPTYKYEFDSEYYVSDESKSGRRTPAWCDRI

SEQ ID NO: 50712 - protein, 131 aa, Sorghum bicolor
  unsure (1)..(131): unsure at all Xaa locations
  Clone ID: LIB3480-027-P1-K1-A10.pep
ALVNDTVGTLALGHYYDEDTVAAVIIGAGTNACYIERTDAIIKCQGLLTNSGGMVVNMEWGNFWSSHLPRTPYDISLDDETQNRNDQGFEKMISGIYLGEIARLVLXRMALESDVXGDACDHLSTPFTLST

SEQ ID NO: 50713 - protein, 96 aa, Sorghum bicolor
  Clone ID: LIB3480-027-P1-K1-A4.pep
APRHTRYYVSRARPCGPPRHGRRHRGGAGGRLRGRRRRAVHPRRRSRRRRRPRSRPDQRSAGRPIARRAPLTPRAPGVVPAGLYEHCKYGHVVMSV

SEQ ID NO: 50714 - protein, 153 aa, Sorghum bicolor
  unsure (1)..(153): unsure at all Xaa locations
  Clone ID: LIB3480-027-P1-K1-A6.pep
WAKLPLLRRLMLSHPEVEWIWWMDSDARFTDMAFELPLSRYDGHNLIIHGYQDLLFEKHSWIALNTGSFLFRNCQWSLDLLDAWAPMGPKGFIRDQAGKVLTANLKGRXAFEADXXSPLIYLLLSQKDKWMDKVFIENSYYLHGFWAGLVDKV

SEQ ID NO: 50715 - protein, 45 aa, Sorghum bicolor
  unsure (1)..(45): unsure at all Xaa locations
  Clone ID: LIB3480-027-P1-K1-B1.pep
WRTGCRXASRTPPAGRSRXRCRPSPPRSGXXPAWXGXSAPAGRVG

SEQ ID NO: 50716 - protein, 106 aa, Sorghum bicolor
  unsure (1)..(106): unsure at all Xaa locations
  Clone ID: LIB3480-027-P1-K1-B5.pep
PSRCRRRRRRREIAAVEPAAERTRVQGRRAEARPGARRLLIRGRPRRDALVRGGAVLLLLLHRRRRAGGVXEQGLLLRHRDLLDRRRPVQPHMVIPHGTQVQQPRP

SEQ ID NO: 50717 - protein, 106 aa, Sorghum bicolor
  Clone ID: LIB3480-027-P1-K1-B6.pep
LDLRGNQLASLPPSLGRLVKLEELDVSADHLTSLPAAIGSLKNLKKLIVETNNLDELPSTMGNCVSLVELRAGYNHFKALQEAVGKLESLEVLSVQYNSIRGLPTT

SEQ ID NO: 50718 - protein, 140 aa, Sorghum bicolor
  unsure (1)..(140): unsure at all Xaa locations
  Clone ID: LIB3480-027-P1-K1-B7.pep
ARSDDAPHLLLPRDLRRRSYHALECCRMAYDHIAHQHTYWNRTSGRDHIWFFSWDEGACYAPKEIWNSMMLVHWRNTNTKHKNSTTAYRADNWDDIPXDKRGTHPCFXPRKDLVLPXWKEPNPGAIWLKLLVWSMKNHTT

SEQ ID NO: 50719 - protein, 103 aa, Sorghum bicolor
  Clone ID: LIB3480-027-P1-K1-B8.pep
FAAAVLAYMLKLVVGYSPTKTYYIRASLTVCHPAFPSLIFWQNKKKLSPIVCHLPSPSFQPQQKFLSARIYARGLGARILSFPAHLVRRKTGFHVRKTQERKI

SEQ ID NO: 50720 - protein, 131 aa, Sorghum bicolor
  unsure (1)..(131): unsure at all Xaa locations
  Clone ID: LIB3480-027-P1-K1-B9.pep
EDTSQESVMLWLLKDKLSEMDHDGDGRINLEEFVAQSDLERAEAEEKFRELDADMDNYLTVEEARSVLQSLITGEFSYATSHAKFLMKADVNQDGKLSLEEMLDDYVXFYSTVYTDXHYSNEVDSDSHDEL

SEQ ID NO: 50721 - protein, 118 aa, Sorghum bicolor
  Clone ID: LIB3480-027-P1-K1-C11.pep
KRHSPAPRPAACGSGPRPGRYRRPARGPSRRSATRATGGSCGTRVSPRPPPRRPMSRSAGSGEAPGSRCHASHRLRIMDRWRCDDVSLGIGQHGLCPTAAPLITNTSRRVSFLPSVIY

SEQ ID NO: 50722 - protein, 75 aa, Sorghum bicolor
  Clone ID: LIB3480-027-P1-K1-C4.pep
NKHTQYFEWGVQTFMSHNAPPAYECLSTVGALVEPALADPASGESPETHVYPRAKLFKSIIYCAPENTKCAGAVP

SEQ ID NO: 50723 - protein, 123 aa, Sorghum bicolor
  unsure (1)..(123): unsure at all Xaa locations
  Clone ID: LIB3480-027-P1-K1-C7.pep
RWTGIPVTRLGQNDKERLVGLADRLHXRVIGQHEAVNAIAEAVLRSRAGLGRTQQPTGSFLFLGPTGVGKTELAKALAEQLFDDEKLLVRLDMSEYMEKHSVSRLIGXPPGYVGHEKEGTACG

SEQ ID NO: 50724 - protein, 121 aa, Sorghum bicolor
  Clone ID: LIB3480-027-P1-K1-C8.pep
GRVGVKPLFPDARSRPAAVRRLFDGPVKLDTAGLMQQSICYDGANRWTVSVAWGFTVLVARGIMSPREMEMPARTFLNWYRRADYTAYAFNTRPMAAQPEPEASPVLMSSGRRQDDAAGRP

SEQ ID NO: 50725 - protein, 72 aa, Sorghum bicolor
  Clone ID: LIB3480-027-P1-K1-D11.pep
VGKRFFIVVGLLKKGEAIKFSLENIKNIKWYGWVGKAGCFYKESPPVFVDGVFIGNIFLFFFFLVVFYFLFI

SEQ ID NO: 50726 - protein, 83 aa, Sorghum bicolor
  unsure (1)..(83): unsure at all Xaa locations
  Clone ID: LIB3480-027-P1-K1-D3.pep
IFFLYHLKKFXXLKTFKIFFFFLKSPPQXIFFINFNFFFIYIYLIFFILFFSFLTLYFXPSFFFFFFFFFFFFFFFFFFFFTR

SEQ ID NO: 50727 - protein, 118 aa, Sorghum bicolor
  unsure (1)..(118): unsure at all Xaa locations
  Clone ID: LIB3480-027-P1-K1-E10.pep
LKKSFNMSNLIIHQTMLPPVEAADEEGDAYDYAELDSELEKRQQQKAQEKEKGIPXAVAEHKKFLERLMDLLKDDWKGICKGFFNSMTATQVANHAQKYFLQXDQPREEKRQEKLFDS

SEQ ID NO: 50728 - protein, 104 aa, Sorghum bicolor
  unsure (1)..(104): unsure at all Xaa locations
  Clone ID: LIB3480-027-P1-K1-F10.pep
PQVQIGPYIFTFDHTYGLSKPSSSLIXEQCMHSSIDALFSGYNATVLAYCQTGSHTTYTMGTDYSRDSNCGGISAQVLDTIFTKVDTXKDGSEFLIXVSFNEIF

SEQ ID NO: 50729 - protein, 103 aa, Sorghum bicolor
  Clone ID: LIB3480-027-P1-K1-F8.pep
LGGFFSKPWKPKKTKQIKGPAHVSRDDSFKKKASRMEQKDKLGLSPRGKRDPRHYAEATDAMDKVQIEKKKQDDPLDDLNGVLGQLKGMAVDIGRELDRQNQT

SEQ ID NO: 50730 - protein, 51 aa, Sorghum bicolor
  Clone ID: LIB3480-027-P1-K1-G1.pep
GFVTFSDPSVLDRVLEDAHVIDGRTVEVKRTVPKEEMSSKDGPKTKKIFVG

SEQ ID NO: 50731 - protein, 70 aa, Sorghum bicolor
  Clone ID: LIB3480-027-P1-K1-H11.pep
GVIDVTLKAITDDSLVDESLAILALLAGDHETVEEIGETGGVASMLHVIKEDQCKRNKENAVAVLFAICM

SEQ ID NO: 50732 - protein, 155 aa, Sorghum bicolor
  unsure (1)..(155): unsure at all Xaa locations
  Clone ID: LIB3480-027-P1-K1-H3.pep
FSVTEAIEKMPLELFLQVVGSPKVDITITKCSGRTLSEIPISQYNLLMDAHAKGRLSRLINILDKLKLIELVNEHVEDSDVRPRAVTTYSLEIRPYIEEPTPRVIPSSMSVXPSSKIRHDFVLSKLESVDAYWETLKYCYLTAGLADQNAFPGHC

SEQ ID NO: 50733 - protein, 121 aa, Sorghum bicolor
  Clone ID: LIB3480-027-P1-K1-H8.pep
PIYRGGDDDRIEAATRVLHHHELGNGGAGGEAGGPGGAQVGLPRRLPGGLLLRGEAARVHHAQAGRHQAPPPPRQQLTDRSTAASMPAAPRTRRMLYFTARPCSTGCAATTTCRVLLRVVT

SEQ ID NO: 50734 - protein, 50 aa, Sorghum bicolor
  Clone ID: LIB3480-028-P1-K1-A5.pep
NNHKGDHFGYAAGDRMHHVACGVCSFHWNRNPVKFERMRNDSMFILTFIG

SEQ ID NO: 50735 - protein, 65 aa, Sorghum bicolor
  unsure (1)..(65): unsure at all Xaa locations
  Clone ID: LIB3480-028-P1-K1-B11.pep
KNVPVLYXNFGINGKKHICSXRECYQNSCKFSVYEKVASRKLVKKKKKNKKKKKKKKKKKKKKGR

SEQ ID NO: 50736 - protein, 64 aa, Sorghum bicolor
  Clone ID: LIB3480-028-P1-K1-B12.pep
LGLPARLLAQFCSATFSSPRPPPDGRRSTTPTNSRIWQWQTRTDRRKRGMRTEWPEKGPWYRRA

SEQ ID NO: 50737 - protein, 46 aa, Sorghum bicolor
  Clone ID: LIB3480-028-P1-K1-B4.pep
RFHYAVLQWVLLLASLAPRHRASVVFLMAASKGLLVYGGLLSAFPN

SEQ ID NO: 50738 - protein, 85 aa, Sorghum bicolor
  Clone ID: LIB3480-028-P1-K1-C1.pep
ASARDLLDPGLQPGPGSPAHTTRPPQGSPFSGADDLPASSTALLSSNQPAAAAAMADDNTVTLVRLILAIILPPIGVFLKHGLKV

SEQ ID NO: 50739 - protein, 94 aa, Sorghum bicolor
  unsure (1)..(94): unsure at all Xaa locations
  Clone ID: LIB3480-028-P1-K1-C10.pep
MMLLVVLTGHLDDAEIAVDSIAICMNINGWEGMLFIGLSAAISVRVSNELGSGRPRASMYAVMVVLAXXLALGLLAMVLVLATREXFPAIFTVD

SEQ ID NO: 50740 - protein, 45 aa, Sorghum bicolor
  Clone ID: LIB3480-028-P1-K1-C11.pep
ISKLKSDYTIAFLIINPSKQDLTWMYLDKILLINIYLIKIKHFYL

SEQ ID NO: 50741 - protein, 47 aa, Sorghum bicolor
  unsure (1)..(47): unsure at all Xaa locations
  Clone ID: LIB3480-028-P1-K1-D2.pep
HFFDLPFFXIYHSHMIEDHLLFFFFNSPYLLDXLGQTLMSVNITYRS

SEQ ID NO: 50742 - protein, 113 aa, Sorghum bicolor
  Clone ID: LIB3480-028-P1-K1-E12.pep
NLPCIFGCEKDGSSVKTRDKLSIVWGHRKFIHSGLAAASSSPSSPCPPVPDRSADPIVVVAKRDLHCMQCRSAGRNLSTPLARSPSNPSAGPAGFLSSFEITKKLAGQSIKRS

SEQ ID NO: 50743 - protein, 127 aa, Sorghum bicolor
  Clone ID: LIB3480-028-P1-K1-E9.pep
GGDCAVCLGEFSDGELVRLLPRCAHPFHAPCIDTWLRAHVNCPICRSPVDVVPSDPPVAAAEAEAGDAQSGEHHVHEEMSLSQSESETEVSEDSEASAATQSEGTTATTDEDGRATPNVIRRSASMD

SEQ ID NO: 50744 - protein, 48 aa, Sorghum bicolor
  Clone ID: LIB3480-028-P1-K1-G2.pep
RQAACRCLKSLANSVKSVNMGTVATIPGKCGVSVPFPISMSTDCNKVS

SEQ ID NO: 50745 - protein, 42 aa, Sorghum bicolor
  Clone ID: LIB3480-028-P1-K1-G4.pep
IGEVRSMRYMLSYTIMPRHSCNIVTAKFKSLAGGLERVHFKN

SEQ ID NO: 50746 - protein, 61 aa, Sorghum bicolor
  Clone ID: LIB3480-029-P1-K1-A11.pep
NYGHTVPHPKHKWKKKKTGHTLLQIMSFPGSVDTFFGQQSAANILHVLGDFRGRKPLPVFY

SEQ ID NO: 50747 - protein, 127 aa, Sorghum bicolor
  Clone ID: LIB3480-029-P1-K1-C5.pep
VFQMFDKNGDGQITKKELGESLKNLGIFIADEELDATMDKIDVNGDGCVDVEEFGRLYRSIVEDGPGADADGDKHDEDEDMREAFNVFDHNGDGYITVDELRSVLASLGLKQGRTAEDCRKMISKVD

SEQ ID NO: 50748 - protein, 135 aa, Sorghum bicolor
  unsure (1)..(135): unsure at all Xaa locations
  Clone ID: LIB3480-029-P1-K1-D4.pep
GETVIDERKIRIKPLPAGAENSKTPIATLADIPLPDSRLTRRRNSFKLDSYLDPAFMSIIKDPDLRRKEQXEKSAQANKGLNLANMLGFGDLGSPPLSAAEEYSLHSRYLAKANSMNLSDVAEMKINYXRGGVDS

SEQ ID NO: 50749 - protein, 35 aa, Sorghum bicolor
  Clone ID: LIB3480-029-P1-K1-F10.pep
PCESAPSYHISKLMIFTITTVPTTIELPSWGSRKM

SEQ ID NO: 50750 - protein, 47 aa, Sorghum bicolor
  Clone ID: LIB3480-029-P1-K1-F11.pep
LFKRKRCCSLVVVKVWESLISRTSIADCKRSKFISSCINHESYYHIS

SEQ ID NO: 50751 - protein, 107 aa, Sorghum bicolor
  Clone ID: LIB3480-029-P1-K1-F6.pep
SGAYSMVSWCSLHPATGTGSASTTMRSPGCGTCFASLDCIRRRRMRSRRRRCRVDASSRGPDAVLQGATLRMMQGQNVTGASDDVYTFITASVSFFLCSNFVLSKII

SEQ ID NO: 50752 - protein, 96 aa, Sorghum bicolor
  Clone ID: LIB3480-029-P1-K1-H5.pep
RYTCSRTMIITLKEELIIQGDKTIDGRGAQVRIANGAQLTVQFANNVIIHNVHINDIMSSNKNGGTFGLADTSLAHVRRTDTSSSHVVTPSSLQTL

SEQ ID NO: 50753 - protein, 66 aa, Sorghum bicolor
  unsure (1)..(66): unsure at all Xaa locations
  Clone ID: LIB3480-029-P1-K1-H7.pep
FTTDENCQKSKIFFISWSPDTSKVRSXMLYASSKDRFKRELDGIQVELQATDPSEMSMDIVKARAL

SEQ ID NO: 50754 - protein, 95 aa, Sorghum bicolor
  Clone ID: LIB3480-030-P1-K1-A11.pep
AGQSESRPVFHRPPIDPASTVPLLFPSESQWEIEYHSQLNNITLSYAARIISQILLQEVVRCIPQYTGHCKMHIAEYIPVFTVLWKGSMWLSRTL

SEQ ID NO: 50755 - protein, 63 aa, Sorghum bicolor
  Clone ID: LIB3480-030-P1-K1-C12.pep
QLMEEVCCAARLCWVVTTWFQQSRCCKTASRVLLVGATIEQLCRRMEEVIMVHLLQRLLIYYY

SEQ ID NO: 50756 - protein, 161 aa, Sorghum bicolor
  Clone ID: LIB3480-030-P1-K1-C5.pep
KELVPEMFYLPEVFTNVNSSGRLGSVALPPWAENAVDFVHMHRKALESDHVSTRLHEWIDLIFGYKQRGKEAVVANNIFPHVTYDGMVDIDKITDPVQRQGVQNQICYFGQTPFQLLTVPHIRRKPLTEILQLQTIFRNPSESRSYVLPSPEHLNVPASTM

SEQ ID NO: 50757 - protein, 53 aa, Sorghum bicolor
  Clone ID: LIB3480-030-P1-K1-C7.pep
PSSSSITWCVPTYLCISLMTKVNTHRFHQLSKTKLGLSKGLITSGERVNHDSQ

SEQ ID NO: 50758 - protein, 60 aa, Sorghum bicolor
  Clone ID: LIB3480-030-P1-K1-C8.pep
RAKHDSHCRWQPAKRPKPIVIPNNCADRMGNGTRSVAAHEHTMEGRILTMWPMLFSMHYT

SEQ ID NO: 50759 - protein, 109 aa, Sorghum bicolor
  Clone ID: LIB3480-030-P1-K1-D2.pep
AVLVGDHLYVANVGDSRAVISKAGKAMALSEDHKPNRIDERKRIENAGGIVIWAGTWRVGGVLAMSRAFGNRLLKPYVVAEPEIQEEQVNGELECLVLASDGLWDVVEN

SEQ ID NO: 50760 - protein, 53 aa, Sorghum bicolor
  Clone ID: LIB3480-030-P1-K1-D6.pep
EAQGINPLAPQSSRAPPPWQAARGSPSLPAGARSTPWVSYPAARTPRRRSRPS

SEQ ID NO: 50761 - protein, 61 aa, Sorghum bicolor
  Clone ID: LIB3480-030-P1-K1-E1.pep
GPDAPAVRGGAVALPPRLRGSRCSISLSIGVGAGVGGDREFIIRTISWYSILVMFTAQCDW

SEQ ID NO: 50762 - protein, 74 aa, Sorghum bicolor
  Clone ID: LIB3480-030-P1-K1-E8.pep
VNVVPCQLIIHQLAGHLCQLVHCRQHRSVICNQYLGINKSCHHTASSVVVDTDNLVHHQQFKELFRVLERHWLV

SEQ ID NO: 50763 - protein, 40 aa, Sorghum bicolor
  Clone ID: LIB3480-030-P1-K1-E9.pep
VIHRLRSVERSHGCTHWHATRLLCYDESLFQCTVRHLTSA

SEQ ID NO: 50764 - protein, 137 aa, Sorghum bicolor
  Clone ID: LIB3480-030-P1-K1-F2.pep
IMLSDFDLSLRCSVSPMLVRTSSVGRDEPSRPSGPCAQSCIDPLCIQPSWSNSSCFTPRLVSSTPSRTRRPRAEPLKKPSLPQLVVEPTEARSNSFVGTHEYLAPEIIRGDGHGSSVDWWTLGIFLYELLYGKTPFK

SEQ ID NO: 50765 - protein, 47 aa, Sorghum bicolor
  Clone ID: LIB3480-030-P1-K1-G7.pep
HLTSWIDLLCGLVVFGYTVMDWIKLIHRGCWNERSNGILVENHGVME

SEQ ID NO: 50766 - protein, 32 aa, Sorghum bicolor
  Clone ID: LIB3480-030-P1-K1-H2.pep
FTIVCSRPHGLGSRHSIAVQGLLERTHAVHPY

SEQ ID NO: 50767 - protein, 58 aa, Sorghum bicolor
  Clone ID: LIB3480-030-P1-K1-H7.pep
PCNPTYRKLDPLKRPPHYLFPFTLAFTFFMFNCFFFCILLFYFSPFFFFFFFFCRQGI

SEQ ID NO: 50768 - protein, 80 aa, Sorghum bicolor
  unsure (1)..(80): unsure at all Xaa locations
  Clone ID: LIB3480-030-P1-K1-H9.pep
ASPSPFRLRSCWRGXSVRASSLFRLLAXCACAALRLRWXAPGLSRSRRCPSXARALGFAVPLLCRRVRACVGLVPPRPLS

SEQ ID NO: 50769 - protein, 80 aa, Sorghum bicolor
  Clone ID: LIB3480-031-P1-K1-A11.pep
VSTDEDKTTEEEGGDAPPPAAAAASGHAEESSETVAKDGDAAGGGKTPAPAGAESHGGNLRVPVSSVLTIALSSLALVGI

SEQ ID NO: 50770 - protein, 60 aa, Sorghum bicolor
  Clone ID: LIB3480-031-P1-K1-B2.pep
DLRPHGCRHHFGRPRPEQGEVERHEDDGAEHEHGHQHAAADQGGPPLLPLGDGHRLGRVG

SEQ ID NO: 50771 - protein, 39 aa, Sorghum bicolor
  Clone ID: LIB3480-031-P1-K1-B3.pep
LKRARPLLSTKAKIRVPPSSYVSYFLPYSDFAQLSFTRS

SEQ ID NO: 50772 - protein, 145 aa, Sorghum bicolor
  unsure (1)..(145): unsure at all Xaa locations
  Clone ID: LIB3480-031-P1-K1-C5.pep
AVGDLKEFLEDVVLEENRGLPCFLFGHSTGGAIVLKAVLDPFVELHVEGVVLTSPAIHVQPSHPIIKVVAPIFSMLAPKYRVSALHKRGPPVSRDPEALKMKYSDPLVYTGPIRVRTGNEILXISSXXQRNXSRVTVPFLGLMDS

SEQ ID NO: 50773 - protein, 45 aa, Sorghum bicolor
  Clone ID: LIB3480-031-P1-K1-D1.pep
NRSTCNSSNKYLFSQDYQSEILRILDMKEGKVISNRVIVPPPNDA

SEQ ID NO: 50774 - protein, 127 aa, Sorghum bicolor
  Clone ID: LIB3480-031-P1-K1-E11.pep
AVRVPAFLVVGVESAIYFANSMYLVERVLRFLRDEEERALKSNLPSIRSVVLDMSAVTAIDTSGLDALSELKKVLDKRSIELVLANPLGSVAERIFNSAVGETFGSDRLFFSVREAVAAGACKAAQP

SEQ ID NO: 50775 - protein, 91 aa, Sorghum bicolor
  unsure (1)..(91): unsure at all Xaa locations
  Clone ID: LIB3480-031-P1-K1-F4.pep
HASAETGLDEDQSSTGKSGDSSFFAGFLXKGFKDLSLLNKSMDSVKVSINGHPISERALKRQRRKLSCDPVHIVRYRLFWVYGQSDRMPSL

SEQ ID NO: 50776 - protein, 86 aa, Sorghum bicolor
  unsure (1)..(86): unsure at all Xaa locations
  Clone ID: LIB3480-031-P1-K1-F5.pep
EKLLRTSWRRVILGCRGDSTVRWPAAKKTEGIERAWRRRVKEGAGGDSVVGTCHPRRLLYLXPRKTRRGWRMRDGGRGSDREERAP

SEQ ID NO: 50777 - protein, 101 aa, Sorghum bicolor
  Clone ID: LIB3480-031-P1-K1-F9.pep
IFHFNGIAKSVLNGNASAGGSCPIQRPRLCKLNVTVPPRWTQDEYLADVVSASTSSSSKDDSILSLAPPVQTNQHAPLVDCIRTRWPRAVCSWAGDVPSIV

SEQ ID NO: 50778 - protein, 52 aa, Sorghum bicolor
  Clone ID: LIB3480-031-P1-K1-G5.pep
RFGHGLCSSVNYCLLLVLWVNIKLTVSHALEIAFLARISYTGRIFLVQTDCC

SEQ ID NO: 50779 - protein, 57 aa, Sorghum bicolor
  Clone ID: LIB3480-031-P1-K1-G9.pep
DGPGITQPNLNSVHPHLTSCPYTEYTLNSHPSNHMLILYEHCVAPCTGALNAPVFLL

SEQ ID NO: 50780 - protein, 48 aa, Sorghum bicolor
  Clone ID: LIB3480-032-P1-K1-A1.pep
LTAVAMALLAVTSSGWTNLESGAKHIDDELGVHVMMCAPPRTLDSNQP

SEQ ID NO: 50781 - protein, 147 aa, Sorghum bicolor
  unsure (1)..(147): unsure at all Xaa locations
  Clone ID: LIB3480-032-P1-K1-A6.pep
HASAASEVPPPAPHHSWRKSIVILSSSVSGVVLLLAGLIIVVAVAVVLRKRRGKGKVTAVXGSLLLFDYQAVKSATRDFTEKLGSGSFGSVYKVTLPDTTPVARKKLDGLRQGXEKQFRAEVVTLRMIQHINLVRFRXGFCCEGNKR

SEQ ID NO: 50782 - protein, 116 aa, Sorghum bicolor
  Clone ID: LIB3480-032-P1-K1-B12.pep
NKRELVQQTPVDAWKCASSGEEAQKESQTCGNFGGDQGKEDRHAKRAKPAMQSPLASTPKSVKKLSRRNWGETKMQIIQVQETAPMCPLTKNKKQKKNYRKVAAPNPRQNKEFDAR

SEQ ID NO: 50783 - protein, 110 aa, Sorghum bicolor
  unsure (1)..(110): unsure at all Xaa locations
  Clone ID: LIB3480-032-P1-K1-C4.pep
GRVGTPANILDVRGSASKRHVVXAFKILTXDEIVNAILVNIFENIIXSDVIASGIVNAAKQVDLNDPVVVQLQCTNVHQRKRILNESGMTLITAEDLDDTAYKPVKASSM

SEQ ID NO: 50784 - protein, 64 aa, Sorghum bicolor
  Clone ID: LIB3480-032-P1-K1-E10.pep
SSRSQSTSTEILYICVLDWMSSGSISDLCILTIYISCACQHENKMLATCVPRVMTYTSSSLKYR

SEQ ID NO: 50785 - protein, 56 aa, Sorghum bicolor
  unsure (1)..(56): unsure at all Xaa locations
  Clone ID: LIB3480-032-P1-K1-F3.pep
KVIKWGNARVCTVXTLSNYGESSSWSASYTRWSAPWSPPCAAAAAASARVVSKTET

SEQ ID NO: 50786 - protein, 74 aa, Sorghum bicolor
  unsure (1)..(74): unsure at all Xaa locations
  Clone ID: LIB3480-032-P1-K1-F4.pep
RDGPVNHRAAVHRLGSVLSRSRVCWGGVILLRLCLPGVXGEALAAVAQGNKFSRSCPRSLGGLYSQGWDWGCGD

SEQ ID NO: 50787 - protein, 79 aa, Sorghum bicolor
  Clone ID: LIB3480-032-P1-K1-G11.pep
LPGVLWVLPDSYIDVKNKDYGGDKYINGEIIPCTYPTYQPKERRTSKYESRRYERRRDGPPAASRKPRQQAPQTESASS

SEQ ID NO: 50788 - protein, 140 aa, Sorghum bicolor
  unsure (1)..(140): unsure at all Xaa locations
  Clone ID: LIB3480-032-P1-K1-G4.pep
MERRSRHALLLFSAVMASLVSGSTGGIDHIVGAGKGWXMPPNRTYYADWASARQISVGDKLMFLYRSXAHNIVEVPTRELFDVCSMHNITNRYQNGPTIIELTEPGQRFYFCGVXEHCEGRQKLAITCFSSRRRSPTRTT

SEQ ID NO: 50789 - protein, 69 aa, Sorghum bicolor
  Clone ID: LIB3480-032-P1-K1-H1.pep
SSMGYVIRHQVNQEVFRIIGYTDKGLPILSSLIRGMKKNSYDFVCSVNFNLACANSIFCSDHEHFTFVT

SEQ ID NO: 50790 - protein, 50 aa, Sorghum bicolor
  unsure (1)..(50): unsure at all Xaa locations
  Clone ID: LIB3480-032-P1-K1-H12.pep
ADVTLNILVAGXTTGGCMNPLRTLGPAVADENYKQLTIYLLGPTLGALAD

SEQ ID NO: 50791 - protein, 102 aa, Sorghum bicolor
  Clone ID: LIB3480-032-P1-K1-H7.pep
EIACQITSSSPVDDKASESSGSPVKDTPDAGVRLQGSDNSAMAFSALPLVDEAPGTSSRAAGMPVACDCNDLKEDVPLDNAESTGNLEEPTDELTLVDTDAV

SEQ ID NO: 50792 - protein, 66 aa, Sorghum bicolor
  Clone ID: LIB3480-032-P1-K1-H9.pep
SKQAEAANGRYASSVAIIVLAPACTWSCSSWPPSRWRRSRRSSTQSRPHDHGGQVHGVILNRPAPI

SEQ ID NO: 50793 - protein, 43 aa, Sorghum bicolor
  Clone ID: LIB3480-033-P1-K1-A12.pep
SNITSESYAEKYGPSSGSFEQTNSHAQYGALYMQPSIQQIIMT

SEQ ID NO: 50794 - protein, 69 aa, Sorghum bicolor
  Clone ID: LIB3480-033-P1-K1-A6.pep
MRVLSDCARRRCASGRMNDQPCTQGIRHNRQMSAGSALYHRLYDRVDAPFSMRLYIVSVCLSSTEIGCR

SEQ ID NO: 50795 - protein, 154 aa, Sorghum bicolor
  Clone ID: LIB3480-033-P1-K1-A8.pep
PASAASQRNPRTQNPTTAPMASPPPSPAPHPTSAAAAAAVGNGHATSASPVDALFLQNLMSRVQLRPPFLDTNSFLTQDLDDFLLNEFAALSAAAGASDDDEDEEDEDGGLAGGEGSGEARRRRMLAREEAKLEKEILRMVLAVEAEDKPKPNS

SEQ ID NO: 50796 - protein, 49 aa, Sorghum bicolor
  Clone ID: LIB3480-033-P1-K1-B1.pep
TTGRRCTVWPGTFFFAHLHHALPRMICTFEEGFSSIGFATRSIRYELWE

SEQ ID NO: 50797 - protein, 36 aa, Sorghum bicolor
  Clone ID: LIB3480-033-P1-K1-B11.pep
GGLSVFFNIIIIISLADSAFLLVLLKFDCMLYLLSL

SEQ ID NO: 50798 - protein, 112 aa, Sorghum bicolor
  Clone ID: LIB3480-033-P1-K1-B2.pep
MPATFVVKTSILTKDQILVPETLLKKRKSSEKEAADKAAHRETRKKESKTKREQIFKRAESYVKEYRDYQREQIRVARVAKADGSYYVPAQPKLVLVTRIKGINKIDPKKRK

SEQ ID NO: 50799 - protein, 92 aa, Sorghum bicolor
  Clone ID: LIB3480-033-P1-K1-C11.pep
RTTAVVACQLVVKNVVTDRQVLACSLNQILLPVIVNSFIRSYGHPFWLHWLLFKICSCVRRCNCTDVISHAYLKSEPDYLTIESPISRSLIM

SEQ ID NO: 50800 - protein, 40 aa, Sorghum bicolor
  Clone ID: LIB3480-033-P1-K1-E10.pep
RVRGRVGLSREYIFLWAAFRQLICEVLTMLFCPPKSLQSL

SEQ ID NO: 50801 - protein, 63 aa, Sorghum bicolor
  Clone ID: LIB3480-033-P1-K1-F4.pep
ISHIKHDKEHSRSFFCYKIHLHCQIYQCNPTKNSLKILYLFVLLDNHGLIRTIEVGFRSSVKL

SEQ ID NO: 50802 - protein, 85 aa, Sorghum bicolor
  unsure (1)..(85): unsure at all Xaa locations
  Clone ID: LIB3480-033-P1-K1-F6.pep
QHPDWAHLDGPELHPLVARWRNSSXGRTDQARKQRRSLHGHWHTRXCDAPCAGAVIATRVGTTPIASAILASALAPVPFFLVTFV

SEQ ID NO: 50803 - protein, 125 aa, Sorghum bicolor
  Clone ID: LIB3480-033-P1-K1-G12.pep
AGTISALKLGTSPQQRAVAVTVAVVGPPEEDDAPGVVTGGQVLAAAVELDGRNFVRVVILGTGSAVAVGVDDGGRQFAQDLGKLPLGKKPGRGLRFSAARRRRRGGRRRGDGPRAPPPHRHRCVL

SEQ ID NO: 50804 - protein, 34 aa, Sorghum bicolor
  Clone ID: LIB3480-033-P1-K1-G7.pep
NRLCMFTDDVPGTAGVALASAYLELESTWPSSPG

SEQ ID NO: 50805 - protein, 124 aa, Sorghum bicolor
  Clone ID: LIB3480-033-P1-K1-G8.pep
LKELSGEIPWELASLDFLSMLNLSYNQLQGRIPESSHFLTFSDLSFLGNIGLCGFQVSKACNNMTPDMVQHQSKKVSIDIILFLFVGLGFGVGFAIAIILTWGISASSSLPLQSTLLRIMFHLQ

SEQ ID NO: 50806 - protein, 63 aa, Sorghum bicolor
  Clone ID: LIB3480-033-P1-K1-H1.pep
RKRDEKNTALPSSRPMTRTTYRASLGQTLDSKNTLFAGKFQQRGQVRVYHISQAAIQQARTWK

SEQ ID NO: 50807 - protein, 138 aa, Sorghum bicolor
  unsure (1)..(138): unsure at all Xaa locations
  Clone ID: LIB3480-033-P1-K1-H4.pep
AADLRPSEKSGGARMNAHCCGRHMLTRNGSYARLTDAHMVWSHTPPRGXKPNTMTCGGETAFHEENHALQKVLTNQDHGXAAGIXRRERNAVDLHXAFTENWRWRENTFASIAYDCETSATLTQEINATFAAEDNPTA

SEQ ID NO: 50808 - protein, 114 aa, Sorghum bicolor
  unsure (1)..(114): unsure at all Xaa locations
  Clone ID: LIB3480-034-P1-K1-C11.pep
KSEEWREEVRNNHYCYKGKPRVKTGYEIFMASLDIESNLDKVTLPFIIVHGGDDAVTDPTVSEALYTLAKSKDKTLKLYPVMCHXLTSREPKGDIDIVFADIIKWLNERVPSIS

SEQ ID NO: 50809 - protein, 70 aa, Sorghum bicolor
  Clone ID: LIB3480-034-P1-K1-C9.pep
PPWSAVMTVTIPRTTTMYSTEGTSVATAMIPPVTMLYQPCHTLPSMYKGSNLHLARTRLQVITIKLQTCL

SEQ ID NO: 50810 - protein, 68 aa, Sorghum bicolor
  Clone ID: LIB3480-034-P1-K1-E3.pep
ENQKGSTHGFYEMYASSTWTGMSSLMVLLDWFDFPQQECTLISSCGGGGAGRQTHCGIQHGSDGGQVA

SEQ ID NO: 50811 - protein, 29 aa, Sorghum bicolor
  Clone ID: LIB3480-034-P1-K1-E5.pep
DTELIIDRKRNHIGSKANIHRHSDAYHLV

SEQ ID NO: 50812 - protein, 82 aa, Sorghum bicolor
  Clone ID: LIB3480-034-P1-K1-E7.pep
ACEHAPILWWHLDPIQCSSSYSATPAQTAALPNALVMHQIHRLPARVLPKRPRAIAHATIAQPEWAMVRALVQLIKRHWRGG

SEQ ID NO: 50813 - protein, 66 aa, Sorghum bicolor
  Clone ID: LIB3480-034-P1-K1-F1.pep
IDMITGPYKLVRRCEVTAILILYGLPRLLTGSILAHEMMHAYLRLKGYRTLSPKVEEGICQVLAHL

SEQ ID NO: 50814 - protein, 67 aa, Sorghum bicolor
  Clone ID: LIB3480-034-P1-K1-F5.pep
LSNSSIFCLCGYWWFLQVSPMHKKTRHTSPHIALSLSVYQNSLKADDILSAVFELSMYNHSKGTYHG

SEQ ID NO: 50815 - protein, 137 aa, Sorghum bicolor
  Clone ID: LIB3480-034-P1-K1-F8.pep
EVYGVDAVERMLQDFIAGNGAGAGAEADASRDRASIDLASRDVDSNDTTAQQARQVHAKLDGNGGAGTGRNDSSSAGDAKNNGSRSGDAKLPPPLGKEAKPPQVASAPGSSTGRIHSDGVLKILMQKMRSLELSLST

SEQ ID NO: 50816 - protein, 49 aa, Sorghum bicolor
  unsure (1)..(49): unsure at all Xaa locations
  Clone ID: LIB3480-034-P1-K1-G12.pep
SQALRDSSIAGYMSSQKTIEINPENPIMGELRKRAXAHKNYKSVKDLVM

SEQ ID NO: 50817 - protein, 60 aa, Sorghum bicolor
  Clone ID: LIB3480-034-P1-K1-G6.pep
HAFFSSWRNINKAQTDLPSQHLIQLNCQCYIPFSSTLSSSLVVVTHSVTSTLSSPLFPYP

SEQ ID NO: 50818 - protein, 78 aa, Sorghum bicolor
  Clone ID: LIB3480-034-P1-K1-G9.pep
QKKGRLFLNNQFFHPVYYQIYLFFFAPQNKFSAPFFKNTRLGKPLFSPILCLLHTILFLHLPVIKKTPHLISFLKISP

SEQ ID NO: 50819 - protein, 40 aa, Sorghum bicolor
  Clone ID: LIB3480-035-P1-K1-A2.pep
MNPRLVIVHSIDSVVSYPTHRELFFLVANKRRKIISNNRY

SEQ ID NO: 50820 - protein, 116 aa, Sorghum bicolor
  unsure (1)..(116): unsure at all Xaa locations
  Clone ID: LIB3480-035-P1-K1-B6.pep
EHTKNYLALEDNEICHIKDGSVSILKFDPHKEKPASVQRALSVLEMEVEQIKKGSYDHFMQKEIHEQPHSLKTTMRGRLKDGGVLLGGLKEYLKTIRRCRRVVFIGCGTXYNAGLT

SEQ ID NO: 50821 - protein, 151 aa, Sorghum bicolor
  Clone ID: LIB3480-035-P1-K1-B7.pep
PTKAMDPGLVYDLTAGDFIPYLCGMGLGEDRIRKIVEPAHHASSCAETGEIAAKDLNYPSIMIVTGDDVRQVESEAKRTVTNVGEREETYSAEVFAPGVVVAVNPSTLAFGDIGQKRDFVVTVKKAANTPAKGVVEGELKWVSEKHVVRSP

SEQ ID NO: 50822 - protein, 143 aa, Sorghum bicolor
  Clone ID: LIB3480-035-P1-K1-C11.pep
VDNPSSGSHETGHHEEGLLIDLGNDHDAFGEASESTDASASSVPASDLLSIDQLLETVGAEPAPQAGVVSADIGFKDMTSHCEALTIGKQQKMSAFMSFQQSVQASGLASSQPNQMELDLFQDPQLPQAGTHNTNPFADDRLQ

SEQ ID NO: 50823 - protein, 65 aa, Sorghum bicolor
  Clone ID: LIB3480-035-P1-K1-C9.pep
NKKILVNKKFIGEEFLVLVFNPEGPPPGTSVCIFAMYYRCALLCECFEHSQLGSSNLHGPVLCFL

SEQ ID NO: 50824 - protein, 99 aa, Sorghum bicolor
  Clone ID: LIB3480-035-P1-K1-D8.pep
PPTTPVGLGLGLGLVSSATATSAADAGPSPAPPFLDSNPNSSFPRQHLPPCWIPPRRCSIEAITPMERRQAQLMANTPMLHSKFVHLKKLSIAVTAWRS

SEQ ID NO: 50825 - protein, 45 aa, Sorghum bicolor
  Clone ID: LIB3480-035-P1-K1-E1.pep
VSKLRGASTASRLTHARTHHPRGAIARHALNSLPVHLLRDHWRNP

SEQ ID NO: 50826 - protein, 45 aa, Sorghum bicolor
  Clone ID: LIB3480-035-P1-K1-E6.pep
PPPRPSDRAPPLPLAALTAPRSAAWWGSPWRRSEGERAREEVRSE

SEQ ID NO: 50827 - protein, 57 aa, Sorghum bicolor
  unsure (1)..(57): unsure at all Xaa locations
  Clone ID: LIB3480-035-P1-K1-E9.pep
QERDLFVTTTPTSYRESFFTIADHASKTDAFLFFHGTVRVQIPTSPPHCLQTPVRXI

SEQ ID NO: 50828 - protein, 109 aa, Sorghum bicolor
  Clone ID: LIB3480-035-P1-K1-F9.pep
DIRFNDFDGPIPPELFLKPYDAIFLNNNRFTSGIPETIGKTKATVIVLANNQLGGCIPRSIGEAAATLDQFIFINNSITGCLPVETGLLTNATVFDVSDNALTGSIPPT

SEQ ID NO: 50829 - protein, 76 aa, Sorghum bicolor
  Clone ID: LIB3480-035-P1-K1-G9.pep
TPGTVACIGSGLGRRYSDELPKSVDWREKGAVAPVKNQGECGSCWAFSAVAAIEGINQIKNGKLVSLSEQELVDCD

SEQ ID NO: 50830 - protein, 98 aa, Sorghum bicolor
  Clone ID: LIB3480-035-P1-K1-H4.pep
LRLLIEDYPYATDGLLLWDAITRWCDAYVAMYYPSDQAVQGDTELQSWYREAVQTGHADKRGAPWWPRLSTPGDLASLLTTLLWLTSAQHAALNFGQY

SEQ ID NO: 50831 - protein, 59 aa, Sorghum bicolor
  Clone ID: LIB3480-036-P1-K1-A3.pep
GGARPREAGCQVASVSRTCPRAPGCCQSAPRDVERPAHLARHGGSRSRSRLSAGDLELV

SEQ ID NO: 50832 - protein, 79 aa, Sorghum bicolor
  unsure (1)..(79): unsure at all Xaa locations
  Clone ID: LIB3480-036-P1-K1-B4.pep
RRXTRSAPGRRRVGSPGDAGDGLPGLNLLALLLRPLAALAPXGHHHRNHAVXRGSRRRGVPAPRRVNARGAAARGGRRC

SEQ ID NO: 50833 - protein, 73 aa, Sorghum bicolor
  unsure (1)..(73): unsure at all Xaa locations
  Clone ID: LIB3480-036-P1-K1-B8.pep
MAKIKIGINGFGRIGRLVARVALQSSDVXLVAVNDPFISTEYMTYMFKYDTVHGQWKHHDVKVKDSNTLTFGE

SEQ ID NO: 50834 - protein, 133 aa, Sorghum bicolor
  Clone ID: LIB3480-036-P1-K1-C11.pep
ALIWYRRADYTAYAFNTRPMARSPCQKPAVYYMSSARRQGGRGGETTVTRYERWRHPNETRPACRWDIADPDAHLDHIVVLKKPDPGLWDRSPRRNCCRVVSSPKDGGENGEKTMTIDVGVCKEGEFSQVAGA

SEQ ID NO: 50835 - protein, 113 aa, Sorghum bicolor
  Clone ID: LIB3480-036-P1-K1-C2.pep
ASPWLAVEEISPGRSPRAKKFSSRSIGFLSGTQASQMSAWRTRSAYHRGRSTPLMCKTTSTLAAVMAQMLSHRATHVWVTDAESEDGVLVGVVGYTEIFNAATRSTCASSTTS

SEQ ID NO: 50836 - protein, 49 aa, Sorghum bicolor
  Clone ID: LIB3480-036-P1-K1-D10.pep
YHLTTNYSPFYNNVTTETTLVPHILILLHIILFSAGGIITKRPPIIVLN

SEQ ID NO: 50837 - protein, 45 aa, Sorghum bicolor
  Clone ID: LIB3480-036-P1-K1-F7.pep
FLIVRSALTLLSLECLYVLHVYAFDFKSSSFASSPVLLSKTLCDF

SEQ ID NO: 50838 - protein, 47 aa, Sorghum bicolor
  Clone ID: LIB3480-036-P1-K1-G11.pep
LFVIEAQLLLRKMIGGLFFVMTDAEKRILCYKIILFGNGVVLVVTLL

SEQ ID NO: 50839 - protein, 58 aa, Sorghum bicolor
  Clone ID: LIB3480-036-P1-K1-H4.pep
MDQGMELRGCVCRIKSSALELLSMEEDLTTDLDDDLWDLVRRDLQLKATFLYIDLNRV

SEQ ID NO: 50840 - protein, 95 aa, Sorghum bicolor
  unsure (1)..(95): unsure at all Xaa locations
  Clone ID: LIB3480-036-P1-K1-H9.pep
APTRPVELAMAINASIQSAIAEGVPNVQAKASTPNNNGWSIPPSNSHNGWGPSVTPAPSKTSGQSQARVDAPSSSSTYNGWDVPGTSSXQSSSKP

SEQ ID NO: 50841 - protein, 63 aa, Sorghum bicolor
  Clone ID: LIB3480-037-P1-K1-A4.pep
VVGRVVTDITFPVLLGGLHHLQHEAAVDDHHLQEPVPHAVGAAPLSAEIPCWPGDKRPGRRTA

SEQ ID NO: 50842 - protein, 90 aa, Sorghum bicolor
  unsure (1)..(90): unsure at all Xaa locations
  Clone ID: LIB3480-037-P1-K1-C1.pep
KTAPGAQRRVGASTDASDNIISDTDKICMQLFLDIQEYARNLRAIXIDAREXDXYRALWXCVAPKTNRDIQFDVRMCRYKNAPEILDEGI

SEQ ID NO: 50843 - protein, 63 aa, Sorghum bicolor
  Clone ID: LIB3480-037-P1-K1-C3.pep
MCGLPRPDARTLRRIQVSTAEPPSRRDRESRRRRRGRRKGFPPPPSLFSLSLCASPLSWPGFS

SEQ ID NO: 50844 - protein, 93 aa, Sorghum bicolor
  Clone ID: LIB3480-037-P1-K1-D5.pep
PTRPPAQFPTELATAAELCGELYWEPSTELSFPWMFSRIVALIGAPTAWARTVAYTWTISLIHFFGPGMFKSNVQLHNMHDIAYKTAYQIMFT

SEQ ID NO: 50845 - protein, 65 aa, Sorghum bicolor
  unsure (1)..(65): unsure at all Xaa locations
  Clone ID: LIB3480-037-P1-K1-D7.pep
ANKVRIVRAGAVPALVEVLRSGASAPEAREHAAGALFGLALNEDNRAXIGVLGRCPRSGLYVPAS

SEQ ID NO: 50846 - protein, 122 aa, Sorghum bicolor
  unsure (1)..(122): unsure at all Xaa locations
  Clone ID: LIB3480-037-P1-K1-D9.pep
RHLVTLVGYCIAGSSQRLLVYEFVPNNTLEYHLHGKGVPVMEWPRRLAIALGSAKGLAYLHEDCHPRIIHRDIKAANILLDENFEAKVADXGLAKLTTDTNTHVFTRVMGTFGYLAPEYASS

SEQ ID NO: 50847 - protein, 93 aa, Sorghum bicolor
  unsure (1)..(93): unsure at all Xaa locations
  Clone ID: LIB3480-037-P1-K1-E1.pep
VPIHASIYVMLWSSSSFNEYLMKPDVLGDACERHCMPAHEPRAFRIKPVRSYALHXDRPLHSRWYFTVLLGPHVGVSHEDDDGDGRGSRRPHE

SEQ ID NO: 50848 - protein, 102 aa, Sorghum bicolor
  unsure (1)..(102): unsure at all Xaa locations
  Clone ID: LIB3480-037-P1-K1-E4.pep
FRRPLLSADPAITVHQIQPTDKFIIFASDGLWEHLSNQEAVDMVQSSPRNGIARKLVKSAMXEAAXKREMRYSDLKKIDXGVRRHXHDDITVICGGFRFKMP

SEQ ID NO: 50849 - protein, 124 aa, Sorghum bicolor
  Clone ID: LIB3480-037-P1-K1-E7.pep
VKPRERNERYVNAVMTIPKGTLFPMCGMNLAFDRDLIGPAMYFGLMGDGQPIGRYDDMWAGWCVKVICDHLGLGVKTGLPYIWHSKASNPFVNLKKEYKGIFWQEDIIPFFQAVVLAKDFDTVQ

SEQ ID NO: 50850 - protein, 46 aa, Sorghum bicolor
  Clone ID: LIB3480-037-P1-K1-F2.pep
VVLSRPVLMTAAANAAPYAVAIAHTHARTHASKDSLGYILCCCADP

SEQ ID NO: 50851 - protein, 92 aa, Sorghum bicolor
  Clone ID: LIB3480-037-P1-K1-F7.pep
MADEANRAAFMELQSRMIDTTAKIKQLQTQMRSKEGEKKRAYLTLEELRQVPDESNTYKTVGNVFILEPKSVLFNEHEQKLHDSEKCYSFKG

SEQ ID NO: 50852 - protein, 43 aa, Sorghum bicolor
  Clone ID: LIB3480-037-P1-K1-G1.pep
LKHPNHNPISVYYNNLKYNYASDKRTHYNADRSIHDAYNRTRG

SEQ ID NO: 50853 - protein, 34 aa, Sorghum bicolor
  Clone ID: LIB3480-037-P1-K1-G3.pep
KDVTDVTLLNCLLKKTTNGVRIKSYKDAKSVLTA

SEQ ID NO: 50854 - protein, 99 aa, Sorghum bicolor
  Clone ID: LIB3480-037-P1-K1-G8.pep
RTASVVLASLLAALKVVGGTLADHTYLFLGAGEAGTGIAELIALEMSKHAGSPIEECRFKIWLMDYKGLIEASRIDSLQAFKKPGAHEHEPLETLLEAV

SEQ ID NO: 50855 - protein, 89 aa, Sorghum bicolor
  Clone ID: LIB3480-037-P1-K1-H8.pep
ILIPKGDYLVGPLNFTGPCKGDVTIQVDGNLLATTDLDQYKGNWIEILRVDNLVITGKGKLDGQGPAVWSKNSCAQKYDCKILPTRWCW

SEQ ID NO: 50856 - protein, 75 aa, Sorghum bicolor
  Clone ID: LIB3480-038-P1-K1-A7.pep
NGCFKTAGRLLYFGGPKKKLFRWKPAEIKVVPIKRPPRSILIKRTPHINVCFIGVLFYCWFVFISNFIVLFFFFF

SEQ ID NO: 50857 - protein, 59 aa, Sorghum bicolor
  Clone ID: LIB3480-038-P1-K1-B1.pep
YISHYMSHPMLKHHTRYKTVTIIVSDNPIDTRLYSRKRFLRLRTPLHPPTYSQTFSSFI

SEQ ID NO: 50858 - protein, 70 aa, Sorghum bicolor
  Clone ID: LIB3480-038-P1-K1-B5.pep
RTRGAVHVRGCLPSVGAGGSTRSPPQQQPWASAAPRAPERPPPPPSSRHQRRRRQAAARRPRTTNVRSRR

SEQ ID NO: 50859 - protein, 78 aa, Sorghum bicolor
  Clone ID: LIB3480-038-P1-K1-C10.pep
RRERDGPLLKLLGLRGHLVPSLLAPERRLRFLPLPFLLLRLRRRRQQTRGGRLAVLRRPRPRPRPPPGLGPVSGRRRA

SEQ ID NO: 50860 - protein, 96 aa, Sorghum bicolor
  unsure (1)..(96): unsure at all Xaa locations
  Clone ID: LIB3480-038-P1-K1-C12.pep
DDDDDGERGQVHPAVTARRHHRRARASTTRVRVRDGFGPVVSAAEEQVRRGXAVVKRSRDPYADSRSSMVEMIVGRQLFGPPDMEHLLRSYXFLNT

SEQ ID NO: 50861 - protein, 109 aa, Sorghum bicolor
  Clone ID: LIB3480-038-P1-K1-C2.pep
CRANQASTSSVPSVVYENGSASASRGAEFLSNGPVTVNTSVGVSNVRPQQDAVSDGGSKFYGNLSFSDLVNGHHENWRGDRARKRDEHSPDKDVQSTSKLSAFGNNSSL

SEQ ID NO: 50862 - protein, 153 aa, Sorghum bicolor
  Clone ID: LIB3480-038-P1-K1-D10.pep
KFQAVAIAIQRSGFKIVLLLRLVPLLPFNMLNYLLSVTPVGVGEYMLASWLGMMPITLALVYVGTTLKDLSDVTHGWSEISTTRWILIISGFVLSVVLIICITKIAKSSLEKALAENGELDVGTSQLSVVASPSDLQQPLVIKIDTFNEDHEK

SEQ ID NO: 50863 - protein, 74 aa, Sorghum bicolor
  unsure (1)..(74): unsure at all Xaa locations
  Clone ID: LIB3480-038-P1-K1-D11.pep
LFSKIDLTKKILVESERPKVKVGSRVTEFRELFTNCXEFFLIIVKFTFXKNIIIKYFNLYXFIIYINLYFIYII

SEQ ID NO: 50864 - protein, 97 aa, Sorghum bicolor
  Clone ID: LIB3480-038-P1-K1-D12.pep
TKKEVLIVKTTIHDIMNQMIRELPITNPVYLMLGTSFGSSAKGTGLKALEFALSIWDRGDIVGFTGDPGYKEWTRYFSEVRKGHTSLHAGKNSFTDA

SEQ ID NO: 50865 - protein, 54 aa, Sorghum bicolor
  Clone ID: LIB3480-038-P1-K1-D4.pep
IHLRETPGKHSDEKTEAGGVNLISSQQISAMAREGGPGSAPVTGVRTQVVLDAM

SEQ ID NO: 50866 - protein, 100 aa, Sorghum bicolor
  Clone ID: LIB3480-038-P1-K1-D7.pep
MLHTFSEAMIHKHPVSAITDGDLAMQRAIRLVWPNSSHRLCIWHIEQNIVRNVKDDVVKDEFKSFLYDCWPIQETETKWLQFLDTHNGTNKDVWFVYNSD

SEQ ID NO: 50867 - protein, 135 aa, Sorghum bicolor
  unsure (1)..(135): unsure at all Xaa locations
  Clone ID: LIB3480-038-P1-K1-E9.pep
SLGRAPTDRNGGGAAASVPPRPLFRPPRRLPLPPPRRRRLPPLTFLHPPPPPXPPPSAAPAPPAPVPPSSPPPAAPRAPPLPAAPPARARGRPPRRLVPGLGPPGARARRRAPSPSRRGGGFPRLVALRLGAQGH

SEQ ID NO: 50868 - protein, 121 aa, Sorghum bicolor
  Clone ID: LIB3480-038-P1-K1-F1.pep
LAPNQSAGTMPNREVLSDRHSVLITASGLQTPEFSFPRSSILYLPFCLEDGPSETLRQCTCPPSRKLFTRASCARSHPGVHTHGLAAHDPAIRASCARSAADLWCSASVSEFTFIFCRYIS

SEQ ID NO: 50869 - protein, 33 aa, Sorghum bicolor
  Clone ID: LIB3480-038-P1-K1-G11.pep
EISSCSHIFLNMHKWLRCHSHVFDLDITSYYLH

SEQ ID NO: 50870 - protein, 84 aa, Sorghum bicolor
  Clone ID: LIB3480-039-P1-K1-A12.pep
QEDIPALVDCLSRERLVSASAGRVHSVSLTSKGEVWTWGSGRNGRLGLGSSIDEAEPCLVDTLEGVEVLQVAAGMDHNLVLVAE

SEQ ID NO: 50871 - protein, 52 aa, Sorghum bicolor
  Clone ID: LIB3480-039-P1-K1-B11.pep
VTPGFLHSGRCIKKVSGFMLGYAILVLLNRMHAYVNLNIIKKKTKNKKPDAW

SEQ ID NO: 50872 - protein, 95 aa, Sorghum bicolor
  unsure (1)..(95): unsure at all Xaa locations
  Clone ID: LIB3480-039-P1-K1-B3.pep
LQGADEEQHQRPAQRRQEEAQLDRRPLFGVGAAVLGLRRLPAHGILTPSLFVLIALLAEISKTNYTSVAEWDVHRACGLNEATLESICFKKKKNX

SEQ ID NO: 50873 - protein, 108 aa, Sorghum bicolor
  Clone ID: LIB3480-039-P1-K1-C3.pep
HDLPCRGSHGVCTMAVFGWSGCSGERAWVAVVCASTCCYSRRHGRRLLHASTPEDLAAPLTFPIWPCLTSTMETAFFIWRRPLPPSQLEAHPLLQRTFFYPTGGFIAQ

SEQ ID NO: 50874 - protein, 80 aa, Sorghum bicolor
  Clone ID: LIB3480-039-P1-K1-C5.pep
STKVLNSSSTSGRAMVSTSKKTISSLLSAAEAAEEDTGAAAIGIIYRSIRVSYSYLSALRLDEQQCHWIAYVTTASSNDE

SEQ ID NO: 50875 - protein, 61 aa, Sorghum bicolor
  Clone ID: LIB3480-039-P1-K1-D1.pep
SCKLARPQNAYAWHQSGRSLCKHASSWKSTTSRSGSCRQYGLSRLDGSAVGAHCPHRLLSA

SEQ ID NO: 50876 - protein, 108 aa, Sorghum bicolor
  unsure (1)..(108): unsure at all Xaa locations
  Clone ID: LIB3480-039-P1-K1-D11.pep
RFLPPPEWRKGGDPEEDRLDEEALXEYVSRWADDNRVTYSENLVCGSDEMVGIIRKSSPAXDLLIVGRRANGPKSPLTVGISDWSEHLELGXLGDLLTXTDXGCQVST

SEQ ID NO: 50877 - protein, 53 aa, Sorghum bicolor
  Clone ID: LIB3480-039-P1-K1-D12.pep
EVALRVGASLLYRGLRDRFDAAPQPDLLCLNLQGYHGLCSLELTSVLETRTRG

SEQ ID NO: 50878 - protein, 97 aa, Sorghum bicolor
  Clone ID: LIB3480-039-P1-K1-E1.pep
LVSTPWPFSEHYSLITSHLSSWIFIPPLGNHPLYLSAASCFSRRNASTHFLETNADIMHPTLGKVLLYKPNRMHPQHVLTSLALAYNETLCINLSSI

SEQ ID NO: 50879 - protein, 49 aa, Sorghum bicolor
  Clone ID: LIB3480-039-P1-K1-F6.pep
VDDYIGLLLLRVLATRRRSHRLHSSSLTHAALPSPSRMALTVTTPNYTS

SEQ ID NO: 50880 - protein, 68 aa, Sorghum bicolor
  Clone ID: LIB3480-039-P1-K1-F7.pep
VLAVQPHRRPPHYPRVECRCSVAGNADRGGAVWVGVGGGALAVDVGQVVGRALGQGVFDVSGAGDRAL

SEQ ID NO: 50881 - protein, 102 aa, Sorghum bicolor
  Clone ID: LIB3480-039-P1-K1-G12.pep
GTRTRAPWPRRPGTRTGGWWSSGGGTTTSPSRRRRAAAPTTSPSSASTAPPASVPVAPAAAGSAAISRRAAARAGSRAAGACRAGSRWRFRSTTAFRQDHTR

SEQ ID NO: 50882 - protein, 55 aa, Sorghum bicolor
  unsure (1)..(55): unsure at all Xaa locations
  Clone ID: LIB3480-039-P1-K1-G7.pep
HEKHQRLIRMVIQQHPLRELLSLTKEXHLSISYSGSGRLGDWNCGAHTCGRSSIV

SEQ ID NO: 50883 - protein, 37 aa, Sorghum bicolor
  unsure (1)..(37): unsure at all Xaa locations
  Clone ID: LIB3480-039-P1-K1-H12.pep
SLYISIGSVSALTVVLKFFLSXXTRSFSNPSVPVSVS

SEQ ID NO: 50884 - protein, 88 aa, Sorghum bicolor
  Clone ID: LIB3480-040-P1-K1-B10.pep
GGELVFTYGKDFSGVFRIEQVDLNGAPTMSVMPPPVFDKPCKTDLSGLMVFADYPALCWYIVIEYVLSALVILCVITCLPGTYPIWTW

SEQ ID NO: 50885 - protein, 75 aa, Sorghum bicolor
  unsure (1)..(75): unsure at all Xaa locations
  Clone ID: LIB3480-040-P1-K1-B2.pep
KDNDWCLLLFIYQHKFISDQHVTYTHALYWLTCMLQIHKHKEPQAQSKGRVKKQLGKXIHVCVCRAHQALHCTHT

SEQ ID NO: 50886 - protein, 112 aa, Sorghum bicolor
  Clone ID: LIB3480-040-P1-K1-B3.pep
DAWGTVLGDKEQLVHGTTATICSPQPVGGLGTGSFLISLDCGLFHTTIVSSDGEVWCLVMERGLGLCPHAIFTAVAERDAFYSIRVQATGTHAFTFHGTPQIFCVPAHTSLH

SEQ ID NO: 50887 - protein, 134 aa, Sorghum bicolor
  Clone ID: LIB3480-040-P1-K1-B8.pep
GREDFEEHMRRLGRLNHPNLLPLVAYYYRREEKLLIHDYVPNRSLANLLHGGGEGCRMNNAAVHWAARLKIVKGVARALSYLYYELGMLTVPHGHLKSFNILLDGHYEPLLTDYPLVPVMNQSHAVQLMVAFKA

SEQ ID NO: 50888 - protein, 69 aa, Sorghum bicolor
  Clone ID: LIB3480-040-P1-K1-C10.pep
YYLTNFSSQDFWSNHPRYSSSCIVCCEGTHFLLALCSGSIPLASLLQWITTSWSFCPVKCIPREMRTRG

SEQ ID NO: 50889 - protein, 90 aa, Sorghum bicolor
  unsure (1)..(90): unsure at all Xaa locations
  Clone ID: LIB3480-040-P1-K1-C5.pep
PQGLIIHGPPSTYFSSLHAKCTKLLHHLCGLPHSNTHLHALIIAPRPPPPHRPLRPPKKTTSRLNDPILCLSSGLGRRXRLQVEQQGPVD

SEQ ID NO: 50890 - protein, 85 aa, Sorghum bicolor
  Clone ID: LIB3480-040-P1-K1-C7.pep
LIFNGRRQFNYNPRYFYTPLDWQKLFHLPTQTPFASCRFTQHALIKPGSHQIYFPNNKSPLLENGTYPKAPHLAPLTRLAPPESP

SEQ ID NO: 50891 - protein, 54 aa, Sorghum bicolor
  unsure (1)..(54): unsure at all Xaa locations
  Clone ID: LIB3480-040-P1-K1-C8.pep
RHSERRRDAQRASRPPAQCARQCARPACVAGGXSGALAPARAWAGSAGCCXATA

SEQ ID NO: 50892 - protein, 55 aa, Sorghum bicolor
  Clone ID: LIB3480-040-P1-K1-D10.pep
APCTLVSRSSLFYQSPSCRWVDVAVQLGSTCRMPLSRIDAQSIFATREWYVQYLV

SEQ ID NO: 50893 - protein, 91 aa, Sorghum bicolor
  unsure (1)..(91): unsure at all Xaa locations
  Clone ID: LIB3480-040-P1-K1-D5.pep
IVSFGFIFLTQSEACISLSRKEFEAYNPTKPSCPLALVCEEFEQRVGSVEVPVVPGHLPPPDGVQPGXDMPEQXRLQLVDADXSVPRRPVK

SEQ ID NO: 50894 - protein, 68 aa, Sorghum bicolor
  Clone ID: LIB3480-040-P1-K1-D9.pep
WCARCPATARVHVAIQHAPLFERLIISCLFAAMSAIEHSMSVMHTCYASDAVLSVAASWNHGPCISAR

SEQ ID NO: 50895 - protein, 94 aa, Sorghum bicolor
  unsure (1)..(94): unsure at all Xaa locations
  Clone ID: LIB3480-040-P1-K1-E11.pep
AMLDIVIHNARIEGQLDSGIADMKAKSVEMRESPKTVHVDTASGARTGLYTLTGERGVSWGGANTILGERLKDXGGSSSEGFYESRKEWVGGIH

SEQ ID NO: 50896 - protein, 84 aa, Sorghum bicolor
  unsure (1)..(84): unsure at all Xaa locations
  Clone ID: LIB3480-040-P1-K1-F11.pep
PPTFCALLCEEEEEEEEEEGKVDLIEQHGAAATAVGPPGAHASSARRRRGDRRXCPGESPPLEVQQPVPEPLPRAVPFLKPFTT

SEQ ID NO: 50897 - protein, 74 aa, Sorghum bicolor
  Clone ID: LIB3480-040-P1-K1-F7.pep
AGRAKTRMVFVMNTLMRLACLFISVAFIGLTYLMDWLDHCWLACGTMAIGTMIMLTTLGFMCYCIIIHRLPEKN

SEQ ID NO: 50898 - protein, 70 aa, Sorghum bicolor
  Clone ID: LIB3480-040-P1-K1-G3.pep
CVISWTKLECRVATCLNSRTRKILGVPNLRRATYIPPLPCYLHDQRPRPLRRYHHCPHWNANRVLPCTDH

SEQ ID NO: 50899 - protein, 86 aa, Sorghum bicolor
  unsure (1)..(86): unsure at all Xaa locations
  Clone ID: LIB3480-040-P1-K1-G4.pep
FLDSLHVIPRMPLNIILVRALDAAVFGMELARERQSSSNGHLSVRPRTQPCMSSRPSATAXCCTDVGCGVXADICYEVGSAMSVYL

SEQ ID NO: 50900 - protein, 101 aa, Sorghum bicolor
  Clone ID: LIB3480-040-P1-K1-G9.pep
RGYLLYGPPGTGKSSLVAAMANYLRFNLYDLDLSEVRLNSALQKLLIHMPNKSMLVIEGIDCCFDDAAASRKAVKAPELVDDLGMDPDYTSDSSEDNWAQQ

SEQ ID NO: 50901 - protein, 75 aa, Sorghum bicolor
  unsure (1)..(75): unsure at all Xaa locations
  Clone ID: LIB3480-041-P1-K1-B11.pep
INWLEIHLSLASWSNNKEAPTDRPYKQSRRLNGEWHAPCSGSLRAVXCVLTPRPIHSLASYLALVSFAFFPFFLG

SEQ ID NO: 50902 - protein, 50 aa, Sorghum bicolor
  Clone ID: LIB3480-041-P1-K1-C7.pep
YLLPHPRHTPADLNLHPRYMTLSASLSYPLRTGYVASAAADDDDSSYNSI

SEQ ID NO: 50903 - protein, 145 aa, Sorghum bicolor
  Clone ID: LIB3480-041-P1-K1-C9.pep
GFVLDQEQTSQSQTEPTTGEVSNLTRFKKNFVSLIGVCYPWIHATNEGLSFAYQLLYLLDATGFYSPALHVLGLHVCRATGQELMESSSRISRIRNRELERLCGPPWFKAVQRVFLSCVYTTLDYAQTGLIAAVFFFKMMEWGIN

SEQ ID NO: 50904 - protein, 127 aa, Sorghum bicolor
  unsure (1)..(127): unsure at all Xaa locations
  Clone ID: LIB3480-041-P1-K1-D7.pep
ESLICLLQTACLLWKDAACLXQSGVNKAFVTFYVGGDASRTMVVAQRYANLYFTVYGTEHTCXLSTGLFNDGDXSGQCYRIYCDYHTDPEFCIHVTSVTITVTNLCSSNYTLAIDHGGCCNHTRWHF

SEQ ID NO: 50905 - protein, 132 aa, Sorghum bicolor
  Clone ID: LIB3480-041-P1-K1-E10.pep
APRPSRPRSSPPTPSASPSFSAQGTTTTTTTTRRASSSAPHHLRRWGVQLDPAGLVPRLQAVLDAGGLGSGTGRRRRPGGRIRGRGGFAGAAAGCGVPDGDEAAARVEEMGLGGAVEEERERGGEDEVLHGG

SEQ ID NO: 50906 - protein, 56 aa, Sorghum bicolor
  Clone ID: LIB3480-041-P1-K1-F10.pep
PPPLFFFFFFFFFFFFFFFFFFFFFFFFFFFFFFFFFFFFAVSQVLPPASWVTMRY

SEQ ID NO: 50907 - protein, 136 aa, Sorghum bicolor
  unsure (1)..(136): unsure at all Xaa locations
  Clone ID: LIB3480-041-P1-K1-F3.pep
IASGRSRSTTTTAAAGKMRRALNSSQELTDYILVLEDEFCETLAYLSIPSFHRLLLSDXRRMSAMVDARRLAPSGEGXPGDKGFKPDVTVAKDGSGYFKTINAALAKAPAKSAFIYVMFLKGGTFREYVFGSPDVT

SEQ ID NO: 50908 - protein, 49 aa, Sorghum bicolor
  Clone ID: LIB3480-041-P1-K1-G1.pep
NRPPLFFFFFFFFFLFIFFFFFFFFYFFFFFFFFFFFFFFLFFFFFFFF

SEQ ID NO: 50909 - protein, 56 aa, Sorghum bicolor
  Clone ID: LIB3480-041-P1-K1-G2.pep
RSIKAHAENTNHTKKGKTPRRADELYFPLPALGDRDERLRPQERWPFPASDTDTWF

SEQ ID NO: 50910 - protein, 146 aa, Sorghum bicolor
  Clone ID: LIB3480-041-P1-K1-G8.pep
AYGKQGEVREDEIVAAAKAANAHEFISSLPQGYSTIVGERGTQLSGGQKQRVAIARAILKDPKILLLDEATSALDAEAERTVQDALDQVMVSRTTIVVAHRLSTIKGADMIVVIKDGKVAEKGKHEYLVGKGWVYASLVELHSKSA

SEQ ID NO: 50911 - protein, 57 aa, Sorghum bicolor
  unsure (1)..(57): unsure at all Xaa locations
  Clone ID: LIB3480-041-P1-K1-H12.pep
PVPGTHAHSVNHHHKAGMVMNGLSISVYAPETVGCAVVDASGACAAATXTGGLMNKM

SEQ ID NO: 50912 - protein, 82 aa, Sorghum bicolor
  Clone ID: LIB3480-041-P1-K1-H7.pep
WSHHIVHLHIKPHNILLDGGLQPKISDFTPAKLCPHKESTNFRSMGGTRGTAGYIIPERLLTHAVANSTSKCDVYRYRTIAL

SEQ ID NO: 50913 - protein, 82 aa, Sorghum bicolor
  Clone ID: LIB3480-041-P1-K1-H8.pep
PEDPEVFDTLSAVARQKELCVVIKMYWGDPREKVCDAVEELHLESLVMGSRGLGSVQRILLGSVTNYVLSNASCPVTVVKSK

SEQ ID NO: 50914 - protein, 93 aa, Sorghum bicolor
  Clone ID: LIB3480-041-P1-K1-H9.pep
ISQTSGRALSNKRSLANTVTVTACVTEDPQHDSSLAAILDDLSYSASLSRMVLHRAVQCCISVYVMRYVYCPSRSIFQTCLPVSFSYQRKRSR

SEQ ID NO: 50915 - protein, 54 aa, Sorghum bicolor
  Clone ID: LIB3480-042-P1-K1-A6.pep
FFKKAPPFFFFFFFFFFFFFFFFFFFFFFFFFFFFFFFFFFSFIFFFFFFFPRV

SEQ ID NO: 50916 - protein, 184 aa, Sorghum bicolor
  unsure (1)..(184): unsure at all Xaa locations
  Clone ID: LIB3480-042-P1-K1-B10.pep
PPRWRHRRSPSAFRRVTASQGRRPRRRRRRSPSRSRRRRSRRRSRSRLAPTSCGACAXRRTTLTCARRPSRSSRSRSCPPGSGWTAPACCGWPCPPCAPRPPRPRPRRARSRRTPRRSRWRATRCRTASSPSTTSPTASTRPRRRSPAATATPRAPCSTPCAPTSTPATGSRSASSSRRSCPST

SEQ ID NO: 50917 - protein, 62 aa, Sorghum bicolor
  Clone ID: LIB3480-042-P1-K1-B9.pep
TTKLSIIWYMTSSPSELIGWILTCKPLQSQKECLDFPETTILHPYYDNVNHVAIQGSSVCYY

SEQ ID NO: 50918 - protein, 118 aa, Sorghum bicolor
  Clone ID: LIB3480-042-P1-K1-C11.pep
ELARAPSKLSSAFSGTQDKCAACQKTVYPLEKLTLEGEAYHKSCFKCSHGGCILTTSSYAALNGVLYCKIHFGQLFMEKGSYNHMKKKSTSQEVLPDLAAEEQPPQPAAPEDEKGEDN

SEQ ID NO: 50919 - protein, 107 aa, Sorghum bicolor
  unsure (1)..(107): unsure at all Xaa locations
  Clone ID: LIB3480-042-P1-K1-C3.pep
LAGVLKRRDWKNLGLPQLNRFAANPLFAGWVNSKKAXTVRLSKKLPILNGKWDPPCTGPLSAGGGGVTPSWTFKFASALAPVLLVFFLFFLAILAGFPCRVLNGGFL

SEQ ID NO: 50920 - protein, 187 aa, Sorghum bicolor
  Clone ID: LIB3480-042-P1-K1-D11.pep
GGGGSSAPATAPASESRAHPGSAAASLVDADALDCVVCYLPLKPPIFQCDVGHAVCSRCRDKLQATGKCPVCRAVAGRYRRCHVMEQLVESIRVPCAYAAHGCALRLVYYDQESHRLVCEHAPCHCPGEACSFVGSMAALLDHCSTTHKWPCITTVKPNDEDELTICLHDGFNFILADCSTDNKNQS

SEQ ID NO: 50921 - protein, 183 aa, Sorghum bicolor
  Clone ID: LIB3480-042-P1-K1-D6.pep
MTSGGGAQNFKVQADNFVCAVLPDTPFHQVFITPGGVIHLRDGANTQYVTSTSFLFVVYSDLLLRTGQSVMCGNQPVAPARLREFARQQMDYLLGANPRHSSYVVGFGANSPTQPHHRGASTPVLPPGTDVNCGLSFGEWMAPDRPNPNELTGAIVGGPDKNDGFVDKRGNSSYTEPCTYINS

SEQ ID NO: 50922 - protein, 184 aa, Sorghum bicolor
  Clone ID: LIB3480-042-P1-K1-E11.pep
EACFTEHDVAFANRPRLPSQELASFGGAALAVSSYGPYWRTLRRVAAVRLLSTHRVASSMCPVISAEVRAMLRRVMSRAAADGRVQLKDSLFELSLSVLMETIAQTKTSRTDADDGVSPEAHEFRRIVDEILPYLGATNPWDYLPSFLRRFDVLGVRSKIRDVVGRRDAFLQRLIDAERRRLQD

SEQ ID NO: 50923 - protein, 154 aa, Sorghum bicolor
  Clone ID: LIB3480-042-P1-K1-E5.pep
SPPLAFLTALKRLRPASASTPSPRAASASTPSSVARRPRRHPPSRPCPAACRRTATPSPPPSTSSEPTTTPSTTSLPDRNPEPRSRTPSPQAVVLRTGPEPTATTTPSQAPRHRFEHLLSRPEPPSRRRRVLPAPAPACTRQSASIKPSDHNGQ

SEQ ID NO: 50924 - protein, 42 aa, Sorghum bicolor
  Clone ID: LIB3480-042-P1-K1-E7.pep
PRYTNLSHIYNIHVTYISTCSSLSPTIFLVHHKSEETSSSTT

SEQ ID NO: 50925 - protein, 83 aa, Sorghum bicolor
  Clone ID: LIB3480-042-P1-K1-F2.pep
EFIDGRIESFDVVILATGYKSNVPFWLKENEFFSQKDGFPRRRNEWKGKNGLYAVGFSRRGLLGVSMDATKIADDIVQSYNNI

SEQ ID NO: 50926 - protein, 36 aa, Sorghum bicolor
  Clone ID: LIB3480-042-P1-K1-F3.pep
AILFAFIQAGNRGICYKSIKLSKFSVFQVNRLYNNG

SEQ ID NO: 50927 - protein, 108 aa, Sorghum bicolor
  Clone ID: LIB3480-042-P1-K1-F4.pep
RLFLLSHINASHQNLIQYFTIIQYHLISDYYINTFTLLLSKHFYYLYCSMYLNYNSYIYYITHLKLAYLSFHSSFTSTIFLLFFFPSFLLNIYRFTSLTFIIGPPYSF

SEQ ID NO: 50928 - protein, 205 aa, Sorghum bicolor
  Clone ID: LIB3480-043-P1-K1-B12.pep
HASDQFFLYQLLRGMKYIHAASVFHRDLKPKNILANADCKLKICDFGLARVSFNDTPSAIFWTDYVATRWYRAPELCGSFFSKYTPAIDIWSVGCIFAELLTGKPLFPGKNVVHQLDLMTDLLGTPSAESISKIRNEKARRYMSNMRKKPRVPFTKKFPGIDPMALHLLERLLAFDPKERPSAAEALTDPYFNGLANNEREPIAQ

SEQ ID NO: 50929 - protein, 118 aa, Sorghum bicolor
  unsure (1)..(118): unsure at all Xaa locations
  Clone ID: LIB3480-043-P1-K1-C2.pep
AAVASNAQTFSGSASSVALRPPGAPPMLALPAPPAGGSSAAVGADPFAASALVPPPTYVQMSDMQTKQQLLTQEQQMWRQYGNNGMNQGALAMLQQRPNQNQQFLPHTXHNYSGYRTS

SEQ ID NO: 50930 - protein, 86 aa, Sorghum bicolor
  Clone ID: LIB3480-043-P1-K1-D1.pep
MSSRRSRASVSEEEINELISRLQTLLPSARRRGGSEASTTKLLKETCSYIKSLHREVDDLSDRLSDLMATMDHNSPGAEIIRSLLR

SEQ ID NO: 50931 - protein, 56 aa, Sorghum bicolor
  Clone ID: LIB3480-043-P1-K1-D3.pep
SKCPLRPALEVVINRMTCRVYSTLDPYTCHRSIACSLRFLPFLCKLLSRVSLLSSK

SEQ ID NO: 50932 - protein, 48 aa, Sorghum bicolor
  Clone ID: LIB3480-043-P1-K1-D4.pep
GRVGAEVVVCFTSFVRLAFHQAPTNKTFCSDHHRCDRLINNRSSQTII

SEQ ID NO: 50933 - protein, 36 aa, Sorghum bicolor
  unsure (1)..(36): unsure at all Xaa locations
  Clone ID: LIB3480-043-P1-K1-E3.pep
VWGNSPGVFTQSXDGFVNTDGPSEFEFQCDTYRQSS

SEQ ID NO: 50934 - protein, 95 aa, Sorghum bicolor
  Clone ID: LIB3480-043-P1-K1-F2.pep
MNGRPSGPGGRKLDLHIMEPPYARCYRGTVMLIARHHLLRMHCSILCRIFFTLGLVLFMLPEKVTCKQPRVGQYIHSTLCEHMLIVMAARIPIDM

SEQ ID NO: 50935 - protein, 55 aa, Sorghum bicolor
  Clone ID: LIB3480-043-P1-K1-G9.pep
LAVVLKRCDWKNLGVTKFNGFEENTFFASWLNSKKARTVRLSKHLLTLNGKWDAL

SEQ ID NO: 50936 - protein, 56 aa, Sorghum bicolor
  Clone ID: LIB3480-043-P1-K1-H2.pep
GLFICSIPGYSRTYSCNNLGGVMNFCYQLKNFSSPRKVYKIVGPYKRATPMTWRCV

SEQ ID NO: 50937 - protein, 143 aa, Sorghum bicolor
  Clone ID: LIB3480-044-P1-K1-B10.pep
KKYVGEDDDASSAAFRWMIEEIFFLNGALHVGDMVPWLSWLDPHGYIGRMKRVAKMFDRFIEHVLREHGERRRREGDAFVPKDMVDLLLQLADDPGGLDVPLDRDGVKASVLELITGGTDTTSVTVEWAMSELLRKPDVLGKV

SEQ ID NO: 50938 - protein, 169 aa, Sorghum bicolor
  unsure (1)..(169): unsure at all Xaa locations
  Clone ID: LIB3480-044-P1-K1-D6.pep
XKSRCCSKYRKALPDTSASLEGCSRAASLQHACTSCHRTRWIVSSYTAFGLSYPTQTQQKGIQMELAAVATCTCKLCYPSSWHAHVYRSCVHGSTHARMHANGGGGGYGGCGSLVCSSMVSSGQNDDDDDVPNPARFLSSSAAGSCCSNLSRNDAHSAKLRSPNDTCFR

SEQ ID NO: 50939 - protein, 134 aa, Sorghum bicolor
  Clone ID: LIB3480-044-P1-K1-G10.pep
GTYTWTMNNFPDIVPVRSPAFEAGGHKWYINMYPLGDQCSTNSLSLYLHLHDLNKIPLETGMVIELTLSILDQKHDRHYTVTGRFVFGVAAKNGWGWPNFVPLKTLMDPFSCYIVGANCMLKADVTIIGSSNDG

SEQ ID NO: 50940 - protein, 146 aa, Sorghum bicolor
  Clone ID: LIB3480-044-P1-K1-H4.pep
GGELFDRIVRRGHYTERQAGELARVIVAVVESCHSLGVMHRDLKPENFLFVGNDEESPLKTIDFGLSMFFRPGEEFTDVVGSPYYVAPEVLKKRYGQEADVWSARVIIYILLCGVPPFWAETEQGIFEQVLHGSLDFESDPWPSVS

SEQ ID NO: 50941 - protein, 84 aa, Sorghum bicolor
  Clone ID: LIB3480-044-P1-K1-H9.pep
MYPDAAPYEAAPGGVVVAPVAGLFPGAGASREWSSGLFDCFDDFDTCCLTFWCPCITFGRTAEIVDHGTTSCGTSGALFALIEY

SEQ ID NO: 50942 - protein, 88 aa, Sorghum bicolor
  Clone ID: LIB3480-045-P1-K1-A12.pep
LIQILLHQSQQIIYILGFISNHFNAAKSHRYQPNLTKDHSSLCTESHNLAHIFLTIYCKSHFRRSGRTLCFCEQLFFIYSIFFIYNSI

SEQ ID NO: 50943 - protein, 170 aa, Sorghum bicolor
  Clone ID: LIB3480-045-P1-K1-A6.pep
NPRSYYKCTHPGCTVRKHVERASHDLKSVITTYEGKHNHEVPAARNSGGHPSTAAAATGAGGGGPRRPEHTSSVHDGLMMRHLGGCGVPFGLPLQPPSRDPLAPMGNYPTYPFTALGGGGGSGGDGGLTSLPSLPMATNLSAVEGLKLPMLATSSPLHHQHPLLKQPQAM

SEQ ID NO: 50944 - protein, 198 aa, Sorghum bicolor
  unsure (1)..(198): unsure at all Xaa locations
  Clone ID: LIB3480-045-P1-K1-A8.pep
ALRRHLLLSATPARPSCGTTRARRLLLAGAFASEGPSGQDVDYSAGVTNSGSAYLGLFVRLLGLDNDSRDREHAVCTLYQYSLGGRKSVDEIMQFPGCIVLIISLLKSESIPACEAAAGLLRNITSVHIYRKVAGESGAMEEIISLLCKSTITPEILEQCLCTIWNFSIDENGRYKILRSDVLMXRCSYLDEEDIKVK

SEQ ID NO: 50945 - protein, 81 aa, Sorghum bicolor
  Clone ID: LIB3480-045-P1-K1-B10.pep
LARTAIKIHHRRARNMILALQAQACRRSMVSASYIWLSSSNNRSLASCVQRRKKMRTQQQISSDQILGIYTSFLSKYDKYI

SEQ ID NO: 50946 - protein, 63 aa, Sorghum bicolor
  Clone ID: LIB3480-045-P1-K1-D8.pep
CVPFGLQHVSLLGRALGRGLFGLKQPVTWRMPLHQMQLGPATVFAVQALSGCARCLELRLSHI

SEQ ID NO: 50947 - protein, 137 aa, Sorghum bicolor
  unsure (1)..(137): unsure at all Xaa locations
  Clone ID: LIB3480-045-P1-K1-D9.pep
MEAAAGSGSGSAAAAARGRRGLWPCGHPRPPFAAPPPPRSSSAPPRRRHDWNPREQKAADAFTXAILDCVHAYMALTEEDIREEYRRAGKLDRYDDPANDELGKRIARVIKKYPPPPGVFGDDPDRYLKLLEDDDED

SEQ ID NO: 50948 - protein, 91 aa, Sorghum bicolor
  unsure (1)..(91): unsure at all Xaa locations
  Clone ID: LIB3480-045-P1-K1-E4.pep
KPTILTPVAQXPLGSFDGDKAASDDDTVDDDEDAAPVGAPNGATMTEPTEVXAPPGAEATAGGAAVSNAPAVLAAAAARVCAAAVGAFAFF

SEQ ID NO: 50949 - protein, 210 aa, Sorghum bicolor
  Clone ID: LIB3480-045-P1-K1-F4.pep
MRAAVRNGAKHFPTAIVTGRCIEKVCGFVGLPELYYAGSHGMDIKGPSSKEDKTVLLQPAREFLPVINKAYRALEERTKDTPGARVENNKFCLSVHFRCVDEKSWSSLADKVKAVLRDFPELKLTEGRKVLEIRPSIMWDKGKAVEFLLKSLGFDDSTNVLPVYIGDDRTDEDAFKALRERGQGIGILVSKCPRETECFYSLQDPTEVME

SEQ ID NO: 50950 - protein, 161 aa, Sorghum bicolor
  Clone ID: LIB3480-045-P1-K1-G1.pep
EHRAHQGRVQGRDGAGLLHGVLPSVDGYYGNCVYPVGITRSSKAIREASLPEVVGVMREAKEALTTRFTDWMRGGAKDDHYNVPLDYGTVTVSDWSRVGFNEVDYGFGEPGYVFTLNDDVNIVASAIYLKPPAPKRGIRLMLRCVEEPHAAAFADELAKFA

SEQ ID NO: 50951 - protein, 95 aa, Sorghum bicolor
  unsure (1)..(95): unsure at all Xaa locations
  Clone ID: LIB3480-045-P1-K1-G3.pep
NSKEAHTYRLSKHLHTQYGKWHALCSGIXSAACVVYTHSETYTFASAIAPAFCAFFPPFLAMFGVFPRKAKNGGLFRGYILRALRPLDQKNLVGG

SEQ ID NO: 50952 - protein, 121 aa, Sorghum bicolor
  Clone ID: LIB3480-046-P1-K1-A4.pep
IGGAPSWGPIFSAPCLLIFVFFFVPPNFISLPAFSHLIAWETLAVSHLIRFSKIPLSAVLFIKKEPLTDHLPHPCPALFASGASPFPPPLPPPLLGGSPRRSLSFCPSLIPRSFGFFPSFF

SEQ ID NO: 50953 - protein, 53 aa, Sorghum bicolor
  Clone ID: LIB3480-046-P1-K1-B2.pep
VGTEILSHFITLFMCVLMTLLITKIAHRHNIRVHIKPPKNNHSKTQNKLTIYR

SEQ ID NO: 50954 - protein, 205 aa, Sorghum bicolor
  Clone ID: LIB3480-046-P1-K1-C3.pep
ASGMSYNTAGSSGDQAAFPTERKHGLGGMMGWGVLMPIGMITARYFRQLDPCWFYTHMAIQVCGYAIGIAGIVLGFRINEDGLKNVDVHKALGIAVLAMASLQVLAILARPDKTFKVRRVWNWYHHNIGRATILLAIGNIFLGLSIAQEVSAYVVFYGVFVAVWVVSVTAFEMKRCYADDDLTSVYAEPWQTAMRTVSSVHSENN

SEQ ID NO: 50955 - protein, 39 aa, Sorghum bicolor
  unsure (1)..(39): unsure at all Xaa locations
  Clone ID: LIB3480-046-P1-K1-D5.pep
YTTSPSIFLDPTLLXPSSYFIIFLWGHLKKGYYPSFYNN

SEQ ID NO: 50956 - protein, 230 aa, Sorghum bicolor
  Clone ID: LIB3480-046-P1-K1-E5.pep
DAWATRPLLDVTAYVDKMELKKPIRVDTDLKIAGAVTYVGRSSIDIQIEVTQVDKDGDNQSDPIALTANFTFVARDSKTGKCGSVNRLSPENEREKHLFGEREARDKMRKRKREEQKGGLENGIHKLRAEAERLDALLAEGRVFSDLPALADRDSILMKDTRLENSLVCQPQQRNLHGRIFGGFLMHRAFELAFSTAYAFVGQRPWFLEVDHVDFLKPVDVGRLSFDSKH

SEQ ID NO: 50957 - protein, 62 aa, Sorghum bicolor
  Clone ID: LIB3480-046-P1-K1-F5.pep
YTSGEPCKGSTHPASHSQLPRNALTFSFYCRFVVIFDLVKVVYIICIYFLLHKTKTMAVWYP

SEQ ID NO: 50958 - protein, 211 aa, Sorghum bicolor
  Clone ID: LIB3480-046-P1-K1-G3.pep
LDAQPRSSVVLLCFGSMGNLTLPQVQEIAEGLQRSEHRFLWVLRGPPPAGSPYPTDANVEELVPGGFLERTKERGLVWPRWAPQKEILSHPSIGGFVSHGGWNSTLESLWHGVPLVTWPLYAEQHMNAFVLVAALGVAVAMEVDRKRGNFVEAAELERAVRTLMGGSEEGREARAKAAEAKAACRNAVKEGGSSCAALQRLMREILGHGGA

SEQ ID NO: 50959 - protein, 109 aa, Sorghum bicolor
  Clone ID: LIB3480-046-P1-K1-G5.pep
NKNYLNYSQAVNSSGSQNQTYTTLCNMDGRTNKYWAKSLRTDVQPTTANIHVGGVETSSFLCLSSSSFYHRRMKKTDMKFILHTSSSWSDLTTIKQGRDRRKFFQWRRH

SEQ ID NO: 50960 - protein, 198 aa, Sorghum bicolor
  Clone ID: LIB3480-046-P1-K1-G9.pep
HASAPIDGEQAAELAERPPRRHATRSPPQPPPPPRTTVPSRRSTEAGGPAAPRSPTGQLQGTVEAAAAGTRCPGGLISLIRRRPTATGGRDTTTMTSSRRTGSRSRRTGTTTTTSSRRTGSRSRRTETTTTTTGSPATAGRRKDTTTSRMTTTTRENHVTRRRTTTTPMTMTRRSVTRRTTVAATTTMIEPFSLIYIH

SEQ ID NO: 50961 - protein, 94 aa, Sorghum bicolor
  Clone ID: LIB3480-046-P1-K1-H11.pep
MAEPERERAAEEWVRRKRGRKRQGERQTSDPMEVLGEDVMGRVMEFLDARSVARCTAVSCAWRGVAADNRLWAPKGGLVDTTLRVAHSTPCSFG

SEQ ID NO: 50962 - protein, 40 aa, Sorghum bicolor
  Clone ID: LIB3480-048-P1-K1-A11.pep
HSIQLSTYFWHLRLYSLQALASTSVAQSHRKKLPSEPNAC

SEQ ID NO: 50963 - protein, 50 aa, Sorghum bicolor
  Clone ID: LIB3480-048-P1-K1-A2.pep
GSRACLQWLTNSSFLSTRLSQFIHCTLFCNLLTYNTLLLSTSKTLRCIPS

SEQ ID NO: 50964 - protein, 173 aa, Sorghum bicolor
  Clone ID: LIB3480-048-P1-K1-A4.pep
KAWESWWEEEQEHLQSTGLLGRFWEIILSLRFFIFQYGIMYHLNISAGNKSISVYGLSWLVIVAVVMVLKVVSMGRKKFSADFQLMFRLLKLFLFIGSVGTLAVLFTVLHLTVGDIFASFLAFAPTGWAILQISQASKPVIKACGLWGSVKALSRGYEYLMGIVIFVPVAVLA

SEQ ID NO: 50965 - protein, 157 aa, Sorghum bicolor
  Clone ID: LIB3480-048-P1-K1-B8.pep
MKCHEYLCYIAAGPEVTAIDLRTMKKASVLSLHNHRILSCEMLPSEWLICTGTKDKALLWDIRKAQELPNTVAEMQSNGPVTLLHLDPYKVVTGVLSDGEVHVWKTQTGDLLNTLGFGEPAGVRSTVSAMAVDGCRIAMAGRSPEGSVLHYRDFSTS

SEQ ID NO: 50966 - protein, 56 aa, Sorghum bicolor
  Clone ID: LIB3480-048-P1-K1-C10.pep
FIFVDIPNYSLIASYFTVEIDKLRFCGFFLTQWQLCLSSRKKVVLIFEVLLFHLDS

SEQ ID NO: 50967 - protein, 135 aa, Sorghum bicolor
  Clone ID: LIB3480-048-P1-K1-C5.pep
MHLEPLAEVEDHNEDFDMNAEISVSVPTNDDRVTKEVGDDVSVPSSPSKATRGRKGKRSGVHLSPSKVKVKCRFCHKSYAYQQGGATSQLNHHLSRCTQFQNKLAKAKRILAQDSEWDMYEKIRPILREMAGSTT

SEQ ID NO: 50968 - protein, 48 aa, Sorghum bicolor
  Clone ID: LIB3480-048-P1-K1-D9.pep
KKKKKKKKKKKNNIKKKNKKQVEWEIINDKIVLNKKIMAGRFCGPKFT

SEQ ID NO: 50969 - protein, 58 aa, Sorghum bicolor
  Clone ID: LIB3480-048-P1-K1-E9.pep
KKTNLHTTKKQQKWRGNRGGRSLNYLSLRTPAVGGRFNCSSLPYSSFRGHSFSIVGPE

SEQ ID NO: 50970 - protein, 81 aa, Sorghum bicolor
  Clone ID: LIB3480-048-P1-K1-F11.pep
SLPYQSILIPTVLNRTGPYSPLGRLLLTLFHLGPRSSGATAMGRSTHCTYLQHTPLSPTLPPRCGIGVSATPIMRRCRSCV

SEQ ID NO: 50971 - protein, 53 aa, Sorghum bicolor
  Clone ID: LIB3480-048-P1-K1-F7.pep
IHCPVLTFSPSGIIKIVSHFNFIISSFPFSLFRYIFNKVKVPYTSPFITNFKS

SEQ ID NO: 50972 - protein, 69 aa, Sorghum bicolor
  Clone ID: LIB3480-048-P1-K1-H2.pep
FYFGGPIKKILRFIQGLVNFYSLKPPPLFFFFFFFFFFFFFFFFFFIFFFFFFFITRVFFFFFFFFFFF

SEQ ID NO: 50973 - protein, 169 aa, Sorghum bicolor
  Clone ID: LIB3480-048-P1-K1-H3.pep
PRAKGGEPGLTVFSDADMAGDVDGRKSTSGVFVFLGAAPVAWQSLKQKTVALSTCEAEYVAAATAACQAVWLRRLLKELTGKESQPPALLVDNQPAIALAKNPVLHDRSKHIDVKFHFLRDCVDGGQITIEFVDTGRQLADILTKSLGRLRFVELRKMIGMDEVKAQQD

SEQ ID NO: 50974 - protein, 167 aa, Sorghum bicolor
  unsure (1)..(167): unsure at all Xaa locations
  Clone ID: LIB3480-049-P1-K1-A6.pep
KPLYKLSFSAKDDTAEANFFGYDEESRRIIRRNIDFMLRQARTTEGLPQHLMNLITRKYTFVPTQQTIGVQPTVDIASPATASTPAPPIVADDTPEKQPDNSTQANRKLIPKALLPSLNTIGKETNDACTIDKATAVLDQSFKTRSDDXLLKTMCPTSHDKTEKEAL

SEQ ID NO: 50975 - protein, 90 aa, Sorghum bicolor
  unsure (1)..(90): unsure at all Xaa locations
  Clone ID: LIB3480-049-P1-K1-A9.pep
QYIHTYVFLLHACLQWTFPCPWYFLTWLMGFSCKWHNTYYTSSVLKRVRLSACISLVDPSNPNCNLFWYSRCIXFTMHVDYSRHSMCLGV

SEQ ID NO: 50976 - protein, 55 aa, Sorghum bicolor
  Clone ID: LIB3480-049-P1-K1-B12.pep
LILFNIIFFLIIFFFFYIIPYIIFLSFILYFFFFFFFFFFFFFLFFFFLNQTGTI

SEQ ID NO: 50977 - protein, 75 aa, Sorghum bicolor
  Clone ID: LIB3480-049-P1-K1-B2.pep
HASAHASAPRCLPTLVVELALQTHALLRELGNPAGARIVLETERRAVSLWEPGDAARATRGRSGGQALTLLGEPA

SEQ ID NO: 50978 - protein, 45 aa, Sorghum bicolor
  Clone ID: LIB3480-049-P1-K1-B6.pep
KKFICCKPGKLSLGPFNPPPPFLTLVIELNSLKLYNTYKVACARK

SEQ ID NO: 50979 - protein, 76 aa, Sorghum bicolor
  Clone ID: LIB3480-049-P1-K1-B8.pep
EAGCREVHSVYHGPENPVAEDEIHMQQTVPDMSGNKIASSNPFQTKNLQSDIDMSIFFGQKVDKKQEDRFPSVLQS

SEQ ID NO: 50980 - protein, 158 aa, Sorghum bicolor
  Clone ID: LIB3480-049-P1-K1-C12.pep
IASGRSRSRTSLPGIKISGNTSRFPYTHGAGSRSALRITRIVSESFRLGLPGARWFVMGDDDTVFFPDNLADVLSRYDHTQPYYIGNPSESHIQNLIFSYGMAFGGGGFAISRALAAQLARMQDGCIERYPALYGSDDRIHACMSELGVPLTRHLGFH

SEQ ID NO: 50981 - protein, 77 aa, Sorghum bicolor
  Clone ID: LIB3480-049-P1-K1-C7.pep
LYACMHAWCRGCFFLRSFLLIHDPSIAHPRTTADDIYEVYVRIQISHSVFCTYVSKTILKMIMNRLNLWPAALWMHG

SEQ ID NO: 50982 - protein, 188 aa, Sorghum bicolor
  Clone ID: LIB3480-049-P1-K1-D2.pep
SGMSSLAYFMSKDTIDHFNTIVKPIVYLSMFYFFNNPRSSIWENYIVLLALVYCVTGIGYTFAIFFQPGSAQLWSALLPVVLTLIATQQKDTILADLCYTKWALEAFVIANAQNYSGVWLITRCGSLVRNGYDIEHEALCIGVLIANGILFRCVAFFCMVTFQKNLKSQGKPMNFLCPCSRSVSLISV

SEQ ID NO: 50983 - protein, 127 aa, Sorghum bicolor
  unsure (1)..(127): unsure at all Xaa locations
  Clone ID: LIB3480-049-P1-K1-D3.pep
KNGFFFKRYFYLFTNLFFLNKTFFNPGPFIFFFCPFIKIFYVXLTWFLSFFFLKRAPFLCIFYLLSNLIYRYTEIGYLKFLIXFTEFFYFNIFFFFFFFFFFFFFFFFFLNPRIDLHTRPAGAVTCV

SEQ ID NO: 50984 - protein, 199 aa, Sorghum bicolor
  Clone ID: LIB3480-049-P1-K1-D6.pep
DAWGRSGNFKNFQCPPGHYNALASLFFNTNDDAIRNLLSAGRYDYREFGVSTLLTFFTTVYTLGLLTYGVAVPSGLFIPVILAGASFGRLVSTLLGSVSGLDSGLFALLGAASFLGGTMRMTVSVCVILLELTNDLLLLPLIMLVLLISKTVADCFNKGVYEQIVRMKGLPYLEVHASACTRSLVAGDVVSGPLVTFSS

SEQ ID NO: 50985 - protein, 40 aa, Sorghum bicolor
  Clone ID: LIB3480-049-P1-K1-D9.pep
LVVSQLVNLILAPAIQTGPYICCSVKKDCGPRHKILEFLL

SEQ ID NO: 50986 - protein, 62 aa, Sorghum bicolor
  Clone ID: LIB3480-049-P1-K1-E4.pep
PMRHCLHWLCARLYYEEDPLLRHVEPSVTTFLELDIVNLEGDNEFKYTHSRDRQWHIDTLIM

SEQ ID NO: 50987 - protein, 89 aa, Sorghum bicolor
  Clone ID: LIB3480-049-P1-K1-E7.pep
APNDPSKPARHHRSRTLKLTRRRNRHRRRRRRPLAPERWTTHHQTTVLVRQRPNQTTMALVRQRARRMMTPPPPPPEHQQRPARWRHCR

SEQ ID NO: 50988 - protein, 90 aa, Sorghum bicolor
  Clone ID: LIB3480-049-P1-K1-F6.pep
SNPIPLDSFSCIDLICLNKKSTLSLHASALQRRRRQQWHREMPCRRRPKWIHPAALRAIATSRLLRRIYLPATAPRAAASSAASAWTWAW

SEQ ID NO: 50989 - protein, 55 aa, Sorghum bicolor
  Clone ID: LIB3480-049-P1-K1-G11.pep
YKKIIIYKGGALFRGPKLPSLALPPIPFFLGPPNSIAGAPFYPRWTGKTPAVPKL

SEQ ID NO: 50990 - protein, 122 aa, Sorghum bicolor
  Clone ID: LIB3480-049-P1-K1-G4.pep
MAAEEAKKVEVEATKDIAEEKAVVPLPPPPAKLADDDDSKAIVAVVKDAAEKPATIGGSTERDAYLAKIVSEKRLTLITAWEESEKARAENRAAKKLAFITSWENAKKAEMEAELKKIEEQL

SEQ ID NO: 50991 - protein, 59 aa, Sorghum bicolor
  Clone ID: LIB3480-049-P1-K1-G7.pep
KKKKKKNIKNKKKNKINKKKKRGRKKNIRVGWFKVSRLKFSSLTCLTSSMLSLNFNYLT

SEQ ID NO: 50992 - protein, 172 aa, Sorghum bicolor
  unsure (1)..(172): unsure at all Xaa locations
  Clone ID: LIB3480-049-P1-K1-H6.pep
ALAYYRRTVEHRKLGDELRVLACVHSQADVSPMLALLDAASPSPASPVDVYLLHLAPLVGLTSSVLRAFKHGDRNCVPSGGTDSERIVNAFQYFVQQRAVGSAXLLPYVCIAPYATMHDDXCNVALEKRAMLIVVPFHQRLAIDGSVENTTASGGSVQAXNVNVLNYSPCSV

SEQ ID NO: 50993 - protein, 132 aa, Sorghum bicolor
  Clone ID: LIB3480-050-P1-K1-A3.pep
DANLILGEAHSSKILENSEHNIKPRSFDVAKVDEILKTLAGKTLSYKMFARDTQASRSVGPPTECFMFHSRAAVAKLHSANEDYKEGMMVMCVELVANRFLRKMVRGLVATAIREAAAGACDDALLNLMEAT

SEQ ID NO: 50994 - protein, 150 aa, Sorghum bicolor
  Clone ID: LIB3480-050-P1-K1-B2.pep
AVVPLNADVYVSPDDKPSSGAFRPDIDDLMTDMVKFLHDHGAPFVVNIYPFLSLYQSSNFPFEFAFFDGGKNINDKGGVNYDNVFDANYDTLVHALKKGRVPNLKVIVGEAGWPTDGNKNANLKLARRFYDGLLKKLAKNEGTPVRKGKM

SEQ ID NO: 50995 - protein, 172 aa, Sorghum bicolor
  Clone ID: LIB3480-050-P1-K1-C6.pep
LWLYCRTSGNKIVRAYAKDHYFDVVTNVVGLAAAVLGDRFYWWIDPIGAIALAVYTISNWSGTVWENAVSLVGESAPPEMLQKLTYLAIRHHPQIKRVDTVRAYTFGVLYFVEVDIELPEDLPLKEAHAIGESLQIKIEELPEVERAFVHLDFECDHKPEHSILSKLPSSQP

SEQ ID NO: 50996 - protein, 119 aa, Sorghum bicolor
  Clone ID: LIB3480-050-P1-K1-C8.pep
KMKFIVFALLFVGACVAAPEVSSLSGAANTITDAANGVCGLTDSVFSSIVSLLQNLAGIASQLVGTAGAVPKTVCDLLSQALQIILKVIVAVPAAVLEALGLPSALVKEALAILESVLG

SEQ ID NO: 50997 - protein, 113 aa, Sorghum bicolor
  unsure (1)..(113): unsure at all Xaa locations
  Clone ID: LIB3480-050-P1-K1-D2.pep
AATAIYCSGKQGRTKGVVEGREQNGGRNGGSGAGHVMRSHKTSRGRXRRRSVVSRSGAGAALTCPPSRASSRACLASSPFHHHAYLVFGPSPLSSRRVHAAFSPFYHPPNPPA

SEQ ID NO: 50998 - protein, 60 aa, Sorghum bicolor
  Clone ID: LIB3480-050-P1-K1-F2.pep
ISIRAVLQAASKLTVPGLRQHDLSYTDQLLSNHCQPDTYLHTEKTVMLTNYNYLLIMRIF

SEQ ID NO: 50999 - protein, 74 aa, Sorghum bicolor
  Clone ID: LIB3480-050-P1-K1-G4.pep
KRDWGFYINSCFVHCQSLNSLTWHSPTSPRVNNKSIAEAVGDWFFDRREVKEIDCEYPCNPTCHNLVFAKAFKI

SEQ ID NO: 51000 - protein, 58 aa, Sorghum bicolor
  Clone ID: LIB3480-050-P1-K1-H1.pep
SSLASDPLHHARGARPGILGLLRARHAPSNGRLHLYHLTPVYFVYYFFLYIFYCLITF

SEQ ID NO: 51001 - protein, 54 aa, Sorghum bicolor
  Clone ID: LIB3480-050-P1-K1-H12.pep
LGAYFACDHDLWWLIILCAQKLIYVLSLIVVKTDGMLDVCSLCLGCNEPCLASC

SEQ ID NO: 51002 - protein, 82 aa, Sorghum bicolor
  Clone ID: LIB3480-050-P1-K1-H6.pep
LESFNKAAAALRGSVDADRLRLMDTYSLSFLRPDGHVGPYRTPYPFAKGSTESTPVQNDCLHWCVPGPIDAWNDLVMKMALD

SEQ ID NO: 51003 - protein, 161 aa, Sorghum bicolor
  Clone ID: LIB3480-050-P1-K1-H7.pep
VPPKSNSRFFHKGRSIFQESHTLADQHGHHEESDKQTQCSISATGSDVSDSVIFSHTNGAGLKIRSISSDDPDGFDTPRSRSSCFSFTHEPVKKVENCDVRQYLGNFGRGNSSREMKETRSSYVADDYASQKVNPDLLKDMVTFQNRIEYGGLVICNIRTF

SEQ ID NO: 51004 - protein, 152 aa, Sorghum bicolor
  Clone ID: LIB3480-050-P1-K1-H9.pep
RCEHLGCTKSAEGRTDFCIAHGGGRRCSNEGCKKAARGKSGLCIKHGGGKRCQKENCTKSAEGQSGFCIAHGGGRRCKHEGCTKGAQGSTSFCKSHGGGKRCTYPNCSKGAEGSTLFCKGHGGGKRCAAEGLPKSVHGGTEFCVAHGSGKRC

SEQ ID NO: 51005 - protein, 183 aa, Sorghum bicolor
  Clone ID: LIB3480-051-P1-K1-A1.pep
EETHSQVKQMHLIAPLDKQFSILYGLLTDHISENVDYKVIVFCTTAKVTSLVAELLSELKLNVREIHSRKPQSYRTRISKEFKESKGLILVSSDVSARGVDYPNVTLVVQLGVPTDREQYIHRLGRTGRRGNEGAGVLLLAPWEEYFLRSIKDLPISEATQPLIDLDTKKKVDKALAHVEVKD

SEQ ID NO: 51006 - protein, 165 aa, Sorghum bicolor
  Clone ID: LIB3480-051-P1-K1-C1.pep
MFSDPAAGTVIDLDEAMRSNLGPNSSHATNSDCQATFTDLKAGTQRGSQDGNFIMQRSSPEDTQSGLSDPFSDMSLEIEDLIIPWSELVLKEKIGAGSFGTVHRADWNDSDVAVKILMEQDFHPERLKEFLREVAIMRSLRHPNIVLLMGAVTQPPNLSIVTEYL

SEQ ID NO: 51007 - protein, 74 aa, Sorghum bicolor
  Clone ID: LIB3480-051-P1-K1-D1.pep
MAPISRSTAVVLVMMAVVVAVLAAAANAQAPAPAPATSDGTSVDQGIAYVLMLVALVLTYLIHPLDASSAYKLF

SEQ ID NO: 51008 - protein, 78 aa, Sorghum bicolor
  Clone ID: LIB3480-051-P1-K1-F4.pep
NKISPKKKMIDLVFFITGGKYPIFSSTFLFAMYNLSKILNFKFLLVGNSFFQKSCPLIFANAFGDYTYNLETPLTAFI

SEQ ID NO: 51009 - protein, 44 aa, Sorghum bicolor
  Clone ID: LIB3480-051-P1-K1-H9.pep
GVGSIQSRKDEKKTTSSNTSNTATTKRPSTSLLVRQSTTVHRML

SEQ ID NO: 51010 - protein, 162 aa, Sorghum bicolor
  unsure (1)..(162): unsure at all Xaa locations
  Clone ID: LIB3480-052-P1-K1-A3.pep
FLQANTLLLPRPYGDGHGPRVSEESRQATVDLFLKAAGYLDCAVHHVLIHIPPERRRELPVDLAEGNLKALSLQGLGQGVDMQLGLAIENPKATLAVKRRLACEMIKCWKQVKDSIPELPLSDGWXRKHALXVKWKYVEAKAAAYYFHGLILDEGETEKSQE

SEQ ID NO: 51011 - protein, 74 aa, Sorghum bicolor
  Clone ID: LIB3480-052-P1-K1-A6.pep
LNQRYTIKNQVVPPFFFFSSPFFFFFSPRLFFFFPLVGLFLYGHITFAVPFFFLCAPLFLNQHSVFHLLWLELT

SEQ ID NO: 51012 - protein, 190 aa, Sorghum bicolor
  Clone ID: LIB3480-052-P1-K1-A9.pep
FAILVLMALITTFITTPVVMAIYKPARRGPPYKNRAVERANPHDEFRMMACFHSTRNIPTIINLMESSRGTRKRGITVYAMHLVELSERSSAISMVHKARRNGMPFWNKRRNGDGDGDQLVVAFETYQQLSRVSIRAMTAISDLHTIHEDVVTSAHQKRAALIVLPFHKLHQMDGHMESLGDQYQHINQR

SEQ ID NO: 51013 - protein, 60 aa, Sorghum bicolor
  Clone ID: LIB3480-052-P1-K1-B4.pep
RTKHREGRLETLKTPPHVLVFTINFFCIIFLNIPPLFFLYIFFYFFFFLFYFIFYFLFFL

SEQ ID NO: 51014 - protein, 168 aa, Sorghum bicolor
  Clone ID: LIB3480-052-P1-K1-C10.pep
VNTTVAWWLLTTVPHICEKELLPAGSPWTCPSDHVFFDASVIWGLVGPRRIFGPLGYYSALNWFFLGGLILPAVVWLLARALPGHAWWISLINLPVVLGATANMPPASPINYTAWCFVGTVFNFFVFRYRKAWWKPYNYVLSAGMDAGVAIMGVVIYFALVGHPLDWW

SEQ ID NO: 51015 - protein, 61 aa, Sorghum bicolor
  Clone ID: LIB3480-052-P1-K1-D10.pep
PLQLGYFKGSHRERAFSHLGQLTIRECDSCRFSWDKASFLQSHLFQIKYSEFKLSLPIQKV

SEQ ID NO: 51016 - protein, 66 aa, Sorghum bicolor
  Clone ID: LIB3480-052-P1-K1-E1.pep
QALARYRMKKDIINGAAAGFAAGAVLGFRVRSFRTAFFSGSALALTSVLLDVTGMKITDEEEKGNH

SEQ ID NO: 51017 - protein, 57 aa, Sorghum bicolor
  Clone ID: LIB3480-052-P1-K1-G2.pep
EILYRGISENQCCVFIIYHHTIVCRVIQPLTTIIIIVTIPSLGVSTNPTESSVSSWV

SEQ ID NO: 51018 - protein, 76 aa, Sorghum bicolor
  Clone ID: LIB3480-052-P1-K1-G4.pep
MSSDAVAARKGRLKQRYDNEFRLVAGCVPYRANKKDDELGNPCSSLGVGDDHTAEVEVLMISTPNRTDMVFPKGGW

SEQ ID NO: 51019 - protein, 179 aa, Sorghum bicolor
  Clone ID: LIB3480-052-P1-K1-G9.pep
AFSETGQLWNSPLYDWKAMEADGFSWWTKRIKRALDLYDEFRIDHFRGLAGFWAVPSDAKVALVGSWRAGPRNSFFDALFKAVGRINIIAEDLGVITEDVVQLRKSIGAPGMAVLQFAFGGGSDNPHLPHNHEMDQVVYTGTHDNDTVLGWWQNLPEEEKKIVIKYLPEAENTDISWTL

SEQ ID NO: 51020 - protein, 174 aa, Sorghum bicolor
  Clone ID: LIB3480-052-P1-K1-H8.pep
HASAHASGKRKRRAQPSPSRRHNLVVVPEPAVSPDAAYQASPSGTNSYELSGTKSWFTYDELVGITGGFSAANVIGEGGFGKVYMGALGDGRRVAVKQLKVGSGQGEKEFRAEVDIISRIHHRHLVTLVGYCVTENHRLLVYEFVANNTLEHHLHGKGLPVMDWPKRMKIAIGA

SEQ ID NO: 51021 - protein, 144 aa, Sorghum bicolor
  Clone ID: LIB3480-053-P1-K1-A8.pep
KKKKRANTIKRKKKGRPVQKDTKSRGVMCADVDVLTLHPHSCDWTALELRDLVKTLARPNLTSWLEKPLCRPAVFSNRPAPFDLPETCPACPHKGPRPVGAHSEWPMGWPLAGRPIHLPCTDTPLLARSLCLCRYVRWFCSMTS

SEQ ID NO: 51022 - protein, 51 aa, Sorghum bicolor
  Clone ID: LIB3480-053-P1-K1-B1.pep
CTGHCTGHHESSRASCRASWRVTVRVPFALQFARLIGTALCASLSAITTAI

SEQ ID NO: 51023 - protein, 70 aa, Sorghum bicolor
  Clone ID: LIB3480-053-P1-K1-B3.pep
HASEKKIKKNTNKPKKKIKTTKKTRQNQKTGKDCHKITNPFDINNGARHFILSKCVVPFLVSTFSYILTP

SEQ ID NO: 51024 - protein, 83 aa, Sorghum bicolor
  Clone ID: LIB3480-053-P1-K1-C1.pep
VLKSEHVTKVRKSKFKFDLNATSLTESHLIACEEDKLCSFLILVSSQLQHSEAITAKLKLISILHSASNSGYRNHFTIEQAQK

SEQ ID NO: 51025 - protein, 110 aa, Sorghum bicolor
  unsure (1)..(110): unsure at all Xaa locations
  Clone ID: LIB3480-053-P1-K1-C4.pep
YAAIGGKYXEVTDLWGEMKLLASSSSMKFDQELLDSLLYCFVRGGFFLRAMEVIDMMEKREMFIDKYKYKSLWLKYHRTLYKGKAPKVQTEAQLKRREAAIHFKKWIGLT

SEQ ID NO: 51026 - protein, 139 aa, Sorghum bicolor
  Clone ID: LIB3480-053-P1-K1-C5.pep
MDGLRGLAPGRGRGRGQGRTVPPEWTGDSGSGQGAGPGGSWSYSWGRTSGPGGGWGYGHGSAQGPGAAYGFGFGSGGGGSGRGGFEFSFGGHDGGFGWGAGGGSFGVGGDHGSWSARGGLGGGGGRQRPPRGGRGRGSN

SEQ ID NO: 51027 - protein, 157 aa, Sorghum bicolor
  Clone ID: LIB3480-053-P1-K1-C6.pep
GPGATAPAAQTPLLLDRRMTPFYAVTVDAVYVAGEALDIPADVWDVDRNGGAILDSGTSLTILATPAYRAVVTALSKHLAGLPRVTMDPFEYCYNWTDAGALEIPKMEVHFAGSARLEPPAKSYVIDPAPGVKCIGVQEGSWPGVSVIGTILQQEHF

SEQ ID NO: 51028 - protein, 187 aa, Sorghum bicolor
  Clone ID: LIB3480-053-P1-K1-D11.pep
NIDKGLGSGVILDTSTSVTSLVPEAYEPLVAALDRHLAHLPRESFAGFEYCYRWTFTGDGVDPAHNVTIPKVTVEMTGGARLEPEAKSVVMPEVGHGVACLAFRKLPWGGGPCIIGNVLMQEYIWEIDHSKATFRFRKDKCNTRHLHTSTGGEVTNNGSSGGNNQQANGGTSSDAPSSFSTVVHSVN

SEQ ID NO: 51029 - protein, 207 aa, Sorghum bicolor
  Clone ID: LIB3480-053-P1-K1-D12.pep
PFSSQPPARGVFLMTLQHAPPSLHNTKEKKFTDSFKSMIATCLIKDPTKRPPAKKLLKHPFFKRAKSDHNVVKCMLNKLPSLAERMQFIKENEALQADKKPLDNCKEKASQEEYRRGVSEWNFDIADLKAQAALYPDENEAEDFLRFLFELDIVDETTQLKDIRAQSHSINDDKMNVGDDGSGKSNSTSPMSLSQSVKQLDKGSLMT

SEQ ID NO: 51030 - protein, 73 aa, Sorghum bicolor
  Clone ID: LIB3480-053-P1-K1-D6.pep
SGRAPCAHKNTNWMINIQNGETSYTVRFLRAHALELQEGTILIPGVHERDRHGHLHGGTPRGQIQPAAGAEGQ

SEQ ID NO: 51031 - protein, 46 aa, Sorghum bicolor
  Clone ID: LIB3480-053-P1-K1-H11.pep
SRSRSTRVDEYRISEQSPRQPLSLDRERAALCVFFARGEQVDRYAD

SEQ ID NO: 51032 - protein, 125 aa, Sorghum bicolor
  unsure (1)..(125): unsure at all Xaa locations
  Clone ID: LIB3480-053-P1-K1-H12.pep
IPVANAPGFFVGNKRGPFFKRPPFLAAPHLKENPFGGKILSPKKKSRALGWAPRPRKTIKTNTARRGPKSVVLFDEGMVHVRINSAPHTVGFPSNCPGHESSAPGWNMRLTKTKKRRXVGAAVAI

SEQ ID NO: 51033 - protein, 128 aa, Sorghum bicolor
  Clone ID: LIB3480-053-P1-K1-H2.pep
VKPEALAALAEVCSMRFVHGVSTRTGLMGIDYPTASWLSRDCRYRAYTVISVDDLYNPFASMYFGASYLAWLSQYEGREQSYEFIVQAYLGGPENVSLQETGPFWNQFLESLTQYQDPKKDHNSCCIL

SEQ ID NO: 51034 - protein, 88 aa, Sorghum bicolor
  Clone ID: LIB3480-053-P1-K1-H4.pep
SVHAVAYVFWNVHEPVQGQYNFEGRYDLVRFIKEIQAQGLYVSLRIGPFIESEWKYGGFPFWLHDVPNITFRSDNEPFKVSKLVMRDF

SEQ ID NO: 51035 - protein, 181 aa, Sorghum bicolor
  Clone ID: LIB3480-053-P1-K1-H8.pep
DPETGEWPTAMQVWRATYQKPDGTWTIPTGEEIMTKLDEVAGTHQEKISSAPVPIVEHFALVLGRKPNHSRGVGIRAVNRVAEERIRLQAQIEASEQREAAARARADAAEQRAEAAEQRAQALEGQVSTVVETNAQLQAEQQFQRDELSSLRQTQSGEVARLVKEQLDRQMADFFAHIRSG

SEQ ID NO: 51036 - protein, 146 aa, Sorghum bicolor
  Clone ID: LIB3480-054-P1-K1-A11.pep
HGKLAHMPLSSKMDFCEFCVAWAGTNSKLDGADKQRLPPAPDGGAEKWRRVPLPWELFQPVLQIVAHCLLGPTGSDELKAQAARAAECLYWRATETVDARAVLATRSLVRLSQMVEEPIPEPSFSGAIENMAELEAMRANILNNTK

SEQ ID NO: 51037 - protein, 180 aa, Sorghum bicolor
  unsure (1)..(180): unsure at all Xaa locations
  Clone ID: LIB3480-054-P1-K1-A5.pep
ERRKKQRERKGPRAPPVGSTKAAGKDRGRRRRRRKQREWKPWLSGLQRPSVRLCAALRCEAPCMVGDHQYPIRSVVAGLPSLPLAMAFSPPHPPNQEVPYLLPGPGRNQRTELKKKKESRSREGGRRSIDRLPSTKEAATMPPCRPLVAGRFLQSTYPXHRSAFRAPVFCNFITTNKSMS

SEQ ID NO: 51038 - protein, 132 aa, Sorghum bicolor
  unsure (1)..(132): unsure at all Xaa locations
  Clone ID: LIB3480-054-P1-K1-B2.pep
AYNIVLDTEFNAELSDYVLAKACPTADTTDVYTHVLAPDVYADAYSIAAGLLSGQAYVYSYVDRLLELLTEXMTLSKSIPGFEPNLVHCVRPYLSDKFRLXRIMYTMLGRQLARQGANASASIVLRFIFRDI

SEQ ID NO: 51039 - protein, 78 aa, Sorghum bicolor
  Clone ID: LIB3480-054-P1-K1-C1.pep
KHTKIPCMHMKIVGKKGEIGLKDPRTDRYYFSVFFDALSLPLTSAGGSNSVRNLSAATHASYTPLSLSTMTVSLAVHG

SEQ ID NO: 51040 - protein, 141 aa, Sorghum bicolor
  Clone ID: LIB3480-054-P1-K1-C10.pep
KKKKKKKKKKKKKKNNKKKKKMGGGCLGPTFTYTCMASPFGRSLLTSMLLPGRSFPITVFKYNPSVNHFTRLSSNTPLANPCYSPKESSPFPSLFFHLMNCERCPPCTISPTAGHLFCPLTLTLTLAIFPWPSPFYPFLSL

SEQ ID NO: 51041 - protein, 160 aa, Sorghum bicolor
  Clone ID: LIB3480-054-P1-K1-C6.pep
DELRKATGDFNPGQIVGEGGFGVVYRGVIDGAVRKGYPPTEVAVKVLNPEGLQGDREWLTEVSYLGQYSHPNLVELIGYCCEDDHRLLVYEFMAKGSLEHHLFRRACSLSWTTRLAIALHVARGLAFLHGPDRPIIYRDFKTSNILLDAEFNAKLSDFGL

SEQ ID NO: 51042 - protein, 135 aa, Sorghum bicolor
  Clone ID: LIB3480-054-P1-K1-E5.pep
MFRVQSSPSLPNGTAFKQPPFAINNAVPSSTVGFYGTRDAVRPKTAQLTIFYAGSVNVFDNVSAEKAQELMFLASRGSLPTSAPVARKPEAPIFAPAKVAVPEVLPAKQMLFQRPQHVSSPPSAIKPIPGILQAA

SEQ ID NO: 51043 - protein, 75 aa, Sorghum bicolor
  Clone ID: LIB3480-054-P1-K1-E8.pep
NGPPLFFFFFFFFFFFFFFFFFFFFFFFFFFFFFFFFFFFFFFFFFGKKKSMGMFVRDHVGERAADLGHLDERPV

SEQ ID NO: 51044 - protein, 96 aa, Sorghum bicolor
  Clone ID: LIB3480-054-P1-K1-F1.pep
DIQDAILIHGPSNKQLRVRGVISPQYILVGIDKSGGRIGLLSSKFMLQAISVLHIVHLSHKCIHYVIKGSRSSEVEGLWKSPPQEFSYLQYPQEGW

SEQ ID NO: 51045 - protein, 71 aa, Sorghum bicolor
  Clone ID: LIB3480-054-P1-K1-F11.pep
IKLGGPKKKLIPSHPPEVNFEPLKRPPPFFFLFIIFYFFFFIFFFFFFFFFFFFFFFFFFFFFFFFFFFFF

SEQ ID NO: 51046 - protein, 178 aa, Sorghum bicolor
  Clone ID: LIB3480-054-P1-K1-F12.pep
LVTVLIGFYDLYKNVPLLKSAAARICGPLFGWIETWDMVTRIQYLGTILFLRNLRKCLQSLLALLRAARALVRTVAAPLAQAVGPLLASCAQLWGLLSAGLAPAWALLVDLAELLWAPFDLVLDNVAGCLWPLLQVALLPVRAAAALAGCAGSLLSVTYNFSKDIWETMSSIFELNHM

SEQ ID NO: 51047 - protein, 136 aa, Sorghum bicolor
  Clone ID: LIB3480-054-P1-K1-F6.pep
SGKTSHIESFKDKTIADGVFFLELLSAVQSRVVDWNMVKKGEDEDERKLNATYIISVARKLGCTVFLLPEDIMEVNPKMILTLTASIMYWSLQNQGPYQCPGPQDALPEEEEGEEEEEEEEDFEGGVEDGVSETTT

SEQ ID NO: 51048 - protein, 104 aa, Sorghum bicolor
  Clone ID: LIB3480-054-P1-K1-G5.pep
TPLTMTMAWVHLQTNCHMHHTYWIQTNSHMYHSHRSHKHTTDEGHNHQDMSRQEIFSPPPLGECTTATDFELKTSNPAWTSQWSTYDEGASAATTKVILPNHTP

SEQ ID NO: 51049 - protein, 39 aa, Sorghum bicolor
  Clone ID: LIB3480-054-P1-K1-H10.pep
AILYTPRNNNLGGGLLTRAAYTIYSSIIIFVSFLLLLLF

SEQ ID NO: 51050 - protein, 57 aa, Sorghum bicolor
  Clone ID: LIB3480-055-P1-K1-A1.pep
KIPWDRHKPECDSLSHSSRRSEDQDECGLVDALTAAITRVRISEPKRSRLCSPAITI

SEQ ID NO: 51051 - protein, 106 aa, Sorghum bicolor
  unsure (1)..(106): unsure at all Xaa locations
  Clone ID: LIB3480-055-P1-K1-A6.pep
ELLCFASNTSTTLPLCCCVAFFVSLLFLLHRRYGGGKSTSNTKSKGRLPPGPPALVFLAKFLALRRSIFDLAPLLRDLHARHGPVISVHLFTTLVFVADRXLAHRV

SEQ ID NO: 51052 - protein, 79 aa, Sorghum bicolor
  Clone ID: LIB3480-055-P1-K1-B12.pep
ERTLRWEAEIKSPDDDGFDRKWKWEAKGGSSSAGARKLKWGAAVKGKGCLEPWSQSYTWEEDFTASDSDDEKEERAADK

SEQ ID NO: 51053 - protein, 88 aa, Sorghum bicolor
  Clone ID: LIB3480-055-P1-K1-B7.pep
KKKKKKKKKKKKKKKKKKKKKERRDNFWGGKKLNGKIYGGAFFEVPCLFSLVCGPLLSFIVSPKFISLSIFLYLVLLGKFWVFLFKCF

SEQ ID NO: 51054 - protein, 36 aa, Sorghum bicolor
  Clone ID: LIB3480-055-P1-K1-C4.pep
VQLIYGKSIQTDAMASCCCCTAIILLQYTGYITRRS

SEQ ID NO: 51055 - protein, 146 aa, Sorghum bicolor
  Clone ID: LIB3480-055-P1-K1-D11.pep
MLSTSGPSCSELMAESSRDFAVLVADATAAWFSSSTGGAMSLSVSASLNIMILSNSGGRSPLKSSSSVEASSLASSVIPVPCNIWTSLLSSVSSSLSSVEPISSVFSSSSEDHSSSSSRPSSSLISSSVISPCSILAAAPSLSDAW

SEQ ID NO: 51056 - protein, 45 aa, Sorghum bicolor
  Clone ID: LIB3480-055-P1-K1-D2.pep
PNRVSVSPAASGSKGSAEAKINPRGMQCIDLNHKHDRILTLFTDI

SEQ ID NO: 51057 - protein, 85 aa, Sorghum bicolor
  Clone ID: LIB3480-055-P1-K1-E12.pep
AAGALAGVPLGVAAAFSGDAVGALSDLSGDPLGAFDGVEAECFGEAAGDSAANTTAVEATTRRKTARAISRAMVRACVPVLAGLF

SEQ ID NO: 51058 - protein, 52 aa, Sorghum bicolor
  unsure (1)..(52): unsure at all Xaa locations
  Clone ID: LIB3480-055-P1-K1-F5.pep
NGRPXFFFFFFFFXFFFFFFFFFFFFFFFFFFXXASKHFMLLQNQSISQNHS

SEQ ID NO: 51059 - protein, 109 aa, Sorghum bicolor
  unsure (1)..(109): unsure at all Xaa locations
  Clone ID: LIB3480-055-P1-K1-F6.pep
VRAFPTIFLLNSTVRVRYHGSRAMNSLAVFYKDVTGLNPVSLDATSLERMEDTVTIIDHDKXTEKEDSLLSWARSPDRVLHQDTCLALASSFVLLRLLHFLSSKIMHVL

SEQ ID NO: 51060 - protein, 116 aa, Sorghum bicolor
  unsure (1)..(116): unsure at all Xaa locations
  Clone ID: LIB3480-055-P1-K1-G10.pep
MAVAGRGGRGTALLLRALAAPRPWQLAGAGARCIHEGPDTIEELLDRHLVKKPAAVPDEESAEARRRLTSSRREALALYRDILRAARLFAWPDDRXVPWREVLRANARREFEEGPR

SEQ ID NO: 51061 - protein, 142 aa, Sorghum bicolor
  Clone ID: LIB3480-055-P1-K1-G12.pep
NFLFVNKSEESPLKAIDFGLSVYFKPGDRFTEVVGSGCYMAPEVLKRSYGPEIDVWSAGVILHILLCGFPPFWGDSDEKIAQSILRGVINLQKDPWPKVSQSAKDLVKKMLDPDPSTRLTAKQVLEHPWLKNADKASNVSLG

SEQ ID NO: 51062 - protein, 102 aa, Sorghum bicolor
  Clone ID: LIB3480-055-P1-K1-G4.pep
SKEVAVCQNLDHPNVTKFVGPSMGTSHLKIPKKGSSSFRANECCVVVVEFQHGGTLKTLMYNHRDKKLSYKKVVRLALDLARGLSYLHSKKIMHRDVKAENM

SEQ ID NO: 51063 - protein, 78 aa, Sorghum bicolor
  Clone ID: LIB3480-055-P1-K1-H10.pep
PEPDAISESISTLKFAERVATIELGAAKSNKEGGEVRELKEQIACLRAALARKDGDHESIRSTQSSPDIYRMIMGNAL

SEQ ID NO: 51064 - protein, 123 aa, Sorghum bicolor
  Clone ID: LIB3480-055-P1-K1-H11.pep
VTFSRYAKACGLFPIVDKDKAQSALEKIFSFNVMKFKDGTRGAMNGMWPDGTVDMSAMQSREIWPGVTYALAASMIQEGMVEQGFKTAEGIYHAAWSPEGLGYSFQTPEAWNNDDEYRSLCYM

SEQ ID NO: 51065 - protein, 57 aa, Sorghum bicolor
  Clone ID: LIB3480-056-P1-K1-A11.pep
SGILYIYASSLEQWWDCQLITEVDGGDHSRLKILASSLEEEAEELLAPDSSRSLHAT

SEQ ID NO: 51066 - protein, 42 aa, Sorghum bicolor
  Clone ID: LIB3480-056-P1-K1-A6.pep
VEGLFSSGEMLLVLGALGQERKVFLTAATRFDQFYFSFLQGP

SEQ ID NO: 51067 - protein, 54 aa, Sorghum bicolor
  unsure (1)..(54): unsure at all Xaa locations
  Clone ID: LIB3480-056-P1-K1-A8.pep
RDLAESLFLSEVLMXFKDAQKLSFLDIKDSTGIEDYVLXRSLLSLACGKVRILL

SEQ ID NO: 51068 - protein, 39 aa, Sorghum bicolor
  Clone ID: LIB3480-056-P1-K1-B1.pep
VQTAKPHELQKKFFWLKRLRIPGAQYEVQISFKTRLDME

SEQ ID NO: 51069 - protein, 94 aa, Sorghum bicolor
  Clone ID: LIB3480-056-P1-K1-B10.pep
RSVRSWARRAVASAAAAAAIGGVSLGLVVAEGCQPAPAAYAAVVIGGSFDRLLLGHHLFLKAAAELARERIEFGVCDRPMLAKKQYAYLIHPIE

SEQ ID NO: 51070 - protein, 130 aa, Sorghum bicolor
  Clone ID: LIB3480-056-P1-K1-B12.pep
NSAHAARGRARPPTARRRRRRRGRRPRGARRTAARPRRGHTSPGRPGRRRRRRRRSRRRPTARRTRPPGNLARRRTTPTPPATAPRRRTRSSRNRGRTPTAGPRGTSPRTRPHGTRLTNANTAATRNDAS

SEQ ID NO: 51071 - protein, 134 aa, Sorghum bicolor
  unsure (1)..(134): unsure at all Xaa locations
  Clone ID: LIB3480-056-P1-K1-B4.pep
SSSSASSRSSSAPCSSSSRSSCASPSTAPSRSPRPAADPCXPPSSSCSSSPLAPSPSSSTGDASPSSSPAPPPSASLTESRSTSSAGRLSGRLSRSPPTWPRTRPSASPSSASCRRRSGVRAASPRRSGSTRWR

SEQ ID NO: 51072 - protein, 69 aa, Sorghum bicolor
  Clone ID: LIB3480-056-P1-K1-B7.pep
MLGASGGGSDATFLTQVLQNPTMMQMMQNIMSNPQSMNQLLNMNPNVRNMMESNTQMREMIQNPEFLRQ

SEQ ID NO: 51073 - protein, 56 aa, Sorghum bicolor
  Clone ID: LIB3480-056-P1-K1-B8.pep
RDLESCLPESYSSDFVVGTKKKKKRTVFLDMSDGVVVRSRRKIEAQTDNDGYSSES

SEQ ID NO: 51074 - protein, 165 aa, Sorghum bicolor
  Clone ID: LIB3480-056-P1-K1-C12.pep
TSAAHAAPATRPTSRAPRRSARAAGRARPRTHGRSPSTTQTLRTTPPGATPARTRAALAGRPTLLAPLTAPPPAAPTPTATATPRPTPAPAAPRRRRRRHLPTETAATGQLARRRRRRRRRRTTAETRRPWRRRPRRRGRRPRREAAQQPCAAPPGGAPCRKIRR

SEQ ID NO: 51075 - protein, 79 aa, Sorghum bicolor
  Clone ID: LIB3480-056-P1-K1-C4.pep
RHPLFLLLAPVHAGAGRAALSVRRWCLLMAWAGSPSFCAASMLAIHVEFASLELSFVRVVFFFLSPLSARSMLALVRRR

SEQ ID NO: 51076 - protein, 107 aa, Sorghum bicolor
  unsure (1)..(107): unsure at all Xaa locations
  Clone ID: LIB3480-056-P1-K1-C5.pep
TAALVPCYDXPSSPASGPAIEYAESALKRAXLVVIGHCCCGGIKALLSLQDGAPDNFHFVEDRVKIGFPAKMKVLKVFASEPFEDQSYILEKEAEKVSXENLKTYPF

SEQ ID NO: 51077 - protein, 150 aa, Sorghum bicolor
  unsure (1)..(150): unsure at all Xaa locations
  Clone ID: LIB3480-056-P1-K1-C6.pep
AISYINELRGKLTSLESDKXTLASADQRALKKXRVARPPAHAEGLGGLDSGPRCLAEEIDAKILGLEAMIRVQCHXRIHPSARLMSALRELDLDVYHASVSVVXDLMIQQVAVKKASRLYSQDQLNAALYSRLAEPGSALGRYSRRAHLA

SEQ ID NO: 51078 - protein, 97 aa, Sorghum bicolor
  unsure (1)..(97): unsure at all Xaa locations
  Clone ID: LIB3480-056-P1-K1-D10.pep
EGYSLESLFNPPRRHEPVAFSSCLGESSFXDPASFIAIFPLFEXDVWYIVSYYPSXESWYMLCSKSLLSXDVFLKAAFHAHVLLHFIYASHAFLYAR

SEQ ID NO: 51079 - protein, 50 aa, Sorghum bicolor
  Clone ID: LIB3480-056-P1-K1-D12.pep
PSPKKPTSIRISQGLRLRPHHEGDADTAHEQERQEDEVEQEHQLSEGLSA

SEQ ID NO: 51080 - protein, 87 aa, Sorghum bicolor
  Clone ID: LIB3480-056-P1-K1-E2.pep
WSIGRAVLRFHAHARVLATSCTLLSSHLFPVLRPQFFFVRVWDYPGVSLLCRLAALPPLACWRFSLEACAFRPFQLSRCLFGLWVAP

SEQ ID NO: 51081 - protein, 117 aa, Sorghum bicolor
  Clone ID: LIB3480-056-P1-K1-E3.pep
LSAAQSRRRPPPRLHRHLLHGRRRRLCPCVCAAAVVRRLADRGVCGLLLDDYALEELRVAIYLRLDLGGVVSDFRRARARRRVALERFLHHGERLGRRRGHVLSRRRVSSRSSALRA

SEQ ID NO: 51082 - protein, 84 aa, Sorghum bicolor
  unsure (1)..(84): unsure at all Xaa locations
  Clone ID: LIB3480-056-P1-K1-E4.pep
RQGESEQRCRRRSCCGVRCLFGLARCCSDRLAACRCLKSLANCVLSVYMGSVASIPGXCGVSEPFPICMSTDCNKVSLMMKSTT

SEQ ID NO: 51083 - protein, 110 aa, Sorghum bicolor
  Clone ID: LIB3480-056-P1-K1-E5.pep
RTRRRRRAPRPSSTGATPAARSAPPQRRRSTAPPPGDAAALTPAALPTLTTPGSPGTTATPLTTRPPRATRTLTQHHRHEQDRHHDDYGSSGGDDDDDGHRHRNRSRRRS

SEQ ID NO: 51084 - protein, 155 aa, Sorghum bicolor
  Clone ID: LIB3480-056-P1-K1-E6.pep
RTQARRTKARNNKSGRTRTRKTGGEKKRGEQRERLGDRKRAKKKHHNTQHKTPREKERRPGEKTKKGRRGRDPQKENKPQAGKKSRERTEEAPPRKKKEPAPQKRRDHHATEGTEADNQPKTKTKKKKKPKKKKKKKKKKKKKKKKKKKKKKKKR

SEQ ID NO: 51085 - protein, 59 aa, Sorghum bicolor
  Clone ID: LIB3480-056-P1-K1-E7.pep
SLEPSQYRLEIFFMVIAYSIYSLHPVSFNLVSFVRFLVFYLLVDLLVFSVVVVICSFHR

SEQ ID NO: 51086 - protein, 94 aa, Sorghum bicolor
  unsure (1)..(94): unsure at all Xaa locations
  Clone ID: LIB3480-056-P1-K1-E9.pep
DIPPRGLSIEPPPSLGYSTSIQEKFRRVSVLFTAMFXRRRAFLHRFSGVGLDVMVFSEAESNMYDLVSEYQQYQDASAVEEAVFEVVEVGFLVE

SEQ ID NO: 51087 - protein, 76 aa, Sorghum bicolor
  Clone ID: LIB3480-056-P1-K1-F6.pep
CNKGIKRRIKECYMLHPESLYAGICKHQHTTIARKTISHGRELFQSCMQLPTKQTLAYQQLHLNECNNHLLTLKSL

SEQ ID NO: 51088 - protein, 104 aa, Sorghum bicolor
  Clone ID: LIB3480-056-P1-K1-G10.pep
VTNLVNLKKRGGRFLGEEFKRGRQGVFLVFWGGTRLVLGARSFYVGFGKKGRWPQSLGPGDMPVWERGGFLIGGLMGGPPKKAPLFWGLGWAPFRGFFLGGGGG

SEQ ID NO: 51089 - protein, 60 aa, Sorghum bicolor
  Clone ID: LIB3480-056-P1-K1-G12.pep
ASTMPIYLSQAVSPSKIFLKLKSRYVSQRNPTFKKSYSSSYKIETDSFQESGSQEQENVS

SEQ ID NO: 51090 - protein, 150 aa, Sorghum bicolor
  unsure (1)..(150): unsure at all Xaa locations
  Clone ID: LIB3480-056-P1-K1-G6.pep
ELCRFSFIELCPSSGVLFFAQRLFEGLXAFRRPVRSGFSLFRPEVFARRLLLGAVRLCMPAPSVVLFVLAVLLSVLAFRRWVPPLGXGALFLRPLLMGCGPFLGLAPAPEYSFLVYAAPVGFYFXEGLAPIFLVVLVEFLRAMPGGSGGV

SEQ ID NO: 51091 - protein, 89 aa, Sorghum bicolor
  unsure (1)..(89): unsure at all Xaa locations
  Clone ID: LIB3480-056-P1-K1-H10.pep
PSGAGPVVFSSACGYLDVXRAPFFCLGACGFLPFFLVSLGCGSCFEILCVXPAECSGVAVVVLFSVLFFVLFAAFLLDLAGSAFGALAL

SEQ ID NO: 51092 - protein, 93 aa, Sorghum bicolor
  unsure (1)..(93): unsure at all Xaa locations
  Clone ID: LIB3480-056-P1-K1-H2.pep
VSFLSGVIVIVCSLPVPPLPVFASHLGLLLDSAXGTDVSFVVGGVEFHAHRAELAARSPVLXAELFGAMAVAAMPSFTLLDFEPAAFRVMLQF

SEQ ID NO: 51093 - protein, 76 aa, Sorghum bicolor
  Clone ID: LIB3480-056-P1-K1-H3.pep
RRLHPLARCHDGRRPYAKLLRRRLRLRRRRPRHQLEPEHPDPTTPNHHPPSHTLTQPPGNARPKAGANGGRRRTLG

SEQ ID NO: 51094 - protein, 105 aa, Sorghum bicolor
  Clone ID: LIB3480-056-P1-K1-H5.pep
NLNPRACQKLSSTETTSENMLQYLENTLIILGRNAPPYLSETQATSSTFRSRGAVGEGVDRRRGGLRSDPGLEEGGGRLQIKILPPLTSKEPPPPSHDNGSFAVS

SEQ ID NO: 51095 - protein, 75 aa, Sorghum bicolor
  unsure (1)..(75): unsure at all Xaa locations
  Clone ID: LIB3480-056-P1-K1-H9.pep
RVFMTTYRXWGLRXWVPVRAGSFICVYAGEVIDVLRVNLKDSEDDYIFQTVCPGEISLIRFSGPVMLGVVSSFVS

SEQ ID NO: 51096 - protein, 117 aa, Sorghum bicolor
  Clone ID: LIB3480-057-P1-K1-A10.pep
HPGAVGPKRDGGHGHAVLARHVPRVRHQNVGPRVAPAGAADQHRARVLPAQRVVEQEVQVGGLLVAGVGGGGSEVDGDEQYGYEAEHGWRSGHGVRVFSSWIGLELDLVCVEITRNR

SEQ ID NO: 51097 - protein, 70 aa, Sorghum bicolor
  Clone ID: LIB3480-057-P1-K1-A12.pep
APIPTHHQIQRATPTQPTGPHHAFRTCVLYQNLLRAARSARRREFACRPADRARRRRHEGAMTGQGAAPR

SEQ ID NO: 51098 - protein, 79 aa, Sorghum bicolor
  unsure (1)..(79): unsure at all Xaa locations
  Clone ID: LIB3480-057-P1-K1-A4.pep
GTAIMLTLRQPRTCASVTVTTSREPLLRSXEQXXYISCHARPEHYACADEYKTCRTTTLRCEQGQWGSPLSGVLTRDVR

SEQ ID NO: 51099 - protein, 133 aa, Sorghum bicolor
  unsure (1)..(133): unsure at all Xaa locations
  Clone ID: LIB3480-057-P1-K1-B11.pep
ETGTFSKKFQGGASSTKTDQAKAPSKLSSAFSGTQDKCAACQKTVYPLEKMTLEGESYHKSCFKCSHXGCILTTSSYAXLNGILYCKIHFSQLFKEKGSYNHLIQTAQTKKNEAAEAAPEAPADASAAEPEAA

SEQ ID NO: 51100 - protein, 135 aa, Sorghum bicolor
  Clone ID: LIB3480-057-P1-K1-C5.pep
MAPRRVRQRDHRPRQRPWVRPDAARQGHGAAGHVRAQELQPGAETVAPRAGGGVRGHPARLLRRRAEPVPRQGDHPHRRARPRAPLGEQAGEGPGADDGRGRGGLRRRPGQDRRGRHGALRGGVRRDGTAQGLDG

SEQ ID NO: 51101 - protein, 61 aa, Sorghum bicolor
  Clone ID: LIB3480-057-P1-K1-E3.pep
STAAQSDDTDSVRTFARTHRYRCSVEEPNLISMATIKQHSRLPVDHGPLQDGPSTRLRHLW

SEQ ID NO: 51102 - protein, 126 aa, Sorghum bicolor
  Clone ID: LIB3480-057-P1-K1-E9.pep
MAFHRTMTRCLWAGKNAGAAIPKPPAPHPPARRSVPAVDDCPTLAFLRPKPTAVGYATATVPLPAHCFPALPVGDHLFHRHGAVLRGLLPEPLRVQAAPSHAGARLRRPPLQRPAETAGAPSSRRP

SEQ ID NO: 51103 - protein, 128 aa, Sorghum bicolor
  unsure (1)..(128): unsure at all Xaa locations
  Clone ID: LIB3480-057-P1-K1-F9.pep
MAERLLCMEHPWVSAFGILGNIISFLVFLAPVPTLLRVYRKKSTEGFSSVPYVVALIRCTLWILYAVVKTNSSPLLTINAFGCVVEATYILLYLIYAPRAVRLRALAIFXLLDVAALALIVVVVVVLV

SEQ ID NO: 51104 - protein, 87 aa, Sorghum bicolor
  Clone ID: LIB3480-057-P1-K1-H2.pep
GSCNKNHVMFQLPSCVAIGKQVDMVRSTEHYKANRLKFCTASQGCGQNGIGTAFYCHALQNLSDGGGDGHRHHHVHLEILLAQSHQA

SEQ ID NO: 51105 - protein, 38 aa, Sorghum bicolor
  Clone ID: LIB3480-057-P1-K1-H9.pep
YIEKVSVSVIVMPPPTGSSEVFHVDVSARVLIKILNVR

SEQ ID NO: 51106 - protein, 35 aa, Sorghum bicolor
  unsure (1)..(35): unsure at all Xaa locations
  Clone ID: LIB3480-058-Q6-K1-A11.pep
VHRASELSLSRPIRRSFPRMLAKVSLALLARPLAX

SEQ ID NO: 51107 - protein, 73 aa, Sorghum bicolor
  unsure (1)..(73): unsure at all Xaa locations
  Clone ID: LIB3480-058-Q6-K1-A5.pep
HASERELERGRQQPXMDXXXAXXXXANQREXKENXPXXXIGRXXXXEXXRIXXISAYCVLVFYLDRPCSIILL

SEQ ID NO: 51108 - protein, 43 aa, Sorghum bicolor
  Clone ID: LIB3480-058-Q6-K1-A7.pep
AAGLCLVVCDVSAVELLSVHALGGGSHRLVSLEGVEAPFTTLC

SEQ ID NO: 51109 - protein, 114 aa, Sorghum bicolor
  Clone ID: LIB3480-058-Q6-K1-B9.pep
RCSLYRSACALRSRPRSFMSSVWGPSPFPLRISPCFGPRSFWPPSPYPPLGAWGYQELPCCCHLPEFCQALACLLAVRLVACVLPCVLADQLTHAADLGGACEGHPLVVGASPP

SEQ ID NO: 51110 - protein, 100 aa, Sorghum bicolor
  Clone ID: LIB3480-058-Q6-K1-C5.pep
DMESCFGLSVRKDKFVIGTTLYQSCVYFRITSMASSIERICYVSLCFPSRGRVRRCSTLGWEEPLRRMCLLMLMVVSRHPRAKWISTVSCYCAAMMGGSS

SEQ ID NO: 51111 - protein, 177 aa, Sorghum bicolor
  unsure (1)..(177): unsure at all Xaa locations
  Clone ID: LIB3480-058-Q6-K1-D12.pep
RRETEAQGHEAHIIGTEHGCRWVSASTMNKCRRPHRGXVEAVHPARKEPARITIGETXAMQRWTYLQTELDGACYKDLKRLQENGRKTTLLVLDMEPAYSTVEMLRKLPQEVDKTGTANPKTANAAATGNAKTANTPTSSDDRYTDAHLMRIASNVFTYIGMASETPRNTIPNSWVH

SEQ ID NO: 51112 - protein, 134 aa, Sorghum bicolor
  unsure (1)..(134): unsure at all Xaa locations
  Clone ID: LIB3480-058-Q6-K1-D2.pep
GDELLSVNGIDVRGKSAFDASFMLQGTKETFVTIKAKHRDCGPVESMKVHRQLVVRTAVFYRLDKRENDDSSVGYIHITEFNALVKKDLXLKRLQNSGTCYFFLDSRDNLVGSVQARIEIAKLFLNKGHTAILY

SEQ ID NO: 51113 - protein, 102 aa, Sorghum bicolor
  Clone ID: LIB3480-058-Q6-K1-D3.pep
EWSGSIPLSPHAPPVSSGDELLARAAGLVSSASFAPGGLAPPVSQGPAFVSMVGRTKDGPLVRRCCGRVLLPCRSHATLRSTAHRGRRLGRGRLWQLSSTYA

SEQ ID NO: 51114 - protein, 117 aa, Sorghum bicolor
  Clone ID: LIB3480-058-Q6-K1-D6.pep
RRGKTIDQQVLIHGRWRKAIDHGVEVGDDQIRAGSQRLWQVPRAAGRATGSSRPWPLACSLPHADTFPQRHLLVTTGTVIAAEAAIVGISISQLVACTHQSIVRTGFLLVTFSRLLR

SEQ ID NO: 51115 - protein, 140 aa, Sorghum bicolor
  Clone ID: LIB3480-058-Q6-K1-D8.pep
ASNKSEASPSEAPASGSGAASPSESGASEKAPTGAPTDASASPSASPSGDEAAASPDSSSSAASEEPSASSESSGAAEEPSTAESGGASADSPPEPAHASDSPAESPGPAADHEGGSSSLGAGVGAAVLAVAAASVMLSF

SEQ ID NO: 51116 - protein, 140 aa, Sorghum bicolor
  Clone ID: LIB3480-058-Q6-K1-E1.pep
MGPVTAFSAYSARSFATYSRWNSDTHSSSGSSTTTDTSPSMSALVVATRSSVLSRSTKRTTVSLTDSFLARRQATATASRSSGPPRKTAATWVVTFSSPWLLVSILIGSWKLVPLLRNGRSARMAVVHGACSSTLRLSWR

SEQ ID NO: 51117 - protein, 61 aa, Sorghum bicolor
  Clone ID: LIB3480-058-Q6-K1-E10.pep
ISWAETWRPRSIHVLKLEESSLLLLFPFLLFLSLFGMRAIIREAIVVTTIFYTNFSHYNYS

SEQ ID NO: 51118 - protein, 179 aa, Sorghum bicolor
  unsure (1)..(179): unsure at all Xaa locations
  Clone ID: LIB3480-058-Q6-K1-E5.pep
DTDYNDDASIGTKINRRKPNRGLVGDEKRGRSECPGCRRPFQPYQALGVHRASHKRINSNCXSPRPSFDHQPEQSVETNTSWFSTGSPDPNYGGADIAPTAVVALKAKPHKPIKFECPICFRVFGSGQALGGHKRSHSIAGELYERAHAVEDDGMGDDEQPLVSDGFLDLNLPAPGVED

SEQ ID NO: 51119 - protein, 116 aa, Sorghum bicolor
  unsure (1)..(116): unsure at all Xaa locations
  Clone ID: LIB3480-058-Q6-K1-E7.pep
DTGGVPFPFPAAPLLXRAVGLGLFAFSPSGAGGLFCLVLWFGPGRVFPVVSLXSPGPWFXFRGPLFGWFSSPARXRWFGSFCPAAPLFFCLFSPSLLSFSSLLSFLVLVFLFLLFF

SEQ ID NO: 51120 - protein, 84 aa, Sorghum bicolor
  Clone ID: LIB3480-058-Q6-K1-F2.pep
HGIWTSHGTPPHLYFNDWYGALCVWCPLRQWHLPSALIASPPYSVACLCSLAANVKWCFNLVQTKMCCHIPFKTVPMAPAIFSF

SEQ ID NO: 51121 - protein, 48 aa, Sorghum bicolor
  Clone ID: LIB3480-058-Q6-K1-G10.pep
NNDLTKLNGFSRQRIYARGCISGHDLSMPSSQNTSQTRTTNGTPPGTA

SEQ ID NO: 51122 - protein, 66 aa, Sorghum bicolor
  Clone ID: LIB3480-058-Q6-K1-H4.pep
EESKIVCNVYWTVMSLGKPELLTYLWLNSANVIGRVLHSCRDVEYIADHFYHEQSHHHVLSIALQR

SEQ ID NO: 51123 - protein, 69 aa, Sorghum bicolor
  unsure (1)..(69): unsure at all Xaa locations
  Clone ID: LIB3480-058-Q6-K1-H9.pep
PRREQXXKETGXXNKSXQXQXPAEXXPEKGAXEXTRXPSKAARXXXGTQDKXAXGRKTAXPXEKGTXEE

SEQ ID NO: 51124 - protein, 50 aa, Sorghum bicolor
  Clone ID: LIB3480-059-Q6-K1-A8.pep
LMASGRSLCSLLHLLASPYFFSFLLPHVLFCWNNLHGREGGQHEIMDILH

SEQ ID NO: 51125 - protein, 129 aa, Sorghum bicolor
  Clone ID: LIB3480-059-Q6-K1-B11.pep
SSARPLDPDGGGGGSPSSHTGAAPWIPPTATPRSRRRQLPKVARGGSRVFPELAPGGPSSSCSSSSARPLDPYGGGGSPSSHTGAALWIPATAAPKSRPWRLPKVAHGVCRISIELAPGPFLCCKTEDP

SEQ ID NO: 51126 - protein, 101 aa, Sorghum bicolor
  Clone ID: LIB3480-059-Q6-K1-B7.pep
NLFTTTAKRFLAVAAPNITKHVLLQIEYFVEAGSQTSLPRNPKQHEPATENRKKENKKTHQRRPQARPPCPTDKTTSKKNQGTSENCFLVENSVRLVVYLN

SEQ ID NO: 51127 - protein, 178 aa, Sorghum bicolor
  unsure (1)..(178): unsure at all Xaa locations
  Clone ID: LIB3480-059-Q6-K1-C1.pep
VLLCCKNGXHRSLPHVYYLPRLTANIMCVGQPDEGGYXIRVKDGVMLVRDEEMRLLARIPCVPGRLYVLDATIARPVCLAARDVEDAWVWHARFGHVNFATLRKMARDELVRRLPLLNQVEQLCDACMAGKQRRTPFPXKALKRYTEALQLLHGDLCGPISPXTPSGNRYFLLLVDDY

SEQ ID NO: 51128 - protein, 154 aa, Sorghum bicolor
  unsure (1)..(154): unsure at all Xaa locations
  Clone ID: LIB3480-059-Q6-K1-C2.pep
DAGHEREDGPRPHNNYPARRTGNTKPDEQTGERSYNNPAKDGKPARDEEKRTPARRSVPGETVSDATTARPXXRAESDXEDASTWHARYRHVNYTTLGRWHVTKLVXRLPMLNQQGQLYDARMAGKQRRPPFPXKGIXRSTDALQLLHGDLCGP

SEQ ID NO: 51129 - protein, 91 aa, Sorghum bicolor
  unsure (1)..(91): unsure at all Xaa locations
  Clone ID: LIB3480-059-Q6-K1-C3.pep
LAAPLLGASLSPFRLRPCWXAXSVRAFSXFRRLAXVGCVAXPXSWVAPVFSLXXRCXXSARVLFXGVAVPALCRRMLAVRLAPLARPLAVW

SEQ ID NO: 51130 - protein, 99 aa, Sorghum bicolor
  unsure (1)..(99): unsure at all Xaa locations
  Clone ID: LIB3480-059-Q6-K1-D10.pep
VNIYSLFLYHIIACLDVARFYFCCLYIKKNDERETPRNDCLLVCXSLLLSVXCCPVXXAFLVSGXFLSVWPVVAVSGAXXPGPVDGLPFFRVCVQVRSD

SEQ ID NO: 51131 - protein, 62 aa, Sorghum bicolor
  Clone ID: LIB3480-059-Q6-K1-D12.pep
KTKKKKQTHPLKGRLDRNIAGLAVAALCARHTSQTPMENADLDDAHAPAVQTHVATNNFYSL

SEQ ID NO: 51132 - protein, 128 aa, Sorghum bicolor
  unsure (1)..(128): unsure at all Xaa locations
  Clone ID: LIB3480-059-Q6-K1-D4.pep
VFXFLFCXLGLCWCLXXXXFGFLWFFXXXVFRFLFCCWFLVLXPLFLPLLAFLLLVXLXXXLLVLLLLLLLLVLXXPLLXXLXXAPFLXXGXRLXAPXPLAPXRXXGLXVARRXALXGXVVXGRVVRL

SEQ ID NO: 51133 - protein, 58 aa, Sorghum bicolor
  Clone ID: LIB3480-059-Q6-K1-E8.pep
FKYYSVLLSCPVRLMALVRDCRIIFFLCDIITVLSLLVILQPCDIPASHINHSSLFLQ

SEQ ID NO: 51134 - protein, 37 aa, Sorghum bicolor
  Clone ID: LIB3480-059-Q6-K1-F12.pep
SFARGYKLTKFTSRCVKYSLNTTPSSSQKSSNNSDAW

SEQ ID NO: 51135 - protein, 60 aa, Sorghum bicolor
  Clone ID: LIB3480-059-Q6-K1-F2.pep
QRDYSGSQIQCTGRPSTTPGLEKPGRYPTEAARRTYHFSQMTSERRGHYRSAHQTAAQPE

SEQ ID NO: 51136 - protein, 79 aa, Sorghum bicolor
  unsure (1)..(79): unsure at all Xaa locations
  Clone ID: LIB3480-059-Q6-K1-F6.pep
FLVLISLLALYVIVPSIIALFQKRYYCCNNVMYVEKISMCNFYSVQKQRHLKHQLAVHTFTRXRXAVYSDAXFVLFLPC

SEQ ID NO: 51137 - protein, 66 aa, Sorghum bicolor
  Clone ID: LIB3480-059-Q6-K1-G11.pep
HSTTVQLLVVKSQPDGLETVLFLLPETISYVAPANMSDILPWTKMGDQTNHICTFHASDRLLSSSQ

SEQ ID NO: 51138 - protein, 165 aa, Sorghum bicolor
  Clone ID: LIB3480-059-Q6-K1-H10.pep
ITLYEQSSEFLPTLGKLPHLLELSVQWMRGVRHISKEFCGQGDTKGFPSLKDLEFENMPTWVEWSGVDDGDFSCLHELRIKECFELRHLPRPLSASLSKLVIKNCDKLVRLPHLPNLSSLVLKGKLNEELFSDLNLPLLRALKVSLSHNIEYVILSQNLPLLEIL

SEQ ID NO: 51139 - protein, 154 aa, Sorghum bicolor
  unsure (1)..(154): unsure at all Xaa locations
  Clone ID: LIB3480-060-Q6-K1-A12.pep
SRXLCLFCSALFCXXSFALRXLXAXGVXXXVXXXALFFVGLCXXXLSRCCXXFXFXLAGWXXSVSXLCXXFRLGVLXAPWSALXXLXSCLAPCPVCXXFXCRFCXGSRWGXFLXXGXVALXXASXSLLCXVLLXGXXXALVCAALXSXSXPWXA

SEQ ID NO: 51140 - protein, 110 aa, Sorghum bicolor
  unsure (1)..(110): unsure at all Xaa locations
  Clone ID: LIB3480-060-Q6-K1-A5.pep
DAADAXKGXAXDTXHKHXGDXGATGXXTPXQGAXAKEQHGKXHAQAXPXAXAXXEADNHTDHDXGTAPGRXDGNXXPAXXEEARKDTXXETXXPEGDQEXXRPXRKQQXK

SEQ ID NO: 51141 - protein, 68 aa, Sorghum bicolor
  unsure (1)..(68): unsure at all Xaa locations
  Clone ID: LIB3480-060-Q6-K1-A6.pep
DAPGSGAXSAAGEGDTRSXTATRASAXAPXXXAXSPXQPATXAGXPRQAQXRGRPXGXRXRAXRHXDP

SEQ ID NO: 51142 - protein, 103 aa, Sorghum bicolor
  unsure (1)..(103): unsure at all Xaa locations
  Clone ID: LIB3480-060-Q6-K1-A8.pep
GDQQEESTNGRNKSDXHREPTRPDGNRRTNAHXNNPGADAXSTPAPAPDGTDGAEEERAGQATDPRDESEDHKNXHERHTXEAKEPPREATKQDTGTAGRTHT

SEQ ID NO: 51143 - protein, 95 aa, Sorghum bicolor
  unsure (1)..(95): unsure at all Xaa locations
  Clone ID: LIB3480-060-Q6-K1-B10.pep
LWFCAACPRXXRWSSSPXCVLXCSSXLSXSXCLXXAALAACGASLXLPCGLAGRWLSALPSFWLRPSPARSLRALCLVAVLARSLAPAPPGCCPS

SEQ ID NO: 51144 - protein, 191 aa, Sorghum bicolor
  Clone ID: LIB3480-060-Q6-K1-B12.pep
GERSNIEEVIAKYAQLTPQERAKRKLESLEALKKTFKKLDHDVNIQDFLGSGGQTVEELSGHLGSLQCQMAEVQKRLSYWSDPEKVENIDHIRAMEQSLKESLNRIQIHKENFAKQHLIGLQCAAAQFQTDMQLPLGLTGEPGPSSWFQNGGADGQQAMMLPDDSSLLHQRDIAGCSTSTSLPGYPGYFSM

SEQ ID NO: 51145 - protein, 64 aa, Sorghum bicolor
  Clone ID: LIB3480-060-Q6-K1-B8.pep
QLVICVSLKLATAAGAPKQCPLAKAALFLFCSSLSFVFFFWVTSWDTMMEIHHYIWHTIHFEMA

SEQ ID NO: 51146 - protein, 114 aa, Sorghum bicolor
  unsure (1)..(114): unsure at all Xaa locations
  Clone ID: LIB3480-060-Q6-K1-C11.pep
AAIKVSIRFQSSRFFCSQPVPLALVLPLCLCTIACPSPLCVLLCVAVSSGLSRGGVLLVWLCHLLYYSRGQQQYRCPLLSANLGVPLGSRVAQCVVPYGSHSFVSRLXVCDLEL

SEQ ID NO: 51147 - protein, 122 aa, Sorghum bicolor
  unsure (1)..(122): unsure at all Xaa locations
  Clone ID: LIB3480-060-Q6-K1-C4.pep
KSFLSPPLCRPPFAAFVDTPISVGKISLRTLIERSVIEIFGAGVKMCVLSRVYPLIAMGKSACXRCSAWANGRSXVRVSLLWEINQPLMNGALSIARIELPLCPFHIIMMFSGGKLSANCTW

SEQ ID NO: 51148 - protein, 179 aa, Sorghum bicolor
  unsure (1)..(179): unsure at all Xaa locations
  Clone ID: LIB3480-060-Q6-K1-C6.pep
IAQGTQWITLIQALAAKPGGPPHVRITGIDDPVSEYARGEGLDLVGKMLKSMSEEFRIPLEFTPLPGIYATQVTKEMLDIRPGEALAVNFTLQLHHTPDESVDVSNPRDGLLXDGERSVSKGDHTCGAGVAHQHDPVPDAVHRDLGLLLGHVRVDRCXTCHGKTRSGSMWSSTASPRTL

SEQ ID NO: 51149 - protein, 58 aa, Sorghum bicolor
  Clone ID: LIB3480-060-Q6-K1-C7.pep
IGSLTTMTRCVHVEVVPLPTVKVTLLPRIPTAVHPATPAIVSRKEAEDGIRHLISHYE

SEQ ID NO: 51150 - protein, 143 aa, Sorghum bicolor
  unsure (1)..(143): unsure at all Xaa locations
  Clone ID: LIB3480-060-Q6-K1-C8.pep
RPAAPWCVRLXRVXXVGPPLVXPVRCVCLWSXPXVRVGGGXXGCXGGWLVLFXCPCWVCVRGVRVRXGLXLFSWVPFAFPVLSXWCPGCXSXCAGCACXXGFCAAAVCVFVXGRWPLASFARLCXPSXVRXXSPLWFCCGXXX

SEQ ID NO: 51151 - protein, 193 aa, Sorghum bicolor
  Clone ID: LIB3480-060-Q6-K1-D1.pep
LVNFSFAFNFFNSEAAVCMPSDKALVNLDDRDNCLGALRPAQKTALQCAPVLARPVDCSKHVCAGYPTPGGPPSSEKPPSVPEKPPSVPAKPAAPAPMPTPHTPPDVSPEPLPEPSPAPAPAPMPVATPKTPPADDYVPTPPVPEKSAPPPKSVPETPERPKEPPPEVKPPVVASPPPAPVKSSSPPAPVASP

SEQ ID NO: 51152 - protein, 102 aa, Sorghum bicolor
  unsure (1)..(102): unsure at all Xaa locations
  Clone ID: LIB3480-060-Q6-K1-D6.pep
WFCPRLAXGCLCGCLAWFPRGXLASGRXXSXGRXLGGLCFXPVXFCLPGCGRXFPLWXGSCGXRXRVLCSASXLRCLRSWLVGRGRPFCCFFFFSFFFFFFF

SEQ ID NO: 51153 - protein, 192 aa, Sorghum bicolor
  unsure (1)..(192): unsure at all Xaa locations
  Clone ID: LIB3480-060-Q6-K1-E2.pep
IIAENXPEDSSRNSLEKIFGVVGSVKNIKICHPQEPSTARASKSDTLVSNKMHALVEYETSQQAEKAVEKLNDERNWRKGLRVRTVLRRSPKSVMRLKRADFDHFVGSDDDSPHSSQMSSDSPTADYSAAEAAAAAAAAAAAHAHAHVQQHQEDQQQQQNNGGSKQKGWARGRRTTKLHITAPQSPQSASAG

SEQ ID NO: 51154 - protein, 114 aa, Sorghum bicolor
  unsure (1)..(114): unsure at all Xaa locations
  Clone ID: LIB3480-060-Q6-K1-E8.pep
RSALPLPVGRVAAAAVSSGGAVAAGGPAPGRLASVFGXVRSXRLLLALPLPSVLRSXFSVVVGPARSAAGFPVXLAVLFPGLFGPPSASLVPAAEPAAXGPLXVGVVLSGGQAP

SEQ ID NO: 51155 - protein, 145 aa, Sorghum bicolor
  unsure (1)..(145): unsure at all Xaa locations
  Clone ID: LIB3480-060-Q6-K1-F3.pep
VPPVAPCFVLVPLGGGLXXSLGPSGRLSLLLFLWVAWLAPVLLLVRXGXWCRCLWGPRFPVAXVLLVRCLCASXWLVPLLXGVLSCVPLVRFVCGVXCALDXGCXFGLCLCCVVPLGLRPSLPLAAFXRGARPRGARCRAVLCSL

SEQ ID NO: 51156 - protein, 162 aa, Sorghum bicolor
  Clone ID: LIB3480-060-Q6-K1-G10.pep
NCPKGRYPFCFPSVIRSSSLASQAKQSHEEKSSIERSARAYTIHVRQPASHWGPSQNVCTTPPTLPRIYSTIPASMYVQASSILRLQYSNLLRTKAQKELVRSDRLELRRELRRGGRLRRGLRQRWLVKVLEMAPHVEPLAFREVLVGWRRDVGRPGHLREH

SEQ ID NO: 51157 - protein, 114 aa, Sorghum bicolor
  unsure (1)..(114): unsure at all Xaa locations
  Clone ID: LIB3480-060-Q6-K1-G6.pep
HASAGRGFQTHERKARNRENTKRGAAKNKNTGRRKTTRGTGKTRGGTQPKRRAAQTXXTSRRKTQQGRTERPXQQXNTPXGQRDAPQSGAESTTGGETTHSATATPARAQAPTP

SEQ ID NO: 51158 - protein, 118 aa, Sorghum bicolor
  unsure (1)..(118): unsure at all Xaa locations
  Clone ID: LIB3480-060-Q6-K1-G9.pep
PGGVFPGPVCCXVWXXXPLLXXXSLXXCRAFPGARXGXXFXLVLRLPLLXGFXXXXXVLXXGGVAGLXRFGXVLRPAALRRVVLLXAVVPGGGXRGGGXXXPARGXGGXXXXAAXRVG

SEQ ID NO: 51159 - protein, 55 aa, Sorghum bicolor
  Clone ID: LIB3480-060-Q6-K1-H7.pep
TTHAENNAPEVACGMPSDLQKRGGVLDFQIQLFTIYHTILVISMICDWGHDRDLV

SEQ ID NO: 51160 - protein, 149 aa, Sorghum bicolor
  unsure (1)..(149): unsure at all Xaa locations
  Clone ID: LIB3480-061-Q6-K1-A1.pep
GKRTXEXXTXXXHXXXXXEGRXARXXNTXGXXXXXEEGRXXSNXXAQXXRKQPXTXXXXGKQXRXXQXXXEXXXGXGTXXESDXXGXXNXGXPXEXTXXEXAQXGKETXDPXXXXEXKPNXAEEPHXRKXDXXKAKXXLXXEPKXXLKQ

SEQ ID NO: 51161 - protein, 97 aa, Sorghum bicolor
  Clone ID: LIB3480-061-Q6-K1-A11.pep
PPLYSLPAGHRSSWRDREYRAKLRKPMGLLAELLRTTCTSRLWGHTEEGRTDRSSQQTVSLNGDMARSLYYPLNHTTVLVTRTMTSSLTSALAATPF

SEQ ID NO: 51162 - protein, 116 aa, Sorghum bicolor
  Clone ID: LIB3480-061-Q6-K1-A7.pep
SGSSSTQSPSANDHTSLIAQCSTNYHQVLTRRFNSHGERVSANRRCHKLHAHNGPDVMLALDDPRQEIYRLRVMNSIIQASMTYDALPLLYAEGGGGFPHAGRLLRLTRLPRACLP

SEQ ID NO: 51163 - protein, 122 aa, Sorghum bicolor
  unsure (1)..(122): unsure at all Xaa locations
  Clone ID: LIB3480-061-Q6-K1-B4.pep
ITSLVPSICNAVKAEFLSQFAQYRQVPGLSILDTCFNMTGLREVQVPSLKLVFSAGVKVXVYSGSVLYFVSRYSSQVCLAMAPLKSECXTNIFGNYQQKSLRVIFDTSGSQVGFAQETCGYI

SEQ ID NO: 51164 - protein, 69 aa, Sorghum bicolor
  Clone ID: LIB3480-061-Q6-K1-C9.pep
YRLVEKEQPDGMMAKKIRPYLMDLDSTNGTFINGNRIEPRRYYELFEKDTLKFGNSSREYVLLHENSTE

SEQ ID NO: 51165 - protein, 103 aa, Sorghum bicolor
  Clone ID: LIB3480-061-Q6-K1-D12.pep
TWRDQLANQLSANGAHKIFGESTTPDRPVVVSEARRGHQVSCLGARTRQPPNSSASSLTAIAAARRAGAMASHFPSSADAPSRLLGSITGTLTNHSTDRSRSP

SEQ ID NO: 51166 - protein, 61 aa, Sorghum bicolor
  unsure (1)..(61): unsure at all Xaa locations
  Clone ID: LIB3480-061-Q6-K1-D3.pep
YLFMIGTSCPLFVVEGFKVDYFAFIALDAELMSDEKCXDWFGQYVFHFGKEQYIFFCYGDG

SEQ ID NO: 51167 - protein, 88 aa, Sorghum bicolor
  Clone ID: LIB3480-061-Q6-K1-D4.pep
MVSKFAFSALVLLMAVCGELGHAVPLRRGLSLGWMNGMKGGAPGGMQPSDTKLLAGVGKEANVYKRADEAKFIGAVPAFVRPPRIPPS

SEQ ID NO: 51168 - protein, 128 aa, Sorghum bicolor
  unsure (1)..(128): unsure at all Xaa locations
  Clone ID: LIB3480-061-Q6-K1-D8.pep
XPGPLXXGSXXWXRAXLXSAFXASXSSXVXRXPLXXXXXXXFVSXXXXXXPXXXSPXXFXXXLLLLGFLRXXXRFPXLXXXXLXXLSXXFSVLXXXFXSLGXXFXVXLVXXFSFPPWXXXLLLCFPVC

SEQ ID NO: 51169 - protein, 121 aa, Sorghum bicolor
  unsure (1)..(121): unsure at all Xaa locations
  Clone ID: LIB3480-061-Q6-K1-E8.pep
NKKPKKAARQNIARRQEERPRTAKEKRARAXGATKKEXGRAKEXXAKQPEGETGQXTETGTXXAGDXXRRXRXTXGRNXQAXKAAQEAXQRXEEAAXRRSPNPXAAAGNEKRTQXXEDKKP

SEQ ID NO: 51170 - protein, 148 aa, Sorghum bicolor
  Clone ID: LIB3480-061-Q6-K1-F6.pep
SLCVDFSNSGFMSHPVITAAPLVTLGVAHILFVRCLRVQDRWADIPLLTVAIFLMSMHHSFCQVLCDQFVDGPLVPSSFFLLWWWRLWWLLLVLSIPSIWCVRVPAWFFSRASMSISVGSVRMPLIASLGQWCGCCMVMVSSMMWLSA

SEQ ID NO: 51171 - protein, 132 aa, Sorghum bicolor
  unsure (1)..(132): unsure at all Xaa locations
  Clone ID: LIB3480-061-Q6-K1-F7.pep
RRSTEREKQARQPASRPTSKPPPPPPXPXPPPPPQERRGXEXEXPXXPWAXPPXRAPRXWPPPRPPPVPPPVAPPRLPPKCPPPAPRPPVVPPQQGAPPPPGGPAQPGXRPASPAAPPTAGCFFSLPGYYLH

SEQ ID NO: 51172 - protein, 58 aa, Sorghum bicolor
  Clone ID: LIB3480-061-Q6-K1-G6.pep
RTHLSPCSLVYPIWCLSHALCSTYCSYSRSPKTLPWIENLTCTHPHTTPCTTMVLSHS

SEQ ID NO: 51173 - protein, 100 aa, Sorghum bicolor
  Clone ID: LIB3481-057-Q6-K1-D4.pep
MPPYKKRHTPKKESAPTPKKTGEPPRIYRGPKTVKTPGTPTKPTKSPQQKIIPPHTPHIINRVHFKKFFPFFFFYFFFFFFFFFFFFFFFFFFFFFFFFF

SEQ ID NO: 51174 - protein, 130 aa, Sorghum bicolor
  Clone ID: LIB3481-057-Q6-K1-D5.pep
VIQSWHGTCILGEKVKAYTVLMALCMVILFSCNAVEGGAYMRHEALSRKGLKEQRKLATISGLNPSVSNLSGQASSNVNGVNNNNSESTNTNMPDAGTAYTPMTSTTTDSHHDLSVDQYRRITHNNENKP

SEQ ID NO: 51175 - protein, 157 aa, Sorghum bicolor
  unsure (1)..(157): unsure at all Xaa locations
  Clone ID: LIB3481-057-Q6-K1-E1.pep
VRRPTPPPCASCPAAPCCHRPRRATATRRRPETSPSSSSSSSRRQFGDIAVLNNALXTEEPTIDSARVGTAQGFGVRVSEGGVVSHVTVHLVLDAGEHRGXSVTVSSRIDVEEKVRESVVVGDTGRCRFARGYVITRNYNYDLGHGGVAEFDVYLLN

SEQ ID NO: 51176 - protein, 82 aa, Sorghum bicolor
  Clone ID: LIB3481-057-Q6-K1-E4.pep
LMSDRFMNIEFANAFFPPNIYLNIYKLPTPLLIYMHLETNDMSMLKLEHYKESVCSFSILLESMLVPVYCCDLFLSLISCAT

SEQ ID NO: 51177 - protein, 58 aa, Sorghum bicolor
  Clone ID: LIB3481-057-Q6-K1-H3.pep
IDSSSLSILSWLSRQEFITVTTDKLLSPHSQHKALFSSQNFSRFPVIYDMNLLSLVTP

SEQ ID NO: 51178 - protein, 62 aa, Sorghum bicolor
  Clone ID: LIB3481-058-Q6-K1-C2.pep
HASSTAVTLCYCCTGNLCVRQSPCQVRLSPMLLLTVPSFGAAPISFLQPAVASAFFVHSSVF

SEQ ID NO: 51179 - protein, 105 aa, Sorghum bicolor
  Clone ID: LIB3481-058-Q6-K1-C6.pep
AALASRVGTGSQDKAHATFCSLQRCQTAAEEGALLHLNLQPRFATVEPRFAALPLRLRRRSSTAAARPNTALRYPSTHALNLNHSMHCIDRSTSTHPLICIYLNC

SEQ ID NO: 51180 - protein, 109 aa, Sorghum bicolor
  Clone ID: LIB3481-058-Q6-K1-E6.pep
RIPAFNKELFPYYLGYCQAESSVPYDDSMNLRNVLWLAPLPSNETKAWLAPGALVVLDAHPDGIIYQEMIRDYVQIVRTIYEDDLGEVAVDVNYLNVANAAPIDRVFIC

SEQ ID NO: 51181 - protein, 118 aa, Sorghum bicolor
  Clone ID: LIB3481-058-Q6-K1-G5.pep
GARPGAAAGAGAGAGDDDGGKAEVGRAVAESPVLVVGRRGCCLSHVVKRLLQGLGVNPAVHEVADESALAGVVPAADAAALPAVFVGGKLLGGLDRLMAVHISGELVPILKKAGALWL

SEQ ID NO: 51182 - protein, 220 aa, Sorghum bicolor
  Clone ID: LIB3481-058-Q6-K1-G6.pep
PASKPAGHRGAGGSGANPGSQDVRRCFSMGTYEYVMDESSLLRVAVKPPEKKRPATRMPGHRVAMSECDCHSKREGFRGFDAPPKQQQQPSSKAAVDKKESFSISKIWMRSGGARRKDVSSGAIAAPSCSTSRRASSFRLPSALQRTASDVGVTATALVVPKRRADVVSPVTESEYNVSTWDKSASGSVVDWDVESAAGGGHGLSSRADEAPSFARRTLL

SEQ ID NO: 51183 - protein, 60 aa, Sorghum bicolor
  Clone ID: LIB3481-059-Q6-K1-A2.pep
KKNAQVQHPSLKVSTHVCGCRVLALKSQKNSYWWPSRSRLKKLQLEIGYNCPPPEKSQIG

SEQ ID NO: 51184 - protein, 131 aa, Sorghum bicolor
  Clone ID: LIB3481-059-Q6-K1-A3.pep
GSEYGVPSEVSLERQRGGTCTIDESDPAEVVAHRARYLLKNGFGNYDMGEKNCEDSGLYCRTGLLPGEEPGIGTRGQASDAMGETGAAIHYTPVKLWADGALGRGTGTVGMDGAEQNTTDIGVRKDGAKVE

SEQ ID NO: 51185 - protein, 82 aa, Sorghum bicolor
  Clone ID: LIB3481-059-Q6-K1-D3.pep
PKSPRVVKPAGPVNLIFRAPKKKAYIRSQAPRDVKLWDPFKTGPPLFFFFFFFFFFFFFFFFFFFFFFFFFFFFFFFFFFFF

SEQ ID NO: 51186 - protein, 104 aa, Sorghum bicolor
  Clone ID: LIB3481-059-Q6-K1-D4.pep
TDEQRDLSIAVVAILYNLSALSLYSIENSTNVITKLHSTTFPKPHAHILLDNNAQHEGPQEPGRLFLQVVKKRHTCICASCIVLTKTRRIPGCLTEFVVPGSIA

SEQ ID NO: 51187 - protein, 161 aa, Sorghum bicolor
  unsure (1)..(161): unsure at all Xaa locations
  Clone ID: LIB3481-059-Q6-K1-G2.pep
GGQWFXTFIGRKHEDVLTGESNHLYGLLAQSLKSLVDEGLVXXEKLESFYLPMYSPSVGEVEAIVKQVGLFNMNHVKVFEINWDPYDDSEESDVVRNSIRSGENVAKCLRAVMEPLVASQFGEAILDKLFEEYARRVAKHLENEKTKHAVLVLSMKKAIHV

SEQ ID NO: 51188 - protein, 156 aa, Sorghum bicolor
  Clone ID: LIB3481-059-Q6-K1-H2.pep
MEAAAAAPHLLHCSGFGRVAHLPALPGRRQRRRRGQFPRVRAVATEPKPSTSTTTSSSSSSSRDRTRSRHDLSDTRFGDVSKEIQRVRKQMEQDEQLATLMRGLRGQNLRDEQFADDNVRLRLVEVESADNNEGLPFVDSPEIISAYWGKRPRAVA

SEQ ID NO: 51189 - protein, 115 aa, Sorghum bicolor
  unsure (1)..(115): unsure at all Xaa locations
  Clone ID: LIB3481-060-Q6-K1-A3.pep
HQGGPTRGGDPQGGDHKEDDEHKKEEHKKAEEHHKKDGERREGXXEKNKDKXTGEHGEKXGEHKDKDHKEKKDKKKKKEKKHXEGHDXDGHSSSSSDSDGPPASARTEQEEGGNP

SEQ ID NO: 51190 - protein, 93 aa, Sorghum bicolor
  unsure (1)..(93): unsure at all Xaa locations
  Clone ID: LIB3481-060-Q6-K1-A4.pep
PVGRRRRXRGTRRAGPARLPPRGCDDDDAIDRAGRRPHRRAGRLHVGRRRWVQRGNMRRGSTRAVLVLYMPMCATGLSMLXCILKLNHAISAG

SEQ ID NO: 51191 - protein, 148 aa, Sorghum bicolor
  unsure (1)..(148): unsure at all Xaa locations
  Clone ID: LIB3481-060-Q6-K1-B1.pep
MAGVNSSVVGLKPAAAVPXAVXAAASSQAKRVQLVAPEGXRAXLFGLAGVFXXTGTTGSXKVGIIDEYLEKSKVNKELNDKKRLVISGANFXRAYTVEFGRCMLFYNLSGCXILVSXKKVFFMIDDFEIVCEGKEKFKCGXRVFWKWG

SEQ ID NO: 51192 - protein, 75 aa, Sorghum bicolor
  unsure (1)..(75): unsure at all Xaa locations
  Clone ID: LIB3481-060-Q6-K1-B4.pep
MSPLRAYKLICQAHVSCPPWFSSGAKKFIKRILDPNPDTRITIAEILKDEWFKKXYKPPRFEQGEELALRCRCCI

SEQ ID NO: 51193 - protein, 216 aa, Sorghum bicolor
  unsure (1)..(216): unsure at all Xaa locations
  Clone ID: LIB3481-060-Q6-K1-D4.pep
XHQXLLXASSCPFVAGLFPPLPQETAKSSKFSSIGSRFKLQLQSLMETLSSTEPHYIRCVKPNNLLKPAIFENTNVIQQLRCGGVLEAIRISCAGYPTRKTFYEFVNRFGVLAPEVLEGSNDDKIACQKILEKVGLENYQIGKTKVILRAGQMADLDARRAEVLGGAARIIQRQICTYIARKQFAELKRSAMQLQSFVRGTLARKXYECMRKEAAA

SEQ ID NO: 51194 - protein, 159 aa, Sorghum bicolor
  Clone ID: LIB3481-060-Q6-K1-D5.pep
SLPKRAAGIRYVFIGKPMNQRPRYQILGIFLLIQLCILGAERLRRSNISSIASSINQISSGSYPSSTGRGIPVLNEDGNIISDIRSGKAADIASHSEASSGKSKCTLCLSTRQNPTATTCGHVFCWNCIMEWCNEKPECPLCRTPITHSSLICIYHSDF

SEQ ID NO: 51195 - protein, 93 aa, Sorghum bicolor
  Clone ID: LIB3481-060-Q6-K1-E6.pep
LVLLITPLFPTGRLSQRARPLCPSWDSPCRSALGAAPLGVTFSAPVAVVTPLVPVPLALSLSFVAFVSFFPFQAINRGFPLGFLFRAFLFGVP

SEQ ID NO: 51196 - protein, 97 aa, Sorghum bicolor
  Clone ID: LIB3481-060-Q6-K1-F1.pep
KKKKKKKKKRKKKKKKKKKKKKKKKKKKKKKKKKKKKKKKKKKKKKKKKKRGGPVLGDQIFLRGHGTFCLFFWGPKGQFRGPFLTTAEWGKPLGPPI

SEQ ID NO: 51197 - protein, 74 aa, Sorghum bicolor
  Clone ID: LIB3481-060-Q6-K1-H2.pep
ISQRLLLLPPKFRAKREVTARFVYGSKACLGNHFGRSYKFSQILIVDTSEMMLLFLLIQRLEAVSIRTRVQYLT

SEQ ID NO: 51198 - protein, 51 aa, Sorghum bicolor
  Clone ID: LIB3481-057-Q6-K1-B11.pep
SLNLLRVISGQEGVPSEELNAGRVCDWFLKDKLKREQNIGTAVLQWDDPGF

SEQ ID NO: 51199 - protein, 60 aa, Sorghum bicolor
  Clone ID: LIB3481-057-Q6-K1-B12.pep
TNYVKQQKIFLYYVVVESITKCQLVPRYLQPIISQVKPSQGNQYNHTLKSDGNLDKFTRA

SEQ ID NO: 51200 - protein, 179 aa, Sorghum bicolor
  unsure (1)..(179): unsure at all Xaa locations
  Clone ID: LIB3481-057-Q6-K1-D12.pep
SAPLLPRARPGGRDKNRGRNSYYGNRGGVGFFGSSSSERLLHPAAARHDFSSSALGGRRADLEEDVWAVTTNDNNQHHHRDGGALVHHRRPDPAYGLSLAFASPPARHSAPVSVPECPSATLPDYDGGDLEWVPPHEYLQRRWCGAGGASVLEGAGRTLKGXDITRVRDAVWNKTRFFG

SEQ ID NO: 51201 - protein, 176 aa, Sorghum bicolor
  unsure (1)..(176): unsure at all Xaa locations
  Clone ID: LIB3481-057-Q6-K1-E12.pep
RPFLSSSXXPRAGGGRNQPRCSARRPSWTGSARWGSTASSLPTNPPPPRQFQLPXPSPPTGGRAGTLTXTGACPSRHRCKARRRRSRRRNQEWQSRARRLGRRPLRGRWRPAASASTRGRRHSFSSSGSNSSRWCSTTRRRSTXRLQRPRPCRAPSPSWTAFAPFAFTASAPATWA

SEQ ID NO: 51202 - protein, 210 aa, Sorghum bicolor
  unsure (1)..(210): unsure at all Xaa locations
  Clone ID: LIB3481-057-Q6-K1-F8.pep
MLIYLAIAFDFPPWXIKVVNKIWRGFLWRGRKYAXGGHCLVAWVKVCGPPELGGLGISDLKTLGWSLRTRWVWLQKTEPHCPWAALPFHVPKQVRAFYSVAVTSEXDGANTLFWTDRINGQCIADLAPRLFVATPKRRVKQHTVQDALTNRAWILDIQGALTVGGFVDYFHLWWDLLLDFQLPAXWRLSSNGQYLAKSAYEXXFFGSTPF

SEQ ID NO: 51203 - protein, 63 aa, Sorghum bicolor
  unsure (1)..(63): unsure at all Xaa locations
  Clone ID: LIB3481-057-Q6-K1-G12.pep
LVXSXFXXAPPLXLAVXXRASXLLPVPRLLLGRGLXXLVVVVXVRGXVLRCSWVGLLPGFPSL

SEQ ID NO: 51204 - protein, 72 aa, Sorghum bicolor
  Clone ID: LIB3481-057-Q6-K1-G8.pep
GPQKKTPPPWKEGEVKFGPFKKRPPLFFFFFFFFFFFFFFFFFFFFFFFFFFFFFFFFFPPPPPFFFFFFFF

SEQ ID NO: 51205 - protein, 81 aa, Sorghum bicolor
  Clone ID: LIB3481-057-Q6-K1-H9.pep
GSKLTTPGQPTQSFFKRSPKLKGGGGGLQTPDWKNPGGTQIKNLRGQPPFPSWAKNQKARTKGPSQKLPNLKGEWDPPWNR

SEQ ID NO: 51206 - protein, 66 aa, Sorghum bicolor
  Clone ID: LIB3481-058-Q6-K1-D7.pep
NHQQSKHRQIYFHALAELANGFRWARASRPEEGFICNKSHDNVGGPPSLEEKTRRGKSKDYYNTGF

SEQ ID NO: 51207 - protein, 69 aa, Sorghum bicolor
  unsure (1)..(69): unsure at all Xaa locations
  Clone ID: LIB3481-059-Q6-K1-A11.pep
LYEGMVXDVLELVLPFSPPTPYWQALFKASQDLRKPHYVHDKQYCGHTKYQNAAKGMHLFDLIISPPIP

SEQ ID NO: 51208 - protein, 102 aa, Sorghum bicolor
  unsure (1)..(102): unsure at all Xaa locations
  Clone ID: LIB3481-059-Q6-K1-B7.pep
ISQIYWVGGISPFGRLGNWQKGPNGSPFQPFFKLNGELEKAFNGAFRPGGVVVYRKLDRSLCRALRPGPFGFFPXFLASLAGFPGKVLIGGFLLGFDFMVFG

SEQ ID NO: 51209 - protein, 48 aa, Sorghum bicolor
  unsure (1)..(48): unsure at all Xaa locations
  Clone ID: LIB3481-059-Q6-K1-B9.pep
NGPPFFFFFFFFFFFFFFFFFFFFFFFFFXTRPPTLPPPPPPTLPTLP

SEQ ID NO: 51210 - protein, 68 aa, Sorghum bicolor
  unsure (1)..(68): unsure at all Xaa locations
  Clone ID: LIB3481-059-Q6-K1-C10.pep
VSSMVDCVEFAERDEEAVKFGVXEIKKKLENFMKSVEDLGEQADRCSRDIRRARTVVLRRIIRQPLKK

SEQ ID NO: 51211 - protein, 59 aa, Sorghum bicolor
  Clone ID: LIB3481-059-Q6-K1-D11.pep
VWFFKRGPLFFFFFFFFFFFFFFFFFFFFFFFFFFFFFFFFFFFFFPPPCADAGRTMGG

SEQ ID NO: 51212 - protein, 208 aa, Sorghum bicolor
  Clone ID: LIB3481-059-Q6-K1-D7.pep
VRCTFWSLGESLKPGGVVNNFVMAAWCYHLYSQPCGHPDVSKCHFFFSNIGDQLLKDVDRANEDILRRAFTRSSKTRPLHRSDLLFFPCFYEEHWFVFVVDIKDQCFVFLDSYYVLQPEFQVEVRDRLIPNFKFWWEKLVMLDMGFEMYKLLYPFVPRQPAQNISDSGVYVMMFLEYWKSPRSSLFTLFKESDIPNLRIKIANELLFS

SEQ ID NO: 51213 - protein, 55 aa, Sorghum bicolor
  unsure (1)..(55): unsure at all Xaa locations
  Clone ID: LIB3481-059-Q6-K1-D8.pep
SSSTEVSNVNLYREHERSNYPKLPPTDLPLYLTLXAPHILVFPPPPPPPPXAPKK

SEQ ID NO: 51214 - protein, 94 aa, Sorghum bicolor
  unsure (1)..(94): unsure at all Xaa locations
  Clone ID: LIB3481-059-Q6-K1-F10.pep
XLHHTXIPVQLLLVPLSTISTSIWCHVTLLPASLYLTHSPDSSILQLTSPRPSLPGCSSVQGVIIQLSCRSTGYSCSWARTCTCRSQLRPRPPP

SEQ ID NO: 51215 - protein, 61 aa, Sorghum bicolor
  Clone ID: LIB3481-059-Q6-K1-G9.pep
TEVSSGEAGRNCFPCPFSRLRLFPSFLSPEESPGSLRWQDHPPPYYLRICHDIKEKKVSAV

SEQ ID NO: 51216 - protein, 210 aa, Sorghum bicolor
  unsure (1)..(210): unsure at all Xaa locations
  Clone ID: LIB3481-059-Q6-K1-H8.pep
YIQXHIDGTSDDEREFSGMDMNQRLQLLMKWCLRETCDAGKKCMRINYHGTKQVIRAFLPLLLSSDDRRIVNVSSVLGQLRFFGSEALKRELNDVESLTEERLDELAAMFVEDLEGGAVEARGWWPAGFSPAYMVSKATLNAYSRILARKHPALRVNCVHPGFVKTDMTVNFGMLTPEEGGSRVVAVALLPAGGPTGAYFEERQQQAAFV

SEQ ID NO: 51217 - protein, 80 aa, Sorghum bicolor
  unsure (1)..(80): unsure at all Xaa locations
  Clone ID: LIB3481-060-Q6-K1-A11.pep
VFLEVVWGGGGCKLHIIRSFSAADWIEMENRKGGDIWQGYYSVILSVKFHKMVYLRGGGRLXSYEYSVASNGPLKWKSRT

SEQ ID NO: 51218 - protein, 190 aa, Sorghum bicolor
  unsure (1)..(190): unsure at all Xaa locations
  Clone ID: LIB3481-060-Q6-K1-A8.pep
PWVGRLAHQRKPSNLLWKNLAGSLQLEEMDDSTSRGGCVVAHTPGAGKTLGRRGFLVXYXLKVHPRSRPLVLTPKAAIHTWRREFQKWGILLPLHVLHHSNRTSKLMRGLSSKLQVVLKNFHQPTXEXMRXMDCLDKLCKWXEEPSIXXMTYSSFLSLTKENSKLHHQEFITKVLMNNPGLLILDEGHNP

SEQ ID NO: 51219 - protein, 91 aa, Sorghum bicolor
  Clone ID: LIB3481-060-Q6-K1-B7.pep
LGKTLAVAHLILQGGGGGISLAVRNNDRGAGPYRLFQTDCALLNGAMVRRPVSGAYKGGEGWMVTSQCDRYIWEGGRACSFKFIPLVCGGC

SEQ ID NO: 51220 - protein, 75 aa, Sorghum bicolor
  Clone ID: LIB3481-060-Q6-K1-D12.pep
YLKYMDPPPPHGGVGEVDSAEHVVLILAPAHPEVVDSELEEATLSRPVHISFICSPPPPPPIVAAHRKKGRWVEP

SEQ ID NO: 51221 - protein, 173 aa, Sorghum bicolor
  Clone ID: LIB3481-060-Q6-K1-D7.pep
VYSSSSQTFAWRLLRRAVATGERAGRYSVHIDKHCSYYGAIETDQHLFFKCTLPTEIWSTANPPLITNNIPAEEDGVQLSLPLLITPNPTDETLYKSLFILWYIWKARNDNMFQRRTWTSSQIHQAANAHMNTHLAALNEQDQNQPGTILLSAGPSRLRQQQQDEPSGTEAHT

SEQ ID NO: 51222 - protein, 77 aa, Sorghum bicolor
  unsure (1)..(77): unsure at all Xaa locations
  Clone ID: LIB3481-060-Q6-K1-F11.pep
PTPPAPPPPPPRSARKXIPPNKPHARTAVILXAALGCRGRNDHAPSGFLSPATDTAPRRRTETLCGHPPPPVVRRAS

SEQ ID NO: 51223 - protein, 62 aa, Sorghum bicolor
  Clone ID: LIB3481-060-Q6-K1-F12.pep
LWLWKQLALTMYGHIHFCDGTIYWGAKLSFIYLFIYNLSIQRSASLVLKSEEYLVLDSCRIF

SEQ ID NO: 51224 - protein, 199 aa, Sorghum bicolor
  unsure (1)..(199): unsure at all Xaa locations
  Clone ID: LIB3481-060-Q6-K1-G10.pep
MDSGNSGSLQSSSGGDDEFDSRGGGGVDSSPLSALLRPSPSPSAAAFSLHGSYFGLQEFTSAPPPQQPQAGTWSSASFPGASSLSPRVAQPDSGAGARQQQAADTTVAAAQGQGAAMGGAPAPAAQQPPRGSRKRTRASRXAPTTVLTTDTXNFRAMVQEFTGIPCPPFGAXGVGVGVGGPAASLXTRVDHIFPPGWFL

SEQ ID NO: 51225 - protein, 61 aa, Sorghum bicolor
  Clone ID: LIB3481-060-Q6-K1-G12.pep
YIVQIGYDTKLSHILEVHLINKHTKNTSMVGGNYKYLKAAMRHIYISAILFPPRNKSVYSN

SEQ ID NO: 51226 - protein, 82 aa, Sorghum bicolor
  Clone ID: LIB3481-060-Q6-K1-H9.pep
DASGRPFFFFFFFFFFFFFFFFFFFFFFFFFFFFFFFFKGGFSLPKFIKKKRGGGELFGVHFYKKLKRPKFSTWASKKGGKI

SEQ ID NO: 51227 - protein, 77 aa, Sorghum bicolor
  unsure (1)..(77): unsure at all Xaa locations
  Clone ID: LIB3478-015-P1K1-D8-F12g.p
QKSXXGIRSXDTPRQTENRAQETVQSGTEQSRTIDGDAATKKXXWXXKKSFDRNFCPMVTHSCARTRDSGMMGEYDE

SEQ ID NO: 51228 - protein, 90 aa, Sorghum bicolor
  unsure (1)..(90): unsure at all Xaa locations
  Clone ID: LIB3478-015-P1K1-D8-F13g.p
CCPGGVPPRAGCLTNFLLSGLCSPLSVAPRAQTAFLLRLRHSLGCWPCYLIRSPLRCPXSLSSFPCQGSPFPLACAPLFLAPSLVLPPLP

SEQ ID NO: 51229 - protein, 112 aa, Sorghum bicolor
  unsure (1)..(112): unsure at all Xaa locations
  Clone ID: LIB3476-018-P1K1-C11-F2k.p
QIADIVDKGTCSCLASGFIYGLICASTEMGCLYSCLYRSKXRAEYDVDEGECPDFLVHCCCEHLALCQEYRELKXRGFDLGIGWEANMDRQRRGVTGGTVMGAPAIPLGMIR

SEQ ID NO: 51230 - protein, 75 aa, Sorghum bicolor
  Clone ID: LIB3478-015-P1K1-D8-F96k.p
RTSCYKRYSHTPSRLLDFTFTPVGARRYPVRSRLSRPSRLFCRLYTAPFPLVPRKISKQRNLSGTKLPNHSATPH

SEQ ID NO: 51231 - protein, 166 aa, Sorghum bicolor
  Clone ID: LIB3478-006-P1K1-C12-F78n.p
NTHQFVLFGLPILTEQQVMNRKRFLEEEAEAEEEKGLVARGLTWNYSLQGLETGHCKVFMESEDVGRTLDLSVIGSYQELYRKLAEMFHIEERSDLLTHVVYRDANGVIKRIGDEPFSDFMKATKRLTIKMDIGGDNVRKTWITGIRTGENGIDASTKTGPLSIFA

SEQ ID NO: 51232 - protein, 138 aa, Sorghum bicolor
  Clone ID: LIB5047-008-R1-XP1-A1.pep
MTSHLSWMIVRNNNAFLLKKRNISKPFSTEPNNLLNLNSYRYNGLVHKKSVGIVPAADKKGFTVVYKKAKASHKPAKATIKRTLKAGPRRSLTKLRRLIHANHYRRDLLKAALRRASAVLKSQKKPVTSRKARAKKTE

SEQ ID NO: 51233 - protein, 182 aa, Sorghum bicolor
  Clone ID: LIB5047-008-R1-XP1-A11.pep
MDAERKGTQLMRRRVVPPTGGQPTRVLFPDAAEVEVVDELSGTMDSGAYFADLITKGHGLAGQSENPPPPQEVVAQDEVQTIGKRNQRRTKNFTVEEDEQLVKAWLNVSLDRVKGVDQPHTTYWERIHAYFHVHKDFSSDRTQGSLMNRWSGIQHDVNLFAGCLSKTECENQSGVSIDDKVW

SEQ ID NO: 51234 - protein, 251 aa, Sorghum bicolor
  unsure (1)..(251): unsure at all Xaa locations
  Clone ID: LIB5047-008-R1-XP1-B5.pep
MFSILASLLLPTTVTAQVTATNPNGVTNPPEPYFEPVGTQINQTSFSRLLTLNGVDDFCLFGPPEAGPDSLIGNVEPIVVSYCTKPRNNARLIPDGVITAAHFIKTPTYVQIYGFWDGTKVNIPFGDAGGELDPHGAENVGNPIGGNVTSNVPTGQDVFYEEWMSFISYDQFCLRICTAQTNNVTTALQCEHELDIMGCQFVMAIPDFYSSNNSFTSXDXDVAPPPSLYPQPDGSTSTFRQRYTGTYTAPD

SEQ ID NO: 51235 - protein, 224 aa, Sorghum bicolor
  unsure (1)..(224): unsure at all Xaa locations
  Clone ID: LIB5047-008-R1-XP1-C1.pep
YSGEYSRKELILVNRPWPLDVPLPAALLGVATLTRLYLGLWKFPDTSALRQSKSGADAVFPHLRELVLCSVVVESSDMNFLLAGSPVLENFGIVGIREKAMMRLRLVGQHLKCAQILMSAMSSVAMVDTPSLERLILWESKACDNSCIRLKIGKATKLRILGYLSPGIHTLEIRNTVINAGIKATPSTIVPGIKILGLNLRFGVCNDSKMLPTXLRCFPNVEIL

SEQ ID NO: 51236 - protein, 181 aa, Sorghum bicolor
  Clone ID: LIB5047-008-R1-XP1-C10.pep
VHHSAILSNKFLQTMQHRQQMCLDHLRLHLMTPLITVARPLAMSPPWMVNELRHQPLRTPPATQLRLRLLQSLLSSLQDDRAWKQTLDCSLRCANDAGAPTPVGESTSASSSRHPPALLPVGCASPEPDAYPTAPPDRWSSSGYSRLPSPPPLGGHRPPPLSGWPPAFARDNHQCQHGSQK

SEQ ID NO: 51237 - protein, 118 aa, Sorghum bicolor
  Clone ID: LIB5047-008-R1-XP1-C6.pep
MKRSAASTVPFVLLRLLAVATASAAAEAEHAANYLVYVNPHPPGVDCQAYQLGILAAALGSEAKAKEAILYNYRNVMSGFSARLTPPELEAVKKQPQVNRVLPSTTLSLMSSKFDGVS

SEQ ID NO: 51238 - protein, 59 aa, Sorghum bicolor
  Clone ID: LIB5047-008-R1-XP1-D12.pep
RPGRVMKANNRFLTLQATRIKSHAVLCGQWMIYFFTVLDFTCEPVISLNSGRVAVISMD

SEQ ID NO: 51239 - protein, 196 aa, Sorghum bicolor
  Clone ID: LIB5047-008-R1-XP1-F10.pep
PVLYPRLRSAAASLHFRPAAATAAMKGPGLFSDIGKKAKDLLTKDYTYDQKLTISTASASGVGLTSTAVKKGGLYSLDVSSVYKYKNTTVDVKVDTESNISTTLTVLDALPSTKLVTSVKLPDYNSGKVALQYFHENATFATVVGTKPTPVIDLSGTVGAQGVAFGAEAAYDTATGKFTKYTAAIGGTKPDYHAAF

SEQ ID NO: 51240 - protein, 117 aa, Sorghum bicolor
  Clone ID: LIB5047-008-R1-XP1-F2.pep
TSTNDFKPSLQRMTVTLNSDDFSARLAKIFIVANSLLLIYDLLIFLIISIDFYVKAAGLFYLSSSLFSTSLLSLLVIHYYISSRFCLKPKPCLVKRIYKMDTVALLLVFDKYCSIMN

SEQ ID NO: 51241 - protein, 107 aa, Sorghum bicolor
  Clone ID: LIB5047-008-R1-XP1-G1.pep
MKPVVGIVVSNKMQKSVVVAVDRLFHHKVYNRYVKRTSKFMAHDEADDCNVGDRVRLDPSRPLSRHKHWVVAEVLRRAKVYVPPSVTASGEHGIKSQQAGVGTKTST

SEQ ID NO: 51242 - protein, 191 aa, Sorghum bicolor
  unsure (1)..(191): unsure at all Xaa locations
  Clone ID: LIB5047-008-R1-XP1-G5.pep
MVASKIIKAGGAEPDEFEKTVSQALLELELNSELKPQLRDLYITRARELEFATKKAVIIYVPVPKQKAFQKIQTRLVRELEKKFSGKHVVFVAERKILPKPRRNTRNPLKQKRPRSRTLTAVFDAILEDLVFPAEIVGKRIRVKLDGSQLIKVHLDKNQQTTIEHKVDTFTSIYKKLTXREVTFEFPEPYL

SEQ ID NO: 51243 - protein, 48 aa, Sorghum bicolor
  Clone ID: LIB5047-008-R1-XP1-H12.pep
MSCSCGSSCNCGSSCKCGKKYPDLEEKSTAPQATVVLGVAPDNTGAAE

SEQ ID NO: 51244 - protein, 103 aa, Sorghum bicolor
  Clone ID: LIB5047-008-R1-XP1-H9.pep
AARAPARITQGRAAVAPSSRHFPSCCDVASPPHLPAMLTTMAQGPSTTGEHHAGAAARSSLPLASLTQGPWCPRPLPWRRRTSSFTARAAALVRIRSHRQRGH

SEQ ID NO: 51245 - protein, 108 aa, Sorghum bicolor
  unsure (1)..(108): unsure at all Xaa locations
  Clone ID: LIB5047-009-R1-XP1-B11.pep
MEYMGADDGQWPPPPQPPLLLLAAALVVVVVLALWRRLVWQPRSVARSLARQGIRGPPYSFLAGSLPEVKRLXRASRRRVSHLDVGCHDIMPILLPPFHRWVVEYGKA

SEQ ID NO: 51246 - protein, 90 aa, Sorghum bicolor
  Clone ID: LIB5047-009-R1-XP1-C1.pep
NSEVKDADIQDSIVKTTEEKYVLLHTSLGCQQSQAQIANYDDFPLYHQSDKKYLLFHDTHMKSSTLETLHALLRQRARSITGTKDELIAR

SEQ ID NO: 51247 - protein, 114 aa, Sorghum bicolor
  Clone ID: LIB5047-009-R1-XP1-C2.pep
MQIISSASTLQWHMMNRRSRISIFLLVFLRTQSHFPVYLLNTVGDRYFSQGASWYAGMFGPQVESSRSSVVRLAETKHDMRVTRYAGSRCVIFFAAMEKPDRGALEVWKSRPGR

SEQ ID NO: 51248 - protein, 181 aa, Sorghum bicolor
  Clone ID: LIB5047-009-R1-XP1-D11.pep
MVRYSSAHVAASNPEKFAKARGEYVRTHFKNMREVAAAVSGMNLQKAYTYLADVQEHKQIIPFRRFAGGVGRASQAKQFKTTKGRWPVKSVQYLLRLLKNAESNADAKDLSVEELIIKNIVVNQAPKTRRRTYRAHGRINPYQGHPCHIEIFLSTPSSEVARSKDLDVSSSSKKGKKIQAI

SEQ ID NO: 51249 - protein, 61 aa, Sorghum bicolor
  Clone ID: LIB5047-009-R1-XP1-E3.pep
ELYCIVIFIQQSNVHYVCCRCMVAIGPLEGIRRKIMLGESNHNKRWSQCFEIPKKKKKNAP

SEQ ID NO: 51250 - protein, 144 aa, Sorghum bicolor
  Clone ID: LIB5047-009-R1-XP1-F4.pep
MEINEFCSCFIPALPPYHTSCDYWLYCLRKLSAVKALDAQLAADPSSPAPWCSDEPSLFSAQAPKLSWRTSAATFLAHRRMSSLTLSGSTSTSGPAPSPERRRSKRALPRDGGFGWLPPSLAVASAVFSPTGMCAATVSPRPGR

SEQ ID NO: 51251 - protein, 121 aa, Sorghum bicolor
  Clone ID: LIB5047-009-R1-XP1-H6.pep
RPGRGGAIQIFVSCDGGRRRPLQLPPWYRRCCDGITVAAMRPLLSRLFSSTHIGMGSSSFSSSPSRRLGHLTLPSRLLFFRGDLLSGRPCRVRRICRPRKNPTLGPLQGPRRGAGLPLLGP

SEQ ID NO: 51252 - protein, 98 aa, Sorghum bicolor
  unsure (1)..(98): unsure at all Xaa locations
  Clone ID: LIB5047-010-R1-XP1-A2.pep
GGPLERPGPGKYHPHIDLQGNVCLNILAQTLHTLFSRSTLIFMLLNLLFXEPNHEDPLNHDRCSCSSMTHPKMFEENVKRCMAVCYVRQHYFSNMCLT

SEQ ID NO: 51253 - protein, 193 aa, Sorghum bicolor
  Clone ID: LIB5047-010-R1-XP1-B2.pep
MGFVKVVKNKQYFKRYQVKFKRRREGKTDYFARKRLIAQDKNKYSTPKYRLVVRFSNRDITCQVAYSRTEGDRILCAAYAHELPQYGIKVGLTNYAAAYCTGLLLARRLLTQLGLDKLYIGTTEVTGEEFNVEAVEDGPGAFRCYLDVGLMRTSTGARVFGAMKGAVDGGLNIPHSTKRFPGFDSESKKSMLM

SEQ ID NO: 51254 - protein, 108 aa, Sorghum bicolor
  Clone ID: LIB5047-010-R1-XP1-B5.pep
DERMLIYIGSMRMRQQHEAISRLWVHEENRLPCGLPRQAWGELAEMPPYSWSCWHWCRQAWRELGEIERNEKKNANLITLPYLDDNLMEPTIIISAIFHRQKKKKKAP

SEQ ID NO: 51255 - protein, 56 aa, Sorghum bicolor
  Clone ID: LIB5047-010-R1-XP1-D7.pep
MRLWSIRVFFLVYFLASVCSQGSVLLVLMILPCYVTILQISGAACPSFKKKKKKGP

SEQ ID NO: 51256 - protein, 127 aa, Sorghum bicolor
  Clone ID: LIB5047-010-R1-XP1-E1.pep
MSWQAYVDDHLVGTGKVSKAAIIGKQGGIWAASSGYNLSQKEQDAITQSLFSKPDEARAHGVTLAGFKFMVIKAESDEVIGRKGERGVFLVPTNQAILVAEYEAPVQAGDANVIVTKLADYLKSVSY

SEQ ID NO: 51257 - protein, 51 aa, Sorghum bicolor
  Clone ID: LIB5047-010-R1-XP1-E10.pep
SSLCCDVGCGESRAAAGPVAGEWQRGQAADHIADELGRHVKAAVGRRNPIG

SEQ ID NO: 51258 - protein, 160 aa, Sorghum bicolor
  unsure (1)..(160): unsure at all Xaa locations
  Clone ID: LIB5047-010-R1-XP1-E3.pep
MSYSKEHHFXSKGDAGASKTYPHQAGTDRKNAFLCIKGRPCXAVQASTSKTAKHGHAICHFVAIDIFDGKKLEDIVPSSRNCDIPHANRTDYHLIDISXDGFASLLTSHGNTKDDLRLPTDETLVVQIIEGFESEKDLVVTVQAAMGEEPTCSLKDIDPK

SEQ ID NO: 51259 - protein, 74 aa, Sorghum bicolor
  Clone ID: LIB5047-010-R1-XP1-G2.pep
NAKKTLQLHSPIPFLAPMLLTKHRISYLLTSIQPKATRLIHSSIPQFVCDQFASHLCFSQMTLCKRRWIDNNNN

SEQ ID NO: 51260 - protein, 175 aa, Sorghum bicolor
  unsure (1)..(175): unsure at all Xaa locations
  Clone ID: LIB5047-010-R1-XP1-G3.pep
HGTKAWFRGRIRANLIPNHPQDPFFFSGRRKPIACAAVCRPSRFLCFHGGRHITTVSSPSRLRVSSPPSRLRDSSSRSCPLSWGDALRVGSSSARGCRLPACPARALPVEIWSARRSRLPACPVLFRPWLFIPARCTWSSSLPVEIWSFLPLFLQRPSQAISSHGGSEXFWVSLL

SEQ ID NO: 51261 - protein, 124 aa, Sorghum bicolor
  Clone ID: LIB5047-010-R1-XP1-H6.pep
MSDAGSDSASRAPEEVVVDDVEVAAPAKGAMSVEDALQEVLKNALVHDGLARGLRECAKALDKRQAHLCVLVETCTEAEYLKLIEALCAEHNINLIKVSDAKVLGQWSGLAKIDREGNPRKIVR

SEQ ID NO: 51262 - protein, 80 aa, Sorghum bicolor
  Clone ID: LIB5047-011-R1-XP1-A3.pep
MLDNIEKTLGRGEKLSELQDKTSDLHSQAQEFKKQGVKIRRKTWLQNMKIKLVILGILLLLVIIVWVSVCQGFDCTKHET

SEQ ID NO: 51263 - protein, 142 aa, Sorghum bicolor
  Clone ID: LIB5047-011-R1-XP1-A7.pep
NGCKNKLYASLTLATCHLFPFLLKFQLVFISVGKKRRQRQWMSLHRARTGSCRPWSMSRSAMRRRASSMPAPSCFAAASAATRPASTAWSASAAAARRTSKVGSTNNSAAASSSYGFVVECGFVSVVKNCDQSIVKIKTCCK

SEQ ID NO: 51264 - protein, 103 aa, Sorghum bicolor
  Clone ID: LIB5047-011-R1-XP1-B5.pep
MSGLIDIWTLERERMVRTAGAAQASFFRSVVSLGGGERQGRRDTARTECGGGSTSSAAKRCDGVGAVLVDAAEKQAAASAGSSPPGFVREDAFLSILVDCFGQ

SEQ ID NO: 51265 - protein, 119 aa, Sorghum bicolor
  Clone ID: LIB5047-011-R1-XP1-B6.pep
QQDQWNQQDLQSAMISLLFGSDCLVLVASRRRRRRDADLVSISAAYSHRRRKRVPPGDETKEGSCPSTDLIGRYHKIVVVPVTYFTHGEILEGLCSTINRGRPLSFCSDRKVTDFRPGR

SEQ ID NO: 51266 - protein, 63 aa, Sorghum bicolor
  Clone ID: LIB5047-011-R1-XP1-C3.pep
SKSNQRKKHLTKSNPPWTNIAIDDHIARDVGVGGVTRLLLHEDEPSRDEASDRAGRARAPYRC

SEQ ID NO: 51267 - protein, 135 aa, Sorghum bicolor
  Clone ID: LIB5047-011-R1-XP1-E1.pep
MPCATEVVHGEGGTIKVGTTGTIGSLMTRELDTIKVAPQAAAGTPRLRHQGRPVSVLCGATTPRKLMLRKSSSDISSSSSSNNRTDRVSAEEACKPRRVSRRSTFDSPMLRSDSALMDRTPECRQGEEEGECVRC

SEQ ID NO: 51268 - protein, 65 aa, Sorghum bicolor
  Clone ID: LIB5047-011-R1-XP1-E12.pep
GGPGSWGLGFFFCCFFFFFFFGFFFFFFFFFFFFFFFFFFFLTSTLNNPLSFSDGRTCEILIYIQ

SEQ ID NO: 51269 - protein, 100 aa, Sorghum bicolor
  Clone ID: LIB5047-011-R1-XP1-E3.pep
GPGWNGHDVTSPGVFQQYKLQLNWMSLKDAVKEKLTVLENVQWFELLEGKDGSRSGPVIELMGLGRLMNEKARMLSMGQRKRLQLARLLAIDRPIWLPGE

SEQ ID NO: 51270 - protein, 114 aa, Sorghum bicolor
  Clone ID: LIB5047-011-R1-XP1-F10.pep
MAVGKNKGLSKGGKKGVKKKVVDPFTRKDWYDVKAPSMFTTRQIGKTLVNRTQGTKIASEGLKHRVFEVSLADLQNDNDAERSFRKFRLIAEDVHGRNVLTTFHGMDLITDKLL

SEQ ID NO: 51271 - protein, 60 aa, Sorghum bicolor
  Clone ID: LIB5047-011-R1-XP1-G1.pep
NTDINNSMYRLSQSSLVGVHHLRIDLRSPRHLSLGGGGRTPPHPVVQKMKPARPGRLERR

SEQ ID NO: 51272 - protein, 173 aa, Sorghum bicolor
  Clone ID: LIB5047-012-R1-XP1-A8.pep
AGRAGEFRLPHRSILSLRPPHRRRAPPRAGDFLPSCRRRAPPRCSFRGSAPASASEYEAVTAMAAAGGVSTDDVPILQAENLTSNVKSVYYSRTFLSIIGGVVAGIWGFTGLTGFVFYFLIMMIASIGLLAKSKFSVQKYFDSWTRISIEGVFGGLMSFVLFWTFAYDIVHIF

SEQ ID NO: 51273 - protein, 90 aa, Sorghum bicolor
  Clone ID: LIB5047-012-R1-XP1-B11.pep
RLHDVDVMDVIADRVASGPEEGQSVEPVDSHVTSVISLRRIHDRVGANHFKGDVEREVITCTVALCSYVGLLQLIEVMYAARRSCRVAEE

SEQ ID NO: 51274 - protein, 56 aa, Sorghum bicolor
  unsure (1)..(56): unsure at all Xaa locations
  Clone ID: LIB5047-012-R1-XP1-B2.pep
XXXXFGRSTVQSLISSSETNXNXYEPTSHTHQPVHPGXAELCYGFYRKLGIIPTIP

SEQ ID NO: 51275 - protein, 74 aa, Sorghum bicolor
  Clone ID: LIB5047-012-R1-XP1-C1.pep
AAWPGVRVLITEGDGFLRHVRTCLSSRSGPLWCFAWSCRDACSASLDTKFLFSLLSSAKLGTGISFSDDFNFSG

SEQ ID NO: 51276 - protein, 190 aa, Sorghum bicolor
  Clone ID: LIB5047-012-R1-XP1-C11.pep
PAGPGNPRFSLVDYEIKADRSETPLPPQDGRTASSRNLRRIFNGVIEIDGQEHKIQGSGTGALSSLADALRSLGIDLDVVDYNEHTIGTSKDAKAATYIGCTAAQSSQKVWGVGVHQDVVQASLIAMLSAASSFLSSRPTTPIPFRPKRSNTLEIPSPESSPSRKEGSTIVDKLEAAVNGDQADVKSAGV

SEQ ID NO: 51277 - protein, 82 aa, Sorghum bicolor
  unsure (1)..(82): unsure at all Xaa locations
  Clone ID: LIB5047-012-R1-XP1-C2.pep
AVCWAREKMIWRLSSAFFLSASASPSGRAHAPPLAFRSTDSGTTAAFASAATSSKTCVWVKRRRGARPPRWEGERNFSXPXR

SEQ ID NO: 51278 - protein, 79 aa, Sorghum bicolor
  Clone ID: LIB5047-012-R1-XP1-D11.pep
QTPSCCQNTKCFPHNDVAINDEPCNRNNLACSLAMHPSAASSNNRNAYHLSSSRLTFGGDRQRTQTPGAVTPTIASRQF

SEQ ID NO: 51279 - protein, 248 aa, Sorghum bicolor
  unsure (1)..(248): unsure at all Xaa locations
  Clone ID: LIB5047-012-R1-XP1-D12.pep
RPGRGILFDSTITIMKLTLVTLSAVVASTTTASPLVLEPRQQCSTSWSYPYTGRAPPGNYKAFNLASCTVQLSFNKDQYVGVQWAFEATYADGSRAELKPFRDFNSFGVSDTFYPYLGNNFLTRYPGNSAFTAVHEFSSVCKNGQAPISWRFYTTSGTANGCYTTGQIQAVGGVSRPAKVTGVSLRRNNGAXDFEVAWSPVSRAVAYSVIVQYPTGTDEVXNPYTNVXXARVQGSSTSVATTTRRQDV

SEQ ID NO: 51280 - protein, 100 aa, Sorghum bicolor
  Clone ID: LIB5047-012-R1-XP1-E1.pep
SMVARWREEVKWWPCRESVMLAEAPMVRKRCGSSKKQREDHHLFGSKAVVYAAVAACERGYMPQTCLGLLVYVYCAFGVKPPGLLAPIAAAPKKKKKKAP

SEQ ID NO: 51281 - protein, 113 aa, Sorghum bicolor
  Clone ID: LIB5047-012-R1-XP1-E10.pep
AGRAGIHTSPTPIYPSPSLQKSLDCSANLLLANSPRWTPHPPSASYCALAGLTALYDIGSCGTTLTIEVLKDSTSTKLSLITKVDHLPGVRPTLGRHTSRTLPQGAITQDFYP

SEQ ID NO: 51282 - protein, 245 aa, Sorghum bicolor
  Clone ID: LIB5047-012-R1-XP1-F10.pep
RPGRDPIADFDPASALSSTSPSPLTSNVSLPHGERVDNTSRRPSAEELYLQQQQQKARNGGRSRTNSISSVTGSLRRVFTSNSLASLSHKRAQSDAVRSLGGSVQSERQLAMGGLATPLTESAPSGMLADAIPEGPESPRKTGFNTLRRSRTMLNYSKSWFRASAAANVVERVNAEAVAPAQGLQRQSSFMSMTTASSGTEFDIVKEVAPQPLRTGSAPVTRQSPQHSEGFRRASDTHLTTIAEQ

SEQ ID NO: 51283 - protein, 101 aa, Sorghum bicolor
  Clone ID: LIB5047-012-R1-XP1-F6.pep
MSDSMRKGLGEQASEKITPDSQKSTTEKASESLTGAGDRIAGAVQPEGQKSTGQKLGDATRSGGDDASNQGQGVMKQAQDMASNAGQSISDTLSGATGQKK

SEQ ID NO: 51284 - protein, 137 aa, Sorghum bicolor
  Clone ID: LIB5047-012-R1-XP1-G5.pep
MASPDLNWLIVRNNNAYLMKKRNIKKPFSTEPNNLKSVSSFRYSGLVQKQTVGIVPATDKKGFTVVLKTKKNENKPAKNTYKVTFDQGARRSLKKLRNTLVHNHYRNDLKQAAVRRASALLRSQRAPKVKKAVAKKE

SEQ ID NO: 51285 - protein, 94 aa, Sorghum bicolor
  Clone ID: LIB5047-012-R1-XP1-G7.pep
MTKGTSSFGKRHNKTHTLCRRCGRSSYHIQKSTCAQCGYPAAKIRSYNWSEKSKRRKTTGTGRCRYLKVVRRRFRNGFREGGQAKPQRKGQNKA

SEQ ID NO: 51286 - protein, 112 aa, Sorghum bicolor
  Clone ID: LIB5047-012-R1-XP1-H11.pep
PAGPVHTRPVARQPCQKPHVYYMRGSRMDRRRNATVTEYERHRVKHPGCRWRIADPSALLDSIVVLKKPDPELWKRSPRRNCCRVVSSPKQGKDRSMTIDVGVCRDGEFAKV

SEQ ID NO: 51287 - protein, 124 aa, Sorghum bicolor
  unsure (1)..(124): unsure at all Xaa locations
  Clone ID: LIB5047-012-R1-XP1-H12.pep
MLGASRCRRQRAMAPLCVSLLAVALCALTLLAAPPASASRDLRPRRAGFVVRGRVWCDNCRTGFETPASTYIAGAKVXADCQSKTAGGNTCSFEGHTARPGTYHLPCRWRARACRSACPLLVRL

SEQ ID NO: 51288 - protein, 128 aa, Sorghum bicolor
  unsure (1)..(128): unsure at all Xaa locations
  Clone ID: LIB5047-012-R1-XP1-H3.pep
MHAYVYEQNRRRTSSDTKGDAGASKTYPQQXGTVRKNGFLDIKDPPCXGEEVSTSKTATNGHGKCDSLNAILICNGKQLENIGPSSHNXEIPPGNRTDYQLSDISHDGLVSLHTTDANTKDDLTLPTD

SEQ ID NO: 51289 - protein, 107 aa, Sorghum bicolor
  Clone ID: LIB5048-001-R1-XP1-G9.pep
CIPKVTFILRQVAQIKSNIVVIKTSGVAGVSAFSTVILTLSAAIEVAEHGVDCLQHRRHEDERGSGGERDGHPRRGEEVQHEPPAPPADTPAPVPRHAYQPRRLERR

SEQ ID NO: 51290 - protein, 67 aa, Sorghum bicolor
  unsure (1)..(67): unsure at all Xaa locations
  Clone ID: LIB5048-002-R1-XP1-C2.pep
PRPAEGKGQERVFKKLTWLLKLCGPRRXMAXTRALKVAKAVEXWVWSRKGPKNTARPXNFTAPTPEE

SEQ ID NO: 51291 - protein, 69 aa, Sorghum bicolor
  Clone ID: LIB5048-002-R1-XP1-G12.pep
VSCSNAGKERQYSDRHFVLRLYLHSVNCPSSEDCSYLASDVFVPMMSVSIMEFNKLRCMIATQRLERKH

SEQ ID NO: 51292 - protein, 112 aa, Sorghum bicolor
  unsure (1)..(112): unsure at all Xaa locations
  Clone ID: LIB5048-012-R1-XP1-D4.pep
SDIQDVPLVTLIGCCDEGSHRIVVYPHIENNRLAQTLVGSRYRNISGKIAAIAPKLQPGLAREDAFLDEQIQPQIIHRXDVKAPQLLLGQHPTPTTTATPPGRHPTRECDPM

SEQ ID NO: 51293 - protein, 114 aa, Sorghum bicolor
  Clone ID: LIB5049-002-R1-XP1-A6.pep
YTDGSSKPKPSFFSYWASISYKTKEDLVTIGNKLFCIFIHRSFTHIYSIGILIGILNPMQNFASRLRTHNRICILDANSISLWILIARMYILPQYAIERKRIKPFIRTKVFIGI

SEQ ID NO: 51294 - protein, 107 aa, Sorghum bicolor
  unsure (1)..(107): unsure at all Xaa locations
  Clone ID: LIB5049-002-R1-XP1-B3.pep
PLESLGAASFFTYCDIPHVNRTEYPMIDLLQDGFVSLLTSDGNTKDGLRLPTDDTLVAHIIERFDPAKDLDATAQSAMPEXPICAPKDIAPKKLPCLARPNYCISTT

SEQ ID NO: 51295 - protein, 217 aa, Sorghum bicolor
  unsure (1)..(217): unsure at all Xaa locations
  Clone ID: LIB5049-002-R1-XP1-C6.pep
MLTTTFIMALAGLSTMIEASPLQARGGSKRGLAFPKQHNGVAGSQWTHKFSGSKVSWMYDWEAVIDGTPLDLEYVPLLHSNQQWCTEGWANNIANAKKNYKVSHVLSFNEPDQIGGGGSNIDVATAVATHKKFVQPLAAQGLRIGSPSVTNADEPNKGINYLKNFMNQCTGCQIDXVVAHYYAWDNAQDFKNYLEKFHKTFHKPVWVTEFGVTSGDA

SEQ ID NO: 51296 - protein, 76 aa, Sorghum bicolor
  unsure (1)..(76): unsure at all Xaa locations
  Clone ID: LIB5049-002-R1-XP1-D1.pep
RLGSLWRRIEASAFLRTSRVLEQLERGQKGIGDGTXSYGMDDAHXIYMKAWTGTIIGPPTTAHEGRIYQLTMSCDQ

SEQ ID NO: 51297 - protein, 70 aa, Sorghum bicolor
  Clone ID: LIB5049-002-R1-XP1-F11.pep
FAIYVSLGRGRRRGCRSVVDELLDGVTELIGRGTNKALQRQIVHDEDEGRRRLDAVAMSNFLEFEPGPAG

SEQ ID NO: 51298 - protein, 92 aa, Sorghum bicolor
  Clone ID: LIB5049-002-R1-XP1-F4.pep
PAGPGYLPQPFWLWPCLVPPKILSLILLWAMCPLWYDENYFLWGRARNSSTATGALKCRLGVALLPKPGTPNKKKKKKKKKKKKKKKKKKGP

SEQ ID NO: 51299 - protein, 147 aa, Sorghum bicolor
  Clone ID: LIB5049-002-R1-XP1-F5.pep
GAFFFFFFLVYIFFFFFFFFYGNVITFSLTGSEYSTVQYILRLVPFQIISAIIVWNFRIFIIRLYWRVADGSCGLKSLQMARTRPGSDLCALSARRLCHRHLGPAAAEGEEEEEEDAASCSLGRAPAMSAFLVEETAPEPARPGRPR

SEQ ID NO: 51300 - protein, 244 aa, Sorghum bicolor
  unsure (1)..(244): unsure at all Xaa locations
  Clone ID: LIB5049-002-R1-XP1-F7.pep
MAGESWKVPTPVKDLAALVEEPPSQFVQREEDRPGSLMLAADMPDPLPIVDLDKMSTADEATKLRSALQTWGLFLATNHGIDVSLMEDLMKASREFFNQPLQERQKYSNLREGTRFQLEGYGSDPVIAQDHILDWSDRLQLKVEPEDERNLAQWPKHPESFRDLLHEYATKTKTVMVKILRAMAKTLELDEEDFIDQIGGRPQAYARFNYYPPCPXXSFVXXIKAHSDGPLLTGSLVDREGRGL

SEQ ID NO: 51301 - protein, 263 aa, Sorghum bicolor
  unsure (1)..(263): unsure at all Xaa locations
  Clone ID: LIB5049-002-R1-XP1-F8.pep
RSRPAWPGLTSPNNTAERDAPPNNPSLRGFQVIDAAKAAVEQSCPQTVSCADIVAFAARDSINLTGNLAYQVPSGRRDGNVSLLSDANTNLPAPTFNASQLVAGFAAKNLTDEEMVILSGAHTVGRSFCTAFLPRIYNGSTPIVDTGLSAGYATLLQALCPSNANSSTPTTTVIDPSTPAVLDNNYYKLLPLNMGLLFSDNQLRVNSTLNASVNSFAXNETLWKEKFVAAMIKMGNIEVLTXSPGEIRLNCSVVNNGSSSSSS

SEQ ID NO: 51302 - protein, 265 aa, Sorghum bicolor
  unsure (1)..(265): unsure at all Xaa locations
  Clone ID: LIB5049-002-R1-XP1-G9.pep
PAGPGTQIVTTEASKSFAVNGTAGAIPDVDFDIGESYAGLLPISKAANETSELYFWFFPSENPDASDEITIWLNGGPGCSSLEGFLQENGPISWQYGSGPAAVYNPWNWANLTNMVWVEQPVGTGFTQGNATATSQEGTAEEFLGFFKNFVDTFGLQNRKVYITGESYAGRYVPYIADAMLSKNDSTYYDVKGIMFYDPSVAEDVLLEDIPAVAFVDKWAGLFNFNQTFMDDIHNRSXXCXYXEYMGEYLTFPPASKLPYPDMDA

SEQ ID NO: 51303 - protein, 204 aa, Sorghum bicolor
  Clone ID: LIB5049-003-R1-XP1-C1.pep
MAPKIAIVYYSMYGHIKKMADAELKGIQEAGGDAKLFQVAETLPQEVLEKMYAPAKDSSVPVLDDPAVLEEFDGILFGIPTRYGNFPAQFKTFWDKTGKQWQQGAFWGKYAGVFVSTGTLGGGQETTAITSMSTLVHHGFIYVPLGYKTAFSMLANLDEVHGGSPWGAGTFSAGDGSRQPSELELSIAQGPGKAFYEAVAQAHQ

SEQ ID NO: 51304 - protein, 201 aa, Sorghum bicolor
  Clone ID: LIB5049-003-R1-XP1-D10.pep
MAGQSDPHLSIFSPSEVEFVAEDEIVEIVPNIRMDALNMICGDFGPFFPQIPTKVPLWLAVALKKRSKCTIRTPDWMTVDRLTQVLEAERESPREFQPLPFHYIEISKLLFDHARDDISDAYLVRSLIEDIRDVRFHKVETGLETISGRTHAVKLKNLSAMEVNIVRPFMVRTLQAFYKHDSPQMIQQADNTGSRATPVTD

SEQ ID NO: 51305 - protein, 163 aa, Sorghum bicolor
  Clone ID: LIB5049-003-R1-XP1-F1.pep
MASRKVLPGLASGRRLRSRAQQLLWAADLPVATTSRSLAAAAVTALPSGGSPAALLFSLRTISSTRLSTQSAAGDAPGPSAVDHKLIMQEDEFHKLADETIHDLLEKLEEYGDSIQMDGFDIDYGNQVLTLRLGDLGTNVVNKQTPNRQIWLSSPVSGTSRLD

SEQ ID NO: 51306 - protein, 133 aa, Sorghum bicolor
  Clone ID: LIB5049-003-R1-XP1-F10.pep
PAGPGKLEIFSLSQKEESSKILFFMALLKISTTRIVYLWAALFLVLGIMFATSPSYRAASLSGFNCCQENKLPLPRAEIDCRQYPICRPYGCFLACRGWGYTGVGSHCESKKNPMKDECCCNKDPRHGATPLV

SEQ ID NO: 51307 - protein, 134 aa, Sorghum bicolor
  Clone ID: LIB5049-003-R1-XP1-G3.pep
GPFFFFFLQAATHIALRLYSFNSVAHTQLPHKNYTPYIVSSKYEFILRSIFFGIHLDRHSTELYYGHSNSRKEYSDFVRGNHEYRCNVKGHTGYPFHPWLLGILHEWKSIRGVVAMKEILLHHCGLCVSPCSEE

SEQ ID NO: 51308 - protein, 57 aa, Sorghum bicolor
  Clone ID: LIB5049-003-R1-XP1-H1.pep
THSHLNINCKRCSILQHHTKQTPSTNPQATTSMTSQTPPFHRLLSFYSNRNGSDSQT

SEQ ID NO: 51309 - protein, 238 aa, Sorghum bicolor
  Clone ID: LIB5049-003-R1-XP1-H2.pep
MSREKKLVLFGDDKGWKASDWTDSDDRVRGGASQSYLTITGSSARFHGNLDITALGGAGFASQRTTGEDRTWDLSAYDGVYLDIGKHDGKKYTLTLKDEILPLMPDGREQSTISYEYDFESQSKLDLFVPWHAMKPTYRGKEKDDAKPLDTKNVKRFSIMMRSFFGTQEGDFDLTINSIKAVAQPDDIEKGIIGSEKGTGEQEPWSWKESNLVLAVILGSTWAISWGYCWWKDMTWVS

SEQ ID NO: 51310 - protein, 170 aa, Sorghum bicolor
  Clone ID: LIB5049-003-R1-XP1-H5.pep
MNYRKNVDVYIDADISSGRMSRQILRLTKLLHHVEKEEKYMDTYEISLLRGVSKEYAYTLHVTEKSDIYGFGVVILELVTGKKPMAAEIGEMDLVAWVSASIEQNGLESVLDQNLAEQFKDEMCKVMKIALLCVSKLPIKRPPMRSVVTMLLEVKEENKPKMKAATTLLI

SEQ ID NO: 51311 - protein, 117 aa, Sorghum bicolor
  Clone ID: LIB5049-004-R1-XP1-B4.pep
PAGPGAPSILHPPHTTSWASSLTTHLTISSSRPPSPRPTRSDSSSTARRPVSTSTSPTRAAKTTRSCPHRPASTTRSRTGRSSVTRPRCDTMSPSCQAPTSLPRTTSTRSTGPESSV

SEQ ID NO: 51312 - protein, 104 aa, Sorghum bicolor
  unsure (1)..(104): unsure at all Xaa locations
  Clone ID: LIB5049-004-R1-XP1-B9.pep
MANVPXVEFLKTKQTIIPPYMPXQGFAWLGITQASVHGCMNTKQATTPPYLLHKDFHYTKFSFYDNMNSLVLLNCLSEPIMKQSIVAKIRHLLDCSMNFVYCKI

SEQ ID NO: 51313 - protein, 112 aa, Sorghum bicolor
  Clone ID: LIB5049-004-R1-XP1-C12.pep
SSSPSSAAASSFFISASMIFSAATRFWGRPLLFLAGTATSSPLLPLSSWVLPLVSCFRPLPLPLPIDDSIQQKKLQRQLRKLGDAKIIYLDAAYSVVLLLPFWNSQKYLTCD

SEQ ID NO: 51314 - protein, 143 aa, Sorghum bicolor
  Clone ID: LIB5049-004-R1-XP1-C5.pep
MAKQSLLLAILFVACMLEANSKIAAASTAYDVLQQNNLPQGLLPLGVKSYVLKGSALSVSLGRECNFLVTVGGKQFKFRYASTVSGVIKSGSITGVNGVRLQVEFAWLGVNQVSRAGNQITIQLEKSSQSFPVSGFSQSPRCT

SEQ ID NO: 51315 - protein, 125 aa, Sorghum bicolor
  Clone ID: LIB5049-004-R1-XP1-D6.pep
RPGRAYAITLNDIPEGLRPYLCPTDCRLRTDQRAFENAQYDKAQMLKSANEEKQRNTRKLRAEGKLPPHEPRWFSAGRDDDCGERTWYPRRAEDGEVLFWSEREKAGGKGEWDGVDHIFAEDVEA

SEQ ID NO: 51316 - protein, 237 aa, Sorghum bicolor
  Clone ID: LIB5049-004-R1-XP1-E10.pep
MSAGTADTVVCVTGGSGYIGSWLVRKLLGRGCVVHATLRSLAGEKKTELLRALPGAAERLRLFEADMYDADTFEPAIAGCHFVFLVATPMAHDPTSTKYKNMTEATVDAVRIILRQCERSGTVKRVIYTASVTAASPLKEDGSGYKDFVNESNWTPLNLSYEFSNTHLDDYVRSKSLSEKELLSYNESSKDQPGTLVEVVALACAVVGGDTIQTYLWSSLAVVVAPLTGQAILHHSL

SEQ ID NO: 51317 - protein, 241 aa, Sorghum bicolor
  unsure (1)..(241): unsure at all Xaa locations
  Clone ID: LIB5049-004-R1-XP1-E11.pep
XARAREKKKKKKIKCDGKSALWSSSSCGDGVSFVDLVKEYSSRARRFIVEDEELRERIKSDLHIESINGEEDALREVAWGLRSGPPFIISEFLYDVTISPQRHLPLCQGFEVFMKKYQIDIPTEAVDEDFLTRAGTLQRIDELILYRCTEMREVCSKLVPGISGMIKDNFRYVEVMAKILTPWLVGEEWDSSKWSTAGEPWFTPDEMQKIVAKDAAADDAREKXKGDHKVAAMIEPTLMTT

SEQ ID NO: 51318 - protein, 128 aa, Sorghum bicolor
  Clone ID: LIB5049-004-R1-XP1-E3.pep
ECTWPSTWLWSSPKKLFSREGSKNHQLIRNPGASCMGDGALRQSEISLSGPYMFYSDELCCVIELESRRIWSVEITIYNVVPSIFRLGKLIHKQEINVLALVDSLQLNIKRNTFTPLTFWKKKKKKGP

SEQ ID NO: 51319 - protein, 239 aa, Sorghum bicolor
  unsure (1)..(239): unsure at all Xaa locations
  Clone ID: LIB5049-004-R1-XP1-E6.pep
RPGRVAIKAALHDPGNVLWDWDLKFGNDPCRWSMVTCQKGQIQELSMTNKNLSGTLSPAVGKLRTLRYLLLSHNALSGRIPDTVGRMKLLEVLDLSNNHFSGSIPSTLVHLANLQYLKLNNNSLSGPIPESLATDAPMLFSLDVSFNNLSGHRPTFRIWNVFFEGNPFLSDIGSESIAPPVGPKDGKEEDSQGMSXNIFILLLCIGIGCLLVAIVAGAVLFWRKRQRERVFAVADGNIF

SEQ ID NO: 51320 - protein, 136 aa, Sorghum bicolor
  Clone ID: LIB5049-004-R1-XP1-G3.pep
AGRAGARNRRRNSIIFVMAKSSTSRWIAHSIAAVLLVLLIMSASCQAENLTSSDSPQLLPAKIRSPQMPCFEDITNCTFSSCYDLCKAKGVMSYDASCLNWTDNQGHVHVECCCPRSAAYVANKDDNSSAPVYVLP

SEQ ID NO: 51321 - protein, 194 aa, Sorghum bicolor
  Clone ID: LIB5049-005-R1-XP1-A10.pep
MNFISNLVNSDGIINPLIDNGYLPHAAIRLGIRRQLADRLSSIATTSLEAGYESKMKYVELLRQRPIAIETAKANDQHYEVGTQVLKGMLGPRMKYSACLYEKGGETLGEAEVRMMELYVKRAALKDGMTVLDLGCGWGSLSLYLAEIFPNSSITGFSNSRTQKQHIDSVATAKGFKNLRIVTGDVVDHEFEPE

SEQ ID NO: 51322 - protein, 200 aa, Sorghum bicolor
  unsure (1)..(200): unsure at all Xaa locations
  Clone ID: LIB5049-005-R1-XP1-A12.pep
DQVQELRAYLKELGAEITEEKSPKGIEDDLHKIIGVXDACFKERSEQEVEKVLHDIASIMDVIPLERAENIILAFCEKLTKAPGTRLGMVTLRALCVIYQSLDDKSPMRYHVNYHLLHVAKQTDQVRAAFKDVDNLKQRFATCPPSIEQMQXLYPLLHEVLVPSXTTVTSCISHCTQLLRTYTAENASHARDHAIRCIAS

SEQ ID NO: 51323 - protein, 158 aa, Sorghum bicolor
  Clone ID: LIB5049-005-R1-XP1-A6.pep
MAQVVKNSLRAARHRAWVGGGYKSTSSLRAPTPIPTPAFHNSATFSTTPHIMSSQKPFMDAVKERRTYYQLNKESPISDKQIAEIAEKALLHVPSSFNSQSTRLVVLLNKDHEKFWDFVLEVLKPLTPEDQFPKTEQKVKGFGAAKGTILCYEDPEPV

SEQ ID NO: 51324 - protein, 182 aa, Sorghum bicolor
  Clone ID: LIB5049-005-R1-XP1-B5.pep
MATEEGSGGGGAGAGEKKSSQVPAKPGAGGAGKFLAGLPSRGNFSSGSGSSNLGGFRVYVCEHSTDPPEGQVIKTDSTNILIRHLQLNKQKSEVKDADSRTPGENNRGKRSAARSLDVNNSAKRANLGTSSGSSACEEISGFSQHTLQSFTVERLRALLRQSGRSTKGKKDELIARLRESQG

SEQ ID NO: 51325 - protein, 90 aa, Sorghum bicolor
  Clone ID: LIB5049-005-R1-XP1-C11.pep
PSPRRRRSYNSISAPGAPPHKVPYPLREDVSRCVHGKTERGPAVVGHAYCEAWTSYCCWWIVHVCLPLRAARQKLMGSIRPSPGVVIGMV

SEQ ID NO: 51326 - protein, 214 aa, Sorghum bicolor
  unsure (1)..(214): unsure at all Xaa locations
  Clone ID: LIB5049-005-R1-XP1-D2.pep
MVFLVGEVLEANRTARRAYLRVLFESTGRDVAKKVICLLLWLEMTMGFQVLGSVATMTSGDMSLARVIVEACAVYNYVLHGSYEQPAPLVDIPTIVALCGVRGGRLVDSRFFMFHKDIVARGVAFIRDTFAPLIFDDYLHGMLHRFNDVSNSFLVPAPLPAPELMAPFIVFTSLPPEDYQTAFVAIPEHDPLSSQDIQEYXERRLMFGPCIERI

SEQ ID NO: 51327 - protein, 48 aa, Sorghum bicolor
  Clone ID: LIB5049-005-R1-XP1-H11.pep
LVVERNRQIEGSRCEFRTARRSRAERHSRGEETGEWSPPERRMTAPAR

SEQ ID NO: 51328 - protein, 146 aa, Sorghum bicolor
  unsure (1)..(146): unsure at all Xaa locations
  Clone ID: LIB5049-005-R1-XP1-H4.pep
MDAWDLIIVIVVVAPLVLEGVGSQNLWIWNASLNDGGSISDISVLDQSPAYNEILKGQAPPMQFSLNKSQYKLGDYLASEIYPQXKECVRTKPFPRTEKERLFARHQXKARKDVRXAFVCMQARSSIDRGPTRYFPRATLARNFQA

SEQ ID NO: 51329 - protein, 194 aa, Sorghum bicolor
  Clone ID: LIB5049-006-R1-XP1-B12.pep
MVNLSQQKRLAAAVAGVGQRKIWLDPQEAAEIGQANSRSGVRKLLKDGHIIIKPTTIHSRARTRELHAAKRLGRHTGTGKRKGTAEARMPTKVQWLRRMRVLRRLLKKYREGGKIDKHLYHTLYLEAKGNRFKNKRVLMEHIHKAKSEKLRTKNLQEQAEARRVKNKAMRERKAARLAEKRQGIHEVELEEAKE

SEQ ID NO: 51330 - protein, 74 aa, Sorghum bicolor
  Clone ID: LIB5049-006-R1-XP1-C5.pep
MSQAQPLRFQAQRKHVKFQDSQANAMKEPGTSGYGYGMKDDKNKDVDTIASDFIKLKHRAWALQKSTTMYQPST

SEQ ID NO: 51331 - protein, 209 aa, Sorghum bicolor
  Clone ID: LIB5049-006-R1-XP1-D5.pep
MSAAVAPGYTIHVAGLATETTEEKLHDFFSFCGKLVSVKKTGSTADITFEKLSAMRTSLMLNGGTLDGAHLEVTSASDVEPKASVLPTGSTGATPIGAGVAGSSEISQEDKPKAAIVAEYLAHGYVMGDHVIQRAIDFDQKQGISSRFLDFFHSLDKQVGEKVVGEQKTVTGKINESAAAVVAKTREDQNRGVSAPILRLLQQGYRNSY

SEQ ID NO: 51332 - protein, 243 aa, Sorghum bicolor
  unsure (1)..(243): unsure at all Xaa locations
  Clone ID: LIB5049-006-R1-XP1-E1.pep
RPGRVFYSGSPWCLGTQMGWFHNMVDRIAPRDAAKKQFLSDSLVVMGGIGGNDYYSYFIAGKPSKDGNIIPDVIAYIEHFIEELICSTGAKAFLIPNNFPIGCFASYLSRFHSDNPEDYDEHGCLRWFNEFSQTHNEQLYSAIGRINITYPDVKLIYADYYNATMEFIKNPGRFGIGNPLVACCGGDGPYHTSMECNGTAKLWGDPHHFANXDGMHMTEKAYXIIVEGVLXGPFADPPIPXSC

SEQ ID NO: 51333 - protein, 270 aa, Sorghum bicolor
  unsure (1)..(270): unsure at all Xaa locations
  Clone ID: LIB5049-006-R1-XP1-F8.pep
PAGPGSHCQLSHRSLVSTYSCCQGPGVNSQHQIAIMIEEVLKKTSEMFPLPTATASSLPSVAPVPTVIPGSEPVYEVAGDAGQKALWVVFVLMLIASAGFTVMSWKVPLNKRLYHVITTIITLTAALSYFAMATGHGVSLNKIVEREQHDHVPDTYTTTYRQVYWARYVDWSITTPLLLLDLGLLAGMSGGHMIMMIVADLIMVLTGLFAAFGTEDTPQKXGWYTIACIAFIFIFWHLGLNGGANARAKGXQLRTFFVSIAAYTAILWTA

SEQ ID NO: 51334 - protein, 36 aa, Sorghum bicolor
  Clone ID: LIB5049-006-R1-XP1-H12.pep
ENEYKALRDEANISGSGNGEIVPEQPELSNPAASSG

SEQ ID NO: 51335 - protein, 115 aa, Sorghum bicolor
  Clone ID: LIB5049-006-R1-XP1-H7.pep
MARGNSPQTQVFYKGSTGDLFTIFVESVEALQKWKADSSIPMVEVVAGWKVMVPEHGKQGVPNTASKQQLENEFGAGAKEDDIFKKILQEGEVQSSENSERIGITNETQGGRQAH

SEQ ID NO: 51336 - protein, 258 aa, Sorghum bicolor
  unsure (1)..(258): unsure at all Xaa locations
  Clone ID: LIB5049-007-R1-XP1-A11.pep
MASKAPPDLLNATSSIHMIVRQLFSRMVFSLQMECSLSMEIISFWLWLEGNGHPDFLASVESFDNYNLRGIAVAGKMFIEALRRKSSHFNHRSEEEGYFQKEATEGILFYLNNFCYKALEDILEIAEAKERIYRNNHQQVQQQNMKGKAPIMSTKDLLSKIRASFTGNPSHEEGSSSRSMPSPKNQILRDIENPIDQCLSTYPLATLFDSLNLRDDPQADAIQLQIQVQRQPSIPRDERTLFVXFLNXLPFTADELFE

SEQ ID NO: 51337 - protein, 107 aa, Sorghum bicolor
  Clone ID: LIB5049-007-R1-XP1-D11.pep
GPFFFFFLFFFFFFFFFFFFFFYTITNLINLCLGAGMSTPSLCRITPTSSAPNTAEALAVIFAWKQYLSTLCSCSQNFFFSWSRSAHFICAIMTLPMHMSSKVSKEK

SEQ ID NO: 51338 - protein, 219 aa, Sorghum bicolor
  Clone ID: LIB5049-007-R1-XP1-E10.pep
MTATLAYNLYLSLTYLGYLRSAICFAEKKKKKKKSRRTAGQPIRQSPSRPLLRPPIPRARPLPPPRLPPLFKRFPFPACCATRTGTAACLLGPFYPASMAEEAAATLAGGDKLILRGLQFHGFHGVLKEEQTLGQKFVVDIDAWMDLAAAGESDSIADTVSYTDIYGIAKDVIEGTLHNLLESVAHSIAKATLLKFPQISAVRVKVGKPHVAVQGVLDY

SEQ ID NO: 51339 - protein, 169 aa, Sorghum bicolor
  Clone ID: LIB5049-007-R1-XP1-F5.pep
MQGGGGVEQPMQMVLRVKHPSSLGSSAGDDDEGEGSSRSALSVFKAKEEQIERRKMEVREKVFAHLGRVEEESKRLAFIRQELEGMADPTRKEVESIRKRIDTVNRQLKPLSKSCVKKEKEYKEVLEAYNEKSKEKALLVNRLIELVSESERMRMKKLEELNKTVDSLY

SEQ ID NO: 51340 - protein, 127 aa, Sorghum bicolor
  Clone ID: LIB5049-007-R1-XP1-G4.pep
MTPPHLPVTVAVAVLLLFLCLPATSVAAAAAADPTPTPWPPQFHATLVMEYHGNMSVADLWYDWPGGRNLHIIRYQLAADAPYYDNEWNNGTSFFYTPARRTCRSAAVGDGILRPDWLRPGSVYLGR

SEQ ID NO: 51341 - protein, 114 aa, Sorghum bicolor
  Clone ID: LIB5049-008-R1-XP1-A4.pep
MPRATSDAKLLIQSLGKAYAATPTNLKIIDLYVVFAVATALIQVAYMGLVGSFPFNSFLSGVLSCIGTAVLAVCLRIQVNKDNKEFKDLPPERAFADFVLCNLVLHLVIMNFLG

SEQ ID NO: 51342 - protein, 185 aa, Sorghum bicolor
  unsure (1)..(185): unsure at all Xaa locations
  Clone ID: LIB5049-008-R1-XP1-B7.pep
MRKLIETAERDDEKDEXRRKAPTTAESEDVNVKDCNLXRAAYNNVIATFRFFCIIIFSIVHNDEARXSEDRVTLXIKDYCANIETDFTIIYCAILNLLEYHHAPATTAPRLEDYYAPKXGDHXRYLAEPESELERXDAAENTMVAXHAEQDIGLCELAPTHPIRCALRLNFSELYYEILNSSDHC

SEQ ID NO: 51343 - protein, 140 aa, Sorghum bicolor
  Clone ID: LIB5049-008-R1-XP1-C10.pep
VSAEHFDDGYRDDGLHLSRMLSSKPRCGNRCTSCVLQVFELETITSPGPCGPFCQVSPVGSLSEGTRRRSERRSPDPRRVLSQALSRSATTIISFRTASRSCRSITPFPPPSNSPIFPRWHSSRPPPGSIWTRPKSGPAG

SEQ ID NO: 51344 - protein, 174 aa, Sorghum bicolor
  Clone ID: LIB5049-008-R1-XP1-D2.pep
VSGMEHCYLRQPIPRAEAMPERRSRFWQMDAPPPPRAEVICPQPRRATRTPFAVETVNKASPKTNGAFPLYRSDSTCDILDLILSKNDSDGDSSSQVGFLCGSPPVRTNNPVIHDPQFGKKVPSFSPLGSSYGKAPTVRVEVGSPSCGVSSSPKVRIEGFACGNSETHYAVTFV

SEQ ID NO: 51345 - protein, 247 aa, Sorghum bicolor
  unsure (1)..(247): unsure at all Xaa locations
  Clone ID: LIB5049-008-R1-XP1-D7.pep
MGRQFFVGGNFKMNGSIKSITDIVENLNKAKLDPNTEVVIAPPALYLLLTREHLRKGLEVAAQNIFDKPNGAFTGEISAEQLKDSGITWTLVGHSKRRQILQENDDFIANKTKTATDNGLGVILCCGESLEQREAGETVSVVTKQLKAVADKVKDWSKIVVAYEPIWAIGTGKVATTEQAQEVHAALREWLKKEVSPEASEKTRILYGGSVSEXDCNELAQQXDIDGSLXCGASLKPALXTSSRYQA

SEQ ID NO: 51346 - protein, 57 aa, Sorghum bicolor
  Clone ID: LIB5049-008-R1-XP1-E6.pep
RRQRILKSSVPPGGMMPALCFIILEQGLNSGGFSSPSVHPNASQECHPYHEVLWCTN

SEQ ID NO: 51347 - protein, 118 aa, Sorghum bicolor
  unsure (1)..(118): unsure at all Xaa locations
  Clone ID: LIB5049-008-R1-XP1-E9.pep
LASFVPLPSVALTEDVSWAGNCGCXSGCKCCRDCIGCNMYPDMDEYHVTTIDNTLVMGVAPSPNGHIEGGIKAAHGAGAENEGSESGPNCSCNPCTLQESCIITPCTDTAARRKDGLP

SEQ ID NO: 51348 - protein, 221 aa, Sorghum bicolor
  unsure (1)..(221): unsure at all Xaa locations
  Clone ID: LIB5049-008-R1-XP1-H10.pep
MALPNTPPVDFPSFKLVLVGDGGTGKTTYVKRHITGEFEKRYEPTIGVEVRPLDFTTSHGKIRFYCWDTAGQEKFGGLRDGYYINGQCAIIMFDVTSRITYKNVPTWHRDISRVCENIPVVLCGNKVDVKNRQVKAKAVTYHRKKNLQYYEISAKSNYNFEKPFLYLARKLAGNMDVKFVEELALVPADVTIDVAAQQQIDKEIELAAAIPLPXEDDDNMD

SEQ ID NO: 51349 - protein, 204 aa, Sorghum bicolor
  unsure (1)..(204): unsure at all Xaa locations
  Clone ID: LIB5049-008-R1-XP1-H12.pep
HCLNITVIVYTTQFVALFIGGSCLEKKQSSNAYLSQSTRGLRALLRKHGVCFSMPLCNTEVEQATEDDLIELSEIQRRNLGQALHLDALSDVDNTTQSLLSFTGNENVHGLYDVLLNYKSLLNSLSSVDVPVLYSPQPFQNGCLHIPEVKCREMRRADMXLLSSGGFDTEQGSAFASTTGNICYSMEIKDAVLPPWVVSGLCPA

SEQ ID NO: 51350 - protein, 210 aa, Sorghum bicolor
  Clone ID: LIB5049-009-R1-XP1-B9.pep
QNKSYISDLEAQEKATEKELKKLHAITEDERKDHVKLRDSTFKRYVHKLGGSKGQAKFASKSEKEEREFLEAWQKEREAEERRAELQRALNTAKEDRQRLEGKKTRNDGAQRELDQLYASIFSGPTPEVPGEDQMESTVQSAKQYLEQVQSQCNADCAAVDALSRVEERMGVAAGAMQESLSMSRFDMMGGGTLADMMERDALSKAFCAI

SEQ ID NO: 51351 - protein, 131 aa, Sorghum bicolor
  Clone ID: LIB5049-009-R1-XP1-D10.pep
VHHGGAGTTAAGLIAGCPTTVVPFFGDQFFWGERAHARGVGPAPIPIAELTVEALSNAIRFMLDPEVKSRTMELAIAIGNEDGVAAAVDAFHRHLPSELPLSPPAHVEEERIDFLQWFSRALEKCCFPFNM

SEQ ID NO: 51352 - protein, 95 aa, Sorghum bicolor
  unsure (1)..(95): unsure at all Xaa locations
  Clone ID: LIB5049-009-R1-XP1-D5.pep
ANGHVLPKSACSSVEGCFFSLKTRWDRDRQQACCSXTVGVARRHGRFWKVSLAHQPLVEVALMSGGMQRRRAERAEPEGNCLSGRINVFTVLWFV

SEQ ID NO: 51353 - protein, 88 aa, Sorghum bicolor
  Clone ID: LIB5049-009-R1-XP1-E2.pep
SFSKGIQSRRPVIMPNLLGMAFPRQPAVIDSFVGRHYRRRARQTKVNRGLLYTWIIGWQYLHHLTSSCLTFLFHGFPASALISFVLAS

SEQ ID NO: 51354 - protein, 116 aa, Sorghum bicolor
  unsure (1)..(116): unsure at all Xaa locations
  Clone ID: LIB5049-009-R1-XP1-G5.pep
MSRRGWGGKELGKGGAKRHRKVLRDXIQGILNTCIRRLMRRDXEKCISGLIYEETARXCSTIFLENDVPDAVXYTHNDRRRTCFAVYGFYIRECHRRTHCGLGYAKCSDAPGYVIR

SEQ ID NO: 51355 - protein, 136 aa, Sorghum bicolor
  Clone ID: LIB5049-009-R1-XP1-G7.pep
LKFDAMVCSQSSSAMRRSAGGSRTTAHWLPDVGDAAENELTRWYLSSDMIEVPAGRRRYRAEEDACIITEREAWIASSPRPRRSRVAEAPSEIGWWRLIQCYTGDSVHPFSYVSRAGSESAADYVLRTAEGPGPAG

SEQ ID NO: 51356 - protein, 117 aa, Sorghum bicolor
  Clone ID: LIB5049-009-R1-XP1-H7.pep
MSSTIYSSNSSAPAEEQQQPQQQPETPNNDAPKAPLALPEAPANATQLDMSTGGTTVSLDHLGPMVVNVDGTMSRIANWDKMAEIEKKNTLRIIGKRNKDRLAALKAAAPQNEGEAK

SEQ ID NO: 51357 - protein, 86 aa, Sorghum bicolor
  Clone ID: LIB5050-010-R1-XP1-F5.pep
IRQVAPQAQASGHGKGGVRVVGWRWGGGVDEEAGQHKEHKDHEDRVHGHDDATLHSAGSIASMAAGVSHSRELRTKVKGILNLQWE

SEQ ID NO: 51358 - protein, 181 aa, Sorghum bicolor
  Clone ID: LIB5050-010-R1-XP1-H6.pep
MAAHVDPLVVGRVIGDVVDLFVPTVAMSVRFGTKDVTNGCEIKPSLTAAAPVVQIAGRANDLFTLVMTDPDAPSPSEPTMRELIHWLVVNIPGGADPSQGETVMPYLGPCPPVGIHRYVLVVYQQKARFRAPPVLAPGAEVEASRARFRNRAFADRHDLGLPVAAMYFNAQKEPANRHRHY

SEQ ID NO: 51359 - protein, 95 aa, Sorghum bicolor
  unsure (1)..(95): unsure at all Xaa locations
  Clone ID: LIB5050-011-R1-XP1-A12.pep
RKRFIGPVXTVTIEXLIEXMNXLXXIQGSMVLFGGEALXNXSIPQISDTHEPXTPVFVPLQKILTTATFDLVTXHIFGPSHVVTEYSEDQLELVL

SEQ ID NO: 51360 - protein, 107 aa, Sorghum bicolor
  unsure (1)..(107): unsure at all Xaa locations
  Clone ID: LIB5050-011-R1-XP1-B12.pep
GQQERGRGTEPQGGGGGGGGLHTEDSTPGARPENVRLWPAGGDYDVTDGAGASLHLLLELLRLQQXXFXHPLSLXISSLSXDXNHHTXSETLCSLXXLCSGLXXKLP

SEQ ID NO: 51361 - protein, 78 aa, Sorghum bicolor
  unsure (1)..(78): unsure at all Xaa locations
  Clone ID: LIB5050-011-R1-XP1-C2.pep
GRKWGEEXXEKEXRIYXVCSSWWTTPSCSSFHLLPRLPRRVSVIFPPSSAPPRPDFVSGSLSYFFHLLVSFFSCRRWR

SEQ ID NO: 51362 - protein, 66 aa, Sorghum bicolor
  unsure (1)..(66): unsure at all Xaa locations
  Clone ID: LIB5050-011-R1-XP1-D12.pep
LDGGGLLVLSHVRVHLAPSPTAXPLXTGXPPPXXSXPRHPXPKXLMEWNEXXQSXDRSGWRCIFRP

SEQ ID NO: 51363 - protein, 86 aa, Sorghum bicolor
  unsure (1)..(86): unsure at all Xaa locations
  Clone ID: LIB5050-011-R1-XP1-H12.pep
DDGNLSLVVRCYRVQAAREIPSSWFFTGPFNCFWSRRLXXLXXLXIPXKQXSSTGSXLGFXRWEVXXRPPEELFXFXXREXLRNRE

SEQ ID NO: 51364 - protein, 188 aa, Sorghum bicolor
  Clone ID: LIB5050-012-R1-XP1-B11.pep
MENAAANPSAAAAAAAGNGVQASGAGGERPEDASKQNLAQVTSSIQKTLGLLHQLNLTVSSFNSASQLPLLQRLNALVAELDTMQKLAEGCNIQVPMEVVNLIDDGKNPDEFTRDVLNSCIAKNQITKGKTDAFKSLRKHLLEELEQAFPEDVEAYREIRATSAAEAKRLAQSQGTLPNGDVKVKAEH

SEQ ID NO: 51365 - protein, 84 aa, Sorghum bicolor; identical to SEQ ID NO: 46632
  Clone ID: LIB5047-001-R1-XP1-A11.pep

SEQ ID NO: 51366 - protein, 67 aa, Sorghum bicolor
  unsure (1)..(67): unsure at all Xaa locations
  Clone ID: LIB5047-001-R1-XP1-A2.pep
GGGHLLLRQSGVHLAPSAXAAALQPDPHPQCLRSTAILRQEDGWNGMSSPISSDRSGWRSFFPNXPA

SEQ ID NO: 51367 - protein, 193 aa, Sorghum bicolor
  unsure (1)..(193): unsure at all Xaa locations
  Clone ID: LIB5047-001-R1-XP1-A6.pep
MNITPVFNQVLAKHDAPLVEPYVFRVEALDGFLKEAYRIRTHISKLHADLKSIRQSYLSTANPPRRKQYARSDQSSTDKDTKYLTDAERTEIDAQAKQSLRELNHAINNPRDAEELRQTTQSQVALRKXAKQGLGALGRWAAGGAITAKSVAEELEEAKATTIRAHRESIVWMLQNQLEECGRFQSGMMEIGS

SEQ ID NO: 51368 - protein, 112 aa, Sorghum bicolor
  Clone ID: LIB5047-001-R1-XP1-A7.pep
RGLFFFFFCSNRLPQDHSENSFFSFYIPRPDFSTPKGIKQHINWPKNIAIHSSTELIILLQKLPAQRPLSRNPIDPLVLKKTDPAKLYLLARWQIFVYKTRTAQLPVQARPA

SEQ ID NO: 51369 - protein, 63 aa, Sorghum bicolor
  unsure (1)..(63): unsure at all Xaa locations
  Clone ID: LIB5047-001-R1-XP1-B1.pep
GGRVRXTRAGSLTFTDSLDPPWSWWVCGEEERKVDNCGRRGGGAPPGDGPQEAPQGRHCPPHP

SEQ ID NO: 51370 - protein, 96 aa, Sorghum bicolor
  Clone ID: LIB5047-001-R1-XP1-B11.pep
AGRAWAMAAAPVRGKNTARRTAWRLAAVSFLLFVFVAVMLISTTTVQSRHELTSSERGSEFRAWRKDGVRPDRTTDMTTPPAPKANSNVPGGPFGR

SEQ ID NO: 51371 - protein, 198 aa, Sorghum bicolor
  Clone ID: LIB5047-001-R1-XP1-B6.pep
DPPTSATPTVKTTSTAGVTPLVKPTSATPMVNTRSAAGVTPLVKPTSATPTVKTTSAAGVTLLVKTTSAAPTVKKTSAAGAATLVKATSTTPTVKTTSAADMTPLVKTTTAAPTVKTTSAAGATTLVKATSTTPTVTTTSAADMTPLVKATTASDATATISQAPLVSMKNTGTKQAFFFFFFFFFFFFFFFFFARPGR

SEQ ID NO: 51372 - protein, 131 aa, Sorghum bicolor
  Clone ID: LIB5047-001-R1-XP1-B7.pep
MISAPLRVSAPKAAVGGGSFLFGGASYVDSKPSKIKIRCAAAAAPAVGRGGAAAAAATLYEVLGLRAGATGREIKAAYRRLARERHPDVAPAPGAAAEFVRLHDAYATLSDPDTRARYDRGAVAVAQRPWS

SEQ ID NO: 51373 - protein, 66 aa, Sorghum bicolor
  unsure (1)..(66): unsure at all Xaa locations
  Clone ID: LIB5047-001-R1-XP1-C1.pep
HSRFGIDDDGFPSXPATRERRNKKSPAPRRHSHLSYLVSPGTAEPAESNLMGDIQVGGRTLVIPTR

SEQ ID NO: 51374 - protein, 148 aa, Sorghum bicolor
  Clone ID: LIB5047-001-R1-XP1-C11.pep
LPRRVHKMSRERWGLVYHVLALRGSAAASAPWTEKLGATRPRDHSNMHDKGWYDTLTMRTPTRKMDNPGTLTKKTSLTSQNNRLEQQKSAQISMHARWNLHPYTDLIHIYMPVHETRCPLSIFLAADKVRQAVPHPLFLHENLSDPQE

SEQ ID NO: 51375 - protein, 64 aa, Sorghum bicolor
  Clone ID: LIB5047-001-R1-XP1-C12.pep
MGWLHSLFSPLRRMWVRAHSERRNRRGMHILYKDVQSCQDEDVHVLWSILIDSHRHPAVLKLKL

SEQ ID NO: 51376 - protein, 59 aa, Sorghum bicolor
  Clone ID: LIB5047-001-R1-XP1-C4.pep
MSTIHFDEREIFGLIRLINDPEHSLTLEELHVVQPSLIKVANKNNEVFGHFTPTIPHWS

SEQ ID NO: 51377 - protein, 82 aa, Sorghum bicolor
  Clone ID: LIB5047-001-R1-XP1-D4.pep
LLYFLVYKIRKLQKRKKKSRGGSVAGIAQEFSTTEETILAVNKMADSNALVAGQVLVVPLRDRPPLFIFLAARVFLIYFRLV

SEQ ID NO: 51378 - protein, 133 aa, Sorghum bicolor
  unsure (1)..(133): unsure at all Xaa locations
  Clone ID: LIB5047-001-R1-XP1-D8.pep
SKGDAAATKTYPQQAGTVHKNGFLRIWGRPCQAEQDPTSQTWEXHDHATCHFDAIYIFSLNKLEHIVPSSHHCDIXPHENRXEHPLIDISEDGFESLLTSHAHTKDDLRVPSDETLVVHSKECRESVKDLAVT

SEQ ID NO: 51379 - protein, 149 aa, Sorghum bicolor
  Clone ID: LIB5047-001-R1-XP1-E10.pep
MQQEVVDVLERWELVMTAARRGDLGSLESLLSKRAAVCGRDQYGLTALHLAAIKGHCDAIALLAGSGCMDVECEDVEGHRPLHLAVEGGHAEAVEVLLDMGADVNARTRRGATPLQMAEAMGYEAVAQLLCARGAEVAAAPALCPNPAG

SEQ ID NO: 51380 - protein, 176 aa, Sorghum bicolor
  unsure (1)..(176): unsure at all Xaa locations
  Clone ID: LIB5047-001-R1-XP1-E9.pep
RLCLCSSQTAEEREKLSAISMRIKAAKAKIKALSQSEEPLAIVSPARHPSSSTKQEDYRPLFHDKHGSPIATIAVNGGFNRXDYPSPSKATDKFPKTKDGTYLENLLQTANHPALGNHLASDTKSDELPPPTPSLLPKHLARTQFVNIDSLPSPCSQILMACSCMNARNLNTTAYW

SEQ ID NO: 51381 - protein, 177 aa, Sorghum bicolor
  unsure (1)..(177): unsure at all Xaa locations
  Clone ID: LIB5047-001-R1-XP1-F12.pep
MKAKGLLKEYEVVGRKIPTDNEEQTPLYRMRIFAPDAIVAKSRFWYFLRQLRKFKKTTGEIVSIKLIPEKSPTKIKNFGVWLRYNSRSGTHNMYREYRSLAVSEAITACYRDMGARHRARAHAIQVIKVEEVKAANCRRPLVKQFHDSKIKFPLPKRIQGRSLAPRFAYRXPNTYFM

SEQ ID NO: 51382 - protein, 80 aa, Sorghum bicolor
  unsure (1)..(80): unsure at all Xaa locations
  Clone ID: LIB5047-001-R1-XP1-F6.pep
MARSAPAAAAAASSPAPKPQPQPQPHPHPQLRGSQLKQLREIFQRFDMDGDGSLTQLELAALLRSLXLRPTGEEXRAPPA

SEQ ID NO: 51383 - protein, 147 aa, Sorghum bicolor
  unsure (1)..(147): unsure at all Xaa locations
  Clone ID: LIB5047-001-R1-XP1-G2.pep
RAGTRASXFPTPYQSPFHLCKPHILLSWNHINCIHARYITARLIPLASASLIYRSDSPSSPLDLDLDITRLRNRKNASSNAGSRTTTPSTQRLSNDLDRVGPAPGDLQDARLPTTRGQLHPPHTNNTLATARPLLLLRLAPARLMDI

SEQ ID NO: 51384 - protein, 182 aa, Sorghum bicolor
  Clone ID: LIB5047-001-R1-XP1-H11.pep
RPVCLSSDLTELVKTPVAVVSAGVKSILDIPRTLEYLETQGVTVAAYRTNEFPAFFTEISGCQVPCRVDSPEECAKIIYANKNLHLGSGILIAVPIPKHHAASGKIIESAIQTALKEAEDKRIIGNAITPFMLERVKELTGGSSLEANIALVKNNALIGANIAVALSNLQQRKINRMGRSAL

SEQ ID NO: 51385 - protein, 99 aa, Sorghum bicolor
  Clone ID: LIB5047-002-R1-XP1-A8.pep
QETLSLLLLPLDAVSLFLRTPIRHERENLSNPWPPMNSPAHTLPSSSQKMISPLPTKISTQIHHEVTINCNSYWLLLFPNLLDNHYAKDHIHSDKFAHR

SEQ ID NO: 51386 - protein, 81 aa, Sorghum bicolor
  unsure (1)..(81): unsure at all Xaa locations
  Clone ID: LIB5047-002-R1-XP1-B1.pep
RPXGFRQLIQKAXRSPRRRRRRRSKTASAPRSAQAGRGWDLICLQGSPGELSQRSNLVLYGRIQCRASAPSKRHHCAGDES

SEQ ID NO: 51387 - protein, 58 aa, Sorghum bicolor
  unsure (1)..(58): unsure at all Xaa locations
  Clone ID: LIB5047-002-R1-XP1-B2.pep
TYVCPRHLAPRSSPSFSGDDFASSTGGLLGSHAVSRGPAGLGMLGNISVAWFGPKPAX

SEQ ID NO: 51388 - protein, 47 aa, Sorghum bicolor
  unsure (1)..(47): unsure at all Xaa locations
  Clone ID: LIB5047-002-R1-XP1-C4.pep
MSCSCGSXCNCGSSCKCGKKYPPLXEKRXAGQGPVVLGVAPEKTAAA

SEQ ID NO: 51389 - protein, 74 aa, Sorghum bicolor
  Clone ID: LIB5047-002-R1-XP1-D3.pep
AGRVGHYDGVRRKSSQSLSVLLSLNMLEWDYHARSLGRSTASDHRPRFTGDIRADLGTQTAMAQGKARHCLGRH

SEQ ID NO: 51390 - protein, 68 aa, Sorghum bicolor
  Clone ID: LIB5047-002-R1-XP1-D4.pep
MEGAVGQMVVPVLGIVAAAAVTFYTVSFMEMRDKSFEELDEKYSELDESGGRQRRSRRRAERDRKRAK

SEQ ID NO: 51391 - protein, 95 aa, Sorghum bicolor
  unsure (1)..(95): unsure at all Xaa locations
  Clone ID: LIB5047-002-R1-XP1-E7.pep
DRYLVLSGPTRAVVWSDHVSIEVKMTVKGRTESEDKDLSFLVVPLLIGXQELSTLEFTLGHMVRSVAATIFVRVIDGSWLDTFHQLLMSLWRVIC

SEQ ID NO: 51392 - protein, 104 aa, Sorghum bicolor
  Clone ID: LIB5047-002-R1-XP1-G11.pep
FIYKCMICSSCMDIWADILSYSHFLWVVKHVVVVSILGLFIAVVHVPHAFLNQIQGHYNEECRSPRLRATRAVHVRPSEGALSSVIDVEQQSPHAEMACYWPPS

SEQ ID NO: 51393 - protein, 125 aa, Sorghum bicolor
  Clone ID: LIB5047-003-R1-XP1-A6.pep
PGLTPIPFSLSRDPARAAPPASRPASRARSSELARLPPPHQHQPNRADRDAGDWDTESTPADSASAETALNLRCYFHQSLGTSSWEWCDVEDFRIMFVKALPGRLWLGFWFLFCKDIVKVLILYR

SEQ ID NO: 51394 - protein, 59 aa, Sorghum bicolor
  unsure (1)..(59): unsure at all Xaa locations
  Clone ID: LIB5047-003-R1-XP1-B2.pep
AGRFXDLXXCARSRRADAALKFVRGASEKGRVGQDADLLEALTGKTSPSRSRAATPSDN

SEQ ID NO: 51395 - protein, 159 aa, Sorghum bicolor
  Clone ID: LIB5047-003-R1-XP1-B9.pep
RPGLGSLPLTASAVYPRLPALASGAAAYARLQAMKNALPSLRFLASLATVYTPDMACDLKTTCTSVRALHKMQDDRGFPPPIASSAMSMLPAPRMSKRRLATAVVSDRFLMFSALSCLCSCCQDVRCACASRSFWRFYLRWSCDEMGTQDYICPSVLRI

SEQ ID NO: 51396 - protein, 47 aa, Sorghum bicolor
  Clone ID: LIB5047-003-R1-XP1-C1.pep
PVRAVYLYDQFSCRFRPPPFSDSRARRPPGRSVRNAGKAILPLSVGH

SEQ ID NO: 51397 - protein, 67 aa, Sorghum bicolor
  Clone ID: LIB5047-003-R1-XP1-C11.pep
LLTLLFRGLRSILWVHSRENLESVSGALIEQAEITCILQTIPCMWTFSSFLGSSARSRGDHIAACRI

SEQ ID NO: 51398 - protein, 63 aa, Sorghum bicolor
  unsure (1)..(63): unsure at all Xaa locations
  Clone ID: LIB5047-003-R1-XP1-E2.pep
GGGPXPPGGGGPLXDRQESVLSFLDLARSTLVPTTLATSRCGEVRAELAIWEFPLDRPPRAPH

SEQ ID NO: 51399 - protein, 147 aa, Sorghum bicolor
  unsure (1)..(147): unsure at all Xaa locations
  Clone ID: LIB5047-003-R1-XP1-G11.pep
MSATIRSGELLACPVALRRAPPVAVSVVSVRTRARAVAVAVRAEATAEGVGKGGKKAAAAGKKRPASGITKPKPISPELREFVGGAPELPRTEAIKLVWAHIKGNNLQDPNDKKIIICDDKLKKIFGGRDRVXFLEISGLLNPHFQK

SEQ ID NO: 51400 - protein, 109 aa, Sorghum bicolor
  Clone ID: LIB5047-003-R1-XP1-H11.pep
ENQRNIIELRKSEKYNRNEKIRQSIKESRASRAPTSPAKTACFAGLVLAGQGARAVASPQARIQMHPCRRPGLPRTSAMWHVHLRRCLREAWPGLIHVRWRKEGETRPA

SEQ ID NO: 51401 - protein, 121 aa, Sorghum bicolor
  Clone ID: LIB5047-003-R1-XP1-H4.pep
PAGSGSHPDKGFLRRRRRCFRHLRPAKPCRLTRRLRIYNNLVKKMRRETAPSPTGSAWAPTTPSGTTPSAGTGAAPGSASERAKRCYANDACRGLGVCELRSSCLRYCLCDETNLIRLCLQ

SEQ ID NO: 51402 - protein, 50 aa, Sorghum bicolor
  unsure (1)..(50): unsure at all Xaa locations
  Clone ID: LIB5047-004-R1-XP1-A5.pep
PAGFRILTNSIRISRLAKTTIPLLLLSSILVVANQAVAXTTQLSPWPLKV

SEQ ID NO: 51403 - protein, 103 aa, Sorghum bicolor
  Clone ID: LIB5047-004-R1-XP1-A6.pep
MAAATGMQLALLLCLVVLVASPRVALGNCRDDCMAACNGWHVMCQLSCGSACYGEVGITTLSTPDESSARAEAPASAAPAPQQAQEQEEGGGVSGLKPSPARG

SEQ ID NO: 51404 - protein, 64 aa, Sorghum bicolor
  Clone ID: LIB5047-004-R1-XP1-B1.pep
WDLWWVMSFHSPATTFCWKGDSAYTTAFIPHRHLPHFLPASPPAGLPPPHSRRVLRSPPGNGPA

SEQ ID NO: 51405 - protein, 97 aa, Sorghum bicolor
  unsure (1)..(97): unsure at all Xaa locations
  Clone ID: LIB5047-004-R1-XP1-B9.pep
MDVDKQETMEETILVGDDLMRGPPSPVIPKEIASHVLDGVELCDGILRNLFLCLXNHDIEPFCQRXIVLYRQCAEKRXQENREXMQNSEYKLGFFMP

SEQ ID NO: 51406 - protein, 56 aa, Sorghum bicolor
  unsure (1)..(56): unsure at all Xaa locations
  Clone ID: LIB5047-004-R1-XP1-C4.pep
GASPATCXNPHPPPVFVMWEVPTRWWPTSWAGRLARLVSCARVVHVGDQRGPTRPA

SEQ ID NO: 51407 - protein, 82 aa, Sorghum bicolor
  Clone ID: LIB5047-004-R1-XP1-E4.pep
GRREWGSMFLISFCYSLQYLRLETLHIKLSLALRIYCLLFSDDCEMGRRLPSSFADRRDHVRPLFTSLSRRRLMSGATPLTP

SEQ ID NO: 51408 - protein, 84 aa, Sorghum bicolor
  Clone ID: LIB5047-004-R1-XP1-G3.pep
MSCCGGNCGCGSGCKCGSGCGGCKMYPDMAEQQVTTTAKTLVMGVAPSSKGHAEGGFEAAAGAGAENEGCKCGHNCRCNPCTWK

SEQ ID NO: 51409 - protein, 65 aa, Sorghum bicolor
  Clone ID: LIB5047-004-R1-XP1-G4.pep
GRTRGRVSASQSSSMPPHWPSTATRWVVARALGRCVRASAWPPPLRPLRVRDRGGKTRFSPARPA

SEQ ID NO: 51410 - protein, 55 aa, Sorghum bicolor
  Clone ID: LIB5047-004-R1-XP1-G7.pep
TPWRAATRAGSSSSWRSTMSDRQTRSHGKLFRKVAVDAGAIASTRVPCDLRQPGR

SEQ ID NO: 51411 - protein, 122 aa, Sorghum bicolor
  Clone ID: LIB5047-004-R1-XP1-H12.pep
MGCVGSTPANKDAGGSSDGNHGTKKVRKPKAWKHPQPITMAQLRQMREEFWDTAPHYGGQKVIWDALRVASESEVSHAQVVVESAGIIVSNADLTLCYDERGAKYELPKYVLSEPTNLIRDS

SEQ ID NO: 51412 - protein, 100 aa, Sorghum bicolor
  Clone ID: LIB5047-005-R1-XP1-C3.pep
KMNPLHKQVHPSVVHQILHPSSNSQMDLAAHRSRQQEHHYTYTIAFITDGSSSTLNRPCVSSKYRKGLNKWSKESEEHMEEWRPSLLLASFWPDLSCQPS

SEQ ID NO: 51413 - protein, 112 aa, Sorghum bicolor
  Clone ID: LIB5047-005-R1-XP1-C5.pep
MVKGRQGQRVRTYVRGTILGYKPSKSNQYEHTSLLQIEGVSTKEDVAWYGGKRIAYVYKAKTKSDGTAVRCIWGKVTRPHGNSGVVRVKFRSHLPPSSMGKKVRVFMYPSSV

SEQ ID NO: 51414 - protein, 100 aa, Sorghum bicolor
  Clone ID: LIB5047-005-R1-XP1-D10.pep
MATRNHRAAAAAAAAPQPANRGAARIAGKQKDAAAAGRPNATRPALGDIGNVALSDVLDGGIKLPEGIHRPITRSFGAQLLKAALANKNGVAPGQPGTAR

SEQ ID NO: 51415 - protein, 213 aa, Sorghum bicolor
  unsure (1)..(213): unsure at all Xaa locations
  Clone ID: LIB5047-005-R1-XP1-D4.pep
PAGSGSAVLGYIPVPLILNFTVQQGNTMDTRLGAVHISPATLFVIPTVFQMVILVVYDRFIVPFLRRITGYVGGVTHLQRIGIGFLSTIVATGIAALVEAKRKKVAEDSGLVDATTGIPMSVFWLTIQYFLLGVVDVTSFVGLLEFFYSEASMGXMKSIGSSIFYCILGVSAWLXSLLIQLANRFSRHSDGTGGWLDGTNLNKGKLDRFYWLL

SEQ ID NO: 51416 - protein, 95 aa, Sorghum bicolor
  Clone ID: LIB5047-005-R1-XP1-D5.pep
MPAPASATSVGAGSRSPSKAVASRPSGGGTVRQRKTTSTTAPRSRAAGTSSGGMWRFYTDDSPGIKVGPVPVLVMSLLFIASVFMLHIWGKYTRS

SEQ ID NO: 51417 - protein, 229 aa, Sorghum bicolor
  unsure (1)..(229): unsure at all Xaa locations
  Clone ID: LIB5047-005-R1-XP1-E11.pep
PAGPREHPPNQTXGSLTTPLHLPIFHFPIHHKHSRPSINSGNRQSCMSIHCAHCHGVSCAASRDTHIANSLPPSLKHHSTTRALFTTASHADPNSAVRLLNSNVARDRKCHCNHIICRCQTLVLLRARVVRASARRRPVSSTEVVPYVPASLSRYTRCEVASLEVCLRVGAQEGGPPAQHASGQWHFQLRSCLIMAAVQISKTSLHSNCRIRMIXTXVNFQKKKKKRAL

SEQ ID NO: 51418 - protein, 77 aa, Sorghum bicolor
  Clone ID: LIB5047-005-R1-XP1-E12.pep
KPTVWSGIYIAIVLYIEACISGSFMAYIGRCLHLEAKVLGVQEGDFCEVPVVVHRCHTWTCRSCNMLVMKGYLEWTR

SEQ ID NO: 51419 - protein, 95 aa, Sorghum bicolor
  unsure (1)..(95): unsure at all Xaa locations
  Clone ID: LIB5047-005-R1-XP1-F9.pep
LSSRTPCILRENFLMLLARPGTPPNATXTMEFLVGMGSFHSAAERRRRAGNVALAPEPGWCGDGEEETVTGGLNNSSAAAPSTPLEPMTVRDPAG

SEQ ID NO: 51420 - protein, 136 aa, Sorghum bicolor
  unsure (1)..(136): unsure at all Xaa locations
  Clone ID: LIB5047-005-R1-XP1-H3.pep
RPGFVSRLELAVVPRHGAVFYLRTSYTSIYHYGPQEAQQEDRKEGSRRSFGCDQTRLHESVNPLFEKRSRNFGIATCIQTTRDLRRFGQWTRYLRTQRQKXCLQKGLKGPPPIKQLSQTLEQYTVDQLFKLLGKYR

SEQ ID NO: 51421 - protein, 166 aa, Sorghum bicolor
  unsure (1)..(166): unsure at all Xaa locations
  Clone ID: LIB5047-005-R1-XP1-H4.pep
MATSKKDPPNPSRGRMSPNLRPSSSESSGYGYGARRARSVPSSPDRKFSSSSSSVTASSSKDVQRPSLSSAGRSISSRTMGSSIHGTKAQPFPGAASPTLARAKSDKVSTXSQRPPVLAVPPSNSFKDMTKTATKAPPTPTTSLRSKPSPRATADSCKAAASPKPS

SEQ ID NO: 51422 - protein, 98 aa, Sorghum bicolor
  Clone ID: LIB5047-005-R1-XP1-H8.pep
MESFIPFHQFLWRRMSCCGGNCGCGSGCKCVSGCAGCKMHPDMAEQQVTTTAKTLVMGVAPSSKGHAEGGFEAAAGAGAENEGCKCGPNCSCNPCTCK

SEQ ID NO: 51423 - protein, 57 aa, Sorghum bicolor
  unsure (1)..(57): unsure at all Xaa locations
  Clone ID: LIB5047-006-R1-XP1-A7.pep
MDRSDVWNSHXPENYGPVSRVCRDXGNPRGLMRKHGLMXXRQSFRSNAKDIGFIQYR

SEQ ID NO: 51424 - protein, 153 aa, Sorghum bicolor
  Clone ID: LIB5047-006-R1-XP1-D1.pep
GSSWSGPCRPGSTLSRPARRRGLLSSRLQSLARYCAALPGVTDRLQVALELVGVDGLFGVVGLAALGEVRLQQWDDLFDEGNVLPGFVDSFRDLSDFGHEAEGGVGTELVAGQCLCNGVLAGVRLGGGHEGDDEQGGDHGCGVLCCGIPRPGR

SEQ ID NO: 51425 - protein, 63 aa, Sorghum bicolor
  unsure (1)..(63): unsure at all Xaa locations
  Clone ID: LIB5047-006-R1-XP1-D5.pep
RPGRACIDXWLRGHSSCPSCRRILSLHQLPPGERCRRCGARPQDGDAAGWKPTYYGAMPPFLA

SEQ ID NO: 51426 - protein, 186 aa, Sorghum bicolor
  Clone ID: LIB5047-006-R1-XP1-D7.pep
MKGSSEHGETSKAAPLGRGGVSKGVSVLDLILRFIAIIGTLASAIAMGTTNETLPFFTQFIRFKAQYSDLPTLTFFVVANSIVCAYLILSLPLSIVHIIRSRAKYSRLLLIFLDAAMLALVTAGASAAAAIVYLAHKGNVRANWLAICQQFDSFCERISGSLIGSFGAMVMLILLILLSAIALARR

SEQ ID NO: 51427 - protein, 137 aa, Sorghum bicolor
  unsure (1)..(137): unsure at all Xaa locations
  Clone ID: LIB5047-006-R1-XP1-E5.pep
PGRELVTSLSPAGSHGVAPPLLHPPSRRGLPPLRCRPEPRRFPPRHPRSCPQGFGNRAADGSGAVAATAAQRGLGGPADVAAGAGGGPGRVAGDRXQCPSIMKETAPNGSDISSKKVEGLVVIIIIILGKRVTYLFK

SEQ ID NO: 51428 - protein, 168 aa, Sorghum bicolor
  Clone ID: LIB5047-006-R1-XP1-F1.pep
MALLVNKKGTAGAVLLAAAVMAILLLLYAASYMVSTPPRAASRRQYYGHAEYYRTYLVILRKPPNADAMDEDAHRRWHESFLPTTVIGYSGEPRLLDSYYRYVRYGIYAFSARLTFAEIEDVAKKPGVLGSRHCPPKGVTTQCTMCQADDWDCGALVVSKPAATASQK

SEQ ID NO: 51429 - protein, 74 aa, Sorghum bicolor
  Clone ID: LIB5047-006-R1-XP1-G9.pep
PAPTPENRGRSKRDSGRAKGKNHPGHNRPNKAKEKGLKNPKGPRQPSPRGMDPKFLGNLGYSGRGTKKRGEVDP

SEQ ID NO: 51430 - protein, 59 aa, Sorghum bicolor
  Clone ID: LIB5047-006-R1-XP1-H5.pep
MELEVGAPSPARYLVGAAIMMAGVVLPLAYMIFRSKRSPSSASAAGPSSFSKQTNKGLI

SEQ ID NO: 51431 - protein, 194 aa, Sorghum bicolor
  unsure (1)..(194): unsure at all Xaa locations
  Clone ID: LIB5047-006-R1-XP1-H9.pep
MSRLRFAILLAVAAGVLLLPASASSSSSSSRPPEVYSVGDETGLAAPPGNDDDGTQQTLSKWAMTQSFYVGDVLDFKRWSDSVLLVRQGDYDRCSAASPVRRFFADGGDTQFTLARPXLFYFISGAPARCEAGQRMVVLVRVADPLNKIISAAPTPXPPPAATLCKRSRRPLTIAQMQMVAGALRFATGFMPWS

SEQ ID NO: 51432 - protein, 149 aa, Sorghum bicolor
  Clone ID: LIB5047-007-R1-XP1-A7.pep
WMMPSRSCSVWTSQPPPAPSGAMLGPHQIAGRHGGGRRGDSHDSPPPPRLYGSSPVGMNQGDEAPPSEPQLQCCRRAKGGDPDRGHRSEAPLRTREELRGWRSSRMVDEITNREPTTSVMSVVDREGGGRRRIPIVGTEMVPDRRRRRR

SEQ ID NO: 51433 - protein, 130 aa, Sorghum bicolor
  Clone ID: LIB5047-007-R1-XP1-B12.pep
PNQFHMDDTNTIRSSPCHHRLRCYLAKKSFLHLCNVPFRPLVDVFYRNYIPRPAGVLNLLPACDFMMTSSRILPGCRSWVIQFWLGEDVVDEINLVNFLNPHLTISRRSHGGLGASKHYQLAFGWMLERD

SEQ ID NO: 51434 - protein, 116 aa, Sorghum bicolor
  Clone ID: LIB5047-007-R1-XP1-B3.pep
PAGSGAARPAPANPSPQQSAAPAPVATTDVELSEVSSAVAAGKLVVTKVVSPSQSPGFTKISSVVVVSPPLPATARSVDRRWHISPAANVILVPIPPSGPSDGHNNEPPRASPGVM

SEQ ID NO: 51435 - protein, 52 aa, Sorghum bicolor
  Clone ID: LIB5047-007-R1-XP1-B6.pep
MDPQQPEPVSYLCGDCGAENTLKPGDVIQCRECGYRILYKKRTRRIVQYEAR

SEQ ID NO: 51436 - protein, 144 aa, Sorghum bicolor
  unsure (1)..(144): unsure at all Xaa locations
  Clone ID: LIB5047-007-R1-XP1-C10.pep
AGRVCESTLIPPRRRPPNPPRTLPERFKQGTGDGTARFQKRRHKTHTLSIRXVRRSYHLQKSTWSSCVYPAARMRKHNWRVKGMXRKTTGTGRMTYMRHVPRRFKSNFREWTEAAPNKSALADNYTWMLPSRTSEDMKPSLFDR

SEQ ID NO: 51437 - protein, 71 aa, Sorghum bicolor
  Clone ID: LIB5047-007-R1-XP1-D11.pep
EISEPCAASVCIIMKVLLVIHHCSGGGRASDREQVEVWVHSAAGVRGGGLLDVLDCDGEEGESLGYSSPAG

SEQ ID NO: 51438 - protein, 198 aa, Sorghum bicolor
  unsure (1)..(198): unsure at all Xaa locations
  Clone ID: LIB5047-007-R1-XP1-D4.pep
MSGQQDRASKSSSSSISSSTQESEEEAPVRSVTIGSLLAQANSSSGHSLGKRLSHLGSIPYTPRVNGKIPNVDNATLDHERLLERLGTYGLAEFHIEGDGNCQFRALADQIFRNPDYHKHVRKAVMKQLKEFRKQYESYVPMEYKVYLKKMKRSGKWXDHLTLQAAADRFGAKNCLLTSFKDTCLNEIVPWXSNSPQR

SEQ ID NO: 51439 - protein, 75 aa, Sorghum bicolor
  Clone ID: LIB5047-007-R1-XP1-E10.pep
VLLPQPQDAAAQICYLHLSSLPKKQSFSLCLVAVDPHSDGGGGGDQRPISVGHFFRRRGYLSVLGRSQMMQARPA

SEQ ID NO: 51440 - protein, 97 aa, Sorghum bicolor
  Clone ID: LIB5047-007-R1-XP1-G2.pep
MRGNATQIKVHFKGDSDDFIVFAESAQAVQDWKKDKSVPLAQVADSFKVFVTHNHGNQGTLDAAAKGTLEAEFGSSKEEDVIGQILEKGNIIESENS

SEQ ID NO: 51441 - protein, 43 aa, Sorghum bicolor
  Clone ID: LIB5047-007-R1-XP1-H3.pep
VRRSGGGFQIWITLKLLQQGGGGSAEKLDKWDDTRQPLLASKE

SEQ ID NO: 51442 - protein, 199 aa, Sorghum bicolor
  unsure (1)..(199): unsure at all Xaa locations
  Clone ID: LIB5047-007-R1-XP1-H8.pep
MKLNVAFPATGAQKLFEVVDEHKLRIFYEKRMGAEVEADLLGDEWKGYVLRITGGNDKQGFPMKQGILSNVRVRLLLSKGHSCYRPRRDGERKRKSVRGCIADSNLSVSSLVVVRKGEQEIPGLTDKSIPRRLGPKRASKIRKLFNLTKLDDVRQYVIKRPLPQKEGKXQRFKXPKIQRLITPLALQRKRHMLALKKSA

SEQ ID NO: 51443 - protein, 163 aa, Sorghum bicolor
  Clone ID: LIB5049-001-R1-XP1-A8.pep
MLPLRSAAAAPCLVAGLLLHRFSSCSSSSVYSVRHHATYAVSSQPSTCPTTTWFPFPHSSSPRIRGFAAWASAPGQAGSADSPATKALEAKIKEQLQADTVTVVDTSGDGRHVCIDVVSKVFEGKSAVNRQRMVYKAIWEELQSTVHAVDQMTTKTPDEAGAK

SEQ ID NO: 51444 - protein, 61 aa, Sorghum bicolor
  Clone ID: LIB5049-001-R1-XP1-A9.pep
MNGVKRFGGGRVPTGTPSLAWSSVVMVASLLTGASIVHNIYKPDMTIPPVEIASGGKDQES

SEQ ID NO: 51445 - protein, 114 aa, Sorghum bicolor
  Clone ID: LIB5049-001-R1-XP1-D2.pep
HSSITMSFYKKLAIVGLILTLLLVSHRMEAAAKMCSSVVQRLMCGGSNPKTTDKACSDSCKDIGYTGGGSCDMHQKQHNTYRCICRKPCAAEQTQTHAGNLARARDAKQRTQEI

SEQ ID NO: 51446 - protein, 87 aa, Sorghum bicolor
  Clone ID: LIB5049-001-R1-XP1-D6.pep
KRMADFLLNLLSCRGIRDFHSGRFVLNFIASHGNRGGWRPEASGALLPKARQHSAGGAAGVLDGRMGELEKGKESEEEARPGRLERR

SEQ ID NO: 51447 - protein, 171 aa, Sorghum bicolor
  unsure (1)..(171): unsure at all Xaa locations
  Clone ID: LIB5049-001-R1-XP1-G3.pep
GRSRGRPGPGLXLKENAARWLRPSLQPERCTAILATTAVDAAASLLRSSQQPRPHMRASSLLRRRTAILAAHAALILALVRAPLLVTATPPADCTSPTAFFDFVNAFPSDSVRGVLVPCFSVLSSPLGVILARGSFILESYCHFPRRWSSCPSQVSMERCAIQVCQIANFK

SEQ ID NO: 51448 - protein, 63 aa, Sorghum bicolor
  unsure (1)..(63): unsure at all Xaa locations
  Clone ID: LIB5049-001-R1-XP1-G6.pep
MATKVIVELLMLVSIGAIFLAHQACGEPDCHTEKLLVMIHCRRTIKHNGAYHFPTVDCIEXLX

SEQ ID NO: 51449 - protein, 85 aa, Sorghum bicolor
  unsure (1)..(85): unsure at all Xaa locations
  Clone ID: LIB5049-001-R1-XP1-G9.pep
MGAKAAHRRGVLDLEAQFAFFRSQHRHPVNAAAHALLTWPILFTNLLILHFLPLPVPPALXLTLAYAAAYLAVDRRAGALAGVLF

SEQ ID NO: 51450 - protein, 85 aa, Sorghum bicolor
  unsure (1)..(85): unsure at all Xaa locations
  Clone ID: LIB5049-001-R1-XP1-H3.pep
QDYPXXHRARLCFHPARREXHEEXXSHYHTKRSAHPAVPGMTIDEPSKQQEETLRLRGGCPGGCDSERVSEDSPGCWCGCGWGMG

SEQ ID NO: 51451 - protein, 197 aa, Sorghum bicolor
  Clone ID: LIB5049-010-R1-XP1-B6.pep
MSFLTKFFRPFSSMSNAPAQPMNVPSGAQTATVAAGCFWGVEHMYRREYKGKGLYDARVGYIGGDSDNPGYRAVCSGRTGHAEALQVVYDPEKVTYRSLLEFFYKMHDPTTENRQGPDVGTQYRSAIFYHDAEQEKIARDVTDKVNKQWWKGGVATEILPAGKWWDAEQYHQLYLDNNPGGYECPSHFLRSFPPLQD

SEQ ID NO: 51452 - protein, 87 aa, Sorghum bicolor
  unsure (1)..(87): unsure at all Xaa locations
  Clone ID: LIB5049-010-R1-XP1-B9.pep
MPCCGGNCGGGSGCKCTSGCVGCKMYPDMAEQQVTTTAKTLVMGVPPSTKGHARGRLPGXAAPGAENKGCKCAPNCNCNPCTCTRAV

SEQ ID NO: 51453 - protein, 160 aa, Sorghum bicolor
  Clone ID: LIB5049-010-R1-XP1-C4.pep
KGVRRRHRHGRRLLCFLGGGVGGGGLQRGRGVEACGRVGEDGEGAEALQQRRRGPARDAAAAWRRRWTRPRGQHGDRGDDHVQDKEPRGLGAQPRRRQRRPPPLRGHGPAPAQPYPVRTLLFLPCSGSPKGKAGGDGQDQKVAKVQCCCLDNGIGPGPGR

SEQ ID NO: 51454 - protein, 214 aa, Sorghum bicolor
  unsure (1)..(214): unsure at all Xaa locations
  Clone ID: LIB5049-010-R1-XP1-C5.pep
MSRPRILASVEAGVRLLRVAAAAAAVLLCLSVHLGRAAPLGAEVAEFPGFEGNLPSKHYAGYITVGHEQQKRHLYYYLAISERNPSLDPVVIWINGGXACSGFSAFLHSIGPFKMEGSQVHINDGPRVTLNPYSWTKMASLILVDSPAGVGYSYADTEDDYTTNDTSRVVDLYDFLSKWFAEYSEFLSNPFYIAGCSYSGVIVPVLAQEKSKRN

SEQ ID NO: 51455 - protein, 196 aa, Sorghum bicolor
  unsure (1)..(196): unsure at all Xaa locations
  Clone ID: LIB5049-010-R1-XP1-D10.pep
LSRYAIIXTQNGMLPIVETDILVDGPHDIDRCLYXSEVCLADCYKALNDDHVLMEVTLLNPNMETPFSDSNKVTPXTLLLRYTVPHPRMIPTLLMMPAVGFLSXDMIKDXATLTLTAMLKLNFTKTSMLSFSFRRCTLHRYHTLLSAVCLKLRQHQITIRCYFLARXKINSECNLGYYKGDADDDTQNLRLQDYNY

SEQ ID NO: 51456 - protein, 144 aa, Sorghum bicolor
  Clone ID: LIB5049-010-R1-XP1-D5.pep
AALEPAGPGIIRLAPPSHSCCGDPTPARLHLPPPPPPAASSSRAGFRRPRLPLLPPPPHSVYESARYRRSSPPRLVRPSSRRRSGRHQNPRDPTKQFQQFRRATWGSFVYRFQQQFQLQFLCKSRWAAHKLLGSYLSLGAVGLH

SEQ ID NO: 51457 - protein, 229 aa, Sorghum bicolor
  Clone ID: LIB5049-010-R1-XP1-F9.pep
MSSIITPGLRNGLRASSSSLRPTFAIARPLSTSAIARKPDSSISISDPSPSRSTITTRTAQEGSNQLSLETPRNGAEYVLSTLDKMVNWARQGSMWPMTFGLACCAVEMMHMAAARYDQDRLGVVFRASPRQSDIMIVAGTLTNKMAPALRKVYDQMPEPRWVISMGSCANGGGYYHYSYSVVRGCDRIVPVDIYVPGCPPTAEALLYGMLALQRKMRRTRTAVMWYRK

SEQ ID NO: 51458 - protein, 46 aa, Sorghum bicolor
  Clone ID: LIB5049-010-R1-XP1-G9.pep
IRDRPDGDINDKKSKRFNKNFTRILTKSISHSTIQSAHRLEGSGKS

SEQ ID NO: 51459 - protein, 177 aa, Sorghum bicolor
  Clone ID: LIB5049-010-R1-XP1-H1.pep
MAPTGTIKGPGEARTYDGSPLRIGIVHARWNKEIISALLEGTLASLRAAGVRDENIVIQTVPGSYELPYAVQRMYLASQTQHAATAGGTLTSAATDLLGGSTTDLAGLGQKKEEEQSKGSKEPFDAIIAIGALIKGSTMHFEYISDAVSHALMKVQMETGCAVVFGLLTLLTEEQGL

SEQ ID NO: 51460 - protein, 133 aa, Sorghum bicolor
  unsure (1)..(133): unsure at all Xaa locations
  Clone ID: LIB5049-011-R1-XP1-A5.pep
PSSSRKCDPASGAPSMAFSRGVTDTGNAVHRSPSRLFPFFNGDESHAWQLPLPEPWFVFKCKCAMRAPERRGSSGVLRGSRRRGLALAGLAIVEYTFWSSIHXVTIGAHLHAALEKTMPGHWSVVGLTETALT

SEQ ID NO: 51461 - protein, 89 aa, Sorghum bicolor
  Clone ID: LIB5049-011-R1-XP1-B1.pep
ESSSSSTPFRPISRPTIPTLQTHLVLDLATNGTRNSLRRVDISKEALGVLLNLLDVEAKAVVLASGSVGHTGDETVLGALDAANARPGR

SEQ ID NO: 51462 - protein, 144 aa, Sorghum bicolor
  unsure (1)..(144): unsure at all Xaa locations
  Clone ID: LIB5049-011-R1-XP1-B7.pep
CGARAGRAEHFGXGGERKHRPPLLARNPSCRGRNSIPPYPSSLREEAARKLAWLPRMSAARLFAQVDREPLCTGIAFGGRDGNAAKRRRLARHPYWAASHPSSLPLSPRRRLSWCGSARWTTLSSPPLPHFRQVPTTNEANLAS

SEQ ID NO: 51463 - protein, 208 aa, Sorghum bicolor
  unsure (1)..(208): unsure at all Xaa locations
  Clone ID: LIB5049-011-R1-XP1-C2.pep
MATESSAAMAMEEPGVVVNGSSVVSWVASGVVLWSTAFLLVRALFPKRSYDFCNRAVSTMHAVAAVCLACLSVADWSCPVCPLAAASSPRQMKALAVTLAYMVYDAACCHLNGDVRLDNTVHHLVSIVGIGAGFAYQRCGTEMVACLFITEISSPLLHLREMLKEFGVRDTDLNLLIDVLFAVTFSVARMGVGPYLYYVTLTXDYPIL

SEQ ID NO: 51464 - protein, 85 aa, Sorghum bicolor
  Clone ID: LIB5049-011-R1-XP1-C4.pep
GRRRWLAASGMSTYLRTLFLALRPPWMTARLRRGRWGRFGSEVSLPPPSSCGSRSEPSSSSVDLDLSPPPSSTFFNSAPPPPPTS

SEQ ID NO: 51465 - protein, 198 aa, Sorghum bicolor
  Clone ID: LIB5049-011-R1-XP1-E12.pep
MAATPPAPAPPRILLAGDAHGRLHQLFKRVKSVNQSTGPFHALLCVGQFFSPEGDAEGAPGDVADYIEGRASVPIPTYFTGDYGPSAPRLLSKAAAGARGFAPGGIEICPNLFWLRGSNRFTLHGLSVVYLSGRKGLGGPGCYSQDDVDALRALAEEPGIVDLFLTNEWPTGVVSGADPSNVSNHVLDPNGYDPIAAE

SEQ ID NO: 51466 - protein, 128 aa, Sorghum bicolor
  Clone ID: LIB5049-011-R1-XP1-H6.pep
AGRVCGPHHKKIGEITTQWAHKDNPRDIYPHGLASLGAVVEPKPQSVETLYICSFCNKTFKSPQARGGHQNAHKKEIVVLRRNLEEEMSNKRAKQAHNVFVASQEIKQLPLGSDSFDVFTNLDVDSES

SEQ ID NO: 51467 - protein, 255 aa, Sorghum bicolor
  unsure (1)..(255): unsure at all Xaa locations
  Clone ID: LIB5049-012-R1-XP1-B5.pep
MAPSTSVASAEHVAVPETLLKKRRTTEASREAKLAAAAEARKNRTAKRKVIFKRADEYVKEYVQQEKEQVRLQREARKTGDFYVPAQPKVYFVVRLKGISKIAPKPKKILQLLRLLQINNGVFIRVTKATQQMLQLVNPYVTYGEVNLKAVRELVYKRGYAKVDGSRIPITDNAIIEKQLGKFGIICIEDLVHEIVTCGPNFKQVTSALWPFKLSNPTGGRRSRKFIGYVEGGDAGNXEKHMSNLVHQMVLNDGC

SEQ ID NO: 51468 - protein, 216 aa, Sorghum bicolor
  Clone ID: LIB5049-012-R1-XP1-C3.pep
MPLSAASILHAFLLTILLGGGATASFPPGDGDGDVNPSTMFTNDTGTSRIADDTERYICYLCTGRNPLLIRYCPIYWDECHLVCYADDAPAATAAAIPAAPLPAASANPSGVHDDDECYVMKLYRNGSYTIVTRLGCARIATCLLSCGGGDMADSDRKALQGTATKTAAPTATTAAVQGSLTPLLADSSGAARRSLRRRLCVAAAASGLGGARRTR

SEQ ID NO: 51469 - protein, 64 aa, Sorghum bicolor
  Clone ID: LIB5049-012-R1-XP1-C6.pep
PAGPGHVELYRNDQHRFKIVVDSDNEVDLMVQTRHMRDLIILTIRGLAQKFNSTSLNTLLKIEA

SEQ ID NO: 51470 - protein, 171 aa, Sorghum bicolor
  Clone ID: LIB5049-012-R1-XP1-D11.pep
MSTANTLRLYLTCIRNTLEAAMCLQNFPCQEVERHNKPEVELKTSPELLLNPVLICRNEAEKCLIETSINSIRISMKVKQADELENILAKKFLRFLSMRAEAFQVLRRKPVQGYDISFLITNYHCEDMHKHKLIDFIVQFMEDIDKEISELKLSVNTRGRLVATEFLKQFI

SEQ ID NO: 51471 - protein, 197 aa, Sorghum bicolor
  unsure (1)..(197): unsure at all Xaa locations
  Clone ID: LIB5049-012-R1-XP1-E6.pep
MADSAGDAFPDEAETSFTLHEYIEGMEAVELEADLVLGGDDGKDCTYAGGYLKRQAVFSCLTCVPDGVAGVCTACSLACHDGHEMVELWTKRKFRCDCGNSKFGGHLCKLCPEKDSKNSANAYNQNFKGSYCTCGRPYPDPEAKEQVEMIQCSICEDWFHEDHIGLTSIEEXPRDEEGEPLYEEIICHKCSPLCHFL

SEQ ID NO: 51472 - protein, 130 aa, Sorghum bicolor
  Clone ID: LIB5049-012-R1-XP1-G12.pep
RRSSRPGRETQRAPTRIAYITRRRSEVATRGPTKCKYATTHTPAPDPDRASDREGATRQRRGTPISASPQQLGSPKANVHVRVQSYIGNSPASQQLASMVVTAILRRTCRRPPNAPRGLSLYVRELHLPP

SEQ ID NO: 51473 - protein, 101 aa, Sorghum bicolor
  Clone ID: LIB5049-012-R1-XP1-G7.pep
MDRVGGGEKQLEDCTVANALGTWFFSVAGALVAIPVGIKRKSLAPLVFFGTTGTMLDIITGISQCEREHAERQMKLLEAQKLSTDASAGGESSDSFGSADK

SEQ ID NO: 51474 - protein, 87 aa, Sorghum bicolor
  unsure (1)..(87): unsure at all Xaa locations
  Clone ID: LIB5049-012-R1-XP1-H2.pep
MLRRLTADAPRAFSSFSSSSSSPHAPTLAASGYTPRREYGLMPMEIEHTSRGESDYDIFSRLLXERIDCINGPHTDAQATLDVAKLL

SEQ ID NO: 51475 - protein, 223 aa, Sorghum bicolor
  Clone ID: LIB5050-003-R1-XP1-E11.pep
RPLRRRAGIVIATQSSAHLIVQTIAAQLQQQQFLPALNQLAIANPVAYLQQQLFPLNPLAATNAVAYLQQQQLQQFLPALNQLALAVPATYLQQQQLLPLNPFATTNSVAYLQQQQLQQLLPAFSQLALANPAAYFQQLLPFNQPAVANIAAYLQQQQPHLFNQFAVTNAAAYYQQQQRLTVNPLAVANPLAAAFLQQQQWLPFNQMSLVNPALSLQQPIFWR

SEQ ID NO: 51476 - protein, 178 aa, Sorghum bicolor
  Clone ID: LIB5050-003-R1-XP1-H10.pep
MATRAAAATLTAATSSLLRRSASLRPQVLRVPHRVPSRRFVRHIASSTNEEAAARAAAATADTGGPTIFDKIIAKEIPSSIVYEDENVLAFRDINPQAPVHVLVIPKVRDGLTGLDKAEPRHTEILGQLLYAAKVVAEKEGVANGYRVVINNGAEGCQSVYHLHLHVLGGRQMKWPPG

SEQ ID NO: 51477 - protein, 192 aa, Sorghum bicolor
  unsure (1)..(192): unsure at all Xaa locations
  Clone ID: LIB5050-005-R1-XP1-C10.pep
MIRVLCVSSASAGFSMSGIAMLDSEELHFXSKDDAGASKTYPQQGXTVRKSSFLIVYARPCEVENDSTSNTDLHGHAXCHFVXAIEIFITKDLGDIVPSSHNCDIPHVNRTDYLLIVLSXDGVVILLTLDAITLDDLRLPSDETLECQIKECVESGKDLVVTVLSAMPEEQICALPDIVPKVLPCLGRRNYC

SEQ ID NO: 51478 - protein, 120 aa, Sorghum bicolor
  Clone ID: LIB5048-007-R1-XP2-E7.pep
LSERDKPGKRHCKMATDVSTHYELYDVSSFGSEVQTRRLERDVALGELVSGLDEQGEDGSDTGEVCGRSDVTGEGRGVVDVDVVVASSRGKEVNISIVQCLGLDDVVVSGTYSTGDEIRR

SEQ ID NO: 51479 - protein, 78 aa, Sorghum bicolor
  unsure (1)..(78): unsure at all Xaa locations
  Clone ID: LIB5048-007-R1-XP2-G1.pep
RRSXPPGSXEPTTYENQESTPSWPRAPRAVSSSSCLSSRSSSSTPCRRSTPATTTTRMVILLLRHCRVFTQRWRASPP

SEQ ID NO: 51480 - protein, 127 aa, Sorghum bicolor
  Clone ID: LIB5051-002-A1-XP1-A10.pep
TFVKTLTGKTITLEVESSYTIDNVKSKIQDKEGIPPDQQRLIFAGKQLEDGRTLSDYNIQKESTLHLVLRLRGGIIEPSLKVLANKYNCDKQICRKCYARLPPRATNCRKRKCGHSSQIRPKKKIKN

SEQ ID NO: 51481 - protein, 150 aa, Sorghum bicolor
  unsure (1)..(150): unsure at all Xaa locations
  Clone ID: LIB5051-002-A1-XP1-A7.pep
RTHILPTTNRAQSXQGFGKKKTATAXAHCKAGKXXXKGNGKPLSQXQPEILRFKVYEPILILGVDKFADVDIRVRVSGGGHTSQVYAIRQAIAKSIIAYYQKYVDEHSKNQLKQALIQYDRTLLVADNRRCEPKKFGGPGARARYQKSYR

SEQ ID NO: 51482 - protein, 101 aa, Sorghum bicolor
  Clone ID: LIB5051-002-A1-XP1-B2.pep
PAGTKKVLDHNGIPTEIDLYTAGTPNGHKISITLEELGLSYNVHKLEFSKNQQKEPWFLQINPNGRIPAIVDKSSGKPKRVFEGARHCQLGIPLPEKVLTK

SEQ ID NO: 51483 - protein, 75 aa, Sorghum bicolor
  Clone ID: LIB5051-002-A1-XP1-B7.pep
RPGTRPEEEGQGRSPRVVTRMLARRTRSRLHVKRNDSRMIGVRHDGMNLFDSYPVLESTISLVGLGWWMIYIYIM

SEQ ID NO: 51484 - protein, 56 aa, Sorghum bicolor
  Clone ID: LIB5051-002-A1-XP1-B8.pep
GPFFFFFLIIKKRKIILQKDTVSAKATFLEICFVQRCTKRIAETEVFLYNALNLLV

SEQ ID NO: 51485 - protein, 219 aa, Sorghum bicolor
  Clone ID: LIB5051-002-A1-XP1-C3.pep
MATTLFRSSAMRSAARAAPSMRASIGGTTFVRGKATLPDLAYDYGALEPAISGQIMELHHSKHHNTYVTSYNTAIEKLQEAQHKGDIQAQIAQQPLINFHGGGNVNHTLFWENLAPKSQGGGEPPSGALAQKINDSYGSLEELKSKFNAALAGIQGSGWAWLVQDVQTGNIGIKTYANQDPVVGQYRPILGIDAWEHAYYLQYQKRKAEYFSAIWDVVH

SEQ ID NO: 51486 - protein, 133 aa, Sorghum bicolor
  Clone ID: LIB5051-002-A1-XP1-C9.pep
MRRFPTTGGKTTAQMNAQKASLGGKGSRGLAGKGLGKTGAKRHRKVLRDNIQGITKPAIRRLARRGGVKRISCTIYEEVRTQLREYLRKLLLDTCAIVEMCKRKTVCTSDVVYALQKQGRSIYGFGEPQRGIA

SEQ ID NO: 51487 - protein, 142 aa, Sorghum bicolor
  Clone ID: LIB5051-002-A1-XP1-D11.pep
MPEQKPSTFKRFVEVGRVVLVNEGPSAGKLAVIAEIIDHNRALIDGPTTSVPRQQFPYRNLILTPYTIAKLPRGAGSGAIKKAVEKAGVTEKWEASGWAKKLAARQSRKEANDFERFKIQLAKRSRRDVVRKAYVKEKKASA

SEQ ID NO: 51488 - protein, 126 aa, Sorghum bicolor
  Clone ID: LIB5051-002-A1-XP1-E1.pep
ESSHLSVRRGIGYPFVFFVGRVEVVGGAGKHRDLLCFIAEAAGTAGMTVAVDSLDYAVFSGIIVWHSSVHSHSSLRSLSPGVGTSAIRSPLAPNPPRLLTTYFRGVGYYGSEGPLVKSRVFAARPA

SEQ ID NO: 51489 - protein, 174 aa, Sorghum bicolor
  unsure (1)..(174): unsure at all Xaa locations
  Clone ID: LIB5051-002-A1-XP1-E2.pep
FKTNGTLIPISLAWLHFRQAHRNTAKEEPGAGRALCWLIDARELTAEAAAHAIQNERMPVRSLLXHGKLNRLAELSNSFSSQRSPNPALELPGXAACPSKREVLALAQHQEVRRLREDVARLXLQCNALQAQLDKLSSERRRRGSCGGGGFFKWSAFWFGSDMGADVARVRTRP

SEQ ID NO: 51490 - protein, 126 aa, Sorghum bicolor
  Clone ID: LIB5051-002-A1-XP1-E5.pep
MSTTKRSTAAKKGQKITKKFIINCSQPVNDKIFDIQAFEKFLHDRIKVEGRTGNLGDTIQISQQGDGKIEVIAHQEFSGRYLKYLTKKFLKKQQLRDWLRVVSTSKGVYELRFFNVVNDEADEDDE

SEQ ID NO: 51491 - protein, 171 aa, Sorghum bicolor
  Clone ID: LIB5051-002-A1-XP1-F11.pep
AGPIHTVAAVAGSFRYMAPECAYTRKVNEKVDVYSFGVVLLELTTGREANDGGEHGSLADWAWRHLQSGKSIDDAADKHIADAGYGDEVEAVFKLGIICTGRQPSSRPTMKGVLQILQRCEQAHQKTFDEKVADYDNAPLLQARGGSRRKQLSDAKVTDDDGKGGFDDCNI

SEQ ID NO: 51492 - protein, 160 aa, Sorghum bicolor
  unsure (1)..(160): unsure at all Xaa locations
  Clone ID: LIB5051-002-A1-XP1-F12.pep
EKGDPXTDQKGAPQKXREAEKEKNKXPRNAHPREQPKGAXTSPPXXXPPAXPETXPXXXXGPRQPRGAGKPEXGPXPXXAQANSGNPPPXXXRTGSNRRAPPKAAPRQNPTATHPPTHGDPGTNRSTTPPEPATEHRRRHQQSQAPTNAHGDRSPQQHST

SEQ ID NO: 51493 - protein, 70 aa, Sorghum bicolor
  Clone ID: LIB5051-002-A1-XP1-F9.pep
PAGVQRRGSGKTITLLPRRRRPLKWLVRQNVNPHLYLKNMKSSRGSFSKEFPSFYSFLYSYATYTVRRNL

SEQ ID NO: 51494 - protein, 131 aa, Sorghum bicolor
  unsure (1)..(131): unsure at all Xaa locations
  Clone ID: LIB5051-002-A1-XP1-G5.pep
KKQHLGSFLSSFFHKATLLHSKYYSYTMTNRQIFNLCNAHLKNHVYLTFQHQYYCQARYPELSCVVLTPSSYRVSSGVRTITIASQVAFTSKHAHHKSSVIXRPTPRNQKSESVSMGETESCLVDLSDHGR

SEQ ID NO: 51495 - protein, 56 aa, Sorghum bicolor
  Clone ID: LIB5051-002-A1-XP1-G8.pep
MSHESVWYSRPRTYGKGSRECRVCTHKAGLVRKYGLNICRQCFREKAQDIGFTKHR

SEQ ID NO: 51496 - protein, 117 aa, Sorghum bicolor
  unsure (1)..(117): unsure at all Xaa locations
  Clone ID: LIB5051-002-A1-XP1-H10.pep
RPRRPRRGKGNKGRDKGRKDEXKXRXXADKREKRKDTNRPTXKDTNKGXTDRHRQGNXAEXEKXDDHRXGKSGGEQKGKTNERGGRSPRXEEGAKENERGTARQPPXRQPDHTAXTT

SEQ ID NO: 51497 - protein, 110 aa, Sorghum bicolor
  unsure (1)..(110): unsure at all Xaa locations
  Clone ID: LIB5051-002-A1-XP1-H12.pep
HHRYLTDKATRSQAGRGRPARAPKGERGXEAKPPADKPRAAXRDPTEXXPKNXPEQHKSXETAEGDGKXAGTARPPKXTEAAPTPTPAKDKPEAADDENKAAPHSAADGE

SEQ ID NO: 51498 - protein, 91 aa, Sorghum bicolor
  unsure (1)..(91): unsure at all Xaa locations
  Clone ID: LIB5051-002-A1-XP1-H3.pep
LIARSGKEIEKEPXFLENGDAGMEKMAPTKSMPIYSFSEYPPLGRFAARHMMQTMAAGAIKTAYTNDPTGANASEDVAKNKRCASDGSWYT

SEQ ID NO: 51499 - protein, 123 aa, Sorghum bicolor
  Clone ID: LIB5051-002-A1-XP1-H6.pep
MSPVTALLAGTAVPPSPAPARQHARHYSVGFPSLPNGAGRAALAVECSSRPQKKGTKHHMKTRPKKTQPWDIKRRPTQYPPLPPLPPDWTLVASGATVDVEEATSVTPVLEVAAAVAAPTTAD

SEQ ID NO: 51500 - protein, 74 aa, Sorghum bicolor
  Clone ID: LIB5051-003-A1-XP1-B3.pep
GAFFFFFGNLIMYKGPQIFFPPQASKNSGPALILYCLVCDATNNWTSLISGISRVRQPCQVANVQLTPLADPAG

SEQ ID NO: 51501 - protein, 92 aa, Sorghum bicolor
  Clone ID: LIB5051-003-A1-XP1-B5.pep
MSYFRITLMRSGIGMPEKTQGVLKALGLRKRMTTVYHPVTQSVAGQIMRIKELVDVKEVKSPMTKEQMRAARRPDPGYYIEQRAGEAMKGYE

SEQ ID NO: 51502 - protein, 74 aa, Sorghum bicolor
  Clone ID: LIB5051-003-A1-XP1-D5.pep
HIIQQKLVQTTEEVSTTDLPCMIAERVVPVSIALASKSEDIYTLLTIEWPFFSPKNKSTCKWFWHVELARADYK

SEQ ID NO: 51503 - protein, 50 aa, Sorghum bicolor
  Clone ID: LIB5051-003-A1-XP1-F7.pep
IRIHICTCTIIDAKLTHEVTNGRQTKTNKLLKQSSLSMQTMLHKRRRPEQ

SEQ ID NO: 51504 - protein, 89 aa, Sorghum bicolor
  unsure (1)..(89): unsure at all Xaa locations
  Clone ID: LIB5051-003-A1-XP1-G11.pep
MEIRKKESIVQRELKTKRQKTEKSKXQKYKEKKIYNKKKRKKIKKEKIKKKKKRRNKKKKXKKRNXKKNKIKKREKQKPDKKKKKKKHK

SEQ ID NO: 51505 - protein, 92 aa, Sorghum bicolor
  Clone ID: LIB5051-003-A1-XP1-G5.pep
MTKRTKKVGVTGKYGTRYGASLRKTVKKMEITQHARYACPACGKNAVKRTAVGIWNCKPCKKVYAGGAYTFGTPSAATVRSTIRRLREVAEV

SEQ ID NO: 51506 - protein, 246 aa, Sorghum bicolor
  unsure (1)..(246): unsure at all Xaa locations
  Clone ID: LIB5051-003-A1-XP1-H3.pep
RRFGNCSPPDLPLIIGELHSIPSVPLAEDVVAPKNPLGPGGGGGGAPRGGFFSSPPPGGRFFFFPPRVAGHNAACPEGGGKNGPPPAPWGLGDPPPGGPPPPPPPRTPPPPXGGAPPPPPPPGGPPPRGGGFSGGGRPPPPPIFFKHPPGVKRGGPPPPVGVGVEPPPFSPFXGGPFLLYKTPPPPLFFFFFPPRGGEKRGFPPPPPGGGKKPHRPPPPPPRGGGGVXXPPPHPPPRGGGGAGAPP

SEQ ID NO: 51507 - protein, 70 aa, Sorghum bicolor
  Clone ID: LIB5051-004-A1-XP1-A9.pep
VSSYHSCKQEKESNASVTVRPSTRLVPDINLLYNHLRAVAVGAAKLEDQVGVGALVEDGVLATGVARRVR

SEQ ID NO: 51508 - protein, 128 aa, Sorghum bicolor
  Clone ID: LIB5051-004-A1-XP1-B11.pep
AGPVLHQPQQTKPSRNRRAQSRPSLSTPPPPPPPQPPPPRPRPYPPVPLPGTTDSPRSSADPSASRAGHGFAGALGRRGAALVPGVPPDVRRHLLPRPAPLVPAAAAAPPPLPPPLPHLPPPAAPPPP

SEQ ID NO: 51509 - protein, 144 aa, Sorghum bicolor
  Clone ID: LIB5051-004-A1-XP1-B7.pep
MSFFQKQFALPAKSRGCYLITDEVTRQVPEIKNFKVGVMHLFIQHTSCGLTLNENADPTVRADMADALDRLAPEDKEGVLYQHDDEGLDDMPGHIKSSLVGASVSVPITNGRLNTGTWQGIYYCEFRASKHSRKLVATIQGEKA

SEQ ID NO: 51510 - protein, 106 aa, Sorghum bicolor
  Clone ID: LIB5051-004-A1-XP1-B8.pep
PAGSESGDFTNHNCTGGKSIYGNKFADENFQLKHNKPFLLSMANAGPNTNGSQFFITTVVTSWLDGKHVVFGEVVEGQDLVKKIEGQGSDSGKTKSKITITSSGTL

SEQ ID NO: 51511 - protein, 181 aa, Sorghum bicolor
  Clone ID: LIB5051-004-A1-XP1-B9.pep
MSSNKDHTSTPQSYLDQATGAVQSAIGSLTGNTADKAQGENRKDTAAAEHDLSHSAAKAGPFSVIPSGGVAKDNSDRTEGSWNQNMGAAKEALGGLVGAEGLKQQGIQQNKEGKEQEAAGQVNDLGKGIGDRLGGTVGGAVAGLTGNAAQKEEAQRQHDEGKARQRGVEADLQKQAEAERR

SEQ ID NO: 51512 - protein, 79 aa, Sorghum bicolor
  Clone ID: LIB5051-004-A1-XP1-C1.pep
MAAASSRRASQLLGSAASRLLHARGFAAAAAAAPSPAGFGDQSTRATCQGPTGKNGPSHTEQALEHGPTTAGGATPTNG

SEQ ID NO: 51513 - protein, 174 aa, Sorghum bicolor
  Clone ID: LIB5051-004-A1-XP1-C3.pep
MAYQKLLVLFFIGTITFELLIQSATASNPNKGKNLHNAGGSGLPAGDTNDGNGFCENCGCPKNAPGAFNGGMSRPMPGYPGGAMGGCFRPMSGHQPPTGFAPNAAPGGAMGGCFGPMSGHQPPTGFAPNAAPGGAMGGCFRPMSGHQPPTGFAPNGAPGGAMGGCCRPGSRNCQ

SEQ ID NO: 51514 - protein, 167 aa, Sorghum bicolor
  Clone ID: LIB5051-004-A1-XP1-D10.pep
MEAAGAASPPTEPPPTHPAVAPLAFLLGKWRGEGEGSFPTISSFRYGEELLFSHHPSKPVISYTQKTWKAASGEPMHAESGYWRPRPDGSVDVVIAQSTGLAEVQKGSYDAEKKTVTLQSELVGNASKVKRITRTFQVADGELSYVVQMATITTSLQPHLRALLKRI

SEQ ID NO: 51515 - protein, 125 aa, Sorghum bicolor
  unsure (1)..(125): unsure at all Xaa locations
  Clone ID: LIB5051-004-A1-XP1-D8.pep
MGRRRCRCWPSAAPELLLLLLLLVCFSQGLAPTRLLPPLHQATAVPPKVLHQRENVVMLITADGLALQEGDAVXNGEELSISDMMRAQQDGGKTDCQSXNEEWMXRWVLGNAHLDYIYTQHNGKS

SEQ ID NO: 51516 - protein, 168 aa, Sorghum bicolor
  Clone ID: LIB5051-004-A1-XP1-D9.pep
AASKVDWTTIYTQLGLGKETLSSLQAFRARHTSAVNRNAALKASTPQIDLSAYKSILKDQSAIQQAEKVLAEFKPVDYDVKKWDDAVTAFEGKAVAAAKETVTKIAAEESSLNDTLSNIKDARPFEDLTINDVAKARPEVQKTVDTMLQKGKWSVPGYREKFGELALM

SEQ ID NO: 51517 - protein, 63 aa, Sorghum bicolor
  Clone ID: LIB5051-004-A1-XP1-E1.pep
MAGGRVAHATLKGPSVVKEIFIGMTLGLIAGGMWKMHHWNEQRNTRSFYDMLDKGQISAAVQE

SEQ ID NO: 51518 - protein, 216 aa, Sorghum bicolor
  unsure (1)..(216): unsure at all Xaa locations
  Clone ID: LIB5051-004-A1-XP1-E4.pep
AGRCPDPSRGTARSTWGAYKYLSELYTKKQSDVLQFVSRVRCWEYXQLAIIHRASRPSRPDKARRLGYKAKQGYLIYRVRVRRGNRKKPVPKGATYGKPVRQGVNHLKYQRGLKSTAEERVARRCGNLRVLNSYWINQDGVYKYYEVILVDPQHKAIRRDARINWIANPVHKHREARGLTAEGKKNRGLGKGSKFNHTPARATWRKHNTLSLRRYR

SEQ ID NO: 51519 - protein, 93 aa, Sorghum bicolor
  Clone ID: LIB5051-004-A1-XP1-E5.pep
FISFIDYRKTALAVRLLNAVIVAIVIVKTPIMLRVSYYSFSYSTLLLAAGVVLLGVSVVLASCVGKTRVVLRLTRDSIVGNAARGEGGWTEPR

SEQ ID NO: 51520 - protein, 128 aa, Sorghum bicolor
  Clone ID: LIB5051-004-A1-XP1-E6.pep
MIAQSIRASRQALVRVARQQPAFVARRTFITPSAVRSADLVQDLYLRELKNYKVPEVKAGDAEGHVQKFTVPKAPASPEETDIANELKAYETQAVDVEGAQGEDDAVLPQEDWFEEEDESITTPGATH

SEQ ID NO: 51521 - protein, 126 aa, Sorghum bicolor
  Clone ID: LIB5051-004-A1-XP1-F3.pep
MSWQGYVDTNLVGTGKISQAAIIGLKGGVWATSPDFNLTAEEQKAIIAGFDDPSGLQAGGVRANGKKFFTLGVTQRTIYGKQGGDGLVAVKTNQAVLVCVYVAPIVPGEANKVAEGLADYLVSVAY

SEQ ID NO: 51522 - protein, 119 aa, Sorghum bicolor
  unsure (1)..(119): unsure at all Xaa locations
  Clone ID: LIB5051-004-A1-XP1-G1.pep
GFQSSKFNFSTTLHFPSNQTNQPPQHSKCLLPTPTTPTRASSXRPSTLSRTPXTTSPRPTRASPLRPPRRATSSRPRATSPARTPSPTVPPVLSTLLVTRSTRRSTRAPPRPTSAPSKY

SEQ ID NO: 51523 - protein, 95 aa, Sorghum bicolor
  Clone ID: LIB5051-004-A1-XP1-G10.pep
MSAPTASTFFRVTLMRSAIGLPRRTSGVLKALGLHKRMRTVYHPVSPDIAGQIFAVKELVDVQEVDQRLTNSEMKELRKPDTGFWVEKRVRDAKK

SEQ ID NO: 51524 - protein, 205 aa, Sorghum bicolor
  Clone ID: LIB5051-004-A1-XP1-G4.pep
PAGSITSSTFSPLIAWWIHHSGNFKWTAATGVPIVLLGTALLIPFRNPSTNPGVLAFTQILVGLGTAFFATCGQLAVMVPVTHQEIAVVNAIWGLFGSFGSSIGYAIAGAMWNNILPGQLLQRLPESSKADYRTIFGSITVQSSFADGTPERDAIVGAYADVQRKMVITGACFVPLCLACIWVWKNTNIKKLEKEEGKQTKGTVF

SEQ ID NO: 51525 - protein, 159 aa, Sorghum bicolor
  Clone ID: LIB5051-004-A1-XP1-G8.pep
RVLSRSRRGRSKSTTPAAPHVCAPMQTRRGSRLRLQRRCQAQRVRVSWSSRRPAGAAIAMGQARWQPCYALWRGAAAAGAHTRRRAPDWLRCRPGAHCVVKTRRRGSTDMLQYQERGRGRRVEGSVAAVPCSRPSPSLLSVSGEDSEREDRVRSPKRPA

SEQ ID NO: 51526 - protein, 83 aa, Sorghum bicolor
  unsure (1)..(83): unsure at all Xaa locations
  Clone ID: LIB5051-004-A1-XP1-G9.pep
MGRRPRRWHTRGVDFRQNVWSMTAVPYCRPNDCRRNTAIDMFGDFLICIPVAMTFAELXHGPDYPVRAVPSHLCCNNFGKNEY

SEQ ID NO: 51527 - protein, 98 aa, Sorghum bicolor
  Clone ID: LIB5051-004-A1-XP1-H1.pep
MSDPRMFPSGSDDRTDPSDTERRLYNPYQDLNMPYSYRTLYDLPTSPEFLFQEEALAQRCSWGENLTFYTGVGYLSGAVGGAALGLCDVARVCRRGEC

SEQ ID NO: 51528 - protein, 112 aa, Sorghum bicolor
  Clone ID: LIB5051-004-A1-XP1-H10.pep
AGFPTRLTLGTVQLCALSSQITMFSPSIYTVSIFQLGLTSALSAYGLYLSYQNITRLQQYEEKSQKAAEWSNTAAQRLHKTRSTQTSGTVTVCLNHLRPPPDSTNTTTLATT

SEQ ID NO: 51529 - protein, 184 aa, Sorghum bicolor
  Clone ID: LIB5051-004-A1-XP1-H11.pep
MTRRNGCTIYVGNLPGDIREREVDDLFYKYGRIVEIDLKIPPRPPGFAFVEFEDPRDAEDAIYGRDGYNFDGHRLRVELAHGGRGPSSFDRSSSYSSAGQRGASKRSDYRVMVTGLPSSASWQDLKDHMRRAGDVCFTDVYREAGATIGIADYTNYEDMKHAIRQLDDSEFRNAFSRTYPGEAV

SEQ ID NO: 51530 - protein, 106 aa, Sorghum bicolor
  Clone ID: LIB5051-004-A1-XP1-H4.pep
MITRAKLVEQLREHQIRSVQSYPAALAVFSPNPHISSRRDLKVALIYAVLFCFLMVSCYVGLYLKWFRLSAMFVIFGILLPVSLKISRHRRLKRKRERRLLLPLSM

SEQ ID NO: 51531 - protein, 131 aa, Sorghum bicolor
  Clone ID: LIB5051-005-A1-XP1-A2.pep
AGSKTAPAGEKLAALAIPAKVRAALQARGQLLIESDTLTPEMLAKTDVLYCTRVQKERFEDPALYEEVKDAFVVDGKTLKQAKESMIVMHPLPRNAELSKEVDDDPRAAYFRQMRYGMFVRMALLALVMAP

SEQ ID NO: 51532 - protein, 127 aa, Sorghum bicolor
  Clone ID: LIB5051-005-A1-XP1-A4.pep
MPNATKSNKPQGKVGRSAIEDVVAREYTIHMHKRVHGVQFKKRAPRAIKEIRAFAERAMGTKDVRLDPQLNKKVWECGIKGVPFRLRVRISRKRNDEEDAQEKLYSYVQAVNVANPKGLQTAVVEDN

SEQ ID NO: 51533 - protein, 167 aa, Sorghum bicolor
  Clone ID: LIB5051-005-A1-XP1-A7.pep
MAPLKVGDSLPEGVKFEWAPITDADPTACGRPQEYDASKEWAGKKVVLVSVPGAFTPGCQAHHLPPYIQKLGELKSKGVDVVAVIASNDSWVMNAWGKVNGVKGDDILFLSDTKTFFSKNYGWAAGMGDRNGRWAMVFDNGKVTYAENESNPGQVTVSGAEEVLAKL

SEQ ID NO: 51534 - protein, 221 aa, Sorghum bicolor
  unsure (1)..(221): unsure at all Xaa locations
  Clone ID: LIB5051-005-A1-XP1-B12.pep
MLEPQRVHRDADSDLPDTVTSPLLAHPPSPDEPSPATVGSPEITDEEIDAASAACCRICLESDSEPGDELISPCMCKGTQQFVHRSCLDHWRSVKEGSAFSHCTTCKAQFHLRVECLEDDICRRMKFRLFVARDVIAIFLVIQATIAAIGGMAFFLDKDGSFRNKFSDDWERFLSKHPVPFYYCVGVVAFFVLVGFIGLILHLSLYNXNDPCLVGSRDWCF

SEQ ID NO: 51535 - protein, 173 aa, Sorghum bicolor
  Clone ID: LIB5051-005-A1-XP1-B4.pep
MVRYSSAQIAAGNPEKFAKARGEYVRTHFKNMREVAAAVSGMNLQKAYAYLADVQEHKQIIPFRRFAGSIGRASQAKQFKTTKGRWPVKSVNFLLRLLNNAESNADAKELAVEELIIKNIVVNQAPKTRRRTYRAHGRINPYQGHPCHIEIFLSTPSAEVSRSKDLDVASSSK

SEQ ID NO: 51536 - protein, 134 aa, Sorghum bicolor
  Clone ID: LIB5051-005-A1-XP1-D12.pep
MSQSPKWIYKIFPHSSVDPRYTFPVPVPASHEFFLSEIDYKDGFVHLSTAKQVPGTLNRFFADVPAVTLLRIEHERLAGFKRVRWEEAHGDSYPHLFAHLEGENVESVKEVHRKDGEKGWDAALADKDIEQWLV

SEQ ID NO: 51537 - protein, 94 aa, Sorghum bicolor
  Clone ID: LIB5051-005-A1-XP1-F2.pep
MCCYVGKATKIFLCLGAALLVAGLVLGFGLARHTWGADRAQPADCRWPDCQQQQGSAYGGDPLLPATTPTNPLTQPAVAAFPGATTTPSSSSSA

SEQ ID NO: 51538 - protein, 97 aa, Sorghum bicolor
  unsure (1)..(97): unsure at all Xaa locations
  Clone ID: LIB5051-005-A1-XP1-F9.pep
GPFFFFFFFFFFFFFFLAKKQMLQGHMRKGKYTARGIPIRQLQSHEGQETNVTRAYAQGKIHSQGHTYKTTSERPGTNALYXPILSDVSGETGTRPA

SEQ ID NO: 51539 - protein, 113 aa, Sorghum bicolor
  Clone ID: LIB5051-005-A1-XP1-G12.pep
PAVQRMCEGGDWFAGGSCQRNLPLSSEEVEDFFSLDNNSTNVETRLVNQHLVKALEQSSFRVLDITRMSEFRADAHPSTTGGKKHDDCMHWCLPGPTDTWNDLLALSLEAVES

SEQ ID NO: 51540 - protein, 233 aa, Sorghum bicolor
  unsure (1)..(233): unsure at all Xaa locations
  Clone ID: LIB5051-005-A1-XP1-G5.pep
PAGSGPSDRTPVNHHATGGKSGLVAASDDKVVDYVHHSLLPPLVTGHRDHKRKRRKHDAKDALLPQELTATWSTIDADRGGTELATPTGGAHRSQRRAPAAERTGAGGSSSKDDKASPFVALPASSKAIRVKHSSSSSSFVIGGDSGGKQHSVAGSGSSPGDSNHSYYANNHAAATPSSSSRRLTVLGPXAPPPPPHLPXKARRPPSPSAXNSAVVPLKSDDHDERFRRGVEV

SEQ ID NO: 51541 - protein, 171 aa, Sorghum bicolor
  Clone ID: LIB5051-005-A1-XP1-H12.pep
RLDELDQPTTQRFRLPPSSSPRHSSVPRLALSYIASLQVRSSAVQHLQSAFRFSISENIIMPLLRSSLSSRLGTLTRLSLSSVHRFIAPAWHLIITSSTLFVFISFGWSFIVGWLAGSSRWVWRVEVLHMGRVRWLVLLVPESCGRVVAGESKRYGGGVTSKYTVNPIFVR

SEQ ID NO: 51542 - protein, 129 aa, Sorghum bicolor
  Clone ID: LIB5051-005-A1-XP1-H5.pep
MAPTTKSAGKKSAGKTGRSAIADVVAREYTIHLHKRVHGVSFKKRAPRAVKEIRAFAKQAMGTNDVRLDPQLNKKVWESGIKGVPFRLRVRISRKRNDEEGAKEKLYSYVQAVNVKDPKGLHTQIVEDA

SEQ ID NO: 51543 - protein, 152 aa, Sorghum bicolor
  unsure (1)..(152): unsure at all Xaa locations
  Clone ID: LIB5051-006-A1-XP1-B7.pep
RLSSSVCASPPPPLDSSNAASPCQTRRSTSSNRRPTLSAAPTYPQRAGTIGYNGFLDFNVRLCNAVDVSTSTTDQTSAHXKMPHFLPYTDSTLKTLENVDPSSQHCDIPYVNLTVYPLIDISKDAFAILLTSDGNTREDLGLPTDETLVAHH

SEQ ID NO: 51544 - protein, 139 aa, Sorghum bicolor
  Clone ID: LIB5051-006-A1-XP1-C4.pep
AGRAAIHRPSSTSTRTCLAMATRGDDGTIGSQAIAGPSRTPPTPSDPPPSAEIPSFGLQFFEYRRRLFLAGQTIPEPPVTLPDTYTIALPLPDPVPPLPRADVPSSAIGRLEALLDEDGVQETNAAWRAGVPGVHAHLT

SEQ ID NO: 51545 - protein, 267 aa, Sorghum bicolor
  Clone ID: LIB5051-006-A1-XP1-C7.pep
RPGCRFSTFPTKVYHIMSSQPKLYVLLRNKDFPPGGPIRLGSLLTDAANPESLVEGYTPSIPLGTTIYHAWENNHRDTITKNHSTQLGLYTKFLQILGIGLDISGKHAHTDSTDHQAERLDKQYYIPSTAECSDILQDRSVQACVQKAKFSCNVYLVTGIRVATRGAQSEHTDSGEREFTTDLTFDATLGGGVPLSFGPSIAQSNGHSVQTSSSQSSPFVYAYRVKEIHWSKVRGTMTTKDVKGELYGLTYKGSNETTLPGTEDVTG

SEQ ID NO: 51546 - protein, 80 aa, Sorghum bicolor
  Clone ID: LIB5051-006-A1-XP1-D9.pep
RPGSEDRCEMDRILLEMDRVLRPRGTVIIREDVDMLVKVKSVADGMRWESQIVDHEDGPLVREKILLVVKTYWTAQEQDQ

SEQ ID NO: 51547 - protein, 76 aa, Sorghum bicolor
  Clone ID: LIB5051-006-A1-XP1-F2.pep
HHCQVGRIILSTSLNFPAPLVSACSHYCTQRKKVPSIHFRFYIHIQVDIDIYMPQLVDSVIRNTAVAARPPRAPHS

SEQ ID NO: 51548 - protein, 204 aa, Sorghum bicolor
  Clone ID: LIB5051-006-A1-XP1-F5.pep
AGRAPTRSNRQDEDIHSEEELAIPEGVKVTIKNRNVLVEGPRGKLTKSLGHLAVSFTHPKKNVIKIELHHGARKSVATLRTVRTLINNLIIGVTKGYKYKMRYVYAHFPINVNLEKNKETDCWEVEIRNFIGEKLVRRVVMRPGVEVEASKNQKDQLELSGNSLEDVSQGAADIQQICKVRNKDIRKFLDGLYVSERGNIVEDA

SEQ ID NO: 51549 - protein, 108 aa, Sorghum bicolor
  Clone ID: LIB5051-006-A1-XP1-F6.pep
MGVTVESIQAGDGKTFPKAGDTVAMHYVGTLQDGSKFDSSRDRGAPFTTRIGVGQVIKGWDEGVPQLSLGQKANLICTPDYAYGARGFPPVIPPNATLKFEVELLKIN

SEQ ID NO: 51550 - protein, 157 aa, Sorghum bicolor
  unsure (1)..(157): unsure at all Xaa locations
  Clone ID: LIB5051-006-A1-XP1-F9.pep
YDNNQRISLLSINNCLFFETAATMTMPCKRHHEKRMHSQHADLAASSIDSIVTGNDALMEPTCVGNSSVPAAPINWLTRNVHXSDVDEPIXFPFSNYQPKAGSKRSRTCLKRPGITGVNWRCDNLNWELQRYSDKHDCHIDYRTAEKDDIAKGNTSI

SEQ ID NO: 51551 - protein, 34 aa, Sorghum bicolor
  Clone ID: LIB5051-006-A1-XP1-G10.pep
GPFFFFFFFFFFFFFFFFFFFFFFFFFFFFFFFF

SEQ ID NO: 51552 - protein, 128 aa, Sorghum bicolor
  Clone ID: LIB5051-006-A1-XP1-G2.pep
AGRVPVRGSILTFCLFLKKDKRKSSVLMSAHGHTGSSIQQVQSSLDKKEAKVKELLKKKKGWKSKTWPGTMEEVQLLFALIDIKVVSRVLRMGKLSKEQLLWCEEKMSKVDLTENRLRRDGSPILFPC

SEQ ID NO: 51553 - protein, 49 aa, Sorghum bicolor
  Clone ID: LIB5051-006-A1-XP1-G3.pep
AGRAATYGPFGHGDGTPFNVPVLNNGSIVGMFARADQYLDAIGFYVLPF

SEQ ID NO: 51554 - protein, 193 aa, Sorghum bicolor
  Clone ID: LIB5051-006-A1-XP1-H1.pep
MMAGEGNGDEGWRRSGIEVSALQFGYDGQPPLFARFNLRVAPGSRCLLIGANGSGKTTLLKILAGKHMVGGRDVVRVLNGSAFHDTQLVCSGDLSYLGGSWSRTIGSAGDVPLQGDFSAEHMIFGVDGVDPVRREKLVDLLDIDLQWRMHKVSDGQRRRVQICMGLLHPYKVLLLDEITVDLDVVTTMDLLDF

SEQ ID NO: 51555 - protein, 101 aa, Sorghum bicolor
  Clone ID: LIB5051-007-A1-XP1-A10.pep
PAVHIRWVAKTAFMVVGAVSIMKAAGYEPVMGQNTIKLDIAGLFGGGKQVNSGEEQSAPLRCPPGKVMVLENGRAHCVVKERVEIPFDAVLAPPSSRYGLG

SEQ ID NO: 51556 - protein, 232 aa, Sorghum bicolor
  unsure (1)..(232): unsure at all Xaa locations
  Clone ID: LIB5051-007-A1-XP1-A11.pep
MSSLSRRACYKCGNVGHYAEVCSSSERLCYNCKQPGHESNTCPHPRTTETKQCYHCQGLGHVQADCPTLRISGGAANGRCYSCGQPGHLARSCPTPGAAPIAPVGRGAGGPFRGGFAGGRGGFAGGRATSCYKCGGPNHFARDCQAQAMKCYACGKLGHISRDCSAPNGGPLNAAGKTCYRCGEAGHISRDCAQSVDTTGAAPVNGEANATPAAIPNXRAVAVPVAPVVPTL

SEQ ID NO: 51557 - protein, 79 aa, Sorghum bicolor
  Clone ID: LIB5051-007-A1-XP1-B10.pep
RGLFFFFFCTKTGDIIGNRWMVTEHKQSRTRSTCPQSRGQVACISASCLQYDESRHRLTVDEIAEDLGKIYTRHTQQST

SEQ ID NO: 51558 - protein, 252 aa, Sorghum bicolor
  Clone ID: LIB5051-007-A1-XP1-C8.pep
MAPRVFLITGCSTGFGDEFVKVVLQKGDYVVATARNSSKLSFDGANDSNSLLVDLDVTKRESIDNAFDAAIQKFGKIDVVCNNAGYGLNGPFETLSEKQIRQQMEINFFGLIDVTRKAMETMRDRKTGGVIQQVTSIGGQIGVPNFSIYCASKWAVEGFTEAISKEVKPEWGIKFTCIEPGGFRTDWSGRSMDFGEISNPAYADVDPKKQAQGRHGSQAGDPAKAAKVFYDLAVMDDPPMRCVVGTDAYSLI

SEQ ID NO: 51559 - protein, 112 aa, Sorghum bicolor
  Clone ID: LIB5051-008-A1-XP1-A11.pep
NERINLRRYRPVDAARHEIHNYQNENCHADQENALHQGCGQYDKTSLLICVARAMAGLPSIEAAEGSLDVQLDDTNLCTMHAKEGNIMTRAHSYGNDDRRREVLIPPSNHCD

SEQ ID NO: 51560 - protein, 51 aa, Sorghum bicolor
  unsure (1)..(51): unsure at all Xaa locations
  Clone ID: LIB5051-008-A1-XP1-A2.pep
KVNLLLIQLHVENNITQPMCCKITRLIIFYNSIGCIKIFCFPVXXAMGPLV

SEQ ID NO: 51561 - protein, 67 aa, Sorghum bicolor
  Clone ID: LIB5051-008-A1-XP1-A3.pep
GPFFFFFLPKPCIFYCLLKSASCNPDHILFFVNDSVILDTVMVTVSHFSVKLSSVKDRRQIEGRRGA

SEQ ID NO: 51562 - protein, 113 aa, Sorghum bicolor
  Clone ID: LIB5051-008-A1-XP1-A6.pep
MKHLAAYLLLGLGGNTSPSAADVKAVLESVGIEADSDRLDKLISELEGKDINELIASGSEKLASVPSGGAGGAAASGGAAAAGGSAEAEAAPEAAKEEEKEESDEDMGFGLFD

SEQ ID NO: 51563 - protein, 148 aa, Sorghum bicolor
  unsure (1)..(148): unsure at all Xaa locations
  Clone ID: LIB5051-008-A1-XP1-B5.pep
MILKHWIYGVMASLTLRQNEVKILFLILDNGGDTTLLHMLNDETLRQHPPTQYSSSXSAEDLATSTLKXHLHSTDAHHDCSPVIWKDYYLLRRDAPVLPMRMPMTKRRLAATNXELDAXLLSHDSLDAVSLLILWNKIDIPYAASDEE

SEQ ID NO: 51564 - protein, 98 aa, Sorghum bicolor
  Clone ID: LIB5051-008-A1-XP1-D3.pep
MPGAKYTQTYQKVSAMGEKLKAAGKQGPSNDEQLKLYAYAKVAEGKDINDAKKPGMFDLAGKAKYNKWKEVVDAGTTQKQAEDEYVKAAEEILAKHDK

SEQ ID NO: 51565 - protein, 75 aa, Sorghum bicolor
  Clone ID: LIB5051-008-A1-XP1-D6.pep
MAPVTFWAAPRQYINWAARHKPAILWSLVIGSFGPLIVAVVPPLRERLGDPNRSAIPLTYPVPKGPRQIPQGYDD

SEQ ID NO: 51566 - protein, 87 aa, Sorghum bicolor
  Clone ID: LIB5051-008-A1-XP1-E6.pep
MENDRGELVDLYVPRKCSATNRIIKAKDHGSVQISIAKVDENGRYTGENQVYALCGFVRAMGESDDCMNRLTQRDGYLKGVWNASGN

SEQ ID NO: 51567 - protein, 62 aa, Sorghum bicolor
  Clone ID: LIB5051-008-A1-XP1-E9.pep
RGLFFFFFCNFLFFTYFYSLQGLPVGRFFFFFFFFFFFFFFFFFFFFRDINCNCQSKSTCTT

SEQ ID NO: 51568 - protein, 46 aa, Sorghum bicolor
  Clone ID: LIB5051-008-A1-XP1-F1.pep
AGRVRDWNVLEGMCVVKQLESQETKRSDTPKQPCRIVNCGELPLDS

SEQ ID NO: 51569 - protein, 55 aa, Sorghum bicolor
  Clone ID: LIB5051-008-A1-XP1-F2.pep
RPGCVVDENDEVLLAGFGRKGKAKGDIPGVRFKVVKVSGVGLSALWKEKKEKPRS

SEQ ID NO: 51570 - protein, 59 aa, Sorghum bicolor
  Clone ID: LIB5051-008-A1-XP1-F3.pep
SSRCMQLVLNLQHHQHLRCGVGVVGVGLLSWNLEPSAISFSCNNNHMDCEPKKKKKKAP

SEQ ID NO: 51571 - protein, 244 aa, Sorghum bicolor
  Clone ID: LIB5051-008-A1-XP1-G7.pep
MSNQAAWIPEAKGQLQVKEAPMPKAGKGEVVIKNHAVAVNPVDWKIQDYGIFLQKYPNICGTDVAGEVHEVGEGVTHVKKGDRVLGHAFSLVTNDPAHGGFQLYTACNALVVSKIPSDMSFASGSVLPLAISTAAACLYKKETLGLPLPSSNPSSTGKSVLVWGGSSSVGATAIQLAAASGVKVVSVASKHNLEKLKGLGATAAFDYRTPRLPTTSWSLSKAQNSRVFATPSVRQMPRLPGHQC

SEQ ID NO: 51572 - protein, 131 aa, Sorghum bicolor
  unsure (1)..(131): unsure at all Xaa locations
  Clone ID: LIB5051-009-A1-XP1-A11.pep
LSKQPNHYYVLELVASKELAETTTSTVNWLTGCCLHAPARPLLAPPPLPLPLPPRCNLLRTRRRVVVVQPAVRQHHGAVPFRLLRRRRLPDPPSLQRHHVNGAAPAQHGGGSVPGALVQRHGLHLXRNPAG

SEQ ID NO: 51573 - protein, 113 aa, Sorghum bicolor
  Clone ID: LIB5051-009-A1-XP1-A2.pep
GPFFFFFLIMDVMHAKVVYSLHSLRICRQLRVRVSILYLYMGISLLLRSRLDLADPPRLDVGNVALGDGAGRLGRGVGAVLGRQRVAKGRVFSAQGDVGGQSAVRIPGGTRPA

SEQ ID NO: 51574 - protein, 135 aa, Sorghum bicolor
  Clone ID: LIB5051-009-A1-XP1-A8.pep
MRSFLTPSTVQRATTRAFSTTARIMGVQKTILSEGNGPSPQKGDKVTMEYTGWLKTSTGDKGKQFDSTTGRGPFQTPIGVGRVIKGWDEGVVQMKLGEKAKLDISSDFAYGSQEFPGLIPPNSDLIFEVELKKIN

SEQ ID NO: 51575 - protein, 123 aa, Sorghum bicolor
  unsure (1)..(123): unsure at all Xaa locations
  Clone ID: LIB5051-009-A1-XP1-B8.pep
IRSKRSVVSLVIEPSLWFINHCRCQSSASCVIPNRRRNSPCMVAVLPLLLLCYGVGNVHCATVHENREDFQSLLEFKNGTIDRNGVLSNWNSTNHFCXWYGVNCTTTPPYRVVYLNLTSQNLG

SEQ ID NO: 51576 - protein, 87 aa, Sorghum bicolor
  Clone ID: LIB5051-009-A1-XP1-C1.pep
MENDKGVLVDLYIPRHCSATNRLITAKDHASIQIQVADVDADGKAIKGKSTTIAICGRIRAQGDSDDSINRIATKEGLLKNTWTYSR

SEQ ID NO: 51577 - protein, 159 aa, Sorghum bicolor
  Clone ID: LIB5051-009-A1-XP1-D11.pep
MATELTVQSERAFQKQPHIFLNHKVGGPRKNTRNRRWYKDVGLGFRTPKTAIEGTYIDKKCPFTGMVSIRGRILTGTVMSTKMHRTLIIRREYLHFIPKYSRYEKRHKNLAAHVSPAFRAEPGDQVVVGQCRPLSKTVRFNVLRVLPRKGKAAKQFNKF

SEQ ID NO: 51578 - protein, 80 aa, Sorghum bicolor
  Clone ID: LIB5051-009-A1-XP1-D12.pep
YNSVKRTLIHRLVVHFLMKATVRSWSSTACSESSMSKWNAWPTPLDSNSSTSPAYPLALISRWYHSARSLSRKSSRTRPA

SEQ ID NO: 51579 - protein, 64 aa, Sorghum bicolor
  Clone ID: LIB5051-009-A1-XP1-E4.pep
MASPENDGGGKKRRRRRQPKRGYDSSAAEEKDEAAVKRSGGFRHHGSRRKSTPRRAAEAGVECK

SEQ ID NO: 51580 - protein, 106 aa, Sorghum bicolor
  Clone ID: LIB5051-009-A1-XP1-F12.pep
MVDIPKTRRTYCKGKECRKHTPHKVTQYKKGKDSLAAQGKRRYDRKQSGYGGQTKPVFHKKAKTTKKVVLRLECTACKVKHQLVLKRCKHFELGGDKKQRGAAISF

SEQ ID NO: 51581 - protein, 198 aa, Sorghum bicolor
  unsure (1)..(198): unsure at all Xaa locations
  Clone ID: LIB5051-009-A1-XP1-F2.pep
MASAGKITKTLASMGGRQEAIKKYTVQPVGIWAKINNFFAVDSSRSTGIPMNPTFRYPSPGANDPNLYDDPVTVPAGDIAENPYWKRDVRRSYPKLSVVKQPDVVALLSVGSAAQPKEDKLQIGEAGKNQLVALKEEGEKGLSAFFEKEKSAAKSVLGPNGMPPLPARYGQTVTAPKYDLAEEDLXTYGANYPLQSXV

SEQ ID NO: 51582 - protein, 68 aa, Sorghum bicolor
  Clone ID: LIB5051-009-A1-XP1-F7.pep
MDSAKVPVKLVKVTRVLGRTGSRGGVTQVRVEFMDDTTRSIIRNVKGPVREDDILCLLESEREARRLR

SEQ ID NO: 51583 - protein, 199 aa, Sorghum bicolor
  Clone ID: LIB5051-009-A1-XP1-F8.pep
MRFSAVAIISALALTASAEQAAEKRQLGSIINQATSAVVGGGASVFGDATSAIVGGGGSVAGAATSAVGNGGGSILSQATSAVVGGGASVASAASSGIVGGGGSIASAASSGVVGGGGSAASAASSGVVGGGQSAASAASSAAQPSGAAMRGTVFSTGAAMGAVIGAAGIIVGAGRVLANGRPTSTTVVAKNRMRKHNK

SEQ ID NO: 51584 - protein, 164 aa, Sorghum bicolor
  Clone ID: LIB5051-009-A1-XP1-F9.pep
MATTAAAGYGHGCCSAGLPSFALFPGILSTRRSPPPPPRVSLVASSSKLKAPAPRLRVSYRPRCLASSSGQVNSDAVLSSTEATIDIKLPRRSLLVQFTCNACGERTKRLINRVAYERGSIFLQCAGCQVYHKFVDNLGLVVEYDLREENELQGENAVNTNSED

SEQ ID NO: 51585 - protein, 124 aa, Sorghum bicolor
  unsure (1)..(124): unsure at all Xaa locations
  Clone ID: LIB5051-009-A1-XP1-G10.pep
SRPLRVYSSWKQAFFFFRNSPQPCCLCLCRCXRRRRRRLGLVASRFTWSHATELQSKKRTSRQNWPPRASSSSSSRAVATRGVLSAPRPPARARAVGLGRATRPPRHRRTAWRRRAASWRWRRR

SEQ ID NO: 51586 - protein, 128 aa, Sorghum bicolor
  unsure (1)..(128): unsure at all Xaa locations
  Clone ID: LIB5051-009-A1-XP1-G11.pep
EPKIPASQGFADELSEMSHSIQQGQVTFAYNGLSTVHHSLASSQHHHQAWPMTRIGDAENGAVSLTLGLHQNNRVCIDEPLPESLPPNLDRRFAVEEDIDPYMMRSFLNQYRNFGKDXGDHLLHDFAG

SEQ ID NO: 51587 - protein, 112 aa, Sorghum bicolor
  Clone ID: LIB5051-009-A1-XP1-G2.pep
YCARLPICELHRELYTLYRRLMCAHFYVLPNYILRLQLQHPHRPDQDGCTHMILLIMRLLLLFPHTLWNTDDPTAHTLTPTLNIIVPYTPITTDNSLMPLLLSSEINRSACR

SEQ ID NO: 51588 - protein, 87 aa, Sorghum bicolor
  Clone ID: LIB5051-009-A1-XP1-G7.pep
MDTDTTSTDSQFRHPAPAISAAGARAVVCSLAARGAESLARGLVTCVFATVGTVLGAITGALIGLATETGVLSGTGVGGITGALVPM

SEQ ID NO: 51589 - protein, 182 aa, Sorghum bicolor
  Clone ID: LIB5051-009-A1-XP1-H4.pep
MKTTFTVAALTGLLSTASAQYFGLTSARSASPIHYQTVSASGNSIWLNKKTSSYCPENIEDIGGCPAGNTTTFAGGEDTLSMGAVVPGGQQVYIDPDTGAVKYTQAHSAAMPEGAIQTGWTVSPGNGFGILSNSNGAFIACPAKDDSYQVFIGLECVDFDEACLSFDALASNGTEAGAWQYS

SEQ ID NO: 51590 - protein, 72 aa, Sorghum bicolor
  Clone ID: LIB5051-009-A1-XP1-H5.pep
RGLFFFFFCKKLFELVGILHKCNHRVKGHPRRHSSSHSHQTPACHSDAMLSITICNQSSRRVSGKSLRPPSK

SEQ ID NO: 51591 - protein, 62 aa, Sorghum bicolor
  unsure (1)..(62): unsure at all Xaa locations
  Clone ID: LIB5051-010-A1-XP1-B3.pep
VPEFLPQNRLLSNMQWRAIGVSQRCGWMHYAIHRPETIIMMFRRXCNYRQQEEAAAAGLLAK

SEQ ID NO: 51592 - protein, 129 aa, Sorghum bicolor
  Clone ID: LIB5051-010-A1-XP1-B4.pep
RPGWGDFRRQNISTEEQLGSVSDISMGKKAQNVLALILIPFFVYISQAEGAMEPASNITEVVDVESIKTLFQLAYMPEAARVYHTCGQCSCCQGKICTVMACCWEYRCNGNAQVSCVVEAKTCGCANCS

SEQ ID NO: 51593 - protein, 52 aa, Sorghum bicolor
  Clone ID: LIB5051-010-A1-XP1-B5.pep
RLACRPSQAYLSYNTTHILLYMSSNCSVRKTTYQLIMIVLVRHNATRWIPAW

SEQ ID NO: 51594 - protein, 53 aa, Sorghum bicolor
  Clone ID: LIB5051-010-A1-XP1-B7.pep
YLREKKKKKKKKKKKYIFCDFSCFLSRGDRRLHRVYLSFLILLVLLLLCKTLI

SEQ ID NO: 51595 - protein, 168 aa, Sorghum bicolor
  Clone ID: LIB5051-010-A1-XP1-B8.pep
AGRAPDLYAMAVMDRIKNDRQITVDMPHGDAWLREDSARPIVLIAGGTGFSYARSILLTALAQQPDRDIAIYWGGRELRHLYDLDELNALAVKHPNLKVIPVVEQPAEDWQGRSGTVLTAVMQDYASLSGHDIYIAGRFEMAKIARERFCAERGALEAQIKKKKKKAP

SEQ ID NO: 51596 - protein, 118 aa, Sorghum bicolor
  Clone ID: LIB5051-010-A1-XP1-C4.pep
AGRAAGILGKRSSVTTPPPPEGGVARPRLPSGGSAHVGGAGYPNPPDAAIPEAATLRDQWRFAVRQYSRWYSHAWGTAILAGAAFFALGWLVKGSNPLPSRAEPQHDANGKSVAEEEN

SEQ ID NO: 51597 - protein, 174 aa, Sorghum bicolor
  Clone ID: LIB5051-010-A1-XP1-D1.pep
MDVYYFYSYGTAAWLATQAAPLIASPTMIVALLSPEVREASTLEVYFSRSLGFSLIALGIMTVLLTGSVPLSSRLSEGATTNAEDPKAPYALPTLTITAMFHSVLAFYGYAMWAKTGVMSFGLGTLGSGFLAMIALWCILFASSNGRISRKTGADKRTSGFPFKNQEADKRKAR

SEQ ID NO: 51598 - protein, 96 aa, Sorghum bicolor
  unsure (1)..(96): unsure at all Xaa locations
  Clone ID: LIB5051-010-A1-XP1-D3.pep
LCGAQAAGSTMLLLLXEVCIHIYPPISISRTTQKYSTPNPGENSQKYSPISVFPCEINAQVILVTTTCNIISRDECSKKERKKKVYEEKKKKKRPL

SEQ ID NO: 51599 - protein, 82 aa, Sorghum bicolor
  Clone ID: LIB5051-010-A1-XP1-E1.pep
RNIIETRKSDKASKRVMLLGRLHRRSGPPVPPAWRWPARVPVPSPPHKHASRYTYVAGQVFRAHRPCAPVSLPPGSLPARPA

SEQ ID NO: 51600 - protein, 195 aa, Sorghum bicolor
  Clone ID: LIB5051-010-A1-XP1-E4.pep
MEVLLGITGKDFTIIAASKATMRGPTVLKATDDKTRPLNKHTLMAYSGEAGDTVQFAEYVQANIQLYSKRNSSELSPYEVSSFVRSSLAKSLRSRNPYNVNLLLGGFDPITDKPELYWIDYLASSAPVPYAAHGYAQYYCLSLLDKHHHPDIDFEQGMKILRMCTDELKRRLPIDFKGVLVKVVTKDGIREEPYV

SEQ ID NO: 51601 - protein, 162 aa, Sorghum bicolor
  Clone ID: LIB5051-010-A1-XP1-F4.pep
MLIPKADRKAIHEYLFREGVLVAKKDFNLPKHGDIDTKNLYVIKACQSLTSRGYLKTQFSWQWYYYTLTPEGLDYLREWLHLPAEIVPQTHVKQQRSHAPPRGMLGGDGERRGGGRGGPRGDREGGYRRREDGEKKEGAPSSFNPEFSRGGFGRGRGAAPSS

SEQ ID NO: 51602 - protein, 227 aa, Sorghum bicolor
  unsure (1)..(227): unsure at all Xaa locations
  Clone ID: LIB5051-010-A1-XP1-G1.pep
MSWDNARKHARALETALDLKLATYSRIAHIITRAPGQSSSTSSDDGAGGYKLVEEEVEELLSKLEQAIDDLMTLINSPSQPPSTSMQHAAQRHRDNLDDYRRDFLRARSNVDQAIQRSNLLGSVRKDIDDFKSSQTDALLADRGRIDSSHRMMDDTLSQAYATREDFAQQRSLLTSIETRMGGVLNQMPGINSLITMIRSRRXRDSIIVGCVVGICGLLLVGYPLGF

SEQ ID NO: 51603 - protein, 36 aa, Sorghum bicolor
  Clone ID: LIB5051-010-A1-XP1-H7.pep
RPGPGISTNSICVIYLRLHRLWNVLNFQLCTTIISG

SEQ ID NO: 51604 - protein, 136 aa, Sorghum bicolor
  Clone ID: LIB5051-011-A1-XP1-A1.pep
MSSSAAYPDADENLEAIITRVEQKSRKIETLLKQSKPVEALKTALEGSPLKTRDERCKSANWIVVHRAMMAIRDVDGMFNSLDPEYYDILMKYLYRGLSTGDRPTCDQCLKIHEKLTEKAGLGCILRSLADTVNTV

SEQ ID NO: 51605 - protein, 110 aa, Sorghum bicolor
  Clone ID: LIB5051-011-A1-XP1-B4.pep
MSAAELASSYAALILADEGLEITADKLQALIAAAKVPEIEPIWTSLFAKALEGKDVKDLLLNVGSGGAAAPAAGGAAAGGAAAAADAPAEEKAEEEKEESDDDMGFGLFD

SEQ ID NO: 51606 - protein, 203 aa, Sorghum bicolor
  Clone ID: LIB5051-011-A1-XP1-C1.pep
MSEQQKTPAKKTPKKLGGKKDAQQPTPDQTDEAEAEGEAGADVEAEGGAQADGEEEPEPQQERQPSRRRQSRGRGRKGGAQDSDAESVARSDVSASGGRRQRQKQKKQGKQGGGGLEDITEGVPGGDLVNGAGDMVQNTAGNAVNQVGNTAGQALGGLTGGKQGGGEEEGGGEQLRLRLELNLDIEIQLKAKNHGDLTLGLLN

SEQ ID NO: 51607 - protein, 117 aa, Sorghum bicolor
  Clone ID: LIB5051-011-A1-XP1-C11.pep
MFSIVRSSTRRAALAPVRGAMATRFASTSTEAQKKAEDGEDAVGEGLKKAGKALQSDGSIGKNFNPDGAVGSKAEAVGGPFSSDGVIGKQFTDKGAIGGTGQKVAENVEQAGKETKN

SEQ ID NO: 51608 - protein, 130 aa, Sorghum bicolor
  Clone ID: LIB5051-011-A1-XP1-C4.pep
MAARGFERFSRWFQRSSAAAGGSKDEDDRSERNGLLRSQLDQVVPVTDCADTSKALAVHMGPKTVALKVSMHCHGCARKVQKQISKLQGVVSFRVELESKRLTVVGNVSPTEVLECVCKVTKHAEILQAP

SEQ ID NO: 51609 - protein, 149 aa, Sorghum bicolor
  Clone ID: LIB5051-011-A1-XP1-D2.pep
MSDGEEVPQQEVEAVEEVEVPADNASGSMSVLDALKGVLKISLIHDGLARGLREASKALDRRQAHMCVLNEACEEEAYKKLVVALCGEHKIPLIKVPDGKQLGEWAGLCQIDREGNARKVVNCSCVVVKDWGEESQERSILLNYFQTEQ

SEQ ID NO: 51610 - protein, 63 aa, Sorghum bicolor
  Clone ID: LIB5051-011-A1-XP1-D3.pep
MLDILYDSWSPAMTVSSICISILSMLSSSPAKQRPADNDRYVRNCRNGRSPKETRWWFHDDTV

SEQ ID NO: 51611 - protein, 159 aa, Sorghum bicolor
  Clone ID: LIB5051-011-A1-XP1-D5.pep
MRTYDDSFSGQKIYPGKGKLYIRGDSKIFRFQNGKTESLFLQRKNPRKIHWTTLYRRAHKKGISEEVAKKRTRRTVKHQRAIVGASLDVIKERRSQRPEARSAARAAALKEGKEKKAAAESAKKAEKAKNAAASARGNAAKVSKQGAKGAAPKVQARTR

SEQ ID NO: 51612 - protein, 254 aa, Sorghum bicolor
  unsure (1)..(254): unsure at all Xaa locations
  Clone ID: LIB5051-011-A1-XP1-E9.pep
AGRAPAFTLLLQNTTNAHNDIHNRLFPPTPHPTXPPSKPSLDRESPQTRALITHLNLQPHIEGGYFVETDRDALRVPNPFTNTHPSATASDADSSSRAASTTIHYLLTRASPLGAFHRNRGRTVHTLHKGRARYVIIHADEVAPGDRPSGYGSEDAADEKKLWTGKARVETYVVGQDVLGGERLQWIVEGGKYKASFLLPDAKDGEDSAEGCLISETVVPGFEFADHDFMKRERAEALLTQEQLEEMGWMLRRD

SEQ ID NO: 51613 - protein, 76 aa, Sorghum bicolor
  Clone ID: LIB5051-011-A1-XP1-F1.pep
RGLFFFFFGATSKTDYMNKRIQKSNSLFSLSLSRVRSNKYGVIFLFGSQKDFATDSTERRYGNTRLCIDGDKNSKL

SEQ ID NO: 51614 - protein, 165 aa, Sorghum bicolor
  unsure (1)..(165): unsure at all Xaa locations
  Clone ID: LIB5051-011-A1-XP1-F3.pep
RPGLRNEQILTITVLYCGIAXMGTKVLSTTFNGTNKIRAYAHCAKNSEGITLLLINLDGNNTNHICVTSQGAQTQSARKESRMSYQIPGLGEAAELTRQEYHLTPKGGNLQSQQMLLNGNVLATDANGDIPKLEPVQVEGTQPITVGPYSIVFAHIPSFYAPACS

SEQ ID NO: 51615 - protein, 88 aa, Sorghum bicolor
  unsure (1)..(88): unsure at all Xaa locations
  Clone ID: LIB5051-011-A1-XP1-F8.pep
AGRAAPFRSFLLRIXKTSIDPSKLVGKYIPNVTARPFELTKEYFEDVYRLTSSPRIGNILANWEKYESDEPSASRPRAGSAAVRPQEE

SEQ ID NO: 51616 - protein, 213 aa, Sorghum bicolor
  unsure (1)..(213): unsure at all Xaa locations
  Clone ID: LIB5051-011-A1-XP1-G4.pep
VRRSRRQAVRPHPRSSTTHKHDPQPAGSHNINNVNMSGSTGYHSAGALMYCNTTFYSGMDNVTVQSNERVNVSWPDGNAPFEIKRLNGNSAQELDCMVSRFNGGYMPWSIDWSFNNRSFIWNVDEQYNLRFGNQTASRNETFQAPGDWSLFIAVQKEDMDSNNWAHNDYRYWTSPRYVVGNNPLPSNGVERKISVQAGLLVGMLAMTCLTSLX

SEQ ID NO: 51617 - protein, 84 aa, Sorghum bicolor
  unsure (1)..(84): unsure at all Xaa locations
  Clone ID: LIB5051-011-A1-XP1-H12.pep
PAGSGIPDEGLAMIRYHSFYPWXTGGAYKWMMNEKDERMLEAVKAFNPYDLYSKSDEVPKVEDLKEYYLDIIDEFIGKDKKLKW

SEQ ID NO: 51618 - protein, 155 aa, Sorghum bicolor
  Clone ID: LIB5051-011-A1-XP1-H3.pep
MAAVYENLSSDLVWQISRANNAYLTKRKGAGGVQFSRDPLNLTNKHSRKWAGYVNEQAIGINADSPNTIGLTTKLPSRANKPAKSQQTSSFSANTPGRKIYKSVVNTTAKRGYRADLRAAAVARASAVKLSQQQKKERAASKPRGAAAKKAEESS

SEQ ID NO: 51619 - protein, 192 aa, Sorghum bicolor
  Clone ID: LIB5051-012-A1-XP1-A12.pep
MRYIHSEETLKVPEGVKVHIKTRQVTVEGPRGVLKKDLGHLAVSFQQPDASTIKIEMHHGARKNVAALRTVRSLVNNMIIGVTKGFKYKMRYVYAHFPINVNLDKDNDTGLWVVEIRNFLGEKLIRRITCGEGVEVEASKNVKDELVLSGNSIEAVSQSAADIQQICRVRNKDIRKFLDGIYVSERGNIEQE

SEQ ID NO: 51620 - protein, 270 aa, Sorghum bicolor
  unsure (1)..(270): unsure at all Xaa locations
  Clone ID: LIB5051-012-A1-XP1-A9.pep
MALSKLDGCELPAAADMHVHLRDGAMTELVVPTIRKGGVNTVFVMPNLVPPITTPQHALDYQQRLQSLAPDVTFLMSLYLHPNITPETVIEAKKAGITGIKSYPAGVTTNSSAGVVSYEAFYPVFEEMQRQNMVLNLHGEAPPSATSDVTVLNAEETFLPTLLELHRRFPKLRIILEHCTTAAAIEAVKSCGPTVAATITAHHLCLTVDDWAGDPHCFCKPVAKLPSDRRALLKTAISGDPKFFLGTDSAPHPAISKRXEQVAAGVFTQP

SEQ ID NO: 51621 - protein, 142 aa, Sorghum bicolor
  Clone ID: LIB5051-012-A1-XP1-B1.pep
HFCRSWRRSSPPYRRKRDTATIVSAESDDVAACRTVLELVSESVSPLRSCSSLGCAGTGDAETSGTSGPSTRRPLSPSPTTTTTVPTRTPTTHLRPPAAGARPTGTATRTAATRRPRRRRTSPPTRATTAPATAIVRDRPTR

SEQ ID NO: 51622 - protein, 141 aa, Sorghum bicolor
  Clone ID: LIB5051-012-A1-XP1-B10.pep
MSRAFKIGGGIAAVGAGYYFYQAGGDPKAAQKRFEADAAKVQHAGKNDASSKGTEIRKDAEVFAADAGKEVDRLAAQARDGTHKVDQKLEEYRARAEKNIDSTIKKTGTELNKAVDSFDKNVSEGADKAKSGISSWFGGSK

SEQ ID NO: 51623 - protein, 228 aa, Sorghum bicolor
  Clone ID: LIB5051-012-A1-XP1-B3.pep
AGRAVITLITSLLTHVTPVIPTMSNTIPPTDPVAAVVSDSLPKPVAPAEAIQQPPAAALEPLTKTEGGFLQQARETILPYVEKVQSTAKPYTDAATHKVEELVQKIEGTAPTSATTTDPTATRDLNAPAGTTTTGQTAAEKAQGVFAQVSSAVTSTFQQVTNTIETRTTTDTHPGFITQVTNAVHKGQEKIEAFLDQPVQGSQPAVQTRRTLSPTRLRPETPVAATPL

SEQ ID NO: 51624 - protein, 235 aa, Sorghum bicolor
  Clone ID: LIB5051-012-A1-XP1-B4.pep
MPAAIPLLPLDAPEAWTKPSLANTDGGKTYKPTHPDCFKVEFSAIPPDESGGEETFASALIAVTDIEPNSIITPLTNLSQAPLKAYSSVQYGVGDHDHLELNSDLLFMNHSCDPTAYVSLPKYKPDQWVLMSTPKGLKRSEAVTFFYPSTEWDMAQGFKCSCGSENCLGEIKGAKYLSIEQLEQRGHVNQHIRSLKGQQEKEQSDHRGDRVKNKRLDICGRRISVAQVNMHPYKM

SEQ ID NO: 51625 - protein, 182 aa, Sorghum bicolor
  unsure (1)..(182): unsure at all Xaa locations
  Clone ID: LIB5051-012-A1-XP1-C4.pep
SIMKWTIALGLVSAVAALRIETPPALVTCQPAAVQFGDGTPPYFIAVLPAGEVSAVPLLQFPEQQSGPYTWNVNLPAGTNLTLRVTDGSGSPAYSSPAVIQAGPDTSCVNGGSSASASAGPSASSASGSAGPSATSGSPTNPSAPTPAQSPAQSSGAAVLXQSVGGPMVGVVGLAAALGLLV

SEQ ID NO: 51626 - protein, 104 aa, Sorghum bicolor
  Clone ID: LIB5051-012-A1-XP1-C5.pep
RQGTEPTRQGQQVLSRVSLHRRSYTPQTRPHVNLNTMPDHPVEQGAAGSLTDKIAKESSDSTASSHANHADIQAHNSKGPAIPDSMPKAESKEDLKKRAEELNK

SEQ ID NO: 51627 - protein, 80 aa, Sorghum bicolor
  Clone ID: LIB5051-012-A1-XP1-C6.pep
CRVRHRRARRTRSGRNRLSCLCSSNASTRSRMSGCVPCDWTQAAAISSSSIAARMHADQRLVDMMPLVQSSISTFFRCVK

SEQ ID NO: 51628 - protein, 185 aa, Sorghum bicolor
  Clone ID: LIB5051-012-A1-XP1-C8.pep
RPVRDEVMSIHPVQKQTSAGQRTRFKAFVAVGDSDGHVGLGVKCAKEVATAIRGAIIVAKLSIVPVRRGYWGSHIAEPHTVPCKVSGKSGSVMCRLIPAPRGTGIVAAPASKRMLQLAGIQDCYTQSKGSTATQGNFLKATVAALAKTYEFQSPDLWQIIPPGLSPYDEHSTHLLIAARKAAGGY

SEQ ID NO: 51629 - protein, 135 aa, Sorghum bicolor
  Clone ID: LIB5051-012-A1-XP1-D10.pep
PAGSGHHSHQTTHTQHSNQTTPTTKPSTCLLPTPTLPTRASSVRSPTPSPTPPTTLPSPSRAPPPLPPRRATRSRPRATSPARTPSPTVPPVLLTPPATSSTRRSTTPPPPPTSRASKCLAPARQLRTLMIVKAS

SEQ ID NO: 51630 - protein, 187 aa, Sorghum bicolor
  Clone ID: LIB5051-012-A1-XP1-E8.pep
MGIDIERHHVKKGQRTAPQSEDPYLMLLVKLYRFLARRTESRFNKVILRRLYQSKINRPPLSISRIARQVSKSNKAYTDKHTVVTVGTVTDDARLIEVPKLSVAALRFTRTARARIEKAGGECITLDQLALRKPTGSNTLLLRGARNARETVKHFGSGVNHAKPYVISKGKKEENARGRRRSRGFKI

SEQ ID NO: 51631 - protein, 230 aa, Sorghum bicolor
  Clone ID: LIB5051-012-A1-XP1-F9.pep
CAALRRRVRSFFSKNTGTTAAMASPVYTTRKVGAPHTLEHRVYIEKDGVPVSPFHDIPLYANEQQTILNMIVEIPRWTNAKQEISKEETLNPIKQDTKKGKLRFVRNCFPHKGYLWNYGAFPQTWEDPNVTHPETKMNGDNDPLDVCEIGELVAKPGEVKQVKVLGVMALLDEGETDWKIIVIDVNDPLAPRLNDVEDVERHLPGLLRDTNEWFRIYKIPDGKPEKQFSF

SEQ ID NO: 51632 - protein, 135 aa, Sorghum bicolor
  Clone ID: LIB5051-012-A1-XP1-G5.pep
RPGSRQQAQEEVAKAKEGLVERLKQALDAQVSEVRVSHRLTDSPAILAIGEQDFGLQMRRILEASGQKAPDSKPIFEINPQHPLIEKLDGEPDEDRFADLSHILFDQAALAAGDSLKDPAAYVRRLSKKKKKKGP

SEQ ID NO: 51633 - protein, 89 aa, Sorghum bicolor
  unsure (1)..(89): unsure at all Xaa locations
  Clone ID: LIB5051-012-A1-XP1-H1.pep
LSLPPPPRPQPSPTRRPARPPRPPPSPPLPLLLPSPPQSPPPARPSLARRSQPARPPRAHLLQLPAPLRVPPPPPPLPLLPPXRPRPTA

SEQ ID NO: 51634 - protein, 84 aa, Sorghum bicolor
  Clone ID: LIB5051-012-A1-XP1-H12.pep
MSRCGGNCGCGSGCKCGSGCGGCKMYPDMAEQQVTTTAKTLVMGVAPSSKGHAEGGFEAAAGAGAENDGCKCGPNCSCNPCTCK

SEQ ID NO: 51635 - protein, 136 aa, Sorghum bicolor
  Clone ID: LIB5051-012-A1-XP1-H5.pep
GPFFFFFLFFFQSLTAIHSNDFASRLYLDTPYIANGGPPSMRATALLLVLDGDVLAGGLLEKTSDAVRDLLGGTGGLLVAGLAEDAVDALVKGVLLAGGLLGAAGGDGVGSALGGGFSGGRHVCMSELVVDGWWVG

SEQ ID NO: 51636 - protein, 78 aa, Sorghum bicolor
  unsure (1)..(78): unsure at all Xaa locations
  Clone ID: LIB5051-012-A1-XP1-H6.pep
GLEVLFLXNSLSGCLPYELGLLEKATVIDAGTNRLTGTIPASFACLRKVEQLNLADNLLYGEVPDALCRLAFSHLNNL

SEQ ID NO: 51637 - protein, 148 aa, Sorghum bicolor
  Clone ID: LIB5052-001-A1-XP1-B6.pep
MPTRLTKTRKHRGHVSAGHGRVGKHRKHPGGRGMAGGQHHHRTNIDKYHPGYFGKIGMRYFHKQQNLFWKPVINLDKLWSLIPVEKREEYLTKKGGNAPVLNLLDYGYSKLLGKGRLPEVPIVVRARYVSAEAEKKIKEAGGVVQLVA

SEQ ID NO: 51638 - protein, 102 aa, Sorghum bicolor
  unsure (1)..(102): unsure at all Xaa locations
  Clone ID: LIB5052-001-A1-XP1-B8.pep
MMASRGTSAVLSRAARMRQKLQSVLEASALDIEDVSYQHAGHAAVKDNANETHFNVKVSXPKFEGQSLVKRHRMVYDLLRDELSSGLHAVSIVAKTPKELGS

SEQ ID NO: 51639 - protein, 228 aa, Sorghum bicolor
  unsure (1)..(228): unsure at all Xaa locations
  Clone ID: LIB5052-001-A1-XP1-D6.pep
MAAMSETTEVRLHGAWGSAHAAMARNALALKGVQYEYVEEDLDNKSEALLRLNPVHHGKVPVLVLVVDGRRRPLAESLVIVEYVDEAWPESPALLPREPRARAAARFWARFFHDEVSPLSRPVLFADGEAERAELVREMKARMAVMEAGIAEDFPSGDEGPFVHGRSPGLLDVILGSCAAXTRVLSAVSXEEIVDPWTMPRVHASMAAFDQLAAGFGNTVPHEHLLAR

SEQ ID NO: 51640 - protein, 217 aa, Sorghum bicolor
  Clone ID: LIB5052-001-A1-XP1-F10.pep
MSKISVAGVRTNVQQLLEYSNETKKRNFLETVELQIGLKNYDPQRDKRFSGTIKLPTLPRPRMSLCVLGDQHDIDRAKHHGVDAMSTDDLKKLNKNKKLIKKLAKKYDAFIASDALIKQIPRLLGPGLSKAGKFPTPVSHAEDLANKMNEVKSTIKFQLKKVLCMGVAIGNVGMTEDELIGNIMLAINYLVSLLKKGWQNVGSLDIKATMSPPKRLY

SEQ ID NO: 51641 - protein, 140 aa, Sorghum bicolor
  Clone ID: LIB5052-001-A1-XP1-F2.pep
AGRAAKTPSNLLRNVQPRYHLQEAVIMLAAISIPTLLLLASVAAAQEETPSVATSPFVSPTPESEAIFTIQTSADPDPWSCYMDCVQPPCPPCTGSMMSIPPVTETESVGSISPVPMPSVTDVSIPPVTESVVTTPVPMP

SEQ ID NO: 51642 - protein, 143 aa, Sorghum bicolor
  Clone ID: LIB5052-001-A1-XP1-G4.pep
RPGCELHLHHTTSCPFARQYKDYPPRLDPSSPSDSPAEVRNRGTRRPVTCGTRSRCPRVRSESRPLSRRSHGSDTLASLRSALRGTTSRTRACKTGLWSRRRRGWRLEVTCQSTFRRRTTSPGRRAGYGCADTVEEAGHWRLV

SEQ ID NO: 51643 - protein, 123 aa, Sorghum bicolor
  Clone ID: LIB5052-001-A1-XP1-H3.pep
PAGLRSLQRRSRHSPRQWGCRRPLASSSSGASACADGGKLTDRAAPTPTAAQSSTVHRQPLRSSRPPAIHSLSVSSSCYSLPRPLESWVLASAALPGVCIFLFTWIRLQNKAGPGVRFTPIRC

SEQ ID NO: 51644 - protein, 42 aa, Sorghum bicolor
  Clone ID: LIB5052-002-A1-XP1-A3.pep
AGQPCRWKKARLTRRSDRGQRQKSAYQRVAAEVSSGTEGEGN

SEQ ID NO: 51645 - protein, 141 aa, Sorghum bicolor
  Clone ID: LIB5052-002-A1-XP1-B10.pep
NSTSSSQNLSDVEIAVFGSRAHLEKQALATRKWYRNFLMKGFHLVVLLTAGPGIKDTQCGFKMFTRAAARKLFTNIRLKRWCFDVELVYLCKCLRIPMVEVSVNWTEIPGSKVRMTSIIHMVFELLLIKVGYGLGIWKIYS

SEQ ID NO: 51646 - protein, 75 aa, Sorghum bicolor
  Clone ID: LIB5052-002-A1-XP1-B7.pep
AANEDTASTAANTPAASESRPRGCSNGSEGSGARGDGDAAGWSPRSASAARARARPDGEEEVEKRLVVNAGKHPG

SEQ ID NO: 51647 - protein, 57 aa, Sorghum bicolor
  Clone ID: LIB5052-002-A1-XP1-C10.pep
LARRLVLQFLHNRGEARGQALFGRHERIPVTLSLAKLSMFSLYSLFARSTGSQEGNV

SEQ ID NO: 51648 - protein, 159 aa, Sorghum bicolor
  unsure (1)..(159): unsure at all Xaa locations
  Clone ID: LIB5052-002-A1-XP1-C5.pep
VPLAKSKVDSGASKTYPPQAGTGCKNGFLAVMGRPCIDVKDSTSHTXGKHGHPICPFVAINIFDRXTLEYIVPSAHNCDVPHVNRTEYLLIDISEDGFERLLTSDAYTKDDLRLPTDDTLVDHIDESLERVKDLGVTVQTAMGEEQICALIDIGPQYLP

SEQ ID NO: 51649 - protein, 189 aa, Sorghum bicolor
  Clone ID: LIB5052-002-A1-XP1-D4.pep
MEKRLLMQAVVLATTLRTVKILALEDADSIDVVSNYLKCFPCLEKLYISASQGYRSAASYDKQNPIECLEHHLKMVAIDGYDGIRPHVKFAQFFVRNARLLELMKFRVFRNYHCEPGTTKEWIEDQERQLQVRSMASRHVKFHFVHDARDYQDVYCGEDISDLSEHIHDSSGDDPFDQWFESEKEALAC

SEQ ID NO: 51650 - protein, 133 aa, Sorghum bicolor
  Clone ID: LIB5052-002-A1-XP1-D6.pep
MAAALAALPRGASRLAPRVRQPPFRALCAAAAAGEASKRRLVLYSKPGCCLCDGLKEKLHAASLLAGTPYSLASLELQERDITTNPEWERLYQYEIPVLAKVLPDGTEEILPRLSPRLSVELVQKKIYSAFDQ

SEQ ID NO: 51651 - protein, 118 aa, Sorghum bicolor
  Clone ID: LIB5052-002-A1-XP1-E12.pep
VRRSSRPGPASVKLAPQWWQDNAGDGVFDMIMTFEERVFDLVVEDMSNREPRLMKCVLIINMDVKDNHEEAGVGAKLAVELCQKLEAIDGDWEDIIDDLITAFEKQHKRRLAYSISFY

SEQ ID NO: 51652 - protein, 89 aa, Sorghum bicolor
  Clone ID: LIB5052-002-A1-XP1-F11.pep
TCQTYRHTLPTQPAEARTLSKVEIIATLVQKRTSARRHHSWARGIDSSARLESVAHVQNTVMDVYYRNDSMKSGVAISLVRLHSPKSGC

SEQ ID NO: 51653 - protein, 237 aa, Sorghum bicolor
  Clone ID: LIB5052-002-A1-XP1-G9.pep
RPGRALSSIPITPRDDPIVDRLHALYCFDVLAAKLEHRDAIAPPFKSDTNYALFVTWNTTSHTRHNKKPALRGCIGTFSPLPLAKGLRDYALISALEDHRFSPIKSSELPSLSVAISLLSPFTPIPDPLAWVPGTHGIHITFPHPSHPSRSLSATYLPEVCTEQGWTREECVLSAIQKAGYRGTVRVGDEVWRSLKVRVYCSEKVGATWDEYVAWKALYDKEADAEEDAGGEEGREL

SEQ ID NO: 51654 - protein, 196 aa, Sorghum bicolor
  Clone ID: LIB5052-002-A1-XP1-H12.pep
MTPSPSEAVAKVAQAAAGTNSSAKVYKRESNTARVLGAGCAGIAELMVFHPVDTTAKRLMSNIGKIENAAHLNKVVFRDAANASVGGRFLSLFPGLGYAAAYKVLQRVYKFGGQPFVRDYLAHNHGDSFDRAFGKGNGKAIMHATAGSIIGIGVIVLLPLDVLKIKRQTNPEAFRGRGQVKIVSDEGFGLHRGWGW

SEQ ID NO: 51655 - protein, 99 aa, Sorghum bicolor
  Clone ID: LIB5052-002-A1-XP1-H5.pep
LAALSLQLRAAEARDAFDGMPHEPWDHRPSGDGSSFLRYRVPASLRPFNSSVTLVRFTVFCDGLWPRHCRRLPVEALVMAMRAEGSPRGSGYTAQELID

SEQ ID NO: 51656 - protein, 78 aa, Sorghum bicolor
  Clone ID: LIB5052-003-A1-XP1-A12.pep
GGGGGKKGGKKTCAALETDGFKNGCLIATLSPPSPSPSPHKPPSRTALAICAWRRPASPHRLAPRSAARSGRGAATSR

SEQ ID NO: 51657 - protein, 226 aa, Sorghum bicolor
  Clone ID: LIB5052-003-A1-XP1-A4.pep
MTSWEEATAVEKLSSNTYSCNLQDDWCIGSVPNGGYVTGCILEVVKTHFNTTLAKQNQPHTITLHVEFLRRTQAGPATYKVEDVKLGRQTSVVHVTMEQDGRTEVVAYVTNSNMDTEAGFTHDTGYRPSPSIPSVDFSKLENGEDPNWRYQAEMPHAEFRKATKRVQFYFPREDKSPAYLADEVVCFSDGKTFTNSSVAFVADMFPLMVESFKERARGPSGTRRYL

SEQ ID NO: 51658 - protein, 74 aa, Sorghum bicolor
  Clone ID: LIB5052-003-A1-XP1-B12.pep
RPGRAEPLPKPELPVPPQPLPKPELPVPPEPLPKPELPVPPEPLPKPELPVPPQPLAKPELPPPVLAGELPPKP

SEQ ID NO: 51659 - protein, 170 aa, Sorghum bicolor
  unsure (1)..(170): unsure at all Xaa locations
  Clone ID: LIB5052-003-A1-XP1-B2.pep
MSGNGVMKKVSDAATKAGKAIDWDGLAKMLVSDEARKEFANLRRTFEDVNHQLQTKFSQEPQPIDWEYYKKGIGSKVVDMYKEAYESIEIPKYVDTVTPQYKPKFDALLVEMKEAEKASLKESEKIEKEIAEMKEMKKKISTTTADEYFAKHPELKQKFDDEIRNDYXGY

SEQ ID NO: 51660 - protein, 147 aa, Sorghum bicolor
  Clone ID: LIB5052-003-A1-XP1-C10.pep
AGRAGALGQRIRTCRTLGSSGSIRLCLSSVRRRAGTHAGGGGSTMSSAIRTSTQEEGRRGHGHRTTGAIRCSPFSSSQGVDLICNGKSKSLHQVMGGCGKKFMKDELVFKPKEDMRSHGVLDVGFCKMEVTVAWSLISYHPVPLNVY

SEQ ID NO: 51661 - protein, 104 aa, Sorghum bicolor
  Clone ID: LIB5052-003-A1-XP1-D10.pep
CAALRRRVGKNLPGHSTSPPPGRHYPFSCSPQPLATRVRSCTSTSAWSEFEVVQGSCQAPAARWIWTRSGLQAWTTQGSTVQPPSSVSISIEVRCVHTCIAIAS

SEQ ID NO: 51662 - protein, 232 aa, Sorghum bicolor
  Clone ID: LIB5052-003-A1-XP1-D11.pep
MTTVTPEVTWAQRSSSDDPEKNYVYLTIVAADVPESDLKLDLKEQSLSFKGTSTSKKVTYAIDLEFFAEIDPKESKISHSGRDVTMVLRKKELKEEYWPRLLKDNKKMHFLKTNFDKWVDEDEQDEAPEDESMNQMNPMGAGGMGGGDGGFGGIDFSKLGAGGGGGMPGMEGMDMASMMQSMGGAGGMPGMGGMGGEDSDDDDDDMPELENDEDSKDKAAPSGDKPKIEGVA

SEQ ID NO: 51663 - protein, 91 aa, Sorghum bicolor
  Clone ID: LIB5052-003-A1-XP1-E6.pep
AGRAGLSDLGEASCGAGRRGGRRRRMNWIGRKIHLYNVTIGLYMLDWWERYLFNILMVCLFWYILRYLLGFFQSNLKTLFQEGNYLGQGST

SEQ ID NO: 51664 - protein, 115 aa, Sorghum bicolor
  Clone ID: LIB5052-003-A1-XP1-G4.pep
PAGLREHYKSLPTTISISFDPIYLQPPTPTSKHNILKMHVAIYRITVYPPCHFRRRYKGSCSLRAFCLTRQSSRGASSDDRQECCGHLLLHHECDLSCVPQLKETGSSIALIAMR

SEQ ID NO: 51665 - protein, 155 aa, Sorghum bicolor
  Clone ID: LIB5052-003-A1-XP1-H3.pep
GAFFFFFFFPHAYHTNGVQSSTPAILTHGSQVSVISVGNSIQAYSTLAFTSRIYNPTPIDPPPTTPKHVTALSSRTFGTWTFLACLIRFYAAYNINNSAMYQLAMWSYAVAWAHFMSEWWVFGTARWGKPLVGPVVAANTSLLWMLMQWGYYVKA

SEQ ID NO: 51666 - protein, 79 aa, Sorghum bicolor
  Clone ID: LIB5052-003-A1-XP1-H8.pep
SSFHHSYVPRSRAADSTGRATPGATAGTGCQDRNTHPHLPDHQETTTDKNLGSSVSTIVQSERRILVLGDDTNSDLRTN

SEQ ID NO: 51667 - protein, 96 aa, Sorghum bicolor
  Clone ID: LIB5052-004-A1-XP1-B7.pep
MASEKSDTQKQDAQIKSADMSEEMQQEAIEVAQSAMEQFTIEKDIAQYIKKEFDSRKGATWHCIVGRNFGSFVTHETKHFIYFYLGHCAILLFKTQ

SEQ ID NO: 51668 - protein, 151 aa, Sorghum bicolor
  Clone ID: LIB5052-004-A1-XP1-B9.pep
AGRVGDTHRLSLPAMSTADPTAPPFVIVGGIANFRDLGGCTTSAGQTVTKGLAFRCADPSKATPEGLDKMSQDLEVGLAPLRELFVERLLKNPTLAGDEVGVRNMVSSKRENMLASLEMIDNEFGGCEGYMRKWCGLGDQEIETLRKRLRA

SEQ ID NO: 51669 - protein, 140 aa, Sorghum bicolor
  Clone ID: LIB5052-004-A1-XP1-C12.pep
ASHSTHHFDIRILERVRGQSKMSSDDSPSQRYPRSPHTRHHYDSHTVQSNGISSGHNSASDLQSSSVVPHTTGQQESLLLTDKRIPASLSANLRGNRAPAPASLDLSPSRQQAQARHEAPRVSLSNASRCSSKKKKKKGP

SEQ ID NO: 51670 - protein, 111 aa, Sorghum bicolor
  Clone ID: LIB5052-004-A1-XP1-C2.pep
DNSQSNMNSRNICGALMFMLFLFAFPVQSRPYQELNVRSERSLAYILTNTTPDPNKLSIKFCVLRECPNKQSCYCCLTQKPDQLCYYKLDECRAVCPNCDPICPPIPSPSA

SEQ ID NO: 51671 - protein, 103 aa, Sorghum bicolor
  Clone ID: LIB5052-004-A1-XP1-E3.pep
IQEFNNFIYGNKITSKLPHYTGSSNTCRGGKDRRIIAGSDRAAPILRQAWLHTVAFSGEPVTCTAKIVVALAQALSPTISVKTAHPGKSAAQVPAKSTTCPNR

SEQ ID NO: 51672 - protein, 83 aa, Sorghum bicolor
  Clone ID: LIB5052-004-A1-XP1-F12.pep
LLGFLFSSFCFLFHVCSVVLFHGLMSFGHLLLIKISVGVKIYRTGICRSVGLRCAVYLLYLNNIIVMSCQCYKTTEQMHCILF

SEQ ID NO: 51673 - protein, 149 aa, Sorghum bicolor
  Clone ID: LIB5052-004-A1-XP1-G1.pep
MPKNKGKGGKNRRRGKNENDNEKRELTFKEEGQEYAQVVKMLGNGRLEAACFDGSKRLAHIRGKLRKKVWINQGDIILLSLREYQDEKGDVILKYSADEARSLKAYGELPETAKINETDTYGGEEEGGIGFDFGEDDSESDGEIDVDDI

SEQ ID NO: 51674 - protein, 57 aa, Sorghum bicolor
  unsure (1)..(57): unsure at all Xaa locations
  Clone ID: LIB5052-004-A1-XP1-G4.pep
MGKAKRASIFIRLVSAAGTGFFYVKRXNPRRITEKLEFRKYDPRVNKHVLFTEAKMK

SEQ ID NO: 51675 - protein, 139 aa, Sorghum bicolor
  unsure (1)..(139): unsure at all Xaa locations
  Clone ID: LIB5052-004-A1-XP1-G6.pep
LHMDSASHDVGRICMSCRAESMFIRYRSCILVADVVLSPPSDEESTVSGVVLLQKIRGARGSSWPENSIQVAGVQVVVEDAVGKAVLPDRGVSRVFSSLDAPTRCGRISGDCGRAYLLVSPHVRSCLYCGSVLPQARAX

SEQ ID NO: 51676 - protein, 50 aa, Sorghum bicolor
  Clone ID: LIB5052-004-A1-XP1-H7.pep
AFKLKPLAREHVSELLFNWLAPGDLIQEESTDRSYPRSTRSGESDTRKGP

SEQ ID NO: 51677 - protein, 73 aa, Sorghum bicolor
  Clone ID: LIB5052-005-A1-XP1-A1.pep
MKKLAAMLAVCTMAFTLAACSSNYVMHTNDGRTIVAEGKPRVDTDTGMISYKDANGNEQQINRSDVKEMVEMK

SEQ ID NO: 51678 - protein, 100 aa, Sorghum bicolor
  Clone ID: LIB5052-005-A1-XP1-A12.pep
RPGLHHLNTSDHSTLSQNASHYCSPCRHAQLPGSSPQEQRSRVAEAPPEPRRSQAVAEGPSRQDHALPLLRHFDRYQRRHHVHDVPHGLRPQDLVLDCSP

SEQ ID NO: 51679 - protein, 206 aa, Sorghum bicolor
  Clone ID: LIB5052-005-A1-XP1-C12.pep
MSLKYEAINAPSSTIPSDTTKPFTIPTSPKTDIWRRTTPGDMEFNAPGIGTRIPVSTFKSLAATVSGPWKTQFDQGGILIAFPKNPGADLHDSQWIKAGIEYFNGEPKLGVVGTDRYSDWSLCPMFEAGSKASFLAEKEGDTIWIYAVVKGKKEPLREIKWADLEGRAKDAEMWVGVYGAKPTPEEGDANAGIDVSFQGLKIETSG

SEQ ID NO: 51680 - protein, 72 aa, Sorghum bicolor
  Clone ID: LIB5052-005-A1-XP1-C8.pep
TITFSLILAFLVDLIAEAIDSFYLMLMRPLAYCEEFPNVCCERTCSYTAECSIVKLSEPFDVLHYQDSSADA

SEQ ID NO: 51681 - protein, 111 aa, Sorghum bicolor
  Clone ID: LIB5052-005-A1-XP1-D1.pep
PAWFIKRQFNKYSHTVILHLPLISKTMRTECSAALCIVLVVMSSTLSSCNPGSSCSFTLPRCTAQKCRGRCLAFAKSEGGVLKLSYCVTKNSCECELAPKKHLPLTTEVRG

SEQ ID NO: 51682 - protein, 125 aa, Sorghum bicolor
  Clone ID: LIB5052-005-A1-XP1-E11.pep
AVGAVKATIQYKQVKDDTGTIYIHNRTPFSICRSKVVSLPAKQKPHGRTRLPLLTSARLTYRISLRATPFRGPGPVAVGVGGREGIGGGGGGTGGRRTGRRRTCSAAVMVPRWCRGRGCGVPGPA

SEQ ID NO: 51683 - protein, 106 aa, Sorghum bicolor
  Clone ID: LIB5052-005-A1-XP1-F1.pep
MASPFCAAAAACRLAVSAPSPPAAQAPRPRRGLVAVRAEAAGGGINPAIRKEEDKVVDTVLTGELAKPLTAYCRCWRSGTFPLCDGAHVKHNKATGDNVGPLLVKK

SEQ ID NO: 51684 - protein, 118 aa, Sorghum bicolor
  Clone ID: LIB5052-005-A1-XP1-F6.pep
ASIPCILSPVSSTSHNMSKTLTSKVDAAIMVGVKGLQLFPGEICAAGGVDMGKGVLKGHTSAEVLGRLLVLLPQPVKVVIGVVGVLEVLRHGGRKSESCGYVEVEIRNGLVDPTARAG

SEQ ID NO: 51685 - protein, 226 aa, Sorghum bicolor
  Clone ID: LIB5052-005-A1-XP1-G12.pep
RPGLPATHNTTGTTTNNQGGVVDKVLSYVPGLSPTSSRNQASGTTDATAEPAFGANVGPGSSSHTHTGTGSHGLGSSTGVGAGSVTFGATHNTTSGPHNSNLANQADPRVDSDNSRFGSSNTTGLGSSNSGSYVPAPTLNPHDEDRARVVADRAVGHTGTGVGSGLGHEHSHGSGVGSGVGLGSGAGVGSGVGHEHGHGSAVGTGAALGSGAGLGSGLGHDSHHGS

SEQ ID NO: 51686 - protein, 112 aa, Sorghum bicolor
  Clone ID: LIB5052-005-A1-XP1-G8.pep
AGRASHKFNKYTNTVLLHLSLASMTKMRTECAAALCIVLVIMSSTLSSCIPLPACTAELCQTKCLDFANNHNVVVKSSHCAKADFCNCEVAPKQRLPLTREVKGLADAEDDN

SEQ ID NO: 51687 - protein, 104 aa, Sorghum bicolor
  Clone ID: LIB5052-006-A1-XP1-B7.pep
WCCCPLPFRVCDDSASCRSSLSSSRITLAPDETPREAVRRGQLHQTAGSVNLGHLCLGQCTRRGVPAGAWWPKCSCYMRCTPQTHPGAMLRFSAHSVCSMPSVC

SEQ ID NO: 51688 - protein, 170 aa, Sorghum bicolor
  Clone ID: LIB5052-006-A1-XP1-D6.pep
MDQVLNKVGSYWFSKRASKEIDSIGDDISSISSSIGGSAKWMVNKIKGKMQKALPDLLKEYDMPAGLSPRDATNYEFNEETKKLTVYIPSACDVGYKDSSVLRFFTCVTGYLEKGKFSDIEGMKTKVLVWTKVTAIKTEGPKVHFTAGVKKTRSRDAYEVVRDGITIDKF

SEQ ID NO: 51689 - protein, 201 aa, Sorghum bicolor
  unsure (1)..(201): unsure at all Xaa locations
  Clone ID: LIB5052-006-A1-XP1-D7.pep
MTSIFQKLTRPFTSATLRFAPEQTAKMDVPEGAQKCTIAAGCFWGVEHMYRKDFGNKGLLDARVGYIGGDTKAPGYRAVCSGTTGHAEALQVVFDPAQVSYRSLIEYFYRMHDPTTANRQGPDVGSQYRSGIFYHNQEQKEIAEDITKKANEQWYKGKIVTEILEAGQWWDAEAYHQEYLHHNPSGYEXPSHFLRKFPELT

SEQ ID NO: 51690 - protein, 198 aa, Sorghum bicolor
  Clone ID: LIB5052-006-A1-XP1-E3.pep
MSFSAQPVVIDGKGHLLGRLASVVSKQILSGQKVTVVRCEEINISGSFFRNKLKYHAYLHKRHIVNPTRAGPFHFRAPSRILYKAIRGMVPHKSARGAAALKRLELYEGVPPAQDKVKRVVVPSALRVLRLKPGRKYCTLKRVSHEVGWGYKDVVDRLEEKRKVKGKAYFERKQAALKLRAKASEAAPKNELLTQYGY

SEQ ID NO: 51691 - protein, 60 aa, Sorghum bicolor
  Clone ID: LIB5052-006-A1-XP1-G11.pep
VTCICNGTGTQVHYCPPFLSQIHTCSSLHNDLRCSAILSATTALGLRRRVITYQSPAPMR

SEQ ID NO: 51692 - protein, 122 aa, Sorghum bicolor
  Clone ID: LIB5052-006-A1-XP1-G3.pep
MSSPPTMSTTADADADYHTSDGSVMPDVLAKGREACYKARDAFYACVEKHADKKPTEIATMGLLYPADCKKSRANYVSNCRPTWVKHFDRQYCSKKRVQRLLDGDEDRRGPISLPQPYTFKQ

SEQ ID NO: 51693 - protein, 113 aa, Sorghum bicolor
  Clone ID: LIB5052-006-A1-XP1-G4.pep
AGRASHPEHRPMITQAHPRVQQTRQLQQPQQCDTNKRRNSGDQFSTLHQPSVTRYNQTKSLHGQRLLFHQPAAYMRSRSATRQPALWGADVVNFPMACFTCFDKLCSGETTTT

SEQ ID NO: 51694 - protein, 154 aa, Sorghum bicolor
  Clone ID: LIB5052-006-A1-XP1-H4.pep
RPGFRDSKKSPNSIAIPRRPMVHRETVEQQNAQSNANDQHYHQTMEDNPQHRPLPHAQHYPIPTGLDFIYPPAPVGRGLIHSTAGGVLGGMAEVVLPWVFRGQLPASLYYMSPYHVATQNMNPRLRRHQMELERSLHQIWFFLFVFVVLCLLLF

SEQ ID NO: 51695 - protein, 125 aa, Sorghum bicolor
  Clone ID: LIB5052-006-A1-XP1-H7.pep
PAGFKNSVSVDRSFTRAGVTPPISASQGAVTILKIFLSSCSGYHDHMSTASCPILLQDGTFMRLGRCCCWLPLRPEICGGASKRSTPPPEHGNYKKDPNVMDVQANEYAGTNSNDRMKETVPEIT

SEQ ID NO: 51696 - protein, 134 aa, Sorghum bicolor
  Clone ID: LIB5052-007-A1-XP1-A12.pep
NFIYFCIDVSTSWHPTGYHHGQSVPILLLKGWRVYVDCAHDALATSSNAMALHVARRMIRAPSSTSGEIFLSIFMASFGVTCFTLWRDLLRRTNFLERDSIGSQHEEANSQEQNHISPPHLILSRCVALITVVD

SEQ ID NO: 51697 - protein, 91 aa, Sorghum bicolor
  Clone ID: LIB5052-007-A1-XP1-A2.pep
AGRAATLEKEEEGIVVESLSSHLNKLKGNIKTMERHLDGKKQAFISNVHDKLNEGINLVSLEKEVETAEKYCQAMKDEVAAMRMRYSDSGV

SEQ ID NO: 51698 - protein, 130 aa, Sorghum bicolor
  Clone ID: LIB5052-007-A1-XP1-A7.pep
MAATASVTTTAPSSPAALLKASPSSLISFRPVSCRCKHLCVKTKATENDQSAKKPQKVNSILCQDCEGNGAIACTKCEGTGVNSVDYFEGRFKAGALCWLCRGKREILCGSCNGAGFLGGFMSTFDETAQ

SEQ ID NO: 51699 - protein, 214 aa, Sorghum bicolor
  Clone ID: LIB5052-007-A1-XP1-C4.pep
MTLPRRRHLVLLAGLLVLVVVAATATASTDSSSTTAVAVDFVRRSCRSTEYPRVCETTLVPCAASVGRSPRRLARVALVVGADRARNCSAYIHGSRSGSGGAMKDCAELARDAEDRLRQSAAEMERMGRAGTPRFAWSLSNVQTWASAALTDTSTCLDSLAQHKDRGRGGKGSDGDDDAVRVKRRVVAVAQATSNALALVNRLQPATHRQRLLL

SEQ ID NO: 51700 - protein, 92 aa, Sorghum bicolor
  Clone ID: LIB5052-007-A1-XP1-C5.pep
MATMSLSSTRAQWTAKQNKLFEQALAVYDRDTPDRWHNIARAVGGGKSADEVRRYYELLVKDVEHIEAGKVPFPAYRCPAGYDADRLKHLKI

SEQ ID NO: 51701 - protein, 72 aa, Sorghum bicolor
  Clone ID: LIB5052-007-A1-XP1-D11.pep
PAGLGGKKSGNGRGELDSCAVFFPSYRTVALFFFFFLRFPLCCLLASPLVPVDDCGLRACPCEYDAMKHQVN

SEQ ID NO: 51702 - protein, 123 aa, Sorghum bicolor
  Clone ID: LIB5052-007-A1-XP1-D8.pep
GAFFFFFFDDTSVHRRKGISKMTNLSHAFTNAQLLTLISDLIMIGETSLAWLLSLPWVTGSSSTPSLTGWAGSRRCSRSELRSWSSSNEAGEGEKDSGELHIVECPKDCLASWKRVRIRSPAG

SEQ ID NO: 51703 - protein, 116 aa, Sorghum bicolor
  Clone ID: LIB5052-007-A1-XP1-E5.pep
SSLEGSRSHGSPWRPPSGPSWTASAPPSPAPPTPPATPTRRRTPRLPLRPSRRRRRRPHQRSRPRRRPRPRWRRRWPSWRRRWRRPPPPPPTRPSEGDGDIATCLSALLNSMLLVL

SEQ ID NO: 51704 - protein, 187 aa, Sorghum bicolor
  unsure (1)..(187): unsure at all Xaa locations
  Clone ID: LIB5052-007-A1-XP1-F2.pep
MSVAKNVKTTVFSKYTVQPTGTYAAINRLFALDPKRSTGIPMNPQFRNPPPGGLDPNAYDDPVTVPAADIAENPYWKRDVRRRYPRLSTVTQSDAVALLEVGSAAAPKQELXGEAGTKSLVAAQEEGAKGLAVAFEKNTGLAKDVLGPGGMPPLPSGLHVHGVAGQKRYELESEQSYGTAYPCRTFA

SEQ ID NO: 51705 - protein, 229 aa, Sorghum bicolor
  Clone ID: LIB5052-007-A1-XP1-F9.pep
MATTAPAASVIPALTDRPVKNTICLFDVDGTLTPARRTVSPEMLQLLSALRHKVAIGFVGGSDLAKQQEQLGTASIPVTTLFDFCFAENGLTAIRMGVPLASHSFIKWIGEDNYKQLVKFILHYVADLDIPVKRGTFVEFRNGMINVSPIGRNATIQERNEYEKFDLEHKVREKFVQAIKDNFPDLGLTYSIGGQISFDVFPAGWDKTYCLQHVEAEKQVSGVEYSTIH

SEQ ID NO: 51706 - protein, 252 aa, Sorghum bicolor
  unsure (1)..(252): unsure at all Xaa locations
  Clone ID: LIB5052-007-A1-XP1-G6.pep
MLEFMDYVQSAFYAASRWNVDNSYASLTNTTNNLLDFRTPHGVRLHVSSLSSPNFATSYILGSKGVVDGSFSFLFSSLGLQVASKSSDLPLGHLVKGYRHLQELQKPEQPWQWEIWHRGKRVDTRDTLLYGRFYLPTSTLEALYLRRISPTRLFRLTCVSDGSLPSGGSALAQLQNDCGKYSTEYLFSTDAALLGFRGLYNFGYDPRDPERQPSTXSPSHPWDHQSGRLSMGGEVYFSPMNKSXWPQHWATL

SEQ ID NO: 51707 - protein, 269 aa, Sorghum bicolor
  Clone ID: LIB5052-007-A1-XP1-G9.pep
MSWKGFQKGATRAPQMFKQRFNMGEITKDAVYIDAERRFADLEIETKKLHDESEKYFKAIIGMLDHQIGFAKACAEIYKPISGRASDPDSYVVDGNPEGIRACEEYENIVNELKASLSPELEMIESRIVKPADELMEIIKAVRKTCKKRDNKQLDFDRHSATLKKLQEKKDKSLKDEKALYKAENDVDMATQEYEYFNNLVKADLPVLFQLEKDFIQPLFQSFYYMQLNVFYTLHEVMQSIDIGYFNLTLDIEEGLQEKRGEIQAQTEA

SEQ ID NO: 51708 - protein, 84 aa, Sorghum bicolor
  Clone ID: LIB5052-007-A1-XP1-H11.pep
SARLGTDRGHVGGLTGVHAPPMASSRRAATARDVVRPRRCPSLNEKAPCAYPSTVHTHTHTHLTAACGGMHMLPPLLLCCDLVG

SEQ ID NO: 51709 - protein, 104 aa, Sorghum bicolor
  Clone ID: LIB5052-007-A1-XP1-H12.pep
MFRQQIARQARLFSTTPVARKSPVDAIKDAAKAVDRTISGAAVKGIEKGEEVAGAVKESVPETTGQAKGQANEMAGEAKGKANELAGEAKGKAQELKGEAKSKM

SEQ ID NO: 51710 - protein, 136 aa, Sorghum bicolor
  Clone ID: LIB5052-007-A1-XP1-H3.pep
GVGCHGHTAPPYSTLFLLPDRRCSFVLEISHSSSSSLSRLSCRPYRSPASLGLHTYVLRYQGAGSPRHCRRRCLWCSVKKAAGVEGPEANDDEMSDKQEDFGHSMTINTSCASTAIFFLLYVLLFFSVLFELLTKF

SEQ ID NO: 51711 - protein, 56 aa, Sorghum bicolor
  Clone ID: LIB5052-007-A1-XP1-H6.pep
MEPLEVAITIIFDALLLVFMVKLFFAMFQMKLVVILFYLVILLFAMAFSGRAPSSF

SEQ ID NO: 51712 - protein, 97 aa, Sorghum bicolor
  Clone ID: LIB5052-008-A1-XP1-A12.pep
VLTASGVSSDGQCQLRACQFNTERVDVGEVGSLVVRVDGWTEGTEDVLWADAVSKASSESKIEARIIDGCVVFVCSRLTSVAYSMCGKGDQVAIETM

SEQ ID NO: 51713 - protein, 168 aa, Sorghum bicolor
  unsure (1)..(168): unsure at all Xaa locations
  Clone ID: LIB5052-008-A1-XP1-B12.pep
MADSEEHXIESEEPDGCERSEDCTQQLGVIPAPLKTXFLDIYGRPCNVVEVPTSNTANNGHDKCHSVAVDIFTGKXVEPQWSFFHNCDIPSSPTATEDQLIRISHRSIXCTLLTSHGCTKDDLRLPTEETLVXPLLEEGSHSVKDHVETGQTAMGEENICALEDIGPK

SEQ ID NO: 51714 - protein, 118 aa, Sorghum bicolor
  Clone ID: LIB5052-008-A1-XP1-B2.pep
HTHSGGATGILCGGVGRSCGLQCCAGGSCTVYLQVQGLQLQLGPRWLRSLSSRGTVSAWMTPFGVPVGRCCDAHGEGVGGGGRLLLTHVRVHLSPSAAAAALPPGSADAVACAAGHRS

SEQ ID NO: 51715 - protein, 156 aa, Sorghum bicolor
  Clone ID: LIB5052-008-A1-XP1-G3.pep
IYVCSARSLFIPSGTPSLDAVWPLESAPLVRSSPRKPLQKLNTTMTSLTSKPPPEAILSAWDILYRLMAHPIPPARRPSDSDVTPKGERAGPTAFATPVSASQLHTRLARSTALHPRTKEGIPYLEYHCRSLQRVESMTHKMNRLTWHAYAQLVCY

SEQ ID NO: 51716 - protein, 81 aa, Sorghum bicolor
  Clone ID: LIB5052-008-A1-XP1-H8.pep
PSDATLLVAPKVALSVCQRGAGFALPSPKGRQCRPCIVQCLPFQSPNKSLQRSLTDCPGFPSPSELGFMIFRIRLSASPAG

SEQ ID NO: 51717 - protein, 105 aa, Sorghum bicolor
  Clone ID: LIB5052-008-A1-XP1-H9.pep
MGEVQGSPSPPWSDLPSELLGLVFLRLPTRADRAFFHAVCRTWCSAARHCRLPPPSPVPWLVLPDGSATSFPRGETFQLPTGMRHHNSYGEWLLLSRNDGSCLLM

SEQ ID NO: 51718 - protein, 257 aa, Sorghum bicolor
  Clone ID: LIB5052-009-A1-XP1-A2.pep
RPGWVTDTSPSWLVPSNIGPPGAGPWREVSEPGTLLSWSHRYEREVPSKSGQLKSGKSRKWGLGKAKDLQVEWSKNRFPLYAAAFMLPVMQGYDKRSHGVDLLNRDFVVLGKLIYMLGICMKSMAMHPEASALAPALLDMIRSRDVSRHAEAYVRRSALFAASCILISLHPSYVASSLIEGNQDISTGLEWIRTWALQVAEADPDTECTSMAMTCLRLHSEMALQTSRALGSADHSQTGRAIPSKLNSIILPFRNMM

SEQ ID NO: 51719 - protein, 105 aa, Sorghum bicolor
  Clone ID: LIB5052-009-A1-XP1-B7.pep
LIVMLRVRAAGHAPLDSSEHHAAPVPPGWPSDSDAGGFTTTRDSTAGGLDLASFRHGLELGADEQDHQERNADDASSHRVRVIHSRTQQFCLGLRNLPKRYYTLI

SEQ ID NO: 51720 - protein, 183 aa, Sorghum bicolor
  Clone ID: LIB5052-009-A1-XP1-D3.pep
MFKATTLTNSLRTTTTTFAPSLNRSFHASSANMAIKTYFECQWTGSQYTCDASGKITSKDESVAPRTGRINFNLFDDVVPKTAENFRALCTGEKGFGYAGSKFHRVIPEFMLQGGDFTRGNGTGGKSIYGEKFADENFKLTHNKPFLLSMAHAGPNTNGSQFFITTVVTSWLDGRHVVFGEVL

SEQ ID NO: 51721 - protein, 234 aa, Sorghum bicolor
  Clone ID: LIB5052-009-A1-XP1-D9.pep
MSSERTPLIDSRTRRQAENALPSKGQRIKVAETIGALQAGKLPSQDQLSKLLQVVLDSDTLKSGGGPNSRTARLGTEGQKVLGDVKEVLRALKAWGEEKNDNDLLQNFFYNAATADVDVDINTASAPSQKELSKDAQRAIYSLRTIASLMVTNPVFRQLGSDGILLTRDIFADAASVAADLAKQAEKTARPSEEERKKGVDFEEAKAKGKQAVNGVKSGKAQERPGGLFMRLRR

SEQ ID NO: 51722 - protein, 161 aa, Sorghum bicolor
  unsure (1)..(161): unsure at all Xaa locations
  Clone ID: LIB5052-009-A1-XP1-E12.pep
MLDSEELGFESKDDAGVLKTYAQHVCSAXRKNGFLDVTGRPCDVEXVSTSESGNHGHGLCHFVAIDIFTGTKFDHIGPSSHNCDVPHVNRTEHQLIGISQDGFASLLTSYGHTKDDLRLPTDETLAAHIKEGCEREKDLVVTVQTAMEEEEICALYDIGPE

SEQ ID NO: 51723 - protein, 280 aa, Sorghum bicolor
  unsure (1)..(280): unsure at all Xaa locations
  Clone ID: LIB5052-009-A1-XP1-F8.pep
TFTIIVFLFMGVIFVCGGGPANGEYSEYQGGKRWQDPGAFTNFVGFCGVFVTAAFSFSGTELVGLAAAESENPARSLPSAIKQVFWRITLFYILSLTFVGLLINHDDPRLLGSGLIDVEASPFVIVAERAGIIGFAHFTNAVIMFSVVSIGLSGVYGGSRTLCALAEQGYAPSFFTYVDRAGRPLWATIFVLAWSPLAFMTLDTGGSIAFDWLQSLSGLAALFTWGSICFAHIRFRNAWEYHGHTLDEIPFRXIFGVTGSWIGLILVIIVLIAQFYTAVY

SEQ ID NO: 51724 - protein, 173 aa, Sorghum bicolor
  Clone ID: LIB5052-009-A1-XP1-G1.pep
MSDSKASNPMRELRIQKLVLNISVGESGDRLTRAAKVLEQLSGQTPVYSKARYTVRTFGIRRNEKIAVHVTVRGPKAEEILERGLKVKEYELRKRNFSESGNFGFGISEHIDLGIKYDPSIGIYGMDFYVCMTRPGERVAKRRRCQSKIGASHKVNQQETIKWYKNRFEGIVR

SEQ ID NO: 51725 - protein, 83 aa, Sorghum bicolor
  unsure (1)..(83): unsure at all Xaa locations
  Clone ID: LIB5052-009-A1-XP1-G3.pep
MMSCCSXNCGCGSDCQCDSGCGDCNMSPDMETTATVVMKPMALGAPTTKARAGGFEAAVEGAGCDCNTCKCGSSCDCSCCSCN

SEQ ID NO: 51726 - protein, 90 aa, Sorghum bicolor
  Clone ID: LIB5052-009-A1-XP1-H10.pep
KRSGGVHNPSQQVALDLYNASNGKESVQPHLKDRFLFQDVSQLLKHLQTQSTSRLHLYVHTISHTPQPLIKQKHKIPLQRLDQHARNEHT

SEQ ID NO: 51727 - protein, 54 aa, Sorghum bicolor
  Clone ID: LIB5052-010-A1-XP1-B11.pep
AGLSVSRFLAERVKEADVFTCTYTPRERDKFEGKIRAVVQSLIDNGINVKLYLD

SEQ ID NO: 51728 - protein, 195 aa, Sorghum bicolor
  unsure (1)..(195): unsure at all Xaa locations
  Clone ID: LIB5052-010-A1-XP1-C1.pep
PAGLGKESDILLFNTYLWWMTGQKMKILQNSFEDKNKDIIXMETEEAYGMVLNAVLKWVESNMNPKTSRVFFVTMSPTHTRSKDWGDDTDGNCYNQTTPIKDFSYWGPGTSKGLMRVIGEVFGVSKTKIPVGVVNITQLSEYRKDAHTQIYKKQWNPLTPEQIANPKSYADCTHWCLPGLQDTWNELLYSKLFFP

SEQ ID NO: 51729 - protein, 93 aa, Sorghum bicolor
  unsure (1)..(93): unsure at all Xaa locations
  Clone ID: LIB5052-010-A1-XP1-D1.pep
PAGSGAVAGTITVYAXQPIDTVKTRMQSIDSKGQYKNSIDCAVKIFRQEGFFKLWSGAVPRLGRLMFSGGIVFAMYEKTMDLLETLDPEKKYI

SEQ ID NO: 51730 - protein, 168 aa, Sorghum bicolor
  Clone ID: LIB5052-010-A1-XP1-D11.pep
MVSMAAAAAAVGVLLPFPFYYALWTHPQRWVDLCGRGADPCRRMAQVSHAIKALQLLALASVASFSWPPPLYCPVLLAVGQYLNFKVYQLLGESGTYYGVRFGKMIPWVTEFPFGYIKDPQYVGSMLSLVALLCWVPLQYVLLWCLGYVFMMWIEHKEDPATRAKVIS

SEQ ID NO: 51731 - protein, 130 aa, Sorghum bicolor
  Clone ID: LIB5052-010-A1-XP1-D12.pep
PAGSRNQSTDGHVGGSSWGGAQRDMAALEVARPQNAHAHHTMAAHFVASYRARHHIRVRRRRTRRHSIGPRRAPWLPLPHKLGRRPRPAALPAQEVRSVYSVCRRHGCSIWKEKKKYLKATIKARKYFSS

SEQ ID NO: 51732 - protein, 68 aa, Sorghum bicolor
  Clone ID: LIB5052-010-A1-XP1-D8.pep
VSASGLAWGACFFFFFFFFFFFFFFFFFFFFFFFFFEGKETFHHHHRDPIPILQATGGNRPGSAEPGR

SEQ ID NO: 51733 - protein, 164 aa, Sorghum bicolor
  Clone ID: LIB5052-010-A1-XP1-E12.pep
MSPKRILVGYGVDIDAVSGWLNTTDGSEANPTNISRGIFGATTGLSRLLALFARHNITATFFVPGHTLESFPNELAQVRDAGHELGLHGYTHEFPSQMSVEQQWDVLEKSIQVLTKFTGSKPKGYTAPAWSTTTETIPMLEKAGILYDHSFMHHDFLPLAPTLL

SEQ ID NO: 51734 - protein, 155 aa, Sorghum bicolor
  Clone ID: LIB5052-010-A1-XP1-E9.pep
MARILQVVAPLLLLLLPAGLRELLSPTTIHHRTPPMGAADDGTTSTGGGEVLLHPLVLMPGLTCNELEARLTDAHRPSVPRCGAMKGKGWFGLWANCSDLPAHHYVQCFIEQMTLVYDPIINDYRNLPGVETRVRGFGSSRGFQRNPKHTYVTLL

SEQ ID NO: 51735 - protein, 177 aa, Sorghum bicolor
  Clone ID: LIB5052-010-A1-XP1-F12.pep
RDLFFFFFSDERTTQRVQGPGSRLYIVKRVECMQWATSGLTHFRAEQPLPDPVSPSRSPSLSRLVSPGHIKGSEHRPTNVRAFLLLWGRLSNHCDLKLVSNWVGSLTAPPGSSLQSHREESAEYSSFSRRRSRVKKSDELSLPSWTTWPSFCKTSRQSLDFQCIRSVPDALLISLPW

SEQ ID NO: 51736 - protein, 154 aa, Sorghum bicolor
  Clone ID: LIB5052-010-A1-XP1-G10.pep
MVKAVAVLRGDSNIKGTVTFEQADESSNTTISWNITGHDANAERGMHVHAFGDNTNGCTSAGPHFNPHNKTHGAPEDEERHVGDLGNFKTDGQGNAQGSVTDKLIKLIGSESVIGRTIVVHAGTDDLGKGGHEESKKTGNAGARPACGVIGISN

SEQ ID NO: 51737 - protein, 67 aa, Sorghum bicolor
  Clone ID: LIB5052-010-A1-XP1-H1.pep
ECEIRIRKKLKRIVPASKKIPSLPQTSLGEINGTIPERAHRDHRFIVQANIRTYYQITGSTIGTRPA

SEQ ID NO: 51738 - protein, 80 aa, Sorghum bicolor
  Clone ID: LIB5052-010-A1-XP1-H10.pep
PAGYKNWRFQPLTVNREKKSLLLLRSKAQGCRPFHFLFFHFIRASKATSKAWGCRRFSSGREAKDRRRIDRMVGAGAGPP

SEQ ID NO: 51739 - protein, 269 aa, Sorghum bicolor
  unsure (1)..(269): unsure at all Xaa locations
  Clone ID: LIB5052-010-A1-XP1-H9.pep
MPISKILSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPYVLPVPFMNVVNGGSHAGGRLAFQEFMIVPSAAPSFSEAMRQGAEVYQKLKSLTKKRYGQSAGNVGDEGGVAPDIQTAEEALDLITDAIEEAGYTGQIKIAMDVASSEFYKADEKXYDLDFRNPTL

SEQ ID NO: 51740 - protein, 114 aa, Sorghum bicolor
  Clone ID: LIB5052-011-A1-XP1-C4.pep
PAGLGTTLSASLSCPALSSACAPTGPKTNSDAWRPPTYTYGSPSWCLIAPMMYTSVLRKLHYMLHPWRDRLVNASPSDAREPSGISIRKNLWKTSTRCYHRVSAIQPAKYIDRL

SEQ ID NO: 51741 - protein, 161 aa, Sorghum bicolor
  Clone ID: LIB5052-011-A1-XP1-D12.pep
MLLALALKAELNGVTDLRPNDTEDAPFFYTFKVQCTSCREVHPNPVSVNRFEMNEQSGSKGEANFVWRCKNCKREHSANIKAAPTSYPQSDPPKKINILEFDCRGLEFVEFKAEGEFLATGIESGTKFSGIELPDGEWYDYDEKAGEEVSITNVEWEIRRA

SEQ ID NO: 51742 - protein, 212 aa, Sorghum bicolor
  Clone ID: LIB5052-011-A1-XP1-E4.pep
LYALGILRLPMRYEETACEVLIMKCESDLASKLLLAELLLFRVTEERACDLLCVAVHLLLEGHLLRILLSTSVRSRRSLLRLARLRHIRVVVVGNCAGWCSFDTRLLVLSPRGEGILTSLVAATLSGCSLVLHLSRGAGGSTKGNVLLRSGAGGIKLGSRGGVGLWDRSGVVSGHGIGLFRTIGMCSVYSRVFRTPRNEPVVDVVLFPSPAG

SEQ ID NO: 51743 - protein, 106 aa, Sorghum bicolor
  Clone ID: LIB5052-011-A1-XP1-F4.pep
MTDAFRKDTHTKLGEKMQPQSSKSTGTKIKESITGTGDKIAREAQPDSSKTNTQSTMDKIGRSKDNNVHRSTGGSIVDKTKNALGMGHHTTGTHTTHTTHTHGSGL

SEQ ID NO: 51744 - protein, 95 aa, Sorghum bicolor
  Clone ID: LIB5052-011-A1-XP1-F7.pep
PACARTHALSPHHISLRTEETEDSCSSRRRRLAQTTRSSSAGEQVLRGAMLQVALKEHEEDTDDEEEDDGADHDPREEVHRRTHSRNGSGAKQAL

SEQ ID NO: 51745 - protein, 211 aa, Sorghum bicolor
  Clone ID: LIB5052-011-A1-XP1-H11.pep
RLATRLDLLATMASYIDFSQPSLWVSAASIVFNPTFWNIAAQQEYHNKVITKLFGGNSRLGCYALAVTIFSLGIFRDYLYNEALADQPTHPTLLSPAIKYSAIPLFLTGNTLVLTSMWALGVTGTYLGDYFGILMDEPVTTFPFNVSSSPMYHGSAMSFLATAIWYGKPAGILLTALVHTAYSIACRWEDPFTGMIYQKRDEERKKGKKGL

SEQ ID NO: 51746 - protein, 208 aa, Sorghum bicolor
  Clone ID: LIB5052-012-A1-XP1-A10.pep
RFGTLQATNHCRRRSRGSGNMDHGSEVARPTTTVESTDVAMAGAVQGGLQAHMSASTFHGHLGAAASPRRASFEPTAAFARHVRAGGAGRGEVPVAVLFHREPAPGGEVFVGQLTDGVFAQQTVPGHRARRRRNGGRAPASSSPPVRRNRCLLLGCQWARRRRPELAGSCVSPLRDAFGRSVSDYSARAPCVVTLSDDECSEAAKTWM

SEQ ID NO: 51747 - protein, 109 aa, Sorghum bicolor
  Clone ID: LIB5052-012-A1-XP1-B4.pep
MPPQVKSKAQKAAAAQAGSKAGKKKKRSKGKVKDKANNAVVLDKALFDRIVKEVPTYRVISQSTLIDRMKVNGSLARRAIAYLEEEGLIKQVVHHHAQLIYTRAHAGKD

SEQ ID NO: 51748 - protein, 221 aa, Sorghum bicolor
  unsure (1)..(221): unsure at all Xaa locations
  Clone ID: LIB5052-012-A1-XP1-B7.pep
KKKKKKKKKFLIPKNGPEKSSSKVTLELKMELLNWGSCFRNWILSQKAYIETLNGWLVKWLPQKKEETPDGIAPFSPGRLGAPAGFITANDWGQAMKRIPKASVVNTMEAFAVNVHMLWERQDEKQQQKLKADYLSRDFAKRLKSLQEEHGLQGQFEADKAVLPIADNGRAVDNRMVALDTLHKRLDEQRARHDETVKQIRKASAADLKXGLAPIFEALES

SEQ ID NO: 51749 - protein, 71 aa, Sorghum bicolor
  Clone ID: LIB5052-012-A1-XP1-C4.pep
VLSRAGIVVSVELHHDMSVHFPPARHVQDVAQGSPSSGGWGRLQFCGSGVVGAFVNGGEAEEDLVIPARPA

SEQ ID NO: 51750 - protein, 223 aa, Sorghum bicolor
  unsure (1)..(223): unsure at all Xaa locations
  Clone ID: LIB5052-012-A1-XP1-E5.pep
MAAAATNELKLDPKYDQYDYPTVAPTAQSGHPGHTTPEQDAQVFQLRTQLEQAGHTKNLDTLTLLRFLRARKFNVELAKQMFVDCEKWRAEYAGCGVDELVRTFDYKERPEVFKYYPQYYHKTDKDGRPVYIEQLGNVDLTALNKITSQDRMIQNLVCEYEKMADPRLPACSRKSGYLLETSCTIMDLKGVGIGKATSVYGYLGAVSQIXQNYYPERMGKMYI

SEQ ID NO: 51751 - protein, 213 aa, Sorghum bicolor
  Clone ID: LIB5052-012-A1-XP1-E6.pep
PAGSGFFLVIGPLQLVSFPMVKLVGIHTRLPLPSLGEIAAQLLVYFLVEDYLNYWIHRLLHGEWGYQKIHRVHHEFTAPIGFAAPYAHWAEVLILGIPSFVGPAIAPGHMITFWLWIILRQVEAIETHSGFDFPFTPTKYIPFYGGAEYHDYHHYVGGQSQSNFASVFTYCDYLYGTDRGYRFHKAYLAKLKDLGQNDGEKGDGSGLSYVKLD

SEQ ID NO: 51752 - protein, 180 aa, Sorghum bicolor
  Clone ID: LIB5052-012-A1-XP1-E7.pep
QKWNIYIYIYIYKLLFTRTSIYSDVATRVNSSLSHGAGAGFDTGSTPSHPWIHRRRRKPPSHRRRRASPSTAAAGLAPPPSAAARSGQRARWPSSSSRSSRERLASCRRADATRLWCGSTASQRRQLPLSLADPPHKARPLHQLWRQGSIPPLMAAPASAGRQPLAGGMAIGDWGQIRWC

SEQ ID NO: 51753 - protein, 90 aa, Sorghum bicolor
  Clone ID: LIB5052-012-A1-XP1-E8.pep
MGIHLVAFVAARGFLQVFQVSAPLLWPLNLWLPLARHLPEACAAFYDALVSHAARLRATVRRHRRDTGSRSALDEYLRNATMLTLSLFHL

SEQ ID NO: 51754 - protein, 130 aa, Sorghum bicolor
  Clone ID: LIB5052-012-A1-XP1-F1.pep
MSPAHIPIVKKRTKHFKRHQSDRYHGVKESWRKPKGIDNRVRRRFKGQTPMPKIGYGSNSKTKHLLPSGHKELLVRNLSDLELLLMHNNKYAAVIAHGVSSKKRVEIIGRAKVLGVKVTNAAAKLRTEEA

SEQ ID NO: 51755 - protein, 159 aa, Sorghum bicolor
  Clone ID: LIB5052-012-A1-XP1-H12.pep
MAKQLLILVATIIALMLRATYARIIQINPAGSVYHLLELNNLPQGLLPLGVQSYVLGAGGALDVKLSSECNAFVTFSGRKFEFVYATEVNGVIKSGSISSVSGVSVQVEFVWHVLHEVTRAGKQLKIQLGNNTLSFPVSAFTEIPSCNRGIESSTDAFA

SEQ ID NO: 51756 - protein, 239 aa, Sorghum bicolor
  Clone ID: LIB5051-001-Q1-XP2-A6.pep
MEKRRRRHLLLAAAAVVLVAVAAIPLPSAEAKLSPDYYRSTCPDVEAIVRAVVAKKVNETFVTVPATLRLFFHDCFVEGCDASVMIASRDNDAEKDAPDNVSLAGDGFDTVVRAKAEVEKKCPGVVSCADILAIAARDVVAMSSGPHWTVQLGRLDGLVSKAGNVAGKLPGPNMRVKDLAAMFAKHNLTTLDMVALSGAHTVGFAHCTRFTDRLYRHGGGGNGARRWTRRTTLRTRGSS

SEQ ID NO: 51757 - protein, 78 aa, Sorghum bicolor
  Clone ID: LIB5051-001-Q1-XP2-B3.pep
STKENTKGPIRGGRRRLSVTTTGARAPPTAYANPAPASELHNHTPLHCTAAHYEATHCLTLYYSSDCTEPCGYTHQSA

SEQ ID NO: 51758 - protein, 183 aa, Sorghum bicolor
  Clone ID: LIB5051-001-Q1-XP2-C6.pep
MFATRRFVSLAPRAFGAARGFQSTARASVQVGDSIPSIDLVETSPGNKVNIAKELQGKGVIVGVPAAFSPACSSSHVPGYINHPALKNAGKVFVVSVNDPFVMGAWGTTLDPTGKSGIRFLADPHSELTSALDLSFDGAAIFGNARSKRYALVVENGKVTKAFVEPDNTGLDVSAAEKVLGSA

SEQ ID NO: 51759 - protein, 78 aa, Sorghum bicolor
  Clone ID: LIB5051-001-Q1-XP2-E12.pep
MQIKVRTLTGKEIELDIEPDYKVQRIKERVEEKEGIPPPQQRLIYGGKQMADDKTAEEYALEGGATLHLVLALRGGSW

SEQ ID NO: 51760 - protein, 164 aa, Sorghum bicolor
  Clone ID: LIB5051-001-Q1-XP2-E2.pep
RPGPETDSRAVSSVHCFIVPAPVRCPVMLHNFRPVVVLVLSFLVLLASASPVKRQSSSCNPVRFNTVLPTFICAESTIDFAWEGGSGKYNIFRWDQDQRIYYLENTGVQQIQFGWGEFDTYPTGISFIIGVESADDLSAECGDAFEAEQRTEIMPFVRCETLSG

SEQ ID NO: 51761 - protein, 134 aa, Sorghum bicolor
  Clone ID: LIB5051-001-Q1-XP2-F1.pep
CSPQFSLPLCSQCFIPLRFLLAAGTLTDRALRIYLGATDLLLLMPAICLVSDSYPEPPRWDPSVLDQPDRPCGRCTDGDCQDHAGVDEEALLEEANAATGLPLHCRQWRQSLLQQFLRLGLICRCQHRGGTRPA

SEQ ID NO: 51762 - protein, 285 aa, Sorghum bicolor
  unsure (1)..(285): unsure at all Xaa locations
  Clone ID: LIB5051-001-Q1-XP2-F4.pep
MGRGPKKHLKRLAAPSSWMLDKLGGTYAPRPSPGPHKLRESLPLTVFLRNRLKYALTGREVTSIVKQRLIKVDGKVRTDETYPAGFMDVITIERSGEHFRLLYDIKGRFTIHRISAEEASFKLLKVRRHQLGAKGVPHIVTHDGRTIRYPDPAIKVNDTVKFDFVQNKIVDHIKFEPGNVVMITGGRNMGRSGVIVHRERHLGGFDIVHVRDVLDRTFATRLSNIFVIGEGAKAQVSLPXGKGVKLSIAEERDQRRRARAQEAGTGLYHGCRLYEKKKKKAPRAR

SEQ ID NO: 51763 - protein, 89 aa, Sorghum bicolor
  Clone ID: LIB5051-001-Q1-XP2-G10.pep
MKRLLIMRRCEPIVRFTCCSVHYRECRRNHAASTGGYAIDGCREFIAEGEESTSGALKCAACGCHRSFHRRVQVYEVAWDYGSDTSSTE

SEQ ID NO: 51764 - protein, 154 aa, Sorghum bicolor
  Clone ID: LIB5051-001-Q1-XP2-G9.pep
AGRVPALGLSAGDQITMQLTYQTGPGKWDMYECADLNLVSADAFAAGNWDTQCLNRVAGTQTKRVSASNPNLYKLQQEAEASAAAESGSSSDSGLSRVESGVVGAMVSLAVALLAIALAYFAGVVAFGRKAKAVKHQRAGSYTEHADAKTVNSV

SEQ ID NO: 51765 - protein, 109 aa, Sorghum bicolor
  Clone ID: LIB5051-001-Q1-XP2-H10.pep
GHHGAGGYVIVAGGEACGDREGAEDVAREDALDADPLQSEPLEEAGAGAGLPPRGGSSSSSSVQRVHQRAILIAHPYLQQRLLYQVIRIRSRHLCLSFPFFPLVGIGIP

SEQ ID NO: 51766 - protein, 131 aa, Sorghum bicolor
  Clone ID: LIB5051-001-Q1-XP2-H11.pep
MVAAKKHVPIVKKRTAQFKRHQSDRFDRVGESWRKPKGIDNCVRRRFKGQAVMPKIGYGSNKKTRHMMPSGHKAFLVNNTRDLDLLLMHNKTYAAEIAHAVSAKNRISIVARAKELGVKVTNGKAKLSTEA

SEQ ID NO: 51767 - protein, 122 aa, Sorghum bicolor
  Clone ID: LIB5051-001-Q1-XP2-H5.pep
MGVTKKLISPGNGTDKPKAGDKITMEYTGNLYDQNAPDGKGKQFDSSVGRGDFNTNIGVGQLIKGWDEGIIETDGGMSLGEKATLLITGDYAYGDRGFPGLIPPNATLIFDVQLKAINGKKM

SEQ ID NO: 51768 - protein, 182 aa, Sorghum bicolor
  Clone ID: LIB5051-001-Q1-XP2-H8.pep
RSTNFTTLTPTTHFSSPNTNTHLSQCLPHTRVRTLTTSPSRLSATSTPRAPSRSTALTTPPVAPPALPTPLSSPASTNPSSPSSPAPKSRLAARAPATTARSPSPRAATSTPPPASRPRPATSRASVDPRTRLPSTLRSVAATTTSAPTSARAARPSVPLARSLRTLLAVRERALSRVFILT

SEQ ID NO: 51769 - protein, 212 aa, Sorghum bicolor
  Clone ID: LIB5050-004-R1-XP1-C4.pep
MAARQPPALVDELVEEILLHVPPDDPVRLMRTAVACKPWRRLVCGPGFRRRFREHHGSPPLLGIVSNCMNEDGAKLARFVPTGSFRPRRAELINWLAIDSRHGRVLLRSSFSSDHFNVAVWDPITDELLELPATPWMPQIMHNYKGAVLCAGEGCDHLDCHGKPFLVVFVGAASQCSKMSLSLHDPKLMMSSYVYSSEANAWEWISSSWVLR

SEQ ID NO: 51770 - protein, 152 aa, Sorghum bicolor
  Clone ID: LIB5050-004-R1-XP1-A10.pep
ERRCSQLFTVQISGVPLFRSYMYYSHMVMHTYSPDAFRTCRHMHAGAAREAVISPRYRSSGGVGLGTCHAVNRSLRQPVAQFASLDQGPWKRWLGDSLFLASAIVGRPQLRISTYPQRSRRRAAKILRSGPSSAFRRNGRRGWILGVIYIIP

SEQ ID NO: 51771 - protein, 80 aa, Sorghum bicolor
  Clone ID: LIB5050-003-R1-XP1-H11.pep
LDHQILFRLSSINKSPQPLQMLMTHRLELAGDRANAATASIRHARTSGSTVPPRMRARSIYMQARFTQDAPMNLPRRVCT

SEQ ID NO: 51772 - protein, 77 aa, Sorghum bicolor
  Clone ID: LIB5050-003-R1-XP1-G4.pep
MWCHSCKEGYDEEDAGTCKECYDEASETEEELKREIEELRSRLHFLRLPSPTLDAASAPNCDLLLHAIPSCPSSSGA

SEQ ID NO: 51773 - protein, 148 aa, Sorghum bicolor
  unsure (1)..(148): unsure at all Xaa locations
  Clone ID: LIB5050-003-R1-XP1-D1.pep
SRSPRRPYYLFHMDEDGCITANDVEAVIGSLDQNPTVAELQDMXNDAHADGNATIDSPEFVNPDVQGKMKDPTSDEELXEVFRVFDQDQNAFNSRRXELRHAVTMLINNMTDEEVYEMIREADPDXDWHINYEEPVPAKMIHARSISP

SEQ ID NO: 51774 - protein, 72 aa, Sorghum bicolor
  Clone ID: LIB5050-003-R1-XP1-D4.pep
SPPLFLNWQTFYIHQQGKWNNTARVVEEFAIGPHREGGPPPPPELLISTKAGISSFLGDGGSHRAAVGLDGP

SEQ ID NO: 51775 - protein, 89 aa, Sorghum bicolor
  Clone ID: LIB5050-003-R1-XP1-B7.pep
MAKAVAMLMALAVVVAVSSGGASADCNIAALASCNAAVIQGAKPTAMCCSSLRAQEPCLCTYQNNPKYGKYHPNARKMVTSCGMAIPNC

SEQ ID NO: 51776 - protein, 212 aa, Sorghum bicolor
  Clone ID: LIB5050-003-R1-XP1-C2.pep
MAVNNNAAAPVTPATRAYVTVLANDDGADDNFKGVVGLAKGLRNAGSAYPLVVAVLPDVPESRRRVLMDELGCVVREVQPVFPPHYNKLRVWEFVEYDQMMYLDAVGFQGSLENIHEQFEPNGGRPRAPYIDADMFVYKPSMATARLLRHAISMMMRPRTTTTSDEVMVWPCISIADHVMTRRPRTTVAEAEDGAMMRRRTTTTDHQQGAAS

SEQ ID NO: 51777 - protein, 60 aa, Sorghum bicolor
  Clone ID: LIB5050-003-R1-XP1-A10.pep
PGLTTSPGCPIRITKNLRVCGDCHSAFIYISKIVDHEIIVRDSSRFHHFKNGSCSCGGYW

SEQ ID NO: 51778 - protein, 123 aa, Sorghum bicolor
  Clone ID: LIB5050-003-R1-XP1-A12.pep
LARRGRLRHVLPVFAAVHAAADGVAHPDAAAASRAAAHRPGRLPVSCCVCVVCVAGAGSWANPIRGKANRVLDVMCMCGPPRPVGQTGDRRQTCSIFGRVSVGERRNQRQRRALWFLQLAAPK

SEQ ID NO: 51779 - protein, 146 aa, Sorghum bicolor
  unsure (1)..(146): unsure at all Xaa locations
  Clone ID: LIB5050-002-R1-XP1-G7.pep
SPEDGLAALVLDAVVLCSVAAMNPKQQASNVPTTYHYYNPNENNWNLNADIAYCSTCDPDKPLASRYNHYXTAFCAPAGHKVQAAXLNALRVTNLATXAAITPIIVYQCSNDGLDLYYXTKFKKIDTNVQIYHMRHLNDNYQIVCC

SEQ ID NO: 51780 - protein, 96 aa, Sorghum bicolor
  Clone ID: LIB5050-002-R1-XP1-G5.pep
VHTTQSTRKQVTIISYLVDFLSPPPTGQLSPSEPELAGDGRCARRDLGRQSHGRSTAARSATGEHAHRRRPRPSSLVSAGSEEGEGAGQERNEPPG

SEQ ID NO: 51781 - protein, 84 aa, Sorghum bicolor
  Clone ID: LIB5050-002-R1-XP1-F3.pep
MKVKILQWYAVASWTWDAQDETCGICRMAFDGCCPDCKFPGDDCPLIWGACNHAYHLHCILKWVNSQTSTPLCPMCRREWQFKG

SEQ ID NO: 51782 - protein, 163 aa, Sorghum bicolor
  unsure (1)..(163): unsure at all Xaa locations
  Clone ID: LIB5050-002-R1-XP1-D3.pep
MAASLWRAVMDSVSGSSSSPSALDAPPGGGVEFWHGAERAGWLNKQGEYIKTWRRRWFVLKQGRLFWFKDPGXVTRASVPRGVIPVASCLTVKGAXEDVLNRQFAFELSTPAETMYFIADSXEEKEEWINSIGRSIVQHSRSVTDAEVVDYDSRPQXPQPKAS

SEQ ID NO: 51783 - protein, 131 aa, Sorghum bicolor
  Clone ID: LIB5050-002-R1-XP1-C1.pep
MEEEGGGGASGSEEVVNLEDAVEQLVEHLVVPVLPRGQVNQEEALSPETQEDVARQVHATVILYNYYHRKQFPQLEFASPDRFCMSACLTVSNKNLLMYVNQAQSRLSNGVGVGLSVTDKAIIDACDIAEA

SEQ ID NO: 51784 - protein, 108 aa, Sorghum bicolor
  unsure (1)..(108): unsure at all Xaa locations
  Clone ID: LIB5050-002-R1-XP1-B1.pep
QQVVARALTTSADDHPTIYRMKLWATNEASSKSKFCYFFRKITKAKKSNVKVFDINEIFXERNPTTIQNHGIWLPYQSKTGYHXNMYKEYGDTTLHAAAEQMYNEMAS

SEQ ID NO: 51785 - protein, 187 aa, Sorghum bicolor
  Clone ID: LIB5050-001-R1-XP1-H6.pep
RGSILHPTARTVLVLNISFLISLSLFPLVTATASSSPVTSSRLRPTASPCPRRARCRPHPRRPWRIHRTLGTAAPTLRQVFIDPLAVRRRRAPTRSVSYLQWRQADQPWWPRGWGGMDLLPLGAGGWPRWWPAGPSSPWWPAYLTAAIEGATAVAEEVGSRSLTWRSAWMSESSLWTSSSLPHVSSR

SEQ ID NO: 51786 - protein, 181 aa, Sorghum bicolor
  Clone ID: LIB5050-001-R1-XP1-G9.pep
MNMIRSVRRRFTVGHHMATATDPATLRRAAAELLATAIFVFAAEGATLSLGRMHRHDKGGGVVGGLVVAALAHALALAAAVACAANTSGGHVNPAVTFGALLAGRICLVRSLVYWAAQLLGAVAAALVLRLATGGMHLPEYALAGCVSGWQAAVLEAAMAFGLMHAYFVTVMDHHTRKVRA

SEQ ID NO: 51787 - protein, 114 aa, Sorghum bicolor
  Clone ID: LIB5050-001-R1-XP1-D4.pep
MADVSGSGFGGRRPPGLLANAAKRKDGFVQLFLMAGVFMMSLRSLGQKHRLRDLDDDTADLRREHEDLSLRARCLQDALRREADADSSGAIASHLRRIFAAHPAPAAGGGGEDQ

SEQ ID NO: 51788 - protein, 78 aa, Sorghum bicolor
  Clone ID: LIB5050-001-R1-XP1-D1.pep
MDMTSDQKKSCSFEETQKKTCWPEFVGLSITQAVPSILKDMPNAEIEVLALGSPMTHDFRPNRVRIFVDTVAQTPMVG

SEQ ID NO: 51789 - protein, 137 aa, Sorghum bicolor
  Clone ID: LIB5050-001-R1-XP1-A6.pep
RAILESLWHGVPLVPWPLFAEQHLNAFELVSVMGVAVAMKVDRKRGNLVEAAELERVVRSLMGGSEEEGRKAREKATEAKDLCRKAVADGGSSAASLQELAREIGEHREHQGRTEATPPLPQQVRYAAATLGAARHG

SEQ ID NO: 51790 - protein, 150 aa, Sorghum bicolor
  Clone ID: LIB5050-001-R1-XP1-A8.pep
MACCTSRRPVLVVLSATAVLLAVVFFGAATTTAASAAAASAAPSYCAVGKAIPGCVWYVASRSCDVVAAMLPNRASLRATCCGQLHPAECRCRALRVMMETTPLVVGADPGAQRRCRAAQARFAPAVVAAGECSLRTVHGRPVCNALDAE

SEQ ID NO: 51791 - protein, 74 aa, Sorghum bicolor
  Clone ID: LIB5048-012-R1-XP1-H11.pep
GHTSPRIPVASRSCGDQIDRLSCGEFFLHHSGEKVVASLKLLMNQTHASELWLPNLSCGAQRRPTQRPLNHTKA

SEQ ID NO: 51792 - protein, 123 aa, Sorghum bicolor
  Clone ID: LIB5048-012-R1-XP1-G9.pep
MSTQPLLQRTAKKRIALPVRVEPKVFFANERTFLSWLHFAVVLGGLAVGLLNFGDKVGKISAAMYTIIAMAVMIYALTIYQLRARSIRLRTGAPYDDRLGPTVLCLCLLAAIITNFILKAVYE

SEQ ID NO: 51793 - protein, 250 aa, Sorghum bicolor
  Clone ID: LIB5048-012-R1-XP1-H10.pep
MSFGKLYSYSGNPRTTSLLAVAKENGLDIEFVDTEPAKGVSEDYLKLNKLGKVPTFEGADGFVLSECIAIAVYLASQNEKTSLLGKTKQDYATILRWMSFANTEVLSPLGGWFRPILGRDPYNKKNVDESQKATLKAVHVIEEHLLTHTYLVGERLTLADIFAASILARGFQYFFGKQWRDSNPNTTRWYETVFNQSSYSAVAPKLEFISEALKNVAPKKEGGEKKKEQPKAAPKPKQEEAEEEEAPPAP

SEQ ID NO: 51794 - protein, 138 aa, Sorghum bicolor
  Clone ID: LIB5048-012-R1-XP1-E8.pep
MSKKAAATGTKFRMTLGLPVGAVMNCADNSGAKNLYVISVIGFGARLNRLPAAAAGDMVMASVKKGKPELRKKVMPAVICRQRKPWRRRDGMFLYFEDNAGVIVNPKGEMKGSAINGPVAKECADLWPRIASNAGTVV

SEQ ID NO: 51795 - protein, 176 aa, Sorghum bicolor
  Clone ID: LIB5048-012-R1-XP1-E3.pep
GTDYPYQCVSAVSRTHWLPSYDAAAACHPAYEDACSDAILPSARHGLRRQQSQTSCGRSADMVVVNIALLTTLHRDAACDSGTETRMSMTSGEIPTRRQCGIREDCTADVDLDVASRQVMLRFWLPTAQGLGTLSSCLLRLEIGRATASPIPASRWELTASDTCVAEPLVTQSRLM

SEQ ID NO: 51796 - protein, 247 aa, Sorghum bicolor
  unsure (1)..(247): unsure at all Xaa locations
  Clone ID: LIB5048-012-R1-XP1-C2.pep
MPRATERAMLGCFPVAGRRPSLSYEEGSTSAASTSVSTASPPTSTASTSSPAFLDDDALYPDDAEPEPDACGLSTAIAARRFFLATPGLSNSIVDSVEHPAAASHASNVRALRRAATAAFPASAAAASSSSSASSSSSASGTKPHLHDDGGMQPVRKVSVSTDAPRADFLKSMVEMVEALELDPRRRDADLXRLHDLLLCYIALNERDALRDILGAFADLMCLLDVTTAAVVDGEKRNADDRAGGSG

SEQ ID NO: 51797 - protein, 101 aa, Sorghum bicolor
  Clone ID: LIB5048-012-R1-XP1-C10.pep
RRRRILESRGFRSSCAGCALGVPFFLFICTLDTHNFIIASCLLQFYNSDKLSPSRDELPRVPETFLTARLVGTPSQRRSRRRGSQNHQPIHRSSRGCGPDA

SEQ ID NO: 51798 - protein, 64 aa, Sorghum bicolor
  Clone ID: LIB5048-012-R1-XP1-A7.pep
DTRSVWISREVTVGFFLSRSDLDGLYVEYIEEVIDEGVHDGQDHGGRCENIGVHLFQPLEDVDE

SEQ ID NO: 51799 - protein, 161 aa, Sorghum bicolor
  Clone ID: LIB5048-012-R1-XP1-A4.pep
MDAIKQRMNALRAEADESAAKVEELSAKVRTLEQENLQKEQEITSLQHKNGVLEQEVEKLEGLHKDAKAAVDESAQHGTQNESLQRRLQLLEEEAEENDKNLRETNEKLRQTDVKAGHYERKVQALEQSADQWEKKYEDMAKKYSDTKKELDDFVAEIGNI

SEQ ID NO: 51800 - protein, 193 aa, Sorghum bicolor
  Clone ID: LIB5048-011-R1-XP1-G8.pep
MKFTTAAVIASAAGLATALPTDSKIKDGDVFTIQTIRSGTADLQYNTIQAVQNSLVINAGQQNASCGPEPHNYASFQLNNGTLYLYTANPPQQMFVDRSGMGQGVIQYTTGVQDMVKNGERRTFAINDDGHLVFKDQTGQEIGFQACKPSLNGGYSVWLDDVTNPAGADECLGFAARAIKEENPVKCSYTTYP

SEQ ID NO: 51801 - protein, 176 aa, Sorghum bicolor
  Clone ID: LIB5048-011-R1-XP1-G2.pep
PGFRVVMPDFLDGNLATGDMFSGTEEGNNKRNAYFSSFPGAATSQKEQFGKVADELKKDGAKVAAAGACWGYKVIVSADAALSAIAGFHPSFIAPEDVEKINAPLALLPSEGEDKDIINKIYEGVEKKNPGKNVLKSFPDSVHGWMAARGDLESEEGRKTFSEGYQILSKFFQSNL

SEQ ID NO: 51802 - protein, 154 aa, Sorghum bicolor
  unsure (1)..(154): unsure at all Xaa locations
  Clone ID: LIB5048-011-R1-XP1-E6.pep
MQIFVKSEETFALEVQPFDSVETLKGQIQEREGIPADQQRLIFSGKQLEDGHTLLDYDVQKESTLHLTLRLLGGAKKRKKKNYSTPKKIKHKKKKVKLAVLKYYRVDENGKIHRLRRECPSDQCGAGVFMAAMEDRHYCGKCGYTLVFXKPEEK

SEQ ID NO: 51803 - protein, 231 aa, Sorghum bicolor
  Clone ID: LIB5048-011-R1-XP1-D6.pep
MEISWLVLAGGLLLSSLLVLRRHAKNRRLPPGPPAVPLFGNLLWLRNSAADVEPLLRKLFKRYGPVVTLRMGSRLAIFVADRRLAHAALVGAGAVTMANRPQAATSSLLGVSDNIITRADYGPVWRLLRRNLVAETLHPSRVRLFAPARAWVRGVLMDKLRAESGAGDDDEPGDVMEAFRYTMFCLLVLMCFGERLDEPAVRAIEDAERTWLLYISQQMSVFFFFPSVTTS

SEQ ID NO: 51804 - protein, 112 aa, Sorghum bicolor
  Clone ID: LIB5048-011-R1-XP1-E1.pep
RVLTMSHRGSTLASKGKASTGGGGGGIRNDVAAAVVVPSSGPRPGPTPTGQTTAAEEEARARREAEKAKLAEEIATLKAEIIALEEELAKMDGAAAATRASASHSRVSARPL

SEQ ID NO: 51805 - protein, 115 aa, Sorghum bicolor
  unsure (1)..(115): unsure at all Xaa locations
  Clone ID: LIB5048-011-R1-XP1-E11.pep
RTLTEEEPMLAAIHFTAXIIWDDADPEVADPEDTRLWLKVYDDLLAGGWIDMNCLMVAYIDLLLTAPILMKHIHLQGDLSDICRCTNKVRFKDEEIDIINLIGKELIEDTGNKTE

SEQ ID NO: 51806 - protein, 173 aa, Sorghum bicolor
  unsure (1)..(173): unsure at all Xaa locations
  Clone ID: LIB5048-011-R1-XP1-D2.pep
PGYFHSIYHTTSTTYYWPTYVNRLRKQAQLPILISLLNTDVXAYQKGMDPLTNITVVALLYSDLGCNKADDNLTKRAGDLSSEXLERIPTIIHRPSXYKIPSWILNLTRDILDGKNSHXLANGVASKLRDNLERLKNIRAHRRAPCTTXVSRVRGQHSKTTGRRGRXTVGVSK

SEQ ID NO: 51807 - protein, 198 aa, Sorghum bicolor
  unsure (1)..(198): unsure at all Xaa locations
  Clone ID: LIB5048-011-R1-XP1-A3.pep
PGSVGAGVLGRLGNKGAVSVRFLLHGTSFCFVCCHLASGGEEGDVLRRNADAADILTRTSFLSSGGAPAAPDELPKKILSHDRVVLFGDLNYRIAKDDDEEARQLVRARKWSMLRENDELLLELSSGRQFDGWHEGRVAFAPTYKYRRNSDQFCWCADGGVATGRLDKEXXRHRRRAAVWCDRILWRGKGMKQVRYQR

SEQ ID NO: 51808 - protein, 143 aa, Sorghum bicolor
  Clone ID: LIB5048-011-R1-XP1-A10.pep
MGSVEVTASAWRLVEVGRVVLFVSGPFAGKLAAIAEIIDHKRVLVEGPASTAEASVPRHSAPLSSVSLTRFVIEKLPRAAGTAALKKQWEAQGIESKFNESDYAKKREQTVKRRNLNDFERFKVMRLRKQARFQVRKTLAAAK

SEQ ID NO: 51809 - protein, 202 aa, Sorghum bicolor
  Clone ID: LIB5048-010-R1-XP1-G6.pep
REGRTVLTEAVRMVQLLKIDGYCATNVVEQSDYIKSKWNVDGHEWEVRFYPNYYNYYDYRYPLVAVKLILLGEPRRNKLKVNLSCRLVDTSHRLDPSAELSESHVFPSRDGCTVTLMRRNDIASSGYIVNDSLTVKCTITVLKELTDIEVPANTEAPPLPPSDLERHFGELWQGQRGADVAFVLDTGERFLAHKIILCREVS

SEQ ID NO: 51810 - protein, 199 aa, Sorghum bicolor
  Clone ID: LIB5048-010-R1-XP1-E12.pep
LASSVFGCLICIPYNYHFTILVRLYPYQTFSRTPGLHAQRRGGGRAARPACSRASPVSRMHARRQGEALMEIALLQQRLSETFSLGWLTMQHLVCMRPRSTVVEQHGRLIHAHGEVLPRGRLNPPIEFNVVPKSIIKDATMLQDARPPSLGCRRGRGAVGDDGEVDVKRNLLVHRREGRGKHLEGRCMESGGDGNGDFP

SEQ ID NO: 51811 - protein, 99 aa, Sorghum bicolor
  Clone ID: LIB5048-010-R1-XP1-E2.pep
MASASRLLPPAPPPSAQLRGPRDRLAVRRLRCRASASASATDGAVLLERGGPAAVAVREFVTLDELRAAVRLRVRTFYEYAVDSGGTEDHRKALGDREV

SEQ ID NO: 51812 - protein, 214 aa, Sorghum bicolor
  unsure (1)..(214): unsure at all Xaa locations
  Clone ID: LIB5048-010-R1-XP1-E4.pep
MPPKQSKPGDKAGAAKPEAKKAERKPAATAGAGSSGASAPKQAKPAAAKPAAKDAKAKPAAKPAAKPAAKGAAKGAAKPAAKGAAKGAAKPAAKGAAKGAAKKPVAKGAAAKGAAKPGVKKTVARPVKGVAPKAQKGVKSVKPAAVQRALKVQKKIIKGPHGTRVRKVRPSVHFHLPKTFRPPRNPKYARKSVPRRNRMDAFNIIKFPLTTXAA

SEQ ID NO: 51813 - protein, 186 aa, Sorghum bicolor
  unsure (1)..(186): unsure at all Xaa locations
  Clone ID: LIB5048-010-R1-XP1-D1.pep
MSRSCSMTPTSSPPLVVVRLLASAVATMLVLASGGGVCDGAALKAHFYRRSCPAAEAVVRDIVVARVAADPAALPAKLLRLFFHDCFVRGCDASVLLDSTAGNTAETDAAPNGSLGGFDVIDTAKAVLEAICPGTVSCADIVALAXQDAVSLQLGRDLWDGXLGRRDGVLSRASEALADFPSPSDN

SEQ ID NO: 51814 - protein, 109 aa, Sorghum bicolor
  Clone ID: LIB5048-010-R1-XP1-B8.pep
MADEDNSSDRVDNETPKPEKMFTLKKWNAVAMWSWDVECDTCAICRVQVMDACLRCQAESKAGSGRQDCVVVWGECNHSFHYCCMSLWVKQNNRCPLCQQEWSIQRMGK

SEQ ID NO: 51815 - protein, 181 aa, Sorghum bicolor
  Clone ID: LIB5048-010-R1-XP1-C4.pep
MGDNKSPLSLSPMGGRDRDRELLIPVSGGGSAPGDGVEDGDRASSASAAPSSSGREAFHKVVRSWASKKFMTGCVILFPIAITFYITWWFIHFVDGFFSPIYAQLGINIFGLGFITSVTFIFLIGVFMSSWVGASVLSLGEWIIKRMPLGRHIYNASKQISAAISPDQNKQAFKEVVIIRH

SEQ ID NO: 51816 - protein, 134 aa, Sorghum bicolor
  Clone ID: LIB5048-010-R1-XP1-B2.pep
MADSQVTLRTRKFIRNPLLGRRQMVVDVLHPNRANVSKDELRGKLGELYKAKKDDVSVFGFKTHFGGGKSTGFALIYDSAEAMKKFEPRYRLVRYGMATKVEEASRQQRKQRKNRMKEFRGTAKTKGGAKKDKK

SEQ ID NO: 51817 - protein, 223 aa, Sorghum bicolor
  Clone ID: LIB5048-010-R1-XP1-B1.pep
MPPRLQLLTNAVRPLAQPAYQPVAPFLYPFLHQQSRPASILSSLSDTKGAYNHRIRRGRGPSSGKGKTSGRGHKGQKQHGKVPFGFQGGQTPEIVVHGERGEVDHFSVDMSPVNLNRIQEWINAGRLDPTQPITLRELANSRCMHGVKDGVKLLARGKEELTTPINIIVSRASAEAIEAVEKLGGTVTTRFYTSSPSARSSGTRWTPCTRCRAGFKWRLRLRA

SEQ ID NO: 51818 - protein, 194 aa, Sorghum bicolor
  Clone ID: LIB5048-010-R1-XP1-B6.pep
MGSAPRKQSKTYKVPKRPYEAARLDAELKLAGEYGLRNKREIWRIQLTLSKIRRAARELLKLDDKDSKRLFEGNALIRRLVRIGVLDDTRMRLDYVLALKTEDFLERRLQTQVFKLGLAKSVHHARVLIRQRHIRVGKQVVNVPSFVVRLDSQKHVDYSLGSPYGGGRPGRVKRKRAKAAAGGEGGDDEEEDDE

SEQ ID NO: 51819 - protein, 201 aa, Sorghum bicolor
  Clone ID: LIB5048-009-R1-XP1-E3.pep
GNNNTDLFSNPKVALPAEYAFLTAGWNSTFTINDLSAPGRQQLFDHGVALKLEYPELYTDKLLVGKQDRVIESAQWFADGYYGRNVNSTATLDLINEDNTTISWITPMDVCETWEYSDGGDLVSEWGSVYLPPIAARINKVLASAYPSVNFTAGNVHGMFYACVYGTAVNGIGSSPWCPVFLPEEILQNEYEYDPLMRGAF

SEQ ID NO: 51820 - protein, 93 aa, Sorghum bicolor
  Clone ID: LIB5048-009-R1-XP1-E4.pep
QQQKSLIVRLLEIRTPNASQRQLPRCADQAGVRQAPVGAVINFFTSTLGALKQILPVSTPILSQSHCKVVKGKPSFVARSRDRFFSAAQLVVA

SEQ ID NO: 51821 - protein, 207 aa, Sorghum bicolor
  unsure (1)..(207): unsure at all Xaa locations
  Clone ID: LIB5048-009-R1-XP1-D4.pep
MVKHNNQLQKNHFRKDWQRRVKTWFDQPGSKKTRRVARSKKALASGAAPLQRLRPAVRCPTQRYNIRIREGRGFTTSELKLAGIRKKEAKGLGIVFDHRRRSKSEEGQSLNVERLKEYRSRLVVFPRKAGKPKSGDAQGEDLTAHIXPEFSXALPASYTAEAPRAITSEEKEFNAFRAHREARAEKRNLGGKIKRAEAKGAEEAAKK

SEQ ID NO: 51822 - protein, 220 aa, Sorghum bicolor
  Clone ID: LIB5048-009-R1-XP1-C7.pep
MTPKIFLTGATGYIGGDTLFALYNKHSDYEIAALVRTEEKAKSVTEAFPKVRIVIGGLDDSKILENEAAKADVVIHTADASDHEGAAKAIAKGLASGHSKEKPGFWLHTGGTGILCWETMRDDNKLGEWSEREYNDWTAVQDLTGLPKDAFHKNVDDLVLAAGSESVKTAILCPPTIYGRGRGPLNTRSRQAYELAHLILTGQYIPIIGQGKAGWNNVHV

SEQ ID NO: 51823 - protein, 146 aa, Sorghum bicolor
  unsure (1)..(146): unsure at all Xaa locations
  Clone ID: LIB5048-009-R1-XP1-D10.pep
MGGSHSREDIDLTSSDEEKEYEDDYDARSPIAEAAASAGQRDDDLLRTATPSSLEAIDAKLRSLDLKYQRPTSAKLYLHVGGASPSAHWVPAERRATYAFVDKSSDNDSSPRWFLEVGPXPRVSAPXDSALQLKTIPAQRRADFAA

SEQ ID NO: 51824 - protein, 97 aa, Sorghum bicolor
  Clone ID: LIB5048-009-R1-XP1-B4.pep
MAPAATGGKKQKKKWSKGKVKDKAQHAVVLDKQTNDKLQKDVQSYRLITVATLVDRLKINGSLARKALADLEANGQIKKVVGHSKLSIYTRAIGAEE

SEQ ID NO: 51825 - protein, 67 aa, Sorghum bicolor
  Clone ID: LIB5048-009-R1-XP1-B3.pep
MMYVGRVPWSLRRGWRRCAPPPGSGLGGRVHVCGISRSCALGRVCSTICSPVTSFCSSPLTALCGLC

SEQ ID NO: 51826 - protein, 148 aa, Sorghum bicolor
  Clone ID: LIB5048-008-R1-XP1-H8.pep
MAKHLNFLLVTVACIHHIAYAASLKVAAATGTAYEILDKNNLPRGLLPQGVRSYVLNPDGKLEVTLAGQCEIPVNFGGQQLKFRFSSTVGGVINPGSIHEVYGVDVQIKFGWLGIRQVDRAGDQLTFQAKPFTQSFPVSTFAVSQSCS

SEQ ID NO: 51827 - protein, 155 aa, Sorghum bicolor
  Clone ID: LIB5048-008-R1-XP1-G12.pep
MDTEKLARMQNAVRTGGKGTPRRVQKKVHRSSGADDQKLQATLKKMNVQPITQIEEVNMFKSDGNVIHFSAPKVHAAVPSNTFAIYGHGEDKELTELVPGILNQLGPDSLASLRKLAESYQSLQKSGEGEKGGDDDDEIPELVEGENFESKNDVE

SEQ ID NO: 51828 - protein, 105 aa, Sorghum bicolor
  unsure (1)..(105): unsure at all Xaa locations
  Clone ID: LIB5048-008-R1-XP1-G2.pep
GDFIVSLGEASASLSPNPTAAMAAPSAALSVSGAAHTNSFVCRNKKLKSNRNRLHLAVPSSSESTNYCRKLTICRAQSEDSKGGGGFLXGFXIGGVIFGIFGYVF

SEQ ID NO: 51829 - protein, 107 aa, Sorghum bicolor
  Clone ID: LIB5048-008-R1-XP1-D8.pep
PGKKKNIKEVVIIRHPRVGEYAFGFITSSVSLQSYSGQEDLYCVYVPTNHLYIGDIFMVNSKDVIRPNLSVREGIEIVVSGGMSMPQILSTLDPQMILGDRTGPSRS

SEQ ID NO: 51830 - protein, 145 aa, Sorghum bicolor
  unsure (1)..(145): unsure at all Xaa locations
  Clone ID: LIB5048-008-R1-XP1-D11.pep
MEGRITVRKTAIKSKEWEPGXPWYGTDRVKYLGPFSGXPPRYLNDEIPGDYGCHTAGLSDDPDTFAKNREMQAIHSRWTMLHWLGCDFPEMVNRNGVKIXEAVWFKAVSQIFREGDLDYLSNPSLIHAHSMLDICCDQDELMSAV

SEQ ID NO: 51831 - protein, 109 aa, Sorghum bicolor
  Clone ID: LIB5048-008-R1-XP1-C1.pep
MSTSTGVHNLTTKADFDAALGEKGLMVVDFFATWCGPCKVIAPQVVKFSNSYTDARFYKVDVDEVPEVAQEQSVRAMPTFLLFKDGKQVGEVVGANPVALEAAIKTHSA

SEQ ID NO: 51832 - protein, 144 aa, Sorghum bicolor
  Clone ID: LIB5048-008-R1-XP1-C11.pep
GCYPAMEDDEWRIITGSDPKNTPWSYHNGGSWPTLLWQFTLACIKMGRPELARRAIAVAEERLSDDKWPEYYDTRSGRFIGKQSRSYQTWTIAGFLTSKMLLENPELASILTCDEDLELLEGCACCLSTKRTRCSRRAAKSHIG

SEQ ID NO: 51833 - protein, 196 aa, Sorghum bicolor
  Clone ID: LIB5048-008-R1-XP1-B4.pep
MSLGRKVTLNTGAAIPQLGFGTWQAEPGQVGAAVLEALKAGYRHLDLAKVYGNQKEIAEALKKAFGGEVPNLKREDVFITSKLWNSQHRPKDVPGALDDCLAELGLEYLDLYLVHFPVAFDERGDVHNNLFPLEGEDVKMLDDISIVDTWKAMTQLPKEKARAVGVSSHTKEHLQALIDGTGVTPAANQIERHPRL

SEQ ID NO: 51834 - protein, 213 aa, Sorghum bicolor
  Clone ID: LIB5048-008-R1-XP1-B1.pep
MISVLSLLLLLPSILAVEWHALQYYTANNQQLTSLSGEMVVPPITKAATYYLWPGLQPSDNSGVFQPALDGRSGGWWIGWGWCCSNPSLPWGGGFGVSAGDVVRFSATKNVKSNNWDTTLSVSAKNLNVTNSFALGDKFFNEAVFAIELYDVSWDFGPLKFKNVVMTTTGTDTGYCTSPPANLYDSTNYTSSVPKAWTDRKQKTACRIDSLIL

SEQ ID NO: 51835 - protein, 75 aa, Sorghum bicolor
  Clone ID: LIB5048-007-R1-XP2-F5.pep
MDASTERQNGTVKWFNDEKGYGFITPENGSADLFVHFRAIEKDGFKSLKEGEIVTFVAEQGQKGMQASSVRSATQ

SEQ ID NO: 51836 - protein, 125 aa, Sorghum bicolor
  Clone ID: LIB5048-007-R1-XP2-F6.pep
MKTRSQTAPKPLKTVAMAPRPSSPKRKSRPKPAGKGDRRAPKKPPTAFFYFMEDFRKVYKQEKPSVKSMQEIGKACGEKWNTMAFEEKVKYYDIATEKRAEFEKAMIEYNKKKKNGEMSEESDYD

SEQ ID NO: 51837 - protein, 136 aa, Sorghum bicolor
  Clone ID: LIB5048-007-R1-XP2-F9.pep
MTKINSHLHSSRRKSRKEHFNAPSSVRRVIMSAPLSKELREKYNVRSIPLRKDDEVVIKRGSNKGREGKITACYRLKYVIHIERVTREKTNGQSVPIGIAPSKVEVTKLHMDKDRESILERIAKGREAAKEKRTQA

SEQ ID NO: 51838 - protein, 222 aa, Sorghum bicolor
  unsure (1)..(222): unsure at all Xaa locations
  Clone ID: LIB5048-007-R1-XP2-D8.pep
MVQASEVLKGKTGVIYGDDVYNLFKHAQSEGYAIPAINVTSSSTVVASLEAARDAKSPIILQMSQGGAAYFAGKGVDNKDQSASIQGAIAGAHYIRAIAPAYGIPVVLHTDHCAKKLLPWLDGMLDEDEKFFKANGVPLFSSHMIDLSEESKEENIETTKKYLQRAAPMKQFLEMEIGITGGEEDGVNNEDVDXNSLYTXXEDIFDIYKTLSEVSQYFSIAA

SEQ ID NO: 51839 - protein, 49 aa, Sorghum bicolor
  Clone ID: LIB5048-007-R1-XP2-D10.pep
KMYFTLFLLLMIEKCSSFEQKPLSVHSCCIVISVIQSLRTQSIIKVIMD

SEQ ID NO: 51840 - protein, 170 aa, Sorghum bicolor
  Clone ID: LIB5048-007-R1-XP2-C3.pep
PGRINRALLGQIVFSDPSKRQLLNRLLAPHISSGIVWEIAKLWMKGCKVIILDIPLLFETKMDRWTNPVIVVWVDPKVQIERLISRDGCSEEQARNRINAQLALDWKKSEADIVIDNSGSLDDTKQQFQEVLTKVSEPLTWKERLRSRDGLISVVVCTAVGILLAQKNLL

SEQ ID NO: 51841 - protein, 211 aa, Sorghum bicolor
  Clone ID: LIB5048-007-R1-XP2-C10.pep
MDKEQVKDQSRGQETTGKSEWKQRPPYRVHEKNEDFDVKYEANCHCGKVQYQLSRREPLDSKLCHCTTCQTQHAAPFQWAAIFHKDDINFTNGHHDLEWYDPTDKSIEHKLPCKVRCSYCHSPIMDEGRNMILLFPSLVHLKTDEDKAYFKPRCHMFYGQRVMDIPDGLPKWSGLSGDSDLIEDSPPDMVREHERKREGERNKKLEEGEPD

SEQ ID NO: 51842 - protein, 229 aa, Sorghum bicolor
  unsure (1)..(229): unsure at all Xaa locations
  Clone ID: LIB5048-007-R1-XP2-B12.pep
MGDEEYKNGPAGLESEVLIESNWNEVVDNFDDMNLKEELLRGIYAYGFERPSAIQQRAILPCIKEHDVIAQAQSGTGKTATFSISILQRIDTNLRECQALILAPTRELATQIQKVVINLGEFLKAECSACIGGTNVRDDMRKLDSGAHVVVGTPGRVFDLINRKVLRTNYIXMFVLDEADEMLSRGFKDQIHDVFKTLSSDVQVVLLSATMPTDVLEVSKSFMRNPARI

SEQ ID NO: 51843 - protein, 176 aa, Sorghum bicolor
  Clone ID: LIB5048-007-R1-XP2-A10.pep
GLLNGQKIVVVRCEALNISGEFFRAKLKYSAFLRKQTRHNPTRGGPFHFRAPSKMFWRTVRGMIPHKTPRGKAAMERLKTFEGVPAPYDKKKRVVVPQALRVLRLKPGRKYCTVGRLGHEFGWKYQDVVARLEERRKVKGAAYYERKKAVRRQLAEAKKTANVDSKVQQELTSLGY

SEQ ID NO: 51844 - protein, 125 aa, Sorghum bicolor
  Clone ID: LIB5048-007-R1-XP2-A2.pep
MGRRRSSSWPSAAPVLLLLLLLVVCFSHGVAAARLLPPLQPAPAVPPQVLHQAENVVMAAAADGLVLQEGEAVGNGDELSISEMMGAEEEGAAAVCEGENDECLERRLLGDAHLDYIYTQHKGKP

SEQ ID NO: 51845 - protein, 195 aa, Sorghum bicolor
  unsure (1)..(195): unsure at all Xaa locations
  Clone ID: LIB5048-006-R1-XP1-H1.pep
PGYFWEENCNRNVQNVSSTRLQDERSELKRTQASLEKALNLNAVYRQELASRCSVEQDKDETHRQVEEELAKVITSLTEEVPSLRQQLDVGNKKEDYYVSLLKRKEEEICQMESQLDQSKRLCESRLEELKTKTQNGCCCSSSTWMIRMQIYLVVLTFSRSYYQIVMLCNISIFFLSXSHIVCLDSYXVLFIDLM

SEQ ID NO: 51846 - protein, 113 aa, Sorghum bicolor
  Clone ID: LIB5048-006-R1-XP1-H11.pep
PGSESRLVKSGGAVQRARALELEHSYPRHGGRGARDHLRAGAAEGVVVDGVGARGAEEARRRDESGAPAPALHAAVVRRRQRRGDVEDSVRGGGSVLAFFFFFFLFFFFFFFF

SEQ ID NO: 51847 - protein, 246 aa, Sorghum bicolor
  unsure (1)..(246): unsure at all Xaa locations
  Clone ID: LIB5048-006-R1-XP1-E8.pep
GNTLYAFPRSHFAQEHLPYTTMAIVESWLPPSRENWELICYIWQFFPIITAAQWVLDWYPQGKTSIESRFNIDGKIGWATMESAGFITLLYIMYSLPKELGLGELPWGNWTMAGCFVFHYLYRAVVSPLLLNPSMSPIHPFVWIMAFGFQMFNAISIGGYLAGYGPTSQYEWAARSEYMFLGLVIWCWGLLANMFHDDDLREIRRAADRKQRKAAAEQGKPVESVXQIYMVPKNGLFKYSLHAHYL

SEQ ID NO: 51848 - protein, 181 aa, Sorghum bicolor
  unsure (1)..(181): unsure at all Xaa locations
  Clone ID: LIB5048-006-R1-XP1-F3.pep
MALQPSAADKVDRESTPPFLLRVFWRSNRTLDPHEFSVAPPPDATASMEYFEILPANIQQSSLELYQWSDCTLGQLTSTMMSELPADAGVDVGSRLNFKLIFPDTRAQMGEGGRGKWIDKPLGSVVVGGRDAEMEENDVLEGDANXTLADARFVIGDFVACSIYPPSPDGRVAPMPAXKSP

SEQ ID NO: 51849 - protein, 156 aa, Sorghum bicolor
  Clone ID: LIB5048-006-R1-XP1-E10.pep
MDSPCQSCRLFGAQRSPHDLLGGGAVADVVLWRRKELAGGMLAAVVASWALFYCVPGNTLLSFVSQVLMILLTVLFVWAKAAQLLNRAPPPIPLMKISDESMSEAAEIVGSFMNKVLKDFENIALGKDSSLFYKVAFVLLLTSIVGRLTDLITLVY

SEQ ID NO: 51850 - protein, 212 aa, Sorghum bicolor
  Clone ID: LIB5048-006-R1-XP1-E5.pep
MAGSGSGSGSGSSSSSSSSSPPCASCKLLRRRCTQECVFAPYFPPEDPHKFAIVHKVFGASNVSKMLQELPAQQRADAVSSLVYEANARMRDPVYGCVGAISYLQQQVSQLQVQLALAKAEILCVQMQHDESASAAAAPAPAKQQLHHHHHQQEEMECEAYGSLLVQNGLMMNTLNSTGAVHHQQQMLGSFGSAGDTSMMLEACLKKETLWA

SEQ ID NO: 51851 - protein, 104 aa, Sorghum bicolor
  Clone ID: LIB5048-006-R1-XP1-D4.pep
KWHYKRPYSLHSINTTIKWTAKIHSTHTQAEVQLYKIEIHYGCIMFISGAYYMENCRYRFQSRYLLNQWLMSCRASFALATADASSSLYLTAHPCATPGKILTK

SEQ ID NO: 51852 - protein, 77 aa, Sorghum bicolor
  unsure (1)..(77): unsure at all Xaa locations
  Clone ID: LIB5048-006-R1-XP1-C2.pep
RELLLHPDRSFDYWRASFHSISSLWRRMSCLRRQCAVRFRLAVAAPXAXGCKMYPDMLEQQVTTTPKTPVMGVAPSS

SEQ ID NO: 51853 - protein, 166 aa, Sorghum bicolor
  unsure (1)..(166): unsure at all Xaa locations
  Clone ID: LIB5048-006-R1-XP1-C8.pep
MSDDWNSVTKIGSRTRGGAAGPRETVVKGKSALNAAQRSGGIVATEKKFASANAGASSEGQRLTKVDRSDDIVKPKTVGTVVGQAISKARSEAKNDKGTTMTQKDLATKCNSTPTIIADFERGTAAPDQKLLGNMERVLNVILRXDKNGQXKFPRRNERIICQVTC

SEQ ID NO: 51854 - protein, 84 aa, Sorghum bicolor
  unsure (1)..(84): unsure at all Xaa locations
  Clone ID: LIB5048-006-R1-XP1-C1.pep
MGNTSVFFDMTVGGATGGSIVMEIYDKEDPRTDEKFREMCTGEEGXGGRXGRRSTTRGAKFHRVDXGLHGAGANDFTRGKREGR

SEQ ID NO: 51855 - protein, 104 aa, Sorghum bicolor
  Clone ID: LIB5048-006-R1-XP1-B11.pep
MASSPLAISGGQPTWVPYEPTKDCSQGLCSMYCPQWCYFIFPPPPPFDVGGPSPDDSSGPVFSPLVIAIIGVLAIAFLLVSYYTFVSRYCGTFGSFRGRVFSST

SEQ ID NO: 51856 - protein, 129 aa, Sorghum bicolor
  Clone ID: LIB5048-005-R1-XP2-G7.pep
MSAQAPPTSTGSVKVDAIKQNIQAAEPEKLSGVALYSRFAFAGAVCCSITHGGLTPVDVVKTRIQLDPQTYNRGVIGGFKQVIQNEGAGALLTGAGPTFAGYFLQGALKFGGYEVFQHQPLDLLGYESA

SEQ ID NO: 51857 - protein, 101 aa, Sorghum bicolor
  Clone ID: LIB5048-005-R1-XP2-H11.pep
MAARTKAQEIIDSNAVAVFSKSYCPYCKSAKSLLSEMGAKAYILELDQIDDGAAIQDALEDITKQRSVPNIFIGQKHIGGNSELQAKKSQLSNLLKEANAI

SEQ ID NO: 51858 - protein, 88 aa, Sorghum bicolor
  Clone ID: LIB5048-005-R1-XP2-F5.pep
FISPESLAFPSLYYPTLLPAPITNVLPLQFHPRPTTATSSTVTLIVNIVTFVLLDPRPRAYLDLLLHAVSCSPKARSSSVSVKPTPAL

SEQ ID NO: 51859 - protein, 169 aa, Sorghum bicolor
  unsure (1)..(169): unsure at all Xaa locations
  Clone ID: LIB5048-005-R1-XP2-G10.pep
MGSPPTSSSFIRPATLPHHPDPRLHFRPPSASFRVSEILGGRGLCNGEDGDRKELTSGSCVSTTTSSPAPTPSPSTEPPPPAGDLDAFEKEMMGLTGGXFPGGEAALKDFITRNPPPPRSEKAISQMDAPQAITVSEAPRTSEMTLYLTQMAEQCKNPNNAYYVDCGSM

SEQ ID NO: 51860 - protein, 97 aa, Sorghum bicolor
  Clone ID: LIB5048-005-R1-XP2-D6.pep
MSMFFGQKPQISSEQKITQAEAEIDMVSDMYSRLVKSCTAKCIDTNYREADLNKGESVCLDRCVSKFFEVNVKVSEKMQGEAQGKQGGGGGMFGGGM

SEQ ID NO: 51861 - protein, 125 aa, Sorghum bicolor
  Clone ID: LIB5048-005-R1-XP2-D9.pep
GSVIAHISYIVGSGHNYPNDSTCIASVPCEIVCPCIQVMHSQTGVSYSCLSVSLAVYIVVEVVSVRSSCSPSEEAGHVVSMSPRTASAGIDTPDLSCGSRHQASMYVVSGGCMIGVCVCGVVVQR

SEQ ID NO: 51862 - protein, 167 aa, Sorghum bicolor
  unsure (1)..(167): unsure at all Xaa locations
  Clone ID: LIB5048-005-R1-XP2-D11.pep
QPSGDNRFSKTIWIPRIXPPRMHLCILHDAVDAEPATHLDKELPFMSVXELKNLDNNRXLDEKLAQKYNAFLASEALMKQIPRLLGPGLSKDDKFPTPVSHHEDLAKKVNEVKSTIKFQLKKDLWLGVAFGHVNMTEDQLVQNCMTSVNFLISLLKKQWQNIGSLHI

SEQ ID NO: 51863 - protein, 95 aa, Sorghum bicolor
  Clone ID: LIB5048-005-R1-XP2-D2.pep
MSGIPRSHTPAGGSRLSTVPSQKPRQLSHLQAQLAQLTANMSDLESLMRMTAGQAQDMRGLGGYAGAMFMAASKVLGEETVKGGGSDKEGREGDK

SEQ ID NO: 51864 - protein, 79 aa, Sorghum bicolor
  Clone ID: LIB5048-005-R1-XP2-B5.pep
QASSTNRFQKSTRNAHLFEKKKIDLKAGNHACERTFLVRPMGRTVHSSNMAQSSQIVARPMYMHGLITCKPNVAQQPFR

SEQ ID NO: 51865 - protein, 202 aa, Sorghum bicolor
  Clone ID: LIB5048-005-R1-XP2-B6.pep
MGISRDSRHKRSASGAKRAYYRKKRAFEKGRQPANTRIGTKRVHLVRTRGGNRKFRALRLEAGNFSWGSEGIAKKTRVIGVVYHPSNNELVRTNTLTRSAIVQIDAAPFRQWYEAHYGSSLGRRRQVKAGEKEEDKKKSNSVTKKQADRLKNGGKIENAVEKQFEAGRLYAAVSSRPGQSGRCDGYVLEGEELAFYQRLLRK

SEQ ID NO: 51866 - protein, 75 aa, Sorghum bicolor
  Clone ID: LIB5048-005-R1-XP2-B7.pep
MPFRFEFPWLKNPNTTAGTSNRDTNPSPRFPNPFLPIQAHVTSFLSSLPQDPPPPRRRGRAPRRGGRDAPGGAAS

SEQ ID NO: 51867 - protein, 110 aa, Sorghum bicolor
  Clone ID: LIB5048-005-R1-XP2-A3.pep
GLACTALLRPFSREVGISLGALSAAPEALNKTLSTPGGGHIIGLVVGGAAEALLSRPDKYRILIKKRKGFCKMALRHGSPLVPVFSFAEHVLYHQAQSEPNSRFFHFQKM

SEQ ID NO: 51868 - protein, 115 aa, Sorghum bicolor
  Clone ID: LIB5048-005-R1-XP2-A4.pep
GPATPSGTTPSDDTGARPVSVSKRIAPDKPSLTRFSIPNHHLFLQRQSSLHETSDYIGNFAHGGNRATSLLSEVHLQTRDAMGGISFHVTGYLPTSHSWRFGSVNGNEGNRFMMV

SEQ ID NO: 51869 - protein, 103 aa, Sorghum bicolor
  unsure (1)..(103): unsure at all Xaa locations
  Clone ID: LIB5048-005-R1-XP2-A10.pep
MVNVRTGQSCRLYVMXTILGXLTLKSNHYQTTCSRALSTAGXHHRTHFSWYAAKRMSDIYKAKTKTTHTLYRSICGKVTRSHGNSPLDRAKFHSNLPPESMRP

SEQ ID NO: 51870 - protein, 53 aa, Sorghum bicolor
  Clone ID: LIB5048-004-R1-XP1-H6.pep
FMFVLITKQTRTNLLFLQANRSFDFGIQSLYQYTVSFTHSSHNIPFQSIIKNN

SEQ ID NO: 51871 - protein, 123 aa, Sorghum bicolor
  Clone ID: LIB5048-004-R1-XP1-H8.pep
GPTPIYIFSTQLHAVFHNDSHQSQGKQARLGADAVLRLSPPPLVVNPRSACRREEDDVHRHNHLWPVVLPGVAEAEAPDDDPTIIRPAATTIIRWPAANAVVSCTGGSSESACVMRICTYLYK

SEQ ID NO: 51872 - protein, 66 aa, Sorghum bicolor
  Clone ID: LIB5048-004-R1-XP1-G9.pep
LTVDTPISKDISDKIVESVQKLQSGLEIVNEQRSNYLDLALNFLLLRLSFLIRFFLHFSLILVGSR

SEQ ID NO: 51873 - protein, 56 aa, Sorghum bicolor
  Clone ID: LIB5048-004-R1-XP1-E4.pep
GIPSVAAHSLSLSSLVRGKAPPPSLDNLSHGDMGGSFANVNSDAWLKKLDEHLLAR

SEQ ID NO: 51874 - protein, 130 aa, Sorghum bicolor
  Clone ID: LIB5048-004-R1-XP1-E7.pep
RADDSDLWQASVRHVAHEGGCFLLSANQFCRRKDYPPPPEYAFTGFDEEPKPDDVLCRGGSVIVSPSGAVLAGPKYDGEGLLTVDLDFSEIVRAKFDFDVVGHSSRPEVLTLVVKDQPQVPVVYTSASPN

SEQ ID NO: 51875 - protein, 144 aa, Sorghum bicolor
  Clone ID: LIB5048-004-R1-XP1-E9.pep
LVFFKLLAQQSPHSTLSQAGRQLASLAIMEHHHHQELDLELSLQPFSADAAAAADDPPGFFVCTYCDRKFYSSQALGGHQNAHKYERTLAKRRREIAAAMRAHGARQVDAAAASTCSRPGGDRAPAVQSAAALLRGKSSSLERG

SEQ ID NO: 51876 - protein, 204 aa, Sorghum bicolor
  unsure (1)..(204): unsure at all Xaa locations
  Clone ID: LIB5048-004-R1-XP1-C8.pep
MVDAVKKPKDAKAFMTDFLMGGVSAAVTKTAAAPIERIKLLVHNQDEMIKQVPLATPYKAIGDCFSRVYAEEGLASLXVGNTANVIRYFPTQTLNFAFQDYFKCLFEFNNSEDYXKRVTENIASVADAVASTLFFVYSLDYDLTRLDNDYKAVTKGGSRQLNGLIDDYRKTLASDGIDVLYRGIVPSDDAIVVYRGLYCRLYDS

SEQ ID NO: 51877 - protein, 186 aa, Sorghum bicolor
  Clone ID: LIB5048-004-R1-XP1-D11.pep
MATDDITIPQHVAIAEAPRDVEAIKKQEKAALLSHWDSDVAFKLGCNLRTRLLTFERPAVVDISTISTPGHVLFHATTHSGTALDNDFWVSRKRAAVIRFNASTWRLQNQFEGDEEKFKAKMGLGETAKDDAIHGGGVPIFIKNCDGPVAVVVVSGLKQWDDHQVVIEELGKLCKEMEKGNGSTPI

SEQ ID NO: 51878 - protein, 134 aa, Sorghum bicolor
  Clone ID: LIB5048-004-R1-XP1-B5.pep
SIKMQFHIRGNKCHVLDVEQHETVAEIKNKVAVLEQVDAAEFTLSCEGTILDLFTPASALSSFELDMNVPLLGGKVHGSLARAGKVKGQTPKVEKQEKKKKKTGRAKRRIQYNRRFVNVVQGFGRRRGPNSNSA

SEQ ID NO: 51879 - protein, 63 aa, Sorghum bicolor
  Clone ID: LIB5048-004-R1-XP1-B2.pep
REDCISILIDRLIISGASFHSISSFGGRCHAAEATADAAPAAVRHGCEGARGPDMLSSKGPPP

SEQ ID NO: 51880 - protein, 129 aa, Sorghum bicolor
  Clone ID: LIB5048-004-R1-XP1-A11.pep
SGQQLHITSQHSTNTTKHFPPRRSTCLTTSPLSTTVSVRTASPTSASAPASSQAARSIPMRPARRVARLAARPVVLPAAAPAVAALEAMASLLVERSTLLRLAARVVSPPTKSDGIHSTAVRAENTLAA

SEQ ID NO: 51881 - protein, 66 aa, Sorghum bicolor
  Clone ID: LIB5048-003-R1-XP2-E4.pep
LESILFRAGLLPPPPMLAMARKGGPRDRRPIHPMTGRPLDLEGVTIVDDSNAPEGDAEEPTDEVAS

SEQ ID NO: 51882 - protein, 103 aa, Sorghum bicolor
  Clone ID: LIB5048-003-R1-XP2-F11.pep
QYVRIAAEDRLLGMKEGVIPVLVDLPTNGIEEAKNCSTKLLHLLRDMRRSDQFTNSCSQEVAATGTVEDAPNNSVHKQPVSKSSRFFQRKLNIFSKPRSLTLF

SEQ ID NO: 51883 - protein, 139 aa, Sorghum bicolor
  Clone ID: LIB5048-003-R1-XP2-D6.pep
MAPKQAQKTPTTAGKAPAGKAPAEKKEAGKKTAAVSGDKKKRTKTRKETYSSYIYKVLKQVHPDTGISNRAMSILNSFVNDIFERVATEASKLAAYNKKSTISSREIQTSVRLILPGELAKHAVSEGTKAVTKYSSSTK

SEQ ID NO: 51884 - protein, 89 aa, Sorghum bicolor
  Clone ID: LIB5048-003-R1-XP2-E10.pep
GIVYTTIGDVCLYIVGKDEYDELALAEVIFAVTSAVKDVCGKPPTERLFLDKYGRICLCLDEIVWQGLLENTEKDRVRRLIRLKPPVEP

SEQ ID NO: 51885 - protein, 149 aa, Sorghum bicolor
  unsure (1)..(149): unsure at all Xaa locations
  Clone ID: LIB5048-003-R1-XP2-E2.pep
RGNLPFSRKLHTTQPNKKTRRRCFLRPAGDRDGWIPPKMPKTNANFMKIQEPXRRTRADITHYRARITLVXLHNHNHPTAKYNILVCPFTNSDITAQLITPRIAQDIGLASAHSHAVATIWTLKCELNNYAPGYCTGLLLGKRELYIRG

SEQ ID NO: 51886 - protein, 42 aa, Sorghum bicolor
  Clone ID: LIB5048-003-R1-XP2-D10.pep
KYFFISLNHDTQGTIFKKFFIKFFIPYQCLNNLFFYILLKLI

SEQ ID NO: 51887 - protein, 107 aa, Sorghum bicolor
  Clone ID: LIB5048-003-R1-XP2-D11.pep
MPKEKTTTRTKRATKTEGGRKKKDPNQPKRGLSAYMFFANEQRDKVREDNPGIKFGEVGKKLGEQWKNLSDKQKEPYDAKAKADKQRYEEEKAAYTAGGVDDDEDEE

SEQ ID NO: 51888 - protein, 112 aa, Sorghum bicolor
  Clone ID: LIB5048-003-R1-XP2-B5.pep
VIPSVCRAAQRARGQFSSWFRGAGVTWAVGCALGSVVRSCGAGRRLDRGVGGPMVRRSGRESGSWGAGGHQPCRGVWVHLATCAGACTRTGGARCAVSSASCHNGPEGMMER

SEQ ID NO: 51889 - protein, 246 aa, Sorghum bicolor
  Clone ID: LIB5048-003-R1-XP2-B1.pep
MVKQKVCLAYSGGLDTSCILRYLLDEGYEVICFMADVGQEEDFEAAKEKALKIGASKCYIEDIRKEFVEELCFPAIACNAIYENTYLLGTSLARPVIARAQIAVAQKEGCSAVSHGCTGKGNDQVRFELAFYALQPSIKVIAPWRDPVFYNRFKGRNDLLDYAAEKGIPVPSTKSKPRSMDENMAHCRYEAGILEDPNVTPPEEMWKLTVDPTKAPDAPEDFTVHFQKGLPVKLDYENGKSVTEPV

SEQ ID NO: 51890 - protein, 156 aa, Sorghum bicolor
  Clone ID: LIB5048-002-R1-XP1-H5.pep
PGITSCLRSPSFHLCPSTASFASTYNSARSLRLSTRAALTRKRTQHPSACFRAFSTYFRLTHIRQHGPRLTSDGDSRSSSVCSASSPSLRAVSLRGWSRSTTDTTTTRLAPPGTGSASSCSSRGGPSSSPPSTSAPSSPAPSRSSPRSPRTLPGSS

SEQ ID NO: 51891 - protein, 91 aa, Sorghum bicolor
  Clone ID: LIB5048-002-R1-XP1-H7.pep
CLLRYFVEAWKTSVTKWYRGYSYLGTQQGIVFVSAVFARSLEDHVNDSTSATLCQWTFNLVEFAIQDGFEEPHSWCSEHRNTSEQLLVHPG

SEQ ID NO: 51892 - protein, 90 aa, Sorghum bicolor
  Clone ID: LIB5048-003-R1-XP2-A12.pep
MFLNFPKLTRPLQFRLTLQNFFFFFFFFFFFFFFFFFFFFFFFFFFFFFFFFGQALYCQFHWSKLTSTAPMHGTAGGARLCKPRQAGCHA

SEQ ID NO: 51893 - protein, 125 aa, Sorghum bicolor
  unsure (1)..(125): unsure at all Xaa locations
  Clone ID: LIB5048-002-R1-XP1-H11.pep
DVQNNALVMHTSANCFLXWPPQAITSHLRDAADGSLAAEFIDGGSSLSAAGGAVGHVDPATRLQPRAATAGTWAAARRHAALLHRLCAVALAPLLEGRAVEGAPVLDPRTRETEGGRVGLSLEGG

SEQ ID NO: 51894 - protein, 78 aa, Sorghum bicolor
  Clone ID: LIB5048-002-R1-XP1-H3.pep
MDASALNNPRLKAMIEEERTKAMANELLAKLTFLCWDKCVTGSVGSSFSRSETSCLSNCAKRFAEVKMMTMQRFTGRS

SEQ ID NO: 51895 - protein, 199 aa, Sorghum bicolor
  unsure (1)..(199): unsure at all Xaa locations
  Clone ID: LIB5048-002-R1-XP1-D6.pep
MLPLRCARSPVALSAQMPLKRVANLSTSVCRQQLNSDVRITRTGKPILTVSGGRSSLGGYTATVFGATGFLGRYIVNRLARSGCTVVVPFREEMAKRHLKVAGDLGRVIFVEMDLRNTASIEESVRHSDIVYNLIGRDYPTKNFDLEDVHVHGTERIVDAVAKYDIDRFVHVSSHSARLDSPSEFYRXQAQGEQVARSI

SEQ ID NO: 51896 - protein, 107 aa, Sorghum bicolor
  Clone ID: LIB5048-002-R1-XP1-C6.pep
VNGLSDQCIAWSKRKKPVGILVARWSQFGRQARGGGSGSGRGRRVEWRLGAGREMSWDGHLATATSALAVRRWVGLPTGYGGVARRRVARMFSASDEVTVHSRRVPR

SEQ ID NO: 51897 - protein, 65 aa, Sorghum bicolor
  Clone ID: LIB5048-002-R1-XP1-C8.pep
EQKSTFRQMNDTDLLYSGHLFYLPYTSSLFIDVTWITCFAFFRALGYFLYLFIHFIYISCLLGVV

SEQ ID NO: 51898 - protein, 126 aa, Sorghum bicolor
  Clone ID: LIB5048-002-R1-XP1-D11.pep
MFSQSLMRASRQSLARVARQQTTTMRRNFAVSAVVKADLVQDMYLKELKAYKAPAVKASDAEGHVQKFALPKAPPSPEEADIASELKAYESQEPEVEGQSGEAGAAPAEQDWFEEPAEEEEGSAAH

SEQ ID NO: 51899 - protein, 219 aa, Sorghum bicolor
  unsure (1)..(219): unsure at all Xaa locations
  Clone ID: LIB5048-002-R1-XP1-D12.pep
LVVLRLEKYDKDGIIDKTSGVHGLGRSVGKFLDGRFTVFCLENLRPFSGDINIGDPQRKLILHRPRLPGGESPPGFLDFAVNMIHLDRAHLSCLTASGHGLRETLFYTLFSHLQVYKTRADIQSALPLIKDGAVSLDGGILRPNGSFCLGDSKNLEVRFPVNIEVSSLPENIAEMEEQVKLKNXEKERVLEDMKREEDLLKQVKEYTGSRTRAHGLSHS

SEQ ID NO: 51900 - protein, 148 aa, Sorghum bicolor
  Clone ID: LIB5048-002-R1-XP1-C4.pep
GSDQPNQPTEETTRRDKYRVQSVPVRLAADFPEAIRHNPATTAYIPQEFPSAKGIAASNVFSRRRPVPALPARATVSDRKYPATDGRPRRKGGEGGPGVRCPVRPCRRSPAPNQLQAFRCEFDGRNGLLGWGKEAPRSGGEGEDQSLQ

SEQ ID NO: 51901 - protein, 214 aa, Sorghum bicolor
  unsure (1)..(214): unsure at all Xaa locations
  Clone ID: LIB5048-002-R1-XP1-A8.pep
MESFTQKHVIGIPLTSFAYADEERQGKPSCSTMVHKKNKKSSFIYRMNKLSDKTDNYMQGFKEHLTLGPKISETIKGKLSFGAKVLQAGGIDKVFREYFSVEKDEKLLKAFQCYLSTTAGPIAGMLFISTKKIAFHSDRPLNFMSPKGGSTKVPYKVLIPTKRIKSASVRENLYNPDEKYIDVVTVDGFDFWFMGFVSYEKSFXYLQHVIXELR

SEQ ID NO: 51902 - protein, 53 aa, Sorghum bicolor
  unsure (1)..(53): unsure at all Xaa locations
  Clone ID: LIB5048-002-R1-XP1-B1.pep
HGTPPPSAEAHGARCTDHQATAGGFEAAVEGGGCDCNLRRCGSSCXCSCCSCN

SEQ ID NO: 51903 - protein, 94 aa, Sorghum bicolor
  unsure (1)..(94): unsure at all Xaa locations
  Clone ID: LIB5048-002-R1-XP1-B2.pep
MSCCGGXCGCGSGCKWRQRXAEXCKMYPDMPEXRVTTTGKTPVMGVAPSSKGTXAGSSAAGPGAEXRXXCKCGPNCSCNPWHWQVSCIITPWTA

SEQ ID NO: 51904 - protein, 129 aa, Sorghum bicolor
  Clone ID: LIB5048-001-R1-XP1-H8.pep
VEGVRGQNGLEVLSDDDALGGLEGDNALFALLCLERVIASLDGQVFYAIDLDTLRDSILGLCLVTESPGDVSPLLIGHREVVVCDTDSCALVVADEGLVDLAGADEAVCQRILTTTCMRGVDVRCCRNL

SEQ ID NO: 51905 - protein, 187 aa, Sorghum bicolor
  unsure (1)..(187): unsure at all Xaa locations
  Clone ID: LIB5048-002-R1-XP1-A3.pep
MDALEVLVVAIGIAMATAATDYCSICSDHTLCLYQNASSSCQNLTTRNLTTSEQSSVVAAHNNVRNQIASGSVTNGTNGAQPSATNMHSLVWDDEIAAIAQRWATQCKFEHDTCRNSADGTYVGQNILITTDTSSSLTSILEGSVQAWFSEVAXVNSSTVSQPYVFHENTGHYTQLAWAXTTHXGCG

SEQ ID NO: 51906 - protein, 212 aa, Sorghum bicolor
  Clone ID: LIB5048-001-R1-XP1-F9.pep
PRAFFFFFFSVGAPTIISSTRCLSFVQLQVIGDKQVCHLSGKRFYWHSWQGNMVVFTGTSRDLEEGVAVVVGDVPPALARRRVLLALLAAAPALLPVGAAGVGPAPLVVPAVHDDPALVAPLAVDALVRRRHGEQTLLACDVAMEGAGGRVVLLVSVNAAASEAPLLLLRRRRRRAAVAAGSRSGSRRARPPCTATRRATRGWGRGAGQLGH

SEQ ID NO: 51907 - protein, 156 aa, Sorghum bicolor
  Clone ID: LIB5048-001-R1-XP1-G11.pep
MSWRWAAAARKLAGMPQLRTPGAFTGGLLYRSFGSDSIGSRKSSLPRRVLSIGAISLAGGLVLSAVNDLAIFNGCTTKAIEHAADNPAVVEAIGAPIVRGPWYESSLMVGHRRRSVSCTFPVSGPHGSGFLRIKVTRNGEDGLLLFLWHHHWGDPY

SEQ ID NO: 51908 - protein, 40 aa, Sorghum bicolor
  unsure (1)..(40): unsure at all Xaa locations
  Clone ID: LIB5048-001-R1-XP1-F4.pep
WDPWRKHIMENGIAPRGXSXTSHGDEARLRDLPQNGTDXR

SEQ ID NO: 51909 - protein, 209 aa, Sorghum bicolor
  Clone ID: LIB5048-001-R1-XP1-E6.pep
MAGQGCKITAVALLPLLILLPLAMLSSMASATGRSPAALSGEGFPVLRKVPTGPSNETSDPPPPPYQVPESPVVDFPVLRKVPTGPSNETSDPPPPPYQVPESPVVDFPVLRKVPTGPSNETSDPPPPPSHVAESPVVDFPVLRKVPTGPSNDTSDPPPPPSSQVAESPIVDFPVLRKVPSGPSNITSDPPPSAFRGRERLNPKAAQGA

SEQ ID NO: 51910 - protein, 144 aa, Sorghum bicolor
  Clone ID: LIB5048-001-R1-XP1-E7.pep
KNQMERYFNLFLNCPHEWPVRRPSHLVDYLILGDKELAGQDVPLQHVSLVREVEKQEQPDPPRQDKQQGYECPDDGVVLKVVGHQLLERGPVHNPRGGVRLLLFISCLARYILDQARTGGAPLAQCHGVATQHAFLVPAQETAL

SEQ ID NO: 51911 - protein, 212 aa, Sorghum bicolor
  unsure (1)..(212): unsure at all Xaa locations
  Clone ID: LIB5048-001-R1-XP1-F11.pep
GFKSSTFEVDVLYVDPDDSQISQKISTYTIGPFQTSKGEKAKLKVKVRLNIHGTVTVDSAMMLEEXDVEVPVSSANEAPKDTMKMDTDDAPSDAAAGSDVNMQEPKSAETTEAAPAAENGAQDTEQKSVPMETDAKVELSKKKVKKTTVPVHELVYGALAAIDLQKAVEKEYEMALQDRVMEETKEKNNAVEAYVYDMRNQLYDKYSDFVTP

SEQ ID NO: 51912 - protein, 203 aa, Sorghum bicolor
  unsure (1)..(203): unsure at all Xaa locations
  Clone ID: LIB5048-001-R1-XP1-D8.pep
MAVKGNNPILKNHFRKDWQRRVRVHFDQPVDKLRPIVRCPTVKYNRRVRAGRGFSLAELKEANIPRKLARTIGISVDPRRQNLSEESLKANVERLKAYQQRLILFPRNSKAPKKGEASAEEVKAVRDGDHVLFTNSALPINNKAVVTEEKVSENPSTENAYRKLRDARSEAXLVGVREKRAKAKXRGGGREERIDVERVHLLH

SEQ ID NO: 51913 - protein, 196 aa, Sorghum bicolor
  unsure (1)..(196): unsure at all Xaa locations
  Clone ID: LIB5048-001-R1-XP1-D9.pep
MPFTKLVKNSAYFSRYQVKYARRRAGKTDYYARKRLVTQAKNKYNAPKYRLVVRFTNRDIIAQIVTSEITGDKVFVSAYAHELKAYDITHGLTNWAXXACVGLLVARRALTKLGLDKAFTGVEEADGEFTETEPAEVDGEERRPFKCYLDVGLVRTSTGARVFGAMKGASDGGLYIPHSEKRFPGYDIESKELDAE

SEQ ID NO: 51914 - protein, 74 aa, Sorghum bicolor
  unsure (1)..(74): unsure at all Xaa locations
  Clone ID: LIB5048-001-R1-XP1-C2.pep
QDHVSAQPLRFQAQRKHVKFQDSPSNAMKEPEPMGMAMWXKEAGIRDVDTXSFGXPQAKRQGLGRLQKSTTMYQ

SEQ ID NO: 51915 - protein, 51 aa, Sorghum bicolor
  unsure (1)..(51): unsure at all Xaa locations
  Clone ID: LIB5048-001-R1-XP1-C5.pep
GTPPTVVPGGFLIVTLDALQGPSGLPRSEFTSFWRLGAVVSIENVAAREIX

SEQ ID NO: 51916 - protein, 178 aa, Sorghum bicolor
  unsure (1)..(178): unsure at all Xaa locations
  Clone ID: LIB5048-001-R1-XP1-C9.pep
MSKPSILFVLTSHNKLGDTGKPTGWYLPELAHPYHVLRNKANITVASPKGGEAPLDPASVEAAKDDVSVNFLKNDEQVWKNTQKLSDFKGKAKEFDAIFYVGGHGPMFDLVDDATSQQLIREFWEADKIVSAVXHAPAVFYDAKLSDGSLLVVAKGVTAFTNAEAEKVRLPQVDPCCL

SEQ ID NO: 51917 - protein, 97 aa, Sorghum bicolor
  unsure (1)..(97): unsure at all Xaa locations
  Clone ID: LIB5048-001-R1-XP1-C1.pep
MSCCGGNCGCGSGCKCGTGCGGCKMYPGHGLSXGDHHRPRLTLMGVAPSSKGHAXGGFRXRRXRXPGAEXRXGGKCGPNCSCNPGTSPVSCIITPCT

SEQ ID NO: 51918 - protein, 47 aa, Sorghum bicolor
  Clone ID: LIB5048-001-R1-XP1-A2.pep
LGPEGVPVHLAVHGTGPAPHRREGSEGPDVGGDHCFSDQPIDLTCRS

SEQ ID NO: 51919 - protein, 68 aa, Sorghum bicolor
  Clone ID: LIB5048-001-R1-XP1-A3.pep
MDQVTKFVKPGKQFAKDSIRLVKKCTKPDRREFQKIAVATAVGFCIMGFIGFFVKLIHIPINNIIVGS

SEQ ID NO: 51920 - protein, 226 aa, Sorghum bicolor
  unsure (1)..(226): unsure at all Xaa locations
  Clone ID: LIB5048-001-R1-XP1-A5.pep
MPLPLSDAQISNITGYMSLACWIVVYSPQIWENYQLKSGEGLSVTFIVLWLLGDITNALGGALANLLPTVVILAVYYTACDIVLLIQVYYYRHLARQKAKKQGNSESSPLLESEIRQPPAQPKPLLPPSLEYPLLLLFVLGAGVAAYYLSDTPDDVSIPEKPGKGSEVELEWKSQTLXWLSAALYLGSRVPSIAHNYQTRCXGLSLAMFLFSISXNITYVISILII

SEQ ID NO: 51921 - protein, 85 aa, Sorghum bicolor
  Clone ID: LIB5048-001-R1-XP1-A7.pep
MCVRWSCGNVLRATIEVPDAGEVNFHCTHLDHLDERWRMKQVDAIIRSGDGPHILAGGLNALDGTDYSADRWSDIVQYYEEIGKP

SEQ ID NO: 51922 - protein, 91 aa, Sorghum bicolor
  unsure (1)..(91): unsure at all Xaa locations
  Clone ID: LIB5048-001-R1-XP1-B1.pep
RXPSPPPCSRGQVFFWXFAGGHPQEGGNYSGDPVTRNEKGRFSSWAKGFRGRAKXLHQDNKGEGRESLAYSYGDRGNKKGDMRPLWIERIN

SEQ ID NO: 51923 - protein, 192 aa, Sorghum bicolor
  Clone ID: LIB5050-012-R1-XP1-H3.pep
MADDMPVSVYPPPPLSSTPATQPPLNLSAPPSPSPPSIPSASVTQIPSTQNTLVSPDLDSSSSEDAPGQPVLLSRIFKSERIELSDDFLSAASNKGYRMVRATHGVTAGAWYFEIRIVHLGPTGHTRLGWATNWADIDTPVGYDAYGFGYRDVDGAKVTKAWRDKYADEGYGEGDVLGFYISMPNGEQYEPK

SEQ ID NO: 51924 - protein, 168 aa, Sorghum bicolor
  unsure (1)..(168): unsure at all Xaa locations
  Clone ID: LIB5050-012-R1-XP1-F5.pep
MQRGDPLVVGRIIGDVVDPFVRRVPLRVAYAAREISNGCELRPSAIADQPRVEVGGPDMRTFYTLVMVDPDAPSPSDPNLREYLHWLVTDIPATTGVSFGTEVVCYESPRPVLGIHRMVFLLFQQLGRQTVYAPGWRQNFSTRDFAELYNLGLPVAAXYFNWPKESGN

SEQ ID NO: 51925 - protein, 91 aa, Sorghum bicolor
  Clone ID: LIB5050-012-R1-XP1-E3.pep
ASGRGSPKPAVASCLHQRVSEALKGTHARTHVGVLTARWGPDRSPVLAVTSCLCHTGVPDGRRCPRRPHARAVPASRSVASDYGDLVPAPK

SEQ ID NO: 51926 - protein, 144 aa, Sorghum bicolor
  unsure (1)..(144): unsure at all Xaa locations
  Clone ID: LIB5050-012-R1-XP1-D11.pep
MTDSLNTSTPSTGHQPPLFFCPEMAAPRLTLEVATTMEDLAGLLLESSEPESGMSSCSDVTSSVAPCLWYEMSTTESPSPARCNGVRSLNSRPXPTDDRHGTCACLKSMTSKLSISNVFIMXNAANIPSKRVVSGVIPITPNVD

SEQ ID NO: 51927 - protein, 223 aa, Sorghum bicolor
  unsure (1)..(223): unsure at all Xaa locations
  Clone ID: LIB5050-012-R1-XP1-A8.pep
MAPPPPPELMDDLIGEILLRLPPEDPACLVRASLVCKLWRRLLSDGAFLCQYRAFHRTPPVLGFFHNQYRKGTSVPQYVPTIQASPVPQPAIAVTGSPTTSYRTIDCRHGRVLFEGKDQPSQTLIVWDPITGNQKLIYPPVHPYTKFLAAVLCAADGCDHLRCSGGAFLVVFVGIYDAEEEDNDDEGVEDGDPVGWASLYPSEIGXWSASTSISVDSFIDLVL

SEQ ID NO: 51928 - protein, 169 aa, Sorghum bicolor
  Clone ID: LIB5050-012-R1-XP1-A9.pep
MAASSAAPALLRRLLCSSTPASASASVVLRAAFCSSPGFGPSPPSSMFGDGTEVANVPPLTTPKLFVSGLSRLTTDEKLQGAFAPFGRILEAKVVTDRVSGRSKGFGFVRYATIEEAEKARQEMNAKFLDGWVIFVDPAKPRQPKPAPEQDTSSSHVGFTTNKTVGWCG

SEQ ID NO: 51929 - protein, 58 aa, Sorghum bicolor
  Clone ID: LIB5050-012-R1-XP1-A6.pep
SVIPTRAPPGGGPPPPSGPIRSCSEGGHWPPLYRGEFGKTRGLPLLNALHVIPLLPPG

SEQ ID NO: 51930 - protein, 95 aa, Sorghum bicolor
  Clone ID: LIB5050-011-R1-XP1-F7.pep
MAKQAVAMLVALALVVAAAMSAGGASAVQCNPAQLVVCAPAVINGSPPTASCCSNLRAQESCFCEYAHNPAFRKYIDSPNAGRTLTSCGIPIPDC

SEQ ID NO: 51931 - protein, 56 aa, Sorghum bicolor
  unsure (1)..(56): unsure at all Xaa locations
  Clone ID: LIB5050-011-R1-XP1-F11.pep
GHPPVSTPDPAISRRVDPLFXIPTDTPAPNRDHQQRQCSGEIWRRRKPTTLPFFPR

SEQ ID NO: 51932 - protein, 110 aa, Sorghum bicolor
  Clone ID: LIB5050-011-R1-XP1-E11.pep
MDYSMQGSKDSYSPSPQVHNLYPDAQPQPGLYPPPPPPAANPERGYGYQYQGYFGEAANPPPYAGRWPEQAAAPSDGGPFYYQDDADCITFLRGCVAGLCCCCLLGRCCY

SEQ ID NO: 51933 - protein, 89 aa, Sorghum bicolor
  Clone ID: LIB5050-011-R1-XP1-D10.pep
SGAHIFCMEQASMSGRFLCAAGYPNMRDIVDHFAAKHPDLEIKLTEVTGEGIRIVPNTSKLEDLGFRFKYGVEETLDCSVECAKRLGEL

SEQ ID NO: 51934 - protein, 123 aa, Sorghum bicolor
  Clone ID: LIB5050-011-R1-XP1-A6.pep
AASPVLFFLYSTWPRSYPSAAIAMEKKAADVVVGEAMYSSGCPIWAEPTDLEIHEDTTGASLSTETSPTTESITLINPRINLGKCEHLCQVSDLNPGGQVLPQGIQPTDPWSVRCSDEDLRKE

SEQ ID NO: 51935 - protein, 224 aa, Sorghum bicolor
  unsure (1)..(224): unsure at all Xaa locations
  Clone ID: LIB5050-011-R1-XP1-A8.pep
MGNVSGAAAGAYSGKTALLLGAGFVTRPTVDVLAKSGVKVTVACRTLQKAQDLAKGIPNTNAISLDVNDADALDAEVAKVDVVISLIPYTFHATVIKSAIRKKKNVVTTSYVSPAMMELDAQAKEAGITVMNEIGVDPGVDHLSAVLTIDEVHKAGGKILSFKSYCGGLPAPECSDNPLGYKFSWSSRGVLLALRNQAAFYQDGKVKSVEGPELMAEAXPYFIY

SEQ ID NO: 51936 - protein, 80 aa, Sorghum bicolor
  Clone ID: LIB5050-010-R1-XP1-H7.pep
MGFMLRVRLASFFAGAAAAAASGGYFLYKDYKLASDSMALKVKGVQDSIDTRYKALEKRLAALEGQQSTGAAPDVDTPSD

SEQ ID NO: 51937 - protein, 148 aa, Sorghum bicolor
  unsure (1)..(148): unsure at all Xaa locations
  Clone ID: LIB5050-010-R1-XP1-E10.pep
MMNALENWLVKQCRKPLGRLQMHGGSSRLRKXGLRYYYLHDPYFHGEIKEVLGGLPREVIDARIQRRWRGMDLDVKHQYLRXHAHEEQVPLRGYLRRMVTLERKENAEREILAARPLYRRRLPYSVDRDGSKSSLYGKMTRDEIKCSG

SEQ ID NO: 51938 - protein, 73 aa, Sorghum bicolor
  unsure (1)..(73): unsure at all Xaa locations
  Clone ID: LIB5050-010-R1-XP1-D2.pep
SLRHPPPPKTCSHPTTPHNAPPPSPHTPXPPPPPSPPAPHPPPPPTPPPPPPRPPPPXPPAPAPPPPPPPTPP

SEQ ID NO: 51939 - protein, 69 aa, Sorghum bicolor
  unsure (1)..(69): unsure at all Xaa locations
  Clone ID: LIB5050-010-R1-XP1-B5.pep
MADAEPVDQKXYLEERCKPQCVKSLYDYERCVKRVENDGSGQKHCTGQYFDYWSCVDKCVAPKLFDKLK

SEQ ID NO: 51940 - protein, 156 aa, Sorghum bicolor
  Clone ID: LIB5050-010-R1-XP1-A4.pep
SQKGKTLTILETGEAVVSRDDDAGSCSQAQSSVEDALYGVVVCERQGVDQPVHAPKSPTHAFIFSPSSCNIRRCVAETAPEPRFTMVDGGSAGAMAAALERWRQRWSVGARRQQWRLQLPSPAVAPHREQGGTRLHQRLTITWPWWLGKSYDACMR

SEQ ID NO: 51941 - protein, 240 aa, Sorghum bicolor
  Clone ID: LIB5050-009-R1-XP1-H11.pep
GGPEQPLLMQVFFGGFSKDFYLEQVHRPRHYKGGDSAPLFGNFLEPLSKTPWWIVPSLWWPCVAVGTAVAFGGLSSTMELAGYWAFGLGFWTIIEYVLHRCLFHLDDHLPDNRFAITLHFLLHGIHHYLPMDRYRLVMPPTLFVVLAAPFWKFAHAVIFWNWYAALAAYCGGIFGYTCYDMTHYFLHHQKLPPYYQQLKKYHLAHHFADYQNGFGVTSRFWDRIFGTELEMGPSKVIKSS

SEQ ID NO: 51942 - protein, 108 aa, Sorghum bicolor
  Clone ID: LIB5050-009-R1-XP1-H12.pep
MEGLTSSEISGFVVGALLLGATIAAPKVDGFIASSQRRSLGMCKRCGDLRIVACSQCKGTGSARNGGIGVLDDLYESLGAEAKTDNLVPCTRCRSRGRLLCPECSKIA

SEQ ID NO: 51943 - protein, 167 aa, Sorghum bicolor
  unsure (1)..(167): unsure at all Xaa locations
  Clone ID: LIB5050-009-R1-XP1-F10.pep
KRKTEEAGVHAPEAPIMSINNCVFFIRRMTIDMCFNXYKNFIRLMQTPEVHKKVIARTSSSAEVTLQAGKLDILPTDDVAGDADAAADEDNKLVAQEDPPKAPNKLRMNCRKNVGLTVFQRHCXRTPSCSMHRYTDSHQXNFYYKIEGSEYIAKHNPVGMAHNIIQI

SEQ ID NO: 51944 - protein, 131 aa, Sorghum bicolor
  Clone ID: LIB5050-009-R1-XP1-F3.pep
MAVAAAARAGFRRLFSVSAFAAPPPPAARPAAEPCNNLFVSGLNKRTTSNGLKEAFSKFGQVIEARVITDRISGFSRGFGFVKYATVQEAGEAIKGMDGKFLDGWVIFAEYAKQREATQPSQQGAPYEYSS

SEQ ID NO: 51945 - protein, 93 aa, Sorghum bicolor
  Clone ID: LIB5050-009-R1-XP1-C9.pep
KEEGRKPEAMTSNKNTAATGAKVAMVLLLLATTLLLTTVADARPYLDVLPPSTSHSVAGNLLPHKIIPPSGPSDFWGGEPLPPHVEVKTNHGN

SEQ ID NO: 51946 - protein, 109 aa, Sorghum bicolor
  Clone ID: LIB5050-009-R1-XP1-D4.pep
MATFELYRRSTIGTCLTETLDELVSSGAVSPELAIQVLVQFDKSMTEALEMQVKSRVNVKGHLHTYRFCDNVWTFILTDATFKSEEIQETLGKVKIVACDSQLLQPQQP

SEQ ID NO: 51947 - protein, 217 aa, Sorghum bicolor
  Clone ID: LIB5050-009-R1-XP1-B9.pep
MSLGAEVIELSSDEEEEPVPSTTALARHAPSSPPDVKPHLFADVDVKPLLLPPPLHPPGYGALVPVKTEEPVPVPVATVSPPPRALPPPRLCRQFWKSGDYVVARRNPDADVPGGRNRLRINPKFLHSNATSHKWAFGAIAELLDNAIDEVNNGATFVRVNKFKNPRDGNPSLLVQGCHIYNVNLFIFIWTVIWIPDCNLVVFHIDKMHAGGMDPEA

SEQ ID NO: 51948 - protein, 189 aa, Sorghum bicolor
  unsure (1)..(189): unsure at all Xaa locations
  Clone ID: LIB5050-008-R1-XP1-G5.pep
PVDTFIKHSTQDRAARVIRSRRIHLPTRIRAPAPPRAIAAASASHTAIREGGRGAMGAGMEAEEGVMATDFFWSYTDEPHASRRREILSKYPQIKELFGPDPWAFLKIALVVSLQLWTATFLRDASWVKLLTVAYFFGSFLNHNLFLAIHELSHNLAFTTPSXHRWLGIFANLPIGVPMSVTFXKYHLE

SEQ ID NO: 51949 - protein, 154 aa, Sorghum bicolor
  Clone ID: LIB5050-008-R1-XP1-G12.pep
TAAAAKEGKTPKHHTDPAQGPLDPNARTGKPPLAVIVTASATPPNWRRPNRHYGRRREDAGAPHKSGPRTTGSDRGDRETTTGRHSRHLGDTSKPLMHQEVRKKAPPPPSLRPRRLSATRSGGGKAEGDGEGGGGARWEVRPCRPRGTTQILSR

SEQ ID NO: 51950 - protein, 131 aa, Sorghum bicolor
  Clone ID: LIB5050-008-R1-XP1-C7.pep
MAMSWTRGLKHGVVPRHAAQLIESRSLAIASKGKKGGKGGAADAAKTPALSQELKSTTVFGANILKEGSDPKIQPDSEYPDWLWHMLNKRPVLSELRRKDPKTLPYEDLKRFVKLDNRSRIKEKNALTAKN

SEQ ID NO: 51951 - protein, 117 aa, Sorghum bicolor
  unsure (1)..(117): unsure at all Xaa locations
  Clone ID: LIB5050-007-R1-XP1-G9.pep
TVYKHMELHCIPDEIQILLNMKPGLTSHGGDAQEAAKSILPLLDKESALYRCELXKRTPLKLAATAALRLIANQQAQQILDALRDLVHKKSKFQCKANCINVLEGSHEGSYLWAALN

SEQ ID NO: 51952 - protein, 95 aa, Sorghum bicolor
  Clone ID: LIB5050-007-R1-XP1-H3.pep
MAKFLNYTSVQVLFILSMVLLASCVTHAQIISGEAREVSKTGSTTMTTMVAPRKIIDDNKNLLCYLKGALYCCDLIRKCWHDIKECWKRCHGGKV

SEQ ID NO: 51953 - protein, 110 aa, Sorghum bicolor
  Clone ID: LIB5050-007-R1-XP1-G10.pep
RGRAGPLRLFIAQQNKPLLSFRSVMKGKIAATTGLVLLLLTLAGAEAKVCQWVAPTDVVCQQSTCLPLCISKGYTDGYCTQLDRKCACTKECTGDGGSGRGEGSSGDDRV

SEQ ID NO: 51954 - protein, 193 aa, Sorghum bicolor
  Clone ID: LIB5050-007-R1-XP1-C7.pep
PGRSMAGHYRTHSRSQNPMGNESFGHHGLPTAVQAPSATGRMSVAVVPYPTSFPFIYPMTNQVMMRAPSRFALPSPSMPFWMMAQHQIQPQPQAPLIYGTVFHSYTVMSCPCHAATAVVPSPHHAYPANQSGVVQADLTLRLGSGIGGNSRGDNRQLLEDGCHGKRPMLVMDGGDRSGEEGNNADGLDLELRL

SEQ ID NO: 51955 - protein, 155 aa, Sorghum bicolor
  unsure (1)..(155): unsure at all Xaa locations
  Clone ID: LIB5050-007-R1-XP1-C9.pep
KSCSLRLALLALAESDASTLTTGGCGCQTHHLLPPPCHLLPLLHLPPAGHLPPSVHEIPPXPQCHARPTLHASLLHVHVHRYPPHIICCCPGMLGSWGAGLSPITLPNLPQGLEEQRDRGPTVEEGMTDCHHVINRETMVGKTFILWTQLSPIRS

SEQ ID NO: 51956 - protein, 252 aa, Sorghum bicolor
  unsure (1)..(252): unsure at all Xaa locations
  Clone ID: LIB5050-007-R1-XP1-C11.pep
GLRILRHVPCLEVPNLRKLDLHLFDASEMELDDMLSGCANLEWLSFIRCQVNDELKVKQPLSRLLYLRIAHCSIKKVELHAKNLKTFVYRGVQLPIDLGEVKKLETAELRLYGVTFEYVLSVLPSVLPGVQNFTLKTSYLPEMPLLLENIGKFSQLRFLRLLLRVHCSESNNILSLASFLRAAPLIEEVEVHFDAFCLQRVGWGSLRSLPPHSYNYLRKVHITGFIGIMGQLEFLAHIVXNAPALRILNIDP

SEQ ID NO: 51957 - protein, 75 aa, Sorghum bicolor
  Clone ID: LIB5050-007-R1-XP1-A6.pep
REVSMHALLLNDDPVYITSISVGPRGAARLQHLSYIVQLAYAPLCHAPGVVNLRGAPGAQSRGRCLLYDRVNMHM

SEQ ID NO: 51958 - protein, 70 aa, Sorghum bicolor
  Clone ID: LIB5050-006-R1-XP1-G9.pep
MSKARNALVATGLLVFAGAGLSFPFLFVKSKNRPIIDSSKPLPPQATFRGPYVNTGSRDIGPDPTNYPKK

SEQ ID NO: 51959 - protein, 171 aa, Sorghum bicolor
  unsure (1)..(171): unsure at all Xaa locations
  Clone ID: LIB5050-006-R1-XP1-H2.pep
MELPTRRAGRSAPDRGFAAAPRVGRGAAVSCCWEKPGTLCLLRAKSPSLPRHSRKVEWAIRTMSDDSGDQSSNSTRLFSAIRSFWNKLSAKLKKARKGLPVKILFFLIGFYCATAFATVIXQTGDWDILSAGLAVAVVEVIGALMYRASFALLGRIRNMITIFNYWKAGLT

SEQ ID NO: 51960 - protein, 153 aa, Sorghum bicolor
  Clone ID: LIB5050-006-R1-XP1-H3.pep
MASSSSSNLLAAAVLLSVLAAAGASAGTTCVPGWGIPHNPLPSCRWYVASRTCGIGPLLPLPELRRRCCRELADIAAYCRCTALSILIDGVIPPGPDAQLEGRLEDLPGCPRAVQRRFAATLITEAECNLPTITGVAECPWILGGETMPSKYD

SEQ ID NO: 51961 - protein, 124 aa, Sorghum bicolor
  Clone ID: LIB5050-006-R1-XP1-D9.pep
NVGLIYWIELLLSPEAWIQERPSRGLADRIMLMAAWSVLGCRTEDESLQDRAIFRLCFTCNRFICFQVNDRCHTKFFICPTVYFSASLVAHIVPHMSSYSKLLLLCRGGKVLLPSSMPLSLLPA

SEQ ID NO: 51962 - protein, 79 aa, Sorghum bicolor
  Clone ID: LIB5050-006-R1-XP1-E3.pep
QTEAINHVAQKMKYKQPGPHPTSSATRPLAGNLRAPMVGPLQPMSPRPRTIGGRCVDTPFTGSPHARHTRAAAGSRSSY

SEQ ID NO: 51963 - protein, 158 aa, Sorghum bicolor
  unsure (1)..(158): unsure at all Xaa locations
  Clone ID: LIB5050-006-R1-XP1-D4.pep
MEASGERAAVVRRLMEVKEESGKTFSEIAAETGLTNVYVAQLLRRQAHLKADTVPALRAALPTLTDELVQLMMQPPFRSYNPDIVQEPAIYRLNEAVMHFGESIKEIINEEFGDGIMSAIDFYCSVDKVSXADGKDRVVVTFDGKYLPYTETESEHMM

SEQ ID NO: 51964 - protein, 152 aa, Sorghum bicolor
  Clone ID: LIB5050-005-R1-XP1-G11.pep
SREEEVEESKTIQQTGETPSTRCEAGPQATTCTRGRRPFGLDRMKSRLCCYFNLLLIDERSRQAGRQASLSQFFGGGCCTVPLAFASAPFGGIAGVWAFSLARSALMTSELSVKIFKASSGELVFRIFNASFLASSISLEVRVGASTRPSER

SEQ ID NO: 51965 - protein, 43 aa, Sorghum bicolor
  unsure (1)..(43): unsure at all Xaa locations
  Clone ID: LIB5050-005-R1-XP1-F8.pep
GAAAAPESAPXTGLATAKLASGGXXXRVAXLDXLVSXCGYERG

SEQ ID NO: 51966 - protein, 139 aa, Sorghum bicolor
  Clone ID: LIB5050-005-R1-XP1-D4.pep
MANPRRAIALHIQTQPPPLPTTAASALPPHSSVASSLLHFLKRPASFPFLLSLFVLLTWLSLRFHHPSPPPSLGGRPSVVHDPQANLVRFPAELHPTPIARDGRGWLLDPVAAARDAGLPGVVGECMTEHNYYIRSIVD

SEQ ID NO: 51967 - protein, 83 aa, Sorghum bicolor
  Clone ID: LIB5050-005-R1-XP1-C6.pep
WWRVSPAGIPPSGSSPSPAVRHQLIMVCSIQDLRRSPWLAGNKGLTIQLCVLSRLSLTRSCNANKWGHYSQALRLDGQFKLTM

SEQ ID NO: 51968 - protein, 81 aa, Sorghum bicolor
  Clone ID: LIB5050-005-R1-XP1-D11.pep
CGGNCGCGSGCKGGRGCGGGKMYPDMAEQQVTTTAKTLVMGVAPSSKGHAEGGFEEAVGAGAENERSKRGPNCSCNPCTCK

SEQ ID NO: 51969 - protein, 94 aa, Sorghum bicolor
  Clone ID: LIB5050-004-R1-XP1-F7.pep
MDSGVPAPALSAAKVKLCRRCKASYDPSANTRLSCRFHPSFFVCRRHDDQKRYYELRDGDPPYAAKFYDCCGAEDPDAPGCTTDLHRSYDDAQD

SEQ ID NO: 51970 - protein, 72 aa, Sorghum bicolor
  Clone ID: LIB5050-004-R1-XP1-D6.pep
PGSLQYHYLLLRKGRTSAHHVRFQPTTKRVESCMLYRRLQLMSFICIEDDDCWPYRNIQKESCLCPILQVLF

SEQ ID NO: 51971 - protein, 71 aa, Sorghum bicolor
  Clone ID: LIB5050-004-R1-XP1-E5.pep
PGTLTKRADAQLTLGYAPTSPLIYAFVARGTVRGAPLPQIPGSYTHHQPSEPEDISPAGTTRSATTATGTP

SEQ ID NO: 51972 - protein, 208 aa, Sorghum bicolor
  Clone ID: LIB5121-004-A1-PF1-G4.pep
MLLCANPPAPPIPSSKPANPTPAASDSDSPVMARQALECESSASQNGRSAAGSQPVSDLDPAAGKDAAPRGRAATAAELEERLLKRLDELYAAALARLADLGHGEEASLEAVLHSGHCYGKLRDPVSNIVANTRAYLSDPPHASRAGGFADLRRLEEYSLAGLVCLLQSSCHTLTRAEGFQCLLASDLRLEEAIAMALSLNGERSPAS

SEQ ID NO: 51973 - protein, 135 aa, Sorghum bicolor
  Clone ID: LIB5121-004-A1-PF1-F10.pep
QIPKPEAALDRVSFRSISREGVELHSHVDVSNPYSHRIPICEITYTFKSAGKVIASGTMPDPGWIAASGSTKLELPVKVPYDFIVTLMKDVGGDWDIDYLLEVGLTIDLPIIGAFTIPLTTEGEIKLPTFRDLLF

SEQ ID NO: 51974 - protein, 114 aa, Sorghum bicolor
  Clone ID: LIB5121-004-A1-PF1-F7.pep
MPAQQPTTFKRFVEVGRVVLVNDGPSAGKLAVIAEIIDHNRALIDGPTTSVPRQAFSYRNFILTPYTIAKLPRGAGSGAIKKAVEKAGVLEKWESSGCPNKLAARQVRKNSSDF

SEQ ID NO: 51975 - protein, 132 aa, Sorghum bicolor
  Clone ID: LIB5121-004-A1-PF1-E10.pep
HQQLVFALWYVVPNRVSWPSRASCTLTSWMFHRVGLLVYFLFSSSDLFLSSSLLAGSPRLSAMAGPGLALWCSKVAAPPLVALVSVSCREWEEAVESLDSFATWSVMLPVASSSLGRTGMLMDSVDVSVGFG

SEQ ID NO: 51976 - protein, 121 aa, Sorghum bicolor
  Clone ID: LIB5121-004-A1-PF1-D4.pep
KLYALSIGAHAALQVNLSAAGTSAESTACSSSLTHSMLPAASRSQRSGYIARLLCPRARQEAPRNACSLWPPRSKLSAFQLSNTDRPAPLRAAAAAISATVPSTLDEAPTFCYPPSCVGAE

SEQ ID NO: 51977 - protein, 185 aa, Sorghum bicolor
  Clone ID: LIB5121-004-A1-PF1-C9.pep
YIYVIDTSCNASSVFARSVLGTVKVKGPGIRNLVANAVAGADASSPAVGRNLSLGPQTNGRSSLVVNSDVVLGVVHVEARLHGLETKPVLAVTAGVDRTWNFLNGSTGACAFEVGGVVAAELEANRFDLIKVPAQGVVSDGDHLTALGGGGERNSGVSEESSSGDELHGNGLGLRDCCLGDFGRC

SEQ ID NO: 51978 - protein, 173 aa, Sorghum bicolor
  Clone ID: LIB5121-004-A1-PF1-B6.pep
MAPSKARQKRSLPQITTIAGTGPIANSQPASSTLTKEVDQQEEQCLKEPKIPPLPPITVNVVPQQGLGCEVVEGLLLPSRKREYKSNGKYTVGNHPIYAIGFNFMDVRYYDVFATASSNSVTVYRCLENGSFGLLPAYVDEDKDESFYTSSWTINKVDRKPLLVAAGNNQIIP

SEQ ID NO: 51979 - protein, 147 aa, Sorghum bicolor
  Clone ID: LIB5121-004-A1-PF1-C12.pep
STARDPIAMDPPPAEDSGRRPPRKGGKAREHRLGLKKASILAPSPPPSSSLAPPPIPPPPPPISSSTVPTTMPAVPIPSTAAPTPAPGLPSSSPAALTSTMPPQALQGAGWGAIPPKFSISLWKPSRPKFMGGNLAWISYLQSHLAE

SEQ ID NO: 51980 - protein, 116 aa, Sorghum bicolor
  Clone ID: LIB5121-003-A1-PF1-H8.pep
MRTGAEELKKATPECKLRSRRPVQIELLPPPQPLRTTPNQRKRKAPASAAAAEDDAEAEELESVEELEREVADLDRRILEHLGSTATRLSDAAVSRVTALRPTARLGTTPGHLKDL

SEQ ID NO: 51981 - protein, 94 aa, Sorghum bicolor
  Clone ID: LIB5121-004-A1-PF1-A5.pep
HSISFDGVISIIGFLGGVKGEKQPTFLECLNNICTVRGVLVGNRLQFEEMNRAIEANDIKPVVDEKVFTLDQTKEAYEYMWNAKHFGKLCIKID

SEQ ID NO: 51982 - protein, 176 aa, Sorghum bicolor
  Clone ID: LIB5121-003-A1-PF1-H2.pep
CSIVSIYFIDRTGRKKLLVISLVGVILSLAVLTAVFHETTSHSPAVSAAETAHFDASLTCPSYRSSSSSWDCTRCLKAAGSSECGFCASGGGELLLPGACLVSNNTVRDACHGEGRLWYTRGCPSRYGWLALLGLALYIIFFSPGMGTVPWIVNSEIYPLRYRGVCGDAAGTANWV

SEQ ID NO: 51983 - protein, 271 aa, Sorghum bicolor
  unsure (1)..(271): unsure at all Xaa locations
  Clone ID: LIB5121-003-A1-PF1-H3.pep
MEAARESMAALLDAGLFGPAQTLGCFLVSSAGAGNDAGMSMKVESLVQHGDALYGEREFRRALNAYKQAMQYSRSIPRQATSSTRSSVSATGRSPSPNSSNLLSFNENEVKFKIALCHSALCEHREALHEMEGIPSKVRTLKMNMMLGKLYRISRNSRTAAVCYKECLRQCPYVFEAITALAEMGLSAKEFSLLFPQAPNRGGKVPGDFVDAQRWWTRYVEAQCCIASHDYKGGLDIYLELMQRXPNNVHILLEIAKVEAIIGRNDEAIMD

SEQ ID NO: 51984 - protein, 169 aa, Sorghum bicolor
  Clone ID: LIB5121-003-A1-PF1-G4.pep
MAARTSIARAARQFTSAAARRPSPFVCQRWQQATSKQRLFSVSAALKEKKYTEDHEWIEMSADGKTCTLGISEYAAKALGDVVYIELPQVEMDVSEGDAIGAVESVKSASDILTPISGVVAEVNSALEQTPANVNKDPEGDAWIAKITVSGEPSGKTMTKEEYAAFTEE

SEQ ID NO: 51985 - protein, 122 aa, Sorghum bicolor
  Clone ID: LIB5121-003-A1-PF1-F10.pep
GSPPPHARTHVSACHGRPPRPPDRPATELRRSGTVTTPVQPRDSKIDAKMCFPDVVLGHAAPARAAAGAPPPQSPSPLPPLSLPLRGCRRPHQPRVKLLTPGAPHVTRRHEHHDALEYAPLH

SEQ ID NO: 51986 - protein, 213 aa, Sorghum bicolor
  Clone ID: LIB5121-003-A1-PF1-F8.pep
SGQLALQAKTKIHEKYHHKAQKTTKMSKPVHPATVHFPIAFLSLGYGLDILHSLGGNLPNVIANALPPANDLSRAAYYMLSLGLITSIPAVMSGGQQAVQLFSKQGMYEADGKTLKLKSKAVIAHAVTNDLVLAVTTYLWYSRRQQAANTLAGKLGVESLATAEAAYAPQMWQVIAEVLALGVLLFAASIGGALTYNYGVGFAPAGKSGKKSQ

SEQ ID NO: 51987 - protein, 202 aa, Sorghum bicolor
  unsure (1)..(202): unsure at all Xaa locations
  Clone ID: LIB5121-003-A1-PF1-F9.pep
MASKNQVDLESQKPAPATADAVVASAAPITVTALPVSSGGASSVGRNSGSVVVGVSDGRHVAPETQPLLLAELPNGDSHDDEGLGDDDGGATSTTGDEATRLERAMAKAFRSTAELAKHLPTGAVLVFEVLSPVFTNGGKCDDVNRVMTAWLVGLCAAGCFFLCFTDSFHDAKGTVRYVVATRRGVWXIDRTPPPSPEKPPR

SEQ ID NO: 51988 - protein, 131 aa, Sorghum bicolor
  unsure (1)..(131): unsure at all Xaa locations
  Clone ID: LIB5121-003-A1-PF1-E10.pep
VSRWIAEILSVHRPGGVGYNITVGLDVEWRPSYRSYQNPVATLQLCVGRSCLIFQLLHADYVPGALAEFLGDRGICFFGVGVAADAERITDDHGLQVANAVDLRGRAAKCMNRPXLRQAGMRGLMRAVMGV

SEQ ID NO: 51989 - protein, 201 aa, Sorghum bicolor
  unsure (1)..(201): unsure at all Xaa locations
  Clone ID: LIB5121-003-A1-PF1-E7.pep
SSPLSSSRLSPPLPRASLPRRLPRLSRPPPPLAPVPPVSASDVPAVATLGSERPRPRLRLRPSPPPPPLPPALLVSASDELAVDTHGSERLRPRPPPRPSPPPPPPAPDLLDSASDEPAADTRGSERPRLRLRPPPRPSLPPPPLAPDLLDSASDEPAADTRGNERLRPRAPPRPSPPPPXPAPDPLERASDEVCGDTVEA

SEQ ID NO: 51990 - protein, 128 aa, Sorghum bicolor
  Clone ID: LIB5121-003-A1-PF1-C8.pep
RPIWIKTCCVCVCVFQPNLITTSVKEMMDGPLPLAVAMAADDQDLGVVPIKRVADDAPGVTLDGFVADVDHLHQKDREEVLQRPLQPVIAVLAVVDAHHHHITGFPPDPGDDDDDDDAGRRLGTMAGR

SEQ ID NO: 51991 - protein, 67 aa, Sorghum bicolor
  Clone ID: LIB5121-003-A1-PF1-D4.pep
GRSRPGRECSDEDYVMRRNAVDFGVPLFMEPKTAVLFAQCMNVKLPKAEGVPAEVRRWSDFIGGKPL

SEQ ID NO: 51992 - protein, 89 aa, Sorghum bicolor
  Clone ID: LIB5121-003-A1-PF1-D5.pep
MSGGGAASASASGSFEHHHAKRRPPTPGPPQQPPPQQRKLLTLSVQDNDGVAAGVVPPVTVVLDGRCICHRVHLHRHTGYRSLGDTTPR

SEQ ID NO: 51993 - protein, 112 aa, Sorghum bicolor
  Clone ID: LIB5121-003-A1-PF1-B9.pep
QGRRAETASVSTAHSHRRGDVHVRLYSTRLSDKATRRVALKGSVPMTVSMDHQPAAHGELVSIAGLTLDVNKKLTAGIDSILKPQLPVPESRFYLKFYESNALGLRLKPIHL

SEQ ID NO: 51994 - protein, 210 aa, Sorghum bicolor
  Clone ID: LIB5121-003-A1-PF1-C11.pep
MPSSSSSSSSSQSRSRPCCWLPLLLVLHFSRRATAAGKVPALIVFGDSTVDAGNNNFIPTVARGNFPPYGRDFDRGVATGRFSNGRLVTDFLSEAFGLPSSVPAYLDPGYTIDQLATGVSFASGGTGLDDLTAEIASVIPMSQQLEYFKEYKARLQLAKGETAANGIIAEAVYIFSIGTNDFIVNYFTFPLRQAQYTPAEYAAYLVGLAE

SEQ ID NO: 51995 - protein, 120 aa, Sorghum bicolor
  Clone ID: LIB5121-003-A1-PF1-B7.pep
LRIGRHRGFGKRKGTKDARMPSQIVWMRRLRVLRRLLVKYRAAGKIDKHLYHELYHLSKGNTFKHKRALVEHIHKAKAEKARERAIQEEMDAKRAKTKAARERRQERVQQKRQAQLGDEE

SEQ ID NO: 51996 - protein, 205 aa, Sorghum bicolor
  Clone ID: LIB5121-003-A1-PF1-C3.pep
MDVALSTTMAVAVVIALFIPALLLTLVQRRQHTGHNKPPPDPPEPRGIPLVGHLHLLIKKPLHRTLAHLADRQRHGDVLGLRFGSTTRVAVVSFASVAQQCLVALDTSFGNRPRLPSAKILSYDWSTMGHSNCGAFWRQVRRTAATEISSVERVQHFADVHEQEARAMARRLCRVALAASEGRALVDVKARLWEMLMNGLLHMLC

SEQ ID NO: 51997 - protein, 171 aa, Sorghum bicolor
  unsure (1)..(171): unsure at all Xaa locations
  Clone ID: LIB5121-002-A1-PF1-D8.pep
QRPKGGSGVVFNFYSPSSVHRSFAPHAASYLRLPPHADVAIGLPLFRSVSARPQQAEPAATGASPTKPVLPDLDDPGESSSVLLFAAIFCLLFVSLANATLFLPGRRPMRRVAAHAFVPESTPPYCCPLCPKVLEMEMRLSXEKGKTRLGWEEVWNKRSCSCFFADVLADF

SEQ ID NO: 51998 - protein, 98 aa, Sorghum bicolor
  Clone ID: LIB5121-002-A1-PF1-E10.pep
LKPNRSRLRDFCKVGDGTRDSINPDSVRIDRAGGPCLVAASIPQAYPCHPPKIVWPPQEIPIQFESLEGCLFTARMGVVWWRLRSLQSCLASRGVLRH

SEQ ID NO: 51999 - protein, 123 aa, Sorghum bicolor
  Clone ID: LIB5121-002-A1-PF1-D12.pep
WCDDILPSGHRVRRGEVILVSIYAIGRMESVWGKDCHEFRPERWISEDGTRLQYVPSCKFLAFNSGPRMCLGKDIAIMEMKTIVAAVLWNFDVEVLEGQSIRPKLSILLQMENGLMVTVKKRT

SEQ ID NO: 52000 - protein, 165 aa, Sorghum bicolor
  Clone ID: LIB5121-002-A1-PF1-C6.pep
DALFSASGDAVAALLVRDRLLVVAVPRLADLDVILELDEEEEEAGDAMMLSSTSSRPGRESKLRRRARPARDLSSIHRVALKESRNRTLAIASRRLPSTDDRFLALGVSSSMDGETETSETTTACFLPGLSSSSKTRRSGWSRGRQGEGRGELQREWRRRLFFGS

SEQ ID NO: 52001 - protein, 146 aa, Sorghum bicolor
  Clone ID: LIB5121-002-A1-PF1-B9.pep
SETATWFPRLQGSGSAPLCSAREPALGAPALLRNPAIGAPAFLRNPALGAPALLRAPVLFGAPALFRAPVTTNAADVAKKPTTKVAPDSANLIWLQRELTEVSASSAARFGALHREILSMSAQLKKAQADHDNTILQCPRDVCHET

SEQ ID NO: 52002 - protein, 159 aa, Sorghum bicolor
  Clone ID: LIB5121-002-A1-PF1-A4.pep
MAYGGAARGRLAEERKAWRKRHPHGFVAKPATLPDGSVNLMLWNCVVPGKEGTDWEGGYFPLTLHFTENYPSNPPTCKFPRRFFHVNVYDSGDVCLSILGDAWAPSITVPQILVGIQGLLDNPNPASPAQDFAYDVFAKNMPEYKRRVREQAKRYPSLV

SEQ ID NO: 52003 - protein, 213 aa, Sorghum bicolor
  Clone ID: LIB5121-001-A1-PF1-H12.pep
MSDGEVEVEAPQGYPVLPKDVSQEIGSTKLFNKWSYEDVEIRDISLTDYIQIRTPVYMPHSAGRYAQKRFRKAQCPIIERLTNSLMMNGRNNGKKLMAVRIVAHAFEIIHIMTDQNPIQVAVDAIVNCGPREDSTRIGSAGTVRRQAVDVSPLRRVNQAIALLTIGSREAAFRNIKSIAECLAEELINAAKGSSNSYAIKKKDELERVAKSNR

SEQ ID NO: 52004 - protein, 122 aa, Sorghum bicolor
  Clone ID: LIB5121-001-A1-PF1-G12.pep
FQTGDSESPTVRLGPEDERREDPVATAPWPSPDDERREDSSSAAAHWLLARCRRLPTSSSGSLDAAPPPRPCVATLRQSNGGGRAKELVGIAGGRPVLQSAVHSTSALAYCSPRSSAPVEKK

SEQ ID NO: 52005 - protein, 108 aa, Sorghum bicolor
  Clone ID: LIB5121-001-A1-PF1-E7.pep
MGFEKGDSKKGANLFKTRCAQCHTLKEGEGNKIGPNLHGLFGRKTGQVEGFSYTDANKQKGIEWNNDTLFEYLENPKKYIPGTKMAFGGLKKPKDRNDLITFLAEETK

SEQ ID NO: 52006 - protein, 111 aa, Sorghum bicolor
  Clone ID: LIB5121-001-A1-PF1-F10.pep
VFLTALASTTLCQARLPPRGRPPSTPRCIGRGPAGVHWQGRSAATSTGARRLSGFETQLQVIFRGAFWLRFWAPLQRDEQAKAILSAISKKLEIIVLDISNKGWKHLYSLF

SEQ ID NO: 52007 - protein, 193 aa, Sorghum bicolor
  Clone ID: LIB5121-001-A1-PF1-E11.pep
KLGVMVDHWPVHAARRTRALQSLHAVSLLHHLDNLEEDANVMRERGDRDGLREPRQMFDGHIDDRTAPPSVRVQRHGGATEDHAEEQRGGVEPQRPPLHRHFRLALPAAGTLRAGYQQHEAGEGHRDGALRGAGCRRRVVAAREDGARVHGEREGEVPAHQEDAGEGDEERQVHAFCCIWALTGVRLVVRKED

SEQ ID NO: 52008 - protein, 202 aa, Sorghum bicolor
  Clone ID: LIB5121-001-A1-PF1-E12.pep
MAGLRFTVLLTAYSFGVLLLLLLAASASSASASRPPAVYFVGDEWRTAPASNGGTHKTLSKWAMRHRFYVGDVLDFKRSNDSVLLVRWRDYKRCSAASPPARRFADGGDTRLKLAHPGLFYFISGAPARCEAGQRMVLRVVDARSSLGGDGAPTLAPAPAPGPWTMEPTNVTNPPSDRPIPVWFKLLAPALLGFLAGCSLQG

SEQ ID NO: 52009 - protein, 173 aa, Sorghum bicolor
  Clone ID: LIB5121-001-A1-PF1-C11.pep
MAAVENDYRRGAKVTSAQSNSMGPAPRPSSSSRARLHDFSFPTLSWGTHRVLRCSKNGPASSSPASPEPPSPDKEKAHRPEGGGSLTLQRQRQRAARRPWNLRTRRSATAATTRQAGSDDADEAAQAAVDRAPTPTAEAKKRAFSFSIALSKQEIAEDFAEIPGTRPPRRPNK

SEQ ID NO: 52010 - protein, 97 aa, Sorghum bicolor
  Clone ID: LIB5121-001-A1-PF1-B12.pep
MDNRRHPSSFQQLEKLGEGTYATVFKGRNRQTGELVALKEIHLDSEEGTPSTAIREISLMKELRHENIVLLHDVIHTENKLMLVFEFMDKDLKRYMD

SEQ ID NO: 52011 - protein, 166 aa, Sorghum bicolor
  Clone ID: LIB5121-012-A1-PF1-H9.pep
MATSTNNAPNGIGPVPLPFNNAGNGVDADADAEKKDPRVKEYESLASSLPSNPKLRLRCYQGTWVLAPWVPGIMAVQRGLFAPRRGDVVLASAPKCGTTWLKALAFATTARGAHPPAHDAAHPLLRLNPHDCVPFMEKLFAAGWGSRMDALPSPRLMATHMHHLAP

SEQ ID NO: 52012 - protein, 169 aa, Sorghum bicolor
  unsure (1)..(169): unsure at all Xaa locations
  Clone ID: LIB5121-012-A1-PF1-H10.pep
MPSSASPPAQPAAPPPPPPPASPAPPEEVEATAGSPSRASAVGTVNWGTATLVGVFAGLLYGGSREASASVSKDAEVMLKMGSTTDKREQYRLMRDAMEKRFIRVAKGSLXSGVFELGMFTATFFGIQNFLIDTRGVHDVFNIAAAGSATAACFWAYIARLNEVAVPRN

SEQ ID NO: 52013 - protein, 88 aa, Sorghum bicolor
  Clone ID: LIB5121-012-A1-PF1-G1.pep
MASLCRSAAAAARSAAVRSRSSMARPFLAATSPVSPPRIRRPLIAAALASLESLMPLHSAVAAARLRSCIAVDSACWSCLSQGLTKRI

SEQ ID NO: 52014 - protein, 119 aa, Sorghum bicolor
  Clone ID: LIB5121-012-A1-PF1-F10.pep
MSVVVLDGSTVRGFVADEPAFAHSVDARFAALDANGDGVLSRAELRRALESFRLLDGAGFGSADPAPLPGEVAALYDAVFEQFDADGSGAVDHAEFRDEMRRIMLAVADGLGSQPLQVA

SEQ ID NO: 52015 - protein, 47 aa, Sorghum bicolor
  Clone ID: LIB5121-012-A1-PF1-F12.pep
TTPTSSTHRTSHCCAPSLVARPYHNNIQRTGRRGTGVGGERGLEEGR

SEQ ID NO: 52016 - protein, 87 aa, Sorghum bicolor
  Clone ID: LIB5121-012-A1-PF1-E3.pep
MPRAAVTTLLSLSRRRGYAAAAEVRVRAPAAAMAARAPGAGGAADGASSSKEVFWMRDPQTGCWAPEDRFADVDAAELRARLLARKD

SEQ ID NO: 52017 - protein, 171 aa, Sorghum bicolor
  Clone ID: LIB5121-012-A1-PF1-D11.pep
PPLISSPYGSHRVAPAAPPPSPPPAAPPPPSPPAAAAGSPSRWRRLLILATSCRGCSSPVRPRLARMRLGVCAARPTCTWLPGSDTTYLSWMEAPAEERPFRIDADLNCGATHLAWICRYKVAPLSLPAAVQPVSMVVPCSSRRRMGSQATDLASKHVDPDSSLSAAGFGR

SEQ ID NO: 52018 - protein, 155 aa, Sorghum bicolor
  Clone ID: LIB5121-012-A1-PF1-C3.pep
MASHLDFRYLDEGLGGERGKRKRREEADAAAADSMDLDADAPRPSKLRAMPSLSDPSKPASFGQPTYDGVIAGRVSGRRWKEPRTRRASALVVSRKPTPLEQRVREKSLKRAYQERKAELKEEIRQNKVAKRKAREEREKRKQENVLRPHTKLPT

SEQ ID NO: 52019 - protein, 270 aa, Sorghum bicolor
  Clone ID: LIB5121-012-A1-PF1-B4.pep
IVIGCPPAYRGGTTKGTDLEINLMKLFPKSSYFIEKPVGTGTVSAAKEVTQQLIQNGNIVSVGYMLRYLRCVQKMKQIIHDNNLTVMATNARYSCAYESIGKPAWWNKAIDMGPVIEQGTHFCDLSRYFGGDVDINSVVAHSVEHYEAPGKLSKIPIDESKIPEELRIPRVTSAVWKYDNGAVGSFTHTVSLQGHAYACEIEVWADGYHMRLVDPYQAPTLYVRRPGDDHEERHVYTDDDPFFSESSNFVDCIEGGQTIHFFFFEELPDL

SEQ ID NO: 52020 - protein, 161 aa, Sorghum bicolor
  Clone ID: LIB5121-012-A1-PF1-B2.pep
REARCSPTRARALRFRRWPWRWTTVREMTACTTAASSSLAVSVMSCFRDWLDALCSCATGWGSAGGASTTPSLEQRPPIAEGAEDAGSEEMQGREGQSARRPARPTGSGRGQEAASLVVGGGARREEVAMEAWRLRPPEQKNAGTRVSGEGAGQLRAFCTT

SEQ ID NO: 52021 - protein, 134 aa, Sorghum bicolor
  Clone ID: LIB5121-011-A1-PF1-H9.pep
MRRHGGSEASPSIIHTSSIALLQERFRNLQKVKEMREGRALQRVHTTDTDRTGSSSSLSSALSLGLQAANSNEQPRWFLHPDLIRPSRPLRGPAYYHGLGANGVQTSPPPASSWGGMQNSGYRADVDVDTSLHL

SEQ ID NO: 52022 - protein, 82 aa, Sorghum bicolor
  Clone ID: LIB5121-011-A1-PF1-H1.pep
VKVAGILKEDRVRRLTRQRGDLVGLLGTFADDEDLPWEHGEDDRDGEAQRSDVHRRHAQFNAAKREERPGFRGSPARRLSGR

SEQ ID NO: 52023 - protein, 204 aa, Sorghum bicolor
  Clone ID: LIB5121-011-A1-PF1-G12.pep
LRDASLIGYERNSDRIPATFYAPVLRNMNRWQWAITIIQFAADPALTTRSTSWYVWSLFAHHPISETLPTTGSYGPVWWGAGKDDARDALVWKGACYNTTNGEDEPVTVRFDGVKRGTKATLTLLTNPGGDPYQYNDPLKGNNIVESTTTVISADKKGAFHFSMPQLSVAVLDTDTEVDQPGHHGGHHGKAPKYGGGNKDKRKC

SEQ ID NO: 52024 - protein, 164 aa, Sorghum bicolor
  Clone ID: LIB5121-011-A1-PF1-G2.pep
LKNFGPLATFQTNPHRLHIKMPRMVAPPPSGEFQIVLSKPFNGAPTHMIEVIGEPNRPASIRMSNYNGNSKSSEKKGDVPQDDVKELMSLISTLRGFPSHPSKDVYGLDTKVDFNTMEIQWGNQDDDAAMDGGDLAGEQKDEFKRIADSIEALARQFAKQDSPV

SEQ ID NO: 52025 - protein, 154 aa, Sorghum bicolor
  Clone ID: LIB5121-011-A1-PF1-F2.pep
WKPPFGCLLVNNFAFHQKPKMAARIPCHRHPSSSSSSMAMICPRSSTRQSSFRFRTSAHGSSASPHLSFTAVTDKKVQVFEDQLRGIVCYRDENGEMICEGYDEGPRLGMRLPEKASFPWPVGVRVTDFIQLATLQVFEDVDVRQLRSDQKRQL

SEQ ID NO: 52026 - protein, 230 aa, Sorghum bicolor
  Clone ID: LIB5121-011-A1-PF1-F8.pep
MASSSAQASSSTTPSENRAFERWRQSLSNMTGLGMAASPAEGEARQVEADRAAMERDWSRCERWKNKLMTGSPMIVFMLKHLERAGCPFDASAIQCHPCPETTAGGFSPDHGILLCQNRYFSKRHMEDTLAHELVHAFDHCRFDVDWMNLRHQACSEIRAGNLSGDCRLLREVRRGFYGFSKQHQACVKRRAILSVQANPNCESREMAEKAVNEVWESCSKDTRPFDEIY

SEQ ID NO: 52027 - protein, 175 aa, Sorghum bicolor
  Clone ID: LIB5121-011-A1-PF1-E12.pep
RLSWRRQRQQLRVCSEISWRVALAARSWVRCKHWWEPSSRPLRYEARDAQISRSGTTFGPALLHLAGGVQQVVPCRHGPPREEGERRIAKAASTKMTGTMADVGRAQLAVTIESPSKKKAQRCSVLAGPYSPKKLVHSSRSKASTRRSTSPPAASMPTSTITTATAAGAPLFRTC

SEQ ID NO: 52028 - protein, 133 aa, Sorghum bicolor
  Clone ID: LIB5121-011-A1-PF1-D6.pep
FSRADVVKYSRKLHCAIYAVLESMVTQVDHASSLAAATTETPPRASHAGAPPVSEAKPGEEAEAPAAAGTVGERRPTRPPPRVREPRAADTWTSRRGLQLHARGVITGVHGSEIAVAMERCGPCAEPLTHVGV

SEQ ID NO: 52029 - protein, 162 aa, Sorghum bicolor
  Clone ID: LIB5121-011-A1-PF1-E1.pep
MKGSKVHEHEADVPASDLWAIYGTLRAGELLPELLPHVLAKVELISGDGGVGTILQLILPPGIPGLQSYKERFIKVDNENYIKETEAIDGDILKLGFLAYMVRFEIISKGANLSVIRTTIEYEIEDAHPELEAMVSIATLAAAAEKFSEHAKEKKVPASTSS

SEQ ID NO: 52030 - protein, 154 aa, Sorghum bicolor
  unsure (1)..(154): unsure at all Xaa locations
  Clone ID: LIB5121-011-A1-PF1-E10.pep
MAAAAAPSVSPSPSPATAPAPKVVSPKAGDRKVVPVDAVEVELKLELEEKHVLAVDDSSVDRAVIAKILRSSKYRVTTVESATRALELLALGLLPDVNMIITDYWMPGMTGYELLKHVKESSELREIPVVIMSSENVPTRITRXLEEVVEDFLL

SEQ ID NO: 52031 - protein, 248 aa, Sorghum bicolor
  unsure (1)..(248): unsure at all Xaa locations
  Clone ID: LIB5121-011-A1-PF1-B9.pep
MARSSVPTQNDIAVPESVLKKQKAHQKTSDSQAAELKKKREASKQKREVIKERAAKYTQEYAKAQRDVIEAKRAAKRDNSLFVPAESRLAFVVRIKGINKIDPKKRKTLQLLRLLQINNGVFVRLTKATSEMLKIVEPFVAYGYPXLKTVRELVYKRGYGKVNKQRLPITDNELIEANLGKFGITCIEDIIHEIYTVGPXFKAVSNFLWPFKLSSPXGGFRTRKFKHFXXEGGDLGNREEFINQLVRQ

SEQ ID NO: 52032 - protein, 193 aa, Sorghum bicolor
  Clone ID: LIB5121-011-A1-PF1-C1.pep
LPVGSGASDPSAFLKAVTDARSIFDQAIALGFNPHTLDVGGGFVSETFNDMSAVLSAAVDAHFPPSIRIIAEPGRYYTSSAFTIACNVIARRTVEDPALGVKSYMLYLNDGVYGNFSSIMFDHQHPIPQVLSTRRRPDGFNYSTDSLADSGYASAEEIDSTTGGVKTIEYSIWGPTCDGIDCIPPRSGLPATP

SEQ ID NO: 52033 - protein, 191 aa, Sorghum bicolor
  Clone ID: LIB5121-011-A1-PF1-C12.pep
MSAKSILKADGKAILNYHLTRAPVIKPTPLPAQATHNPPAKLASITFKDGDNVQGVLDAAEATFPFLLAPGAKFVAKPDQLIKRRGKSGLLKLNATWPEAKAWVAERANKLQKVEHVEGYLRTFLVEPFVPHPQETEYYININSVREGDWILFYHEGGVEVGDVDAKAEKLLIPVDLKEYPSNEQIAKGLL

SEQ ID NO: 52034 - protein, 87 aa, Sorghum bicolor
  Clone ID: LIB5121-011-A1-PF1-B2.pep
DLQVQFLYRTIWQEVQTFHSAIMFSYFVIVPLCPSVCYFGCSFSFNVNGSQSCCLFSSKPEVQWSGCARQEDGRRGDDHRNRSEEPG

SEQ ID NO: 52035 - protein, 172 aa, Sorghum bicolor
  Clone ID: LIB5121-011-A1-PF1-B4.pep
TLKMEKLCCLLALLSLAGLSAANSACSKPEVSAQSYTTPDATILTNIGFVAEFTLKCGNGVQNPPLFAELGGKTQPVARIGANKYQVSWAEDVKKARRGDYTINIYDEENYGVLRKAMRNNEDISAVKPLATVVLNYPGAYQGPWVNSEFMAFVLSIAVWYAAFSAKSKLLA

SEQ ID NO: 52036 - protein, 135 aa, Sorghum bicolor
  Clone ID: LIB5121-010-A1-PF1-H8.pep
MKFLKVGRVVIITRGRYAGKKCVIISPLDNGTKSHPFPHALVAGIETYPSKVTRRMSKTKQAKKSKVKPFVKQVNYTHIMPTRYTIELENLKGVVSADTFKEVSQREEAKKTVKKAFEERYQSGKNRWFFTPLQF

SEQ ID NO: 52037 - protein, 101 aa, Sorghum bicolor
  Clone ID: LIB5121-010-A1-PF1-G7.pep
TASSCRSRRTRPHDAQDANSPSARRRRTAPQWPHQHIAGGAITTASDRRSTWSTLNSPRPGRILFKGYIIFGWWNGFRASGSDSDAITAMANTSCVFSVNS

SEQ ID NO: 52038 - protein, 123 aa, Sorghum bicolor
  unsure (1)..(123): unsure at all Xaa locations
  Clone ID: LIB5121-010-A1-PF1-F12.pep
RSRRPGRDLPDRDHRPLRLERFRHRGTAGWRRERRPRTRAEVVVLFRCLLRTAKQFSDYNIREDTRRRVADAFRENRXALADAPDAEAEFSEAKNQLEVAKRQAXDYSLYAPKAKRAMELKAQ

SEQ ID NO: 52039 - protein, 108 aa, Sorghum bicolor
  Clone ID: LIB5121-010-A1-PF1-E4.pep
GAKSSCLHSSVMFIHPRKFIQSGYSQLIGWNSMYTRKPFFSWMRIHPWIRLPKLVLIHCQRSNNKLQALLFLLTFSLRELQQERFLSSSYFYYCYSAILLLVLVLRIR

SEQ ID NO: 52040 - protein, 132 aa, Sorghum bicolor
  Clone ID: LIB5121-010-A1-PF1-F10.pep
RDYWVVRLAELRCSSSSGSLGWVMAVVGARRLVVVHLHDHPRRRLAHVHLRRDRRLLSRSELQSRRALLQLAPPLQAQASWRGDGGVEGEEEEEAGQHEEREERLLGVALHFHLLASRGAYLRTNGTRCQEF

SEQ ID NO: 52041 - protein, 114 aa, Sorghum bicolor
  unsure (1)..(114): unsure at all Xaa locations
  Clone ID: LIB5121-010-A1-PF1-B3.pep
IPDRSQQYRGFLSKKKKNKKIKKKNIKXKKKNKKKKKSNKKQKEKKKNKKKKKNKEKKKMKKKKKKSKKXNRKNKKKKKKNKQNRKYRRERERKKKNKKKIKREKKKKEKEREK

SEQ ID NO: 52042 - protein, 64 aa, Sorghum bicolor
  Clone ID: LIB5121-010-A1-PF1-A2.pep
LSGELHSIPSDPWRRTSSCGGNCGCGSGCKRGSGCVRSKMYPDMAEHHATTSAQTLVMCVTPSP

SEQ ID NO: 52043 - protein, 150 aa, Sorghum bicolor
  Clone ID: LIB5121-010-A1-PF1-A8.pep
SCASLLHTPLLGGLQWWRAFIVPARCKSKSARHFIEHLLGMNSSTTSSSTRLPRVCALLLEFQRRLTRPPSSHQSSPPRSAASHAAPPPAAGQLQEQGRGRRGRGRGRSGTRASESGSVDRGDARRGRKMLACRIEAVSARQAALELVWS

SEQ ID NO: 52044 - protein, 41 aa, Sorghum bicolor
  Clone ID: LIB5121-009-A1-PF1-H4.pep
LAVLTLTHDSSRLHSGLSCVVQRYTAWHDDSFWGGFAAAAG

SEQ ID NO: 52045 - protein, 194 aa, Sorghum bicolor
  Clone ID: LIB5121-009-A1-PF1-G4.pep
TIQRFDSKLDIASFNMPAASVASAPVKRTANKTTASRSAKKPAQSANKKPQTNGATNGASQAQMSPYTIMASRIANRVAEMAENMTFVEREKPQPQQQQQQSAPSNSGKKPPRKLEMRMPNNGASPTNITFSAPFLDNTLAKLLTLQNRMLTVSNDIAACEDVDDKTKQEQFAQSAELSRIIALICAEKARQGA

SEQ ID NO: 52046 - protein, 180 aa, Sorghum bicolor
  Clone ID: LIB5121-009-A1-PF1-E12.pep
MPMAIAMKGIFRGLKIIAQIFTVQRDEHEIEIGYPTDVRHVSHVGLGASDSCPSWMSEFRGLEEVTTAGGRGASIVGSAALSRHTSWASLDFEQPATGALPAAAEACAADSSSGQDGAARGGGPVTVTTKKAARPRKASRASASPGGSSSWRSTAFVATACHGHSCKLPFPSACKPPDRA

SEQ ID NO: 52047 - protein, 133 aa, Sorghum bicolor
  Clone ID: LIB5121-009-A1-PF1-E2.pep
MSDSQVTLRTRKFIRNPLLGRKQMVVDVLHPNRPNVSKDELRAKLSELYKSDKDQVSVFGFRTQYGGGKSTGFALVYDSAEAMKKFEPHYRLVRYGQAAKIEKPSRQQRKQRKNRGKESRGVAKKKGGDKKGK

SEQ ID NO: 52048 - protein, 165 aa, Sorghum bicolor
  Clone ID: LIB5121-009-A1-PF1-E5.pep
MSSLRIARAALRARPAAIARPIQRRGYAEVANDKIKLSLALPHQSIYKSQDVVQVNLPAETGDMGVLANHVASIEQLKPGLVEIIEEQGGSKQFFLSGGFATVQPNSVLSINAVEGYPLEDFSAEAVRNQIAEAQKIASGSGSEADIAEAKIELEVLESLQAALK

SEQ ID NO: 52049 - protein, 46 aa, Sorghum bicolor
  Clone ID: LIB5121-009-A1-PF1-D1.pep
NANLQLIHIQSFFHLTHTVHTPLHLLTSAQLTSASATRSKPSKATS

SEQ ID NO: 52050 - protein, 139 aa, Sorghum bicolor
  unsure (1)..(139): unsure at all Xaa locations
  Clone ID: LIB5121-009-A1-PF1-A8.pep
MDDGVDLPSHHLHGYCFDDFMKSTAACTHTHTCNPPGPSAAMHTHRCLHTHRQFIASSSEELRTPRKPLGNREAVRKYREKKKAHAAFLEEEVKKLRATNQHLLRRLQRHAALEGXVVRLRRPLVDVXGKIDAEIVGAF

SEQ ID NO: 52051 - protein, 61 aa, Sorghum bicolor
  Clone ID: LIB5121-009-A1-PF1-A12.pep
HRTPPATDPSNRTREGEPPKRPPARGETEAPEGPPRGHGHHHHDQQDPGRQHPPRNTSPAT

SEQ ID NO: 52052 - protein, 161 aa, Sorghum bicolor
  unsure (1)..(161): unsure at all Xaa locations
  Clone ID: LIB5121-008-A1-PF1-H10.pep
MKRVKTLPLTEECHHWTDAAEVPWDLQKYWQQRYTIFPYYVDGVHLTHDAWYGVTPEPVATRIARDLPEIVHDGKTTLIDLFAGVGANTIAFALSGRWDHIIGIERDAATLACAQHNAELYGVSEFITWVHGDNXDXLDALQSDYDSLDDDLQIDVTKAVL

SEQ ID NO: 52053 - protein, 121 aa, Sorghum bicolor
  Clone ID: LIB5121-008-A1-PF1-H2.pep
LSDFLFDCGHDGGGCFFLGAYFSILRANRPMNARSSGPSRCSVFSPMGAVATHRAVLPPARRFFGMPVGALRHAAVVVVPAKQSSMGRGSAAIKLTELRRALVVTSPHGCWDWDWDDGAGL

SEQ ID NO: 52054 - protein, 112 aa, Sorghum bicolor
  Clone ID: LIB5121-008-A1-PF1-G12.pep
IRTNGTWQKGHSLLPVPLALDPAEVSFIRLQCGCVGVVARAGAVAWRGRDGVLLRPRRLADRASGQKRVGLSGRRKQRRWPGADRRGGAGLSRPPRMRRLFQSRLPPLNSET

SEQ ID NO: 52055 - protein, 176 aa, Sorghum bicolor
  Clone ID: LIB5121-008-A1-PF1-D9.pep
MPQFLMGSTVDRLDRPSSYSTAKYKRKGHRRPSNSERAPSPDPMDKLQNATTLYVGNLSFYTTEEQIHELFGKCGGIKRLIMGLDRFHKTPCGFCFVEYYTHQDALDCMKYVGGTKLDERIIRCDLDEGFAEGRQYGRGKSGGQVRDEYREEFDPGRGGFGKKIMEERERYADEYD

SEQ ID NO: 52056 - protein, 204 aa, Sorghum bicolor
  unsure (1)..(204): unsure at all Xaa locations
  Clone ID: LIB5121-008-A1-PF1-D8.pep
MTKGGQSASSSGPEDESAAATSTSAPTPAPGRRPRATQQRLEIEGYHVEGISIAGHETCVMFPSLNLAFDIGRCPPLAVSQDFLFVSHAHMDHIGGLPVYVATRGRRRMRPPTVFVPACLADLVRRLFDVHRAMDQSDLDHKLVPLEVGEEYQLTKDLSVRPFRTYHVVPSQGYGIYQXKQKLKEEYAVPPGKELRNSKSLELG

SEQ ID NO: 52057 - protein, 204 aa, Sorghum bicolor
  Clone ID: LIB5121-008-A1-PF1-B7.pep
MLRPVTRTSHRRLDHLRTPPVSSSSYPVSSTSRLPLVSCETERRPAFIRREGAAAVDRGIFRRVGNSIGFGLEESDGPIWMERFVFVLLVFLCNSSFRFTATDAYDPVDPNGNITINWDFQVLNVKDMSPYTVMVSIHNYQMYRHIEHPGWRLSWNWTGKEVIWNTVGAETTEQGDCSRVGAANARPHCCLRRPVMVDLPPGTP

SEQ ID NO: 52058 - protein, 37 aa, Sorghum bicolor
  Clone ID: LIB5121-008-A1-PF1-A7.pep
TPVLVLIAAIVGPLLLAAEALLLPASAMVFQSLDASY

SEQ ID NO: 52059 - protein, 131 aa, Sorghum bicolor
  unsure (1)..(131): unsure at all Xaa locations
  Clone ID: LIB5121-007-A1-PF1-H6.pep
ALSFLVPLPTRPRELMITWPGRNQISRRWSTMGPLLFLVHTTVATAVADIHLAGQPLTSFIVAGLLGYITQGQKRPSGREHCPASWWRKMNEVQVPLVTSQQDPLVLPLHLEQDLSLFHVHLEDVDEQREX

SEQ ID NO: 52060 - protein, 81 aa, Sorghum bicolor
  Clone ID: LIB5121-007-A1-PF1-F9.pep
MGGEATNAGGGGFRARMEHYLYSGEKKHVLAGIAIFAAVFGVPWYFMTRGAKHQSHQDYMEKANKARSERLSSGQPSALKE

SEQ ID NO: 52061 - protein, 72 aa, Sorghum bicolor
  Clone ID: LIB5121-007-A1-PF1-G8.pep
ILHLARTGDVTDLRAATEVLCSRTPSQLAVVRHAYRARFGCHLEHYVTERTSGDHQRLCSRTWPCGGGGGGG

SEQ ID NO: 52062 - protein, 76 aa, Sorghum bicolor
  Clone ID: LIB5121-007-A1-PF1-F5.pep
MVLGKVAHYAFDAVLISAFLAGVRRSTGLTPSLKSDSFSENPSAQKWFENYLWVGETVMDQSVAFFGASSYFERKR

SEQ ID NO: 52063 - protein, 49 aa, Sorghum bicolor
  Clone ID: LIB5121-007-A1-PF1-F7.pep
GRSVHPVSGPWSADMPPAAVRLSGPWDAAATAAEVATLELQGAAWCTFA

SEQ ID NO: 52064 - protein, 120 aa, Sorghum bicolor
  unsure (1)..(120): unsure at all Xaa locations
  Clone ID: LIB5121-007-A1-PF1-D1.pep
TVQTSTASSSPPIPVAEYVARQFLKATASSGAGRGSDRRAYARGARGRSWLPLEVVRERRRRARTRRRSWTRRRRRXSSPASRWSSATASCRCGCTRRSTPANRDGIKRCCRPMSWGGSM

SEQ ID NO: 52065 - protein, 204 aa, Sorghum bicolor
  Clone ID: LIB5121-007-A1-PF1-B4.pep
MRGTAPELQLHLASSRPAPRSPRPVSSLAGATMDRKSKSTKGSAASSAAASMAALAAAAAAGDSSADSGAEDNVPAKMAAVGDVSSSSPVAARRSVAAAGGAASSSSPVPAAARRGAAAAAAASVAAGGGGGGGPRCQAERCNANLMTDEKPYNRRHKVCEAHSKAPVVLVAGLRQRFCQQCSRFHELSEFDDIKRSCRLRLAG

SEQ ID NO: 52066 - protein, 145 aa, Sorghum bicolor
  Clone ID: LIB5121-007-A1-PF1-B2.pep
MNIQRKPGDWNCKNCQHLNFSRRDYCQRCRDPRPDLQFSDSYSTGGVLTSLDIRPGDWYCSCGYHNFASRSSCFKCGTIVRDFPAGQGAAGAEVDFARGRDSAAVRAGWKAGDWICTRPGCNVHNFASRMECYRCNGPREAGTGK

SEQ ID NO: 52067 - protein, 251 aa, Sorghum bicolor
  Clone ID: LIB5121-007-A1-PF1-A1.pep
LSLSLTARLRQLHHIPSKTSLSCSIDGLDLHSFFLNQHTVSLKAASPRSCVVIIHYHKSLLQTLSTNNMLSKLTFAIVALQASLALAGKAVITNRCDYDIWVWSISTGHASSSFMVPAGSSHSEAYTGSSTSLKVSKSDALVAGKHTQFEYSIAAGQLWYDISFVDCANGESASNCPGHDEGLAMNASNDSCGKIDCPAGDYCPTQAYYVDTPLQKLGIAEPVFMCPLSLGTSVDLVMTVCSGNPRSEEHR

SEQ ID NO: 52068 - protein, 86 aa, Sorghum bicolor
  Clone ID: LIB5121-007-A1-PF1-A5.pep
ALHFNCLGAKLGQDERIHYSSSKTTMNVIAISFLQWLANQINQLNGRRGGRNCLSQRSRLPFTGARPPAESSNLSNPIQDERDTRI

SEQ ID NO: 52069 - protein, 98 aa, Sorghum bicolor
  unsure (1)..(98): unsure at all Xaa locations
  Clone ID: LIB5121-006-A1-PF1-H5.pep
MALAFASHARRLLLAGAGAPARSLHAQPYQXVDVAEFLNGVGKRVEKHAAKPEDAVGSDIQRLIEAGKLRRKNRRIPCKRRKLILSLAHKFRLGLWKP

SEQ ID NO: 52070 - protein, 219 aa, Sorghum bicolor
  unsure (1)..(219): unsure at all Xaa locations
  Clone ID: LIB5121-006-A1-PF1-G8.pep
PVLHLPPPMTLAGACRRRRPPRPHLPLFVLVLLIFSTPIPRASALRVPLRQAATLVSLSHSLLSRVAATRAARGDAAAAVRARRIASLLSSRGAWGLGWDYLRHYAFSSATGCGLSCAAAASRLIAAAAEASRLRSAADAAQWMRRHYGDIRDAAAQLLNGLLLAFSEEGPLREVVTDVKWEVEEXELLKDCLEVGXKDLQGLLVIAKDLFAGVPGLLR

SEQ ID NO: 52071 - protein, 160 aa, Sorghum bicolor
  Clone ID: LIB5121-006-A1-PF1-F11.pep
MVEAEGNPTTWKFTQCFGDKGDVEDITEADIISTVEFDQTGNYLATGDKGGRVVLFERNETKKTCEYKFHTEFQSHEPEFDYLKSLEIEEKINKIKWCRRQNASHYLLSTNDKTIKLWKVFEKSLKVVAETTCRMSDTLEWAAGGGVPSGPDAHSAAHPT

SEQ ID NO: 52072 - protein, 179 aa, Sorghum bicolor
  Clone ID: LIB5121-006-A1-PF1-F2.pep
LTQLTQQNQANQTTPSSNPSIRKYAVLQDLLRCCHHRQRRCSSRRRVGDSHCCSHQVPAPRRQVEVRLGRRRRQREVHLQHCRSPQYPDLCQHPQWQHCQRRPAFHPWSLRCSTEDESDAPQTLTIGSQSRGNGCVVGRSRSVPFVCEWCCRQIRHATACRLTLALFVAKEDDELMSFG

SEQ ID NO: 52073 - protein, 93 aa, Sorghum bicolor
  Clone ID: LIB5121-006-A1-PF1-D7.pep
MTKGTPSFGKRHSKSHTLCRRCGDRSFHKQKHQCSQCGYPAAKLRSFNWGLKAKRRKTTGTGRMANIKSVNQRFKNGFREGGAAPKKTKSQSA

SEQ ID NO: 52074 - protein, 227 aa, Sorghum bicolor
  Clone ID: LIB5121-006-A1-PF1-C9.pep
MSPVALEKEDHTRDAEFNKAMHGKSAKARGGMTAMLQKDKAAQQAAVDEYFKHWDNKAAGDETEETRKERRDEYATLTRHYYNLATDLYEYGWGQSFHFARYAYGESFYKAIARHEHYLAHKMNLQDNMRVLDVGCGVGGPAREIVKFAGVNVVGLNNNDYQIERATAYAEKEGLSDKLKFTKGDFMQMSFPDNSFDAVYAIEATVHAPSLEGIYSEIFRVPKPGGV

SEQ ID NO: 52075 - protein, 221 aa, Sorghum bicolor
  Clone ID: LIB5121-006-A1-PF1-A8.pep
MPHLPRASALSAFRAAPQIRAPINKRFFTPSAYNMAIKAYFDCSWTGPTIEVDNAGNVTSQGEVKAQSGRVNFELFDDVVPKTAENFRALCTGEKGFGYQGSKFHRVIPQFMLQGGDFTRGNGTGGKSIYGEKFADENFKLKHDRPFLLSMANAGPNTNGSQFFITTVVTSWLNGKHVVFGGVPDGDVESYKVVRSIEACGSTTEASSLRRAHLPSLVLAS

SEQ ID NO: 52076 - protein, 94 aa, Sorghum bicolor
  Clone ID: LIB5121-005-A1-PF1-H11.pep
YSEGLSQDPVRAKRWLQLAADCGHKKALYECGIKLCAAGDKVKSLMYLELATRRGEYAAAHMRDVIFESLSVVNKQRAMSDADKWKPRTLHPRR

SEQ ID NO: 52077 - protein, 218 aa, Sorghum bicolor
  unsure (1)..(218): unsure at all Xaa locations
  Clone ID: LIB5121-005-A1-PF1-F8.pep
MGSSSTPAAAAAAAPSRRKVALYLALLTLQYGAQPLISKRFVRQDTIVTSLVLATEAAKVICAIILLIAEGSLRKQFSNWTLTGSLTASGLPAAIYALQNSLLQVSYKNLDSLTFSILNQTKLLWTAFFTFLILGQKQSSRQILALALLIGAAVLLSVGESTSKGSKSGGSDYILLYXIIPVTVASXLSXLASSLCQWASQVXKHTSYMMTIEMSFIG

SEQ ID NO: 52078 - protein, 134 aa, Sorghum bicolor
  Clone ID: LIB5121-005-A1-PF1-E7.pep
VLSTACGFGSQMASNNKWTIAGEWSGALTDCAKWLNGRGIGARYDGTYNKGGQGSSYIGSCDGKYMGSVQGFSDADRANVKRFIEAQFVAFEKADGWIFWTWKTESAPEWDFQDLVRNGMIPQPFSAMNYGICG

SEQ ID NO: 52079 - protein, 131 aa, Sorghum bicolor
  Clone ID: LIB5121-005-A1-PF1-D9.pep
EGCSDYFITRLIIQCHRKAFLGISHAVVVIVRSEMHLFHETGLAVTIGVNLRVELVHQRRLVLTYFLLASCSDSSFRASSSDAWEWGMAFERSSVRALGKLPSSLGRCSMWPLSVPPTTFHGYSPPAAERP

SEQ ID NO: 52080 - protein, 143 aa, Sorghum bicolor
  Clone ID: LIB5121-005-A1-PF1-E8.pep
MAAHGKPKPAGPPPPPPPPPPPPPPPPEARKGFTRRMLPFLLAANLFVGAYVLVRTYKKDSGKDSTTDPATASAATAEKPAEAVSVPRKELPPIPEDDQRKLYKWMLEEKRKIKPRNAAEKKKLDEEKALLKEFIRAGSLPRL

SEQ ID NO: 52081 - protein, 94 aa, Sorghum bicolor
  Clone ID: LIB5121-005-A1-PF1-C9.pep
MTKGTPSFGKRHNKTHTLCRRCGQRSLHIQKHTCASCGYPAAKTRKFNWGEKAKRRKTTGTGRMRYLKTVNRKFSNGFQTGAPKGSKGPTVKSS

SEQ ID NO: 52082 - protein, 72 aa, Sorghum bicolor
  Clone ID: LIB5121-005-A1-PF1-C12.pep
MSGLEQELGLSLGVLIDVVDEQWMRDTLPADDIPVPPAMAVKTEDAEDPAPANQENQPAQGDVWRDFALENL

SEQ ID NO: 52083 - protein, 104 aa, Sorghum bicolor
  Clone ID: LIB5121-005-A1-PF1-C5.pep
IISARRPAGPSNFLSGTEGGSNVVRRAGRSTTTSQPPRVEYGRAQLCGPASRRRPPAEDAIEESIGRSTTLAAPWLNAESRKHQNRRGGSRMSEHVFFLLLSGE

SEQ ID NO: 52084 - protein, 262 aa, Sorghum bicolor
  unsure (1)..(262): unsure at all Xaa locations
  Clone ID: LIB5121-005-A1-PF1-B9.pep
MAPIADTVVDDLKSTVNRLEKRIAELENKLSGQSGGASTSAESVRMILMGPPGAGKGTQAPRIKEKFCACHLATGDMLRAQVAAKTALGREAKKIMDAGGLVSDEIMINMIKTELEGNAECAQGFILDGFPRTVTQAEKLDGMLAATKKPLQHAIELQIDDGLLVSRITGRLVHPASGRSYHKIFNPPKAPMTDDVTGEPLIQRSDDNEDTLKKRLSTYHAQTXRPVVAYYQKTGIWKPIDASQEPAQVWKSLLKIFDDQAM

SEQ ID NO: 52085 - protein, 70 aa, Sorghum bicolor
  Clone ID: LIB5121-005-A1-PF1-A4.pep
LCIAKLAIIVVVHAVLVVVVVVVVAAAARGGSNVGRRVPGAGSGGRRVHGQLWRRTHGAWTTTAASAVHG

SEQ ID NO: 52086 - protein, 114 aa, Sorghum bicolor
  unsure (1)..(114): unsure at all Xaa locations
  Clone ID: LIB5121-004-A1-PF1-H9.pep
MDKGCEVLDTMDKVMIALMKEEIEVVDWKLGFAKVDENFSALDYMSLSNISDENDTEGYLSVIKPAIRXSMMVKGGIISVMGGTKYAYHNTPAGLMGIFPNXDGEVACYKHKLY

SEQ ID NO: 52087 - protein, 62 aa, Sorghum bicolor
  Clone ID: 1000769.pep
LRNGVDSLLHQYWNLRSESCQWKRTTTILVTPTLATLYTFTLKNDIITTFFTMYTPALAAIS

SEQ ID NO: 52088 - protein, 76 aa, Sorghum bicolor
  unsure (1)..(76): unsure at all Xaa locations
  Clone ID: 1000795.pep
MSCNCGSSCGCGSSCKCGKKYPDLEETSTAAQATVVLGVAPEKKAXPEFVEAAAESGEAAHGCSCGGNCKCDPCNC

SEQ ID NO: 52089 - protein, 178 aa, Sorghum bicolor
  unsure (1)..(178): unsure at all Xaa locations
  Clone ID: 1000806.pep
ETPETEEAKDAETGKEAEEAPSEDAAKETXXEMKPAEEVKGASAETEDADMADAPAPAPMEEDKKQTEELAEAIAAXPVPXEEKKMKPAEPEAAASNPTEDXAPAAAEPADVXSAAEPKSDAKPAAVAAPVPETKSDAEPAAVAAPAPETKSDAEPAAVAAPAPETKSVAEPAAVAAP

SEQ ID NO: 52090 - protein, 65 aa, Sorghum bicolor
  unsure (1)..(65): unsure at all Xaa locations
  Clone ID: 1000818.pep
LLCXRXGAXAVVVRXRPAVPXRRCXXSRHXRPTCCAXFAXAVVIRCRLAVVASLXLVRXRXRNLP

SEQ ID NO: 52091 - protein, 90 aa, Sorghum bicolor
  Clone ID: 1000819.pep
LPAMYISCDVTDDVCAWYFDRVFGDRCVVCVSLHGHFPTRVFSLSTDIVYMWCVYICVHVVFARLFINALRIKAFSSSVYFIFNERNKPL

SEQ ID NO: 52092 - protein, 44 aa, Sorghum bicolor
  Clone ID: 1000833.pep
DAPRRAVDWWRKQEVDAIATKLLALLCFCRRPPIVNTYAAAPNS

SEQ ID NO: 52093 - protein, 93 aa, Sorghum bicolor
  unsure (1)..(93): unsure at all Xaa locations
  Clone ID: 1000835.pep
PSPGQIFSAGSPPXXVAGAAILMELTVGACTGCDKAPPTXLSRWPPARSTVSTXPLRRGGLALGGRPDDDGGRPGPVGGAPAGQDALRPTAEF

SEQ ID NO: 52094 - protein, 66 aa, Sorghum bicolor
  unsure (1)..(66): unsure at all Xaa locations
  Clone ID: 1000838.pep
GRARRGRGXSXLLXGXXMAQEVLLGANGGVLVFEPSEFXVKXGDTXTFKNNXGXXHNVASDMVETP

SEQ ID NO: 52095 - protein, 136 aa, Sorghum bicolor
  Clone ID: 10419986.pep
AAAAENVVSIFDIETHGKKYTLQGHNTDVQSVCWDNNGEYIASVSQDLVKVWSISSGECIHELSSNGNKFHSCVFHPSYSNLLVIGGYQSLEVWNMVKNQSLTVQAHEGLIAALAQSPVTGMVASASHDNSVKVWK

SEQ ID NO: 52096 - protein, 102 aa, Sorghum bicolor
  Clone ID: 10420048.pep
GAPSPAPAPGPAADVPASAPAPEGSAPAPTPKAAGKKKKKKAKSPSHSPPAPPADSPDLAPADAPDDDAADKVESKKNGAAAAAVSFVASVASAGLAVALLL

SEQ ID NO: 52097 - protein, 183 aa, Sorghum bicolor
  Clone ID: 10420142.pep
ARGSKGFTFSEVNCWRTSNSKIVCCHFSSDGKILASAGHEKKTVLWNMENFQTQYTPEEHGLIITDVRFRPNSSQLATSSFDRTIKLWNAADPGFSLHTFTGHSGQVTSLDFHPKKTDLLCSCDGSGEIRYWNATQLTCLRAIKGGSAQVRFQPHVGQFLAAAAENVVSIFDIETHGKKYTLQ

SEQ ID NO: 52098 - protein, 145 aa, Sorghum bicolor
  Clone ID: 10420146.pep
MSSSALLPATGTPHTGSCGKTASTSFTGSTKHELSLHGNVKPLQLAANGSSRLAYRSLVLKNQWNLSASSSSANAVTTFDDDEVVPSSVSDEKIGVLLLNLGGPETLDDVQPFLFNLFADPDIIRLPRLFRFLQRPLAKLISTFR

SEQ ID NO: 52099 - protein, 172 aa, Sorghum bicolor
  Clone ID: 10420210.pep
HEEKLHSIGSSSQLTTSLYQTTGQAAGDMGHVNITDLRGGKVAFASAAPGAKFQSTYTKRVADFPSNLSVLEVSDPITFPGLFGSPSASSANITDLLEKAGCKQFARLIVSSGVVKTYQAAMDKGLTLFAPNDDAFKAKDLPDLSKLTSADLVALLQYHALPQYAPKASLKV

SEQ ID NO: 52100 - protein, 142 aa, Sorghum bicolor
  Clone ID: 10420216.pep
NNLTREDEFLIVNNAALLPMKNRTEVFLMLHDRIVNYLGQTNRAKKNRILHNLPYNNDWLDTATANAKINQWVVNVKNEYKRTTIDLLRLNRNVRSHLHEYNHDDDIEEILYCEWPMLLTVMETMLHLEGELQDTGIHNKFG

SEQ ID NO: 52101 - protein, 113 aa, Sorghum bicolor
  Clone ID: 10420268.pep
YDDGLPSYANMRSTASHASASPPSSAASSCSPRKASSPDMQSRSVSSPPPPPPTPATTVVVAAGDEPELSSAAADDDVRRLLAAGSRAPAPAPAPTAGGKLSLALAPRISRAA

SEQ ID NO: 52102 - protein, 71 aa, Sorghum bicolor
  Clone ID: 10420345.pep
DARIRNKFSSISMAVDRAFRLALDNLQEPRSLKEIARVWDSCVRRAVTEYVHQLGGDTNSSLCRCQGWVKA

SEQ ID NO: 52103 - protein, 148 aa, Sorghum bicolor
  Clone ID: 10420378.pep
SRLVVQKLATLLSINTSEMLLFVSSTEDIDEYSTERLRDAVSYAKDNAMLIQVPVLGTRKTFWRLSDEATRISRKLALILRNQHSVCKYLTAPLQVSDVWIGSTGNVKLRGVSFTGKGFFSIEHVRDDYKHLSRFLELLITISGGDIN

SEQ ID NO: 52104 - protein, 166 aa, Sorghum bicolor
  Clone ID: 10420509.pep
ARGDQEHGGAETPVAKTPAPSADQAEDQEHSGAETPVAKTPAPSADQAEDQEHSGAETPVAKTPASPADQSKDQEHRGAETPVAKKPIDRLIAAVLSSSPAVIRSSFNLMKSAVIDMDSVPLSIGSNNKMKRVYAVTSTSESPTLSSTDDSAVTSEFNASDAASSY

SEQ ID NO: 52105 - protein, 36 aa, Sorghum bicolor
  Clone ID: 10420633.pep
DQPGKRYFLARIKPYTTARVQEQHGKRYWLVRVKPS

SEQ ID NO: 52106 - protein, 183 aa, Sorghum bicolor
  Clone ID: 10420678.pep
GGAVALKVHFKQPNEWNGAILVAPMCKIADDVVPPWPIQQVLIFMAKLLPKEKLVPQKDLAELAFKEKKKQEQCSFNVIAYKDKPRLRTALEMLKTTQEIERRLEEVSLPLIILHGEADLVTDPAVSKALYEKAKNQDKKLCLYEGAYHAILEGEPDETIFQVLDDIISWLDQHSTREEGMSS

SEQ ID NO: 52107 - protein, 118 aa, Sorghum bicolor
  Clone ID: 10420732.pep
MVGGGNEFRFFLSCEVSHPLAFRVLHAEHILLTDQKVPELFVECKLYIDGIQFGLPVKTRLEPSGPKYCWNELITLSTKYRDLTSLSQLAFTVWDVSTGEDPAIVGGATIFLFNSKRQ

SEQ ID NO: 52108 - protein, 210 aa, Sorghum bicolor
  Clone ID: 10420748.pep
NFHALRFVHKIQETGAVLVERLHGRRASSSPLKDNLLGQFAIKSDPSANKSDASKYLAVHLRFEIDMVAYSLCYFGGGKDEEDELEAYRQIHFPVLSELKKTTKLPSAAFLRSEGKCPLAPEEAVLMLAAIGFKRSTKIYIAGAEIYGGKDRMAAISRLYPALVTKETLLSPSELEPFRNFSSQLAALDFIACAAADAFAMTDPGSQFSS

SEQ ID NO: 52109 - protein, 53 aa, Sorghum bicolor
  Clone ID: 10420808.pep
GRHHCHPPPPPPRHRNPQLARSNQGSRDRVCSLVLGFERRLAGRQPLGDKSSC

SEQ ID NO: 52110 - protein, 203 aa, Sorghum bicolor
  Clone ID: 10420860.pep
ARGETGKKNEIALAKRIEELSMKVSEMEVEMQDLSADRRELSNAYDSMMTELECTKLNLDCCNEEKQKIEVSLEECSEERNRIRVELDLVKKLLENMALTDNNASHDSSESCTPGTTSIGHILGDGKADSASKATPNTTKMDSGLQELEIQSRSLSSNLSQGAEDAVKFGDNEESKNLENCDEEMESSTENNLNGNNSVNGIS

SEQ ID NO: 52111 - protein, 197 aa, Sorghum bicolor
  Clone ID: 10420880.pep
TRIQLRGHNTKIQSIAFAVKGASVVSCASNLLKVWDCITGSCLYTLGGDDQNSVGHTQKINAMAVNKWQSCLVVTSGAKGDGKLLLWNALRGELASDLNSNLRSQDMIYPSVDTMEFYSENHLACGSDCDYGGSAVVQLWDIDSPESYLSFSASDSYITSLKVNPAGNTLITGSGDGTIGLFDIRTCSAISHLSVGS

SEQ ID NO: 52112 - protein, 120 aa, Sorghum bicolor
  Clone ID: 10420952.pep
MEVGDLHKVWEVRALKTKPDAAAARATLDRVARQVQPIMRRHKWRVKVLSEFSPRNPRLLGLNVGGGVEVKLRLRRAGRDHDFIPYEEVLDTMLHELCHNQRGPHDAQFYKLWDELRKEC

SEQ ID NO: 52113 - protein, 168 aa, Sorghum bicolor
  Clone ID: 10420978.pep
MSSGGGGGQQFRYAQTPSKVLHLRNLPWECAEEELVELCKPFGRIVNTKSGVGVNRNQAFVEFTDVNQAIAMVSYFASSSEPAQIRGKPVYIQYSNRQEIVNNKSPGETAGNVLLVTMEGVQASDVTIDVIHMQAHVNWRKCRYQHLQLERYHVCFAASIFLVHSTFL

SEQ ID NO: 52114 - protein, 150 aa, Sorghum bicolor
  Clone ID: 10421058.pep
MLKSDTTSAPKHRFPEEFAAGSCALECAELQFCAEDMSSAGLHGQPGSAIVLDAVPVKDLSFQKLQYGMNQLGLETKGRIRDSLYRLANRLEQKHRVACSSEGLGSSSSDRFESGRWTETQTNPMDQSVAQLLLQKPSYRKTVPPPHRVT

SEQ ID NO: 52115 - protein, 169 aa, Sorghum bicolor
  unsure (1)..(169): unsure at all Xaa locations
  Clone ID: 10421086.pep
ARGNNMGSIYVDCDMLDEAAECYGIALNIKHTRAHQGLARVHYLXKNRKKVAYEEMTKLVQIASNSASAYEKRSEYGERDAARNDLNTATLLDPTRTYPYRYRAAVLMDEGKEEEAIAELSGAIAFKPDVQLLHLRAAFFDSMGDTDSALRDCEAALCLDPTHGDTLEL

SEQ ID NO: 52116 - protein, 128 aa, Sorghum bicolor
  Clone ID: 10421191.pep
LAHPFSYCHDLLLGIMLDLDFWQNFVSCLMEVDQGLNFASGQQCRHIFDWGQLNHSVNEGASSAADSGSNILTKLSNNILIVDIANWLLLSCLNSTRVTIQQIILPEFCQSCIAISIVATMRWSQMAS

SEQ ID NO: 52117 - protein, 165 aa, Sorghum bicolor
  Clone ID: 10421247.pep
ASFTQFVVATDGDEESLDLLRQNISSNLEPNSLSRIKIRKLFWGNKDDTQAVRELSGNGAGFDCIIGTDVTYNPDAIHPLFVTARELISDRANKDSTPALILCYIQRRVDEDSILSNATSQGFRLVDKWINGLHESNGIISSWFSGNDVCSAFRNAVLSVLYFEL

SEQ ID NO: 52118 - protein, 182 aa, Sorghum bicolor
  Clone ID: 10421283.pep
YDETHVSTRVMGTQGYAAPEYIMTGHLTAKSDVYGFGVVLLELLSGRKAVDKTRPAREQSLVEWARPYLTDARRMDRVVMDPNLAGQYSARAAHRAAAVAHQCVALNPKSRPHMSAVVDALEPLLALDDCGIVGPFVYVAPPETVTKGDEAAVGNKRGSGRRGGRRRSSGEGGAAAVVRPEE

SEQ ID NO: 52119 - protein, 138 aa, Sorghum bicolor
  Clone ID: 10421285.pep
SLSGLERTLSQLDMANEHLQSIFPSFKELPGSGNAFERLLALELELAEALQAKKKTDILFQSSFLRQHNDEAAILQSFRDINELIQDTIELKRRQMAVENELKEMQGRYSELSVQFAEVEGERQKLEMNLKNRTPWRS

SEQ ID NO: 52120 - protein, 124 aa, Sorghum bicolor
  Clone ID: 10421289.pep
TVAAAVAGCAVIAAPDPPRGRCYTVHMSATVVVSILQGAAAVLAFSRTAEFLSDGLKSYVREEDGAVILRMVGGLGVAIFCLEWVALALAFVLRYYVYVDRECGGNPMRRSAKVGGEDGSAGTW

SEQ ID NO: 52121 - protein, 201 aa, Sorghum bicolor
  Clone ID: 10421439.pep
DRANAAQRRLSAGCREGTPLDRTRTAVTAGLRKKLKDLMLDFQALRQRMMSEYKETVERRYYTLTGEVPEEEVIERIISDGRGEELLGAAVAEHGKGAVLAAVHEIQDRHDAAREVERSLLELHQVFLDMAVMVEMQGEKLDDIESHVANASHYVQSGNKELGKAKEYQRSSRKCLCIGIIILLLLVLLVIVPIATSLRRS

SEQ ID NO: 52122 - protein, 81 aa, Sorghum bicolor
  Clone ID: 10421634.pep
QRRALQPPRRAWVCHGQVIKESSARLWLPDRDDTDTAIHHRTFHHRHHGYNTIAREIQEEGDDADAGVVVVVVVNFSRKDG

SEQ ID NO: 52123 - protein, 193 aa, Sorghum bicolor
  unsure (1)..(193): unsure at all Xaa locations
  Clone ID: 10421690.pep
TYENFRYRYERKANPFNRGAAGNIAEIFFSPVPPSRNDFRAKVSPADPXPPRSTTSARWRPSRGSASTPGPASASTWQRQASTSTTPPSAPASRPPTSATSSTAATAGRSTGSRRRSTSSRGTPSSAGPAGRARRRRTKRTPSRRSSGPPCTSTTAPPPAGRASGSSRWCDRSRCTYRRAGGIVVIEKPCSSQ

SEQ ID NO: 52124 - protein, 176 aa, Sorghum bicolor
  Clone ID: 10421840.pep
HEAPSSRGSRPTTRGAGAAAMSAAAPAPAQAPRKWEGLVDEALEREVLGACLDQAPERRRIREAFKNVQLSIDHCLFKGQYSGIGTKESYERNSRGVEIFSKCWFPENHRMRAIVCLCHGYGDTCTFFLDGVARKIASAGYGVFALDYPGFGLSEGLHGYIPSFDTLVDDVAEHFS

SEQ ID NO: 52125 - protein, 195 aa, Sorghum bicolor
  unsure (1)..(195): unsure at all Xaa locations
  Clone ID: 10421861.pep
HEAALPLFSGSGEENRENKIKSGPAGSPTISRRENIQQEVINVLERKQSSEGTDDEFNNAMEEVTRLDIDQISPLRMVLIASVAFHDQSVKPGSPLLVSVSLLSHLPSPVVVDQLEVQFNQSDCNFVIHSAQEDSPPLDSNLHDQIVQDTSSLTLFTNRWMRLTHELKXQSGKLECLSVKATINKHLVICCHAES

SEQ ID NO: 52126 - protein, 200 aa, Sorghum bicolor
  Clone ID: 10421949.pep
TREILSFGADSNARRNPSPAPPAATASLTTAPGSLFSQHTATMTQAAAANDAKNNNKRSMEATSRASNTNHHPAATANEGMLSFSSAPTTRPSTGTGAPAKSESDHSDLDASVREVESSRVVAPPPEAEKRPRKRGRKPANGREEPLNHVEAERQRREKLNQRFYALRAVVPNVSKMDKASLLGDAISYINELRGKLTSL

SEQ ID NO: 52127 - protein, 171 aa, Sorghum bicolor
  Clone ID: 10421989.pep
ARGRPPDPDDAATSADGSSSFASPATGASWSLPPTRDVYVNGVVVKVKYCHTCMLYRPPRCSHCSVCNNCVERFDHHCPWVGQCIGRRNYRFFFMFISSTTFLCLYVFAFCWVNLALISRRSGVSFGEAVAESPVSGCLIVYTFVTAWFVGGLTAFHSYLVCTNQTTYENF

SEQ ID NO: 52128 - protein, 108 aa, Sorghum bicolor
  Clone ID: 10422006.pep
ARGHSAGVVPAPPIPDHTPSSPRRHDAAAAATYLQQLVPTSHKAVEALTWTGGEGSGSTSSSRWPKEEVEALIQMRNEKDEQYHDAGGKGPLWEDIGAGMRRIGCNRS

SEQ ID NO: 52129 - protein, 177 aa, Sorghum bicolor
  Clone ID: 10422012.pep
MAAPFPSSCSRARMAVVVALLLVTTAAAPAAVALLKDDIEFMWGPDHSFFSDDGNTLALCLEKTHGSGFRSKGAYLYARYDIDVKLVANNSAGTVTTVYLTTDDVRPGYHDEVDMEFLGNVTGEPYTLHTNIFVDSVGNREQQFRLWFDPTKDFHTYSVQWTPKNIIFLIDGTPIRV

SEQ ID NO: 52130 - protein, 154 aa, Sorghum bicolor
  Clone ID: 11064516.pep
GSVHNICQVYERASGHVQLLQKSVQIPLLLGSTLFLVAGVVNRHDRRSRHSAFVLLGRSWVWFCVFGSLLFLAGGVLNLLKVFKTQQMGGRGLEKLRGGAQERLALEREGKVPLILEHGHGGGGGGGRTRPGPAAGAMTPPPGSYKDALVSSAS

SEQ ID NO: 52131 - protein, 66 aa, Sorghum bicolor
  Clone ID: 11064528.pep
GEELRKHIGATCYIECSSKTQQNVKAVFDAAIKVVIRPPTKQRERKKKKARRGCSMFCSRIMHTRK

SEQ ID NO: 52132 - protein, 147 aa, Sorghum bicolor
  Clone ID: 11064534.pep
PSGAPYQQPPGPDAYQQHHHRPQSTYDHPQELGTSVYDSPVDRPAGQQLPFPTGQPLPPALQRFQQQQQQHNQQQQNQQEYSPSAYSHDDAASAPYPVSQAPPTHHPPPVPTGASKPPYTSLTPGVPNGGEYQAYNPAASNPSLFYQ

SEQ ID NO: 52133 - protein, 89 aa, Sorghum bicolor
  Clone ID: 11064536.pep
HACVGFILPSLARLRTMYLPNELRGGMMSFSLSLANAAIFIFLLQGAHHRRFANSTILFLASYGLLGAGGCIHMLRRWRKHTRQNARSL

SEQ ID NO: 52134 - protein, 117 aa, Sorghum bicolor
  Clone ID: 11064552.pep
MKSNDYLTAALQYGQELQAEFGGDNRPATKEKLREMFAIMAYVDPRESIVGGLLDKRGRVGIAEGVNGAILVSLGKPSSAALEKLCAQTEAFLDAVAAKAGGKAGMVNVREDFLRPQ

SEQ ID NO: 52135 - protein, 72 aa, Sorghum bicolor
  Clone ID: 11064562.pep
DLNNPASLSPFQFHFLIYRISTTSVALSIQFLSVAQFLSTAMATPLGTMDSTGERIQHSNSSTANGTRVEGN

SEQ ID NO: 52136 - protein, 86 aa, Sorghum bicolor
  unsure (1)..(86): unsure at all Xaa locations
  Clone ID: 11064571.pep
YVETALPDRVTSVVDRHLVQEAEDGEGIADMKXSCIISILRIGVQCSEEAPADRMQISDALKELQGIRDKLENIYALKERNSTDIF

SEQ ID NO: 52137 - protein, 77 aa, Sorghum bicolor
  Clone ID: 11064579.pep
GNATYERLPLEQDAEEGAVLSGSSEGGATAQQLEQQQSSGGPVVPPSSMYAVPQTPPHDMFGQWGHAAVTRPPPTSF

SEQ ID NO: 52138 - protein, 172 aa, Sorghum bicolor
  Clone ID: 11064603.pep
NYAPARRSLVISTSGQSRRMMPRQQIQQYINEEEEYASDACDEEDAAFDNEEFEIVGASRQRGHAPNARVSRRSYTRRPEINKFRIKVHALEDKRYIMVGPTIQIGEFEKRIRDKFGFQSPLKLKMQDDGDMVSMVDQEDMDLLLMSAKEFARREGSEIGKTEIWVEVLSMF

SEQ ID NO: 52139 - protein, 75 aa, Sorghum bicolor
  Clone ID: 11064629.pep
NICSAGYSTGSIGFEAKILQMGMVSFLLSNLSDGWTGMSCINTLSPTSRFVRSTSIFGGMCSAGQRYTRLVLIFC

SEQ ID NO: 52140 - protein, 119 aa, Sorghum bicolor
  Clone ID: 11064631.pep
IQLLKAFNHIKCRNCQSRIAKRSDMVVMSTDGVLGAYVNPHGCVHETITVSNATGLALIGNPSTVHSWFPGYSWTIAACMACESHIGWRFKATKKNLRPRSFWGIRSSQIADDTVDQSD

SEQ ID NO: 52141 - protein, 70 aa, Sorghum bicolor
  Clone ID: 11064634.pep
GAVLQKYIGRDGHFKTSETITGLLLCQIEGVKYRILQQKDMIQISCRLDSSAVVVVPAVMPVSVSIPGMA

SEQ ID NO: 52142 - protein, 86 aa, Sorghum bicolor
  Clone ID: 11064645.pep
STASATATATSAAASSASSTQASTTPASQAKAQVSSSTPSASSVTTSGSLSDYFSSLSAEEFLNVISETLSWLVTDKIHARDISTA

SEQ ID NO: 52143 - protein, 84 aa, Sorghum bicolor
  Clone ID: 11064670.pep
TLFVVMATLVPYFSYAAIQIRFFPMFHNKIQWKRYLGKAEDPEVARQLSSRHRTSSQQRMVGISARRDGKAMQITKETELEVQE

SEQ ID NO: 52144 - protein, 108 aa, Sorghum bicolor
  unsure (1)..(108): unsure at all Xaa locations
  Clone ID: 11064680.pep
DDGRWFIWKKRTGRLIKMLAGDGAVVXCIQSHPFDCAVATSGIDNTIKLWTPDANATSMVAGPELDVLSAIENNQRKLCRNRQIVLPFEFLERFRMHEFSEGFECAQS

SEQ ID NO: 52145 - protein, 122 aa, Sorghum bicolor
  Clone ID: 11064681.pep
ATQIHSHFCYSEFQDFFHAIAALDADVLSIENSKSDAKLLRVFVDSEYPRHIGPGVYDIHSPRVPSEQEIKDRIEEMLQFLKPEQLWIDPDCGLKTRQWKETKEALANMVNAAKYFRNKYAK

SEQ ID NO: 52146 - protein, 148 aa, Sorghum bicolor
  Clone ID: 11064688.pep
HEDMFAGIGPFAIPAAQKGCVVYANDLNPDSVHYLRTNAKINKVDDYIFAYNMDARVFMQNLMTVPGLETGSDCQVAADESYPKEGVPANENSSSNGNHNDVREGSQNGANESSVASTTAKKRQQTSEECESDCQDGDASQTKRRNNR

SEQ ID NO: 52147 - protein, 118 aa, Sorghum bicolor
  Clone ID: 11064698.pep
MVWALTPVDTARGTLKRYIFAAGTYKVGRKDCDVIVQTDTSISRVHAEIAIEKMVAWDPHSGAPASPSFVRVIDRSKYGTFVNKVHGTQGSRLHKDENMMLTDGDAVTFGTGNATFRL

SEQ ID NO: 52148 - protein, 149 aa, Sorghum bicolor
  Clone ID: 11064700.pep
TRAAGAYTYDTLHQPDDGGDTSKSKDEIMDDLERHACPSAGACGGMFTANTMATAIESMGLSLPGSSSTPATSPSKMRECVKVADAIKACLEKNIKPRDLLTKRSFENALVITMALGGSTNGVLHFLAMARTAGVDLTLDDIQRVSDKI

SEQ ID NO: 52149 - protein, 172 aa, Sorghum bicolor
  Clone ID: 11064707.pep
HEAEESKNPPEPPAVRDSAGGRRIPGFPEGFQPKSNSSVTRRSLVTGPSNVRPAKRAIVKRQASNDTANGAKHLGLPGRDLINPKYQIHNEAGSISNRTLATDIQNYDGSYHYDTHNFWGSMMSIASHASMQMRRPGRRPFIITRSTFPGLGSYLGKWLGDNVFEWAQYRFS

SEQ ID NO: 52150 - protein, 102 aa, Sorghum bicolor
  Clone ID: 11064710.pep
RKETRRSRASRCSCPSPPPPPPPPARSHREKEREIRSEEVGRGQEPTMMESLGDDDDDDDDDDDPSPFSEKDFFLDARVAVSCKQAKQERQLDCLVPEEPRA

SEQ ID NO: 52151 - protein, 107 aa, Sorghum bicolor
  Clone ID: 11064728.pep
MWRLKVSERSSPWLGSVNNLLGRQEWVLDPDDLGTPEERAQVDRARREFADHRFERKHSSDLLMRIQYAKENPHNHLGDLPPAVKLQENDDDIITEEAVWTSVKRAV

SEQ ID NO: 52152 - protein, 123 aa, Sorghum bicolor
  Clone ID: 11064729.pep
MAFLQTAALLGSLAASAYAHGRVTSISVDGESYDGFLNDYIYMPSPPDIVAWSADNGDNGFVDGSSYTSGDIICHREAKAGKIAATVAAGSKIDIQWGPDAWPESHHGPVIDYLAKCAGDDCT

SEQ ID NO: 52153 - protein, 58 aa, Sorghum bicolor
  Clone ID: 11064731.pep
TTTTTTTSTSPPFFEEGEGEGDGRLWLISGSGSAGAAHWRKRRSEGSGCGSRQGWASC

SEQ ID NO: 52154 - protein, 212 aa, Sorghum bicolor
  unsure (1)..(212): unsure at all Xaa locations
  Clone ID: 11064745.pep
LTQECKPAEGAGDSGSDKLSYSLSNIIDLKDKLSHCLSSRLLRRWCMFEWFYSAIDYPWFAKSEFIEYLNHVKLGHVPRLTRVEWGVIRSSLGKPRRLSKQFLHEEREKLAQYRDSVRQHYTELRSGVREGLPTDLARPLAVGQRVIACHPRTRELHDGNVLTVDHNQCRVQFDRPELGVELVKDIDCMPLHXLENFPESLKQQSIFNGYYS

SEQ ID NO: 52155 - protein, 109 aa, Sorghum bicolor
  Clone ID: 11064754.pep
HEASSPPARLLRRGPIDTSSMASKALFLLAIVLAAAAVLTTAAGQTYENNEKMAYNDAGVKDDRHGGGGVSAGGYACEYGCCHHVFHGGCQKCCPPPPGAAGRPEEVKN

SEQ ID NO: 52156 - protein, 162 aa, Sorghum bicolor
  Clone ID: 11064758.pep
ARGEIETWVLALEYYDNQQYEEAIQVFDGIADTSKILFNCGVICATLGEHERAVECYQRAVGLDQYLAIAYFQEGVSNFLLGDFEEALANFNDTLLYLRGNTSIDYEQLGLKFRLFSCEVLFNRGLCYIYLQQMGLGLQDLEFASKEKVTQDHDVINDAIRE

SEQ ID NO: 52157 - protein, 103 aa, Sorghum bicolor
  Clone ID: 11064766.pep
TRVSSSWWTLVGIIFSPVSVGQKQKGPTERGRRADRQEDRDSFRYTAKSGQSLLIILIYPRLVFVLSRTMGLCHSRPLHRRASDNAVFLSSSNLSSTTPNFTS

SEQ ID NO: 52158 - protein, 164 aa, Sorghum bicolor
  Clone ID: 11064783.pep
MAQFLRGKATAAAAATAAREAAPWRRTASASYHHTIQAVPRETAGPRAAARERRHGRVPAVLLTLAGAAPGNGIAHRQLLTADRRQLAEMLKQSPYFLSTPVRLQVRAGERSNAIVHAGTVLPIKVHRDETSGNILNLVMVKADEGTMLKVDLPVEFKGEDTCP

SEQ ID NO: 52159 - protein, 151 aa, Sorghum bicolor
  Clone ID: 11064788.pep
ARGARDLRAPPPEHPPASVDTRRRPAPAASFSPPRPPRPAGRHHPPPNKPRRRRERATGTALAARTGRASRLDERRRPSARSSSAPATSTPQDSVRNVQCIVYLPRKEMASDEFISLESPCEADAQDEGGDVQVAPDVNGAEPLASELQPE

SEQ ID NO: 52160 - protein, 122 aa, Sorghum bicolor
  Clone ID: 11064795.pep
MSVTKIAGLLLGSAAMVAGHGYVSGAVVDGQYYGGYIVTSYAYTDSPPETIGWSTEATDLGFVSPSSFSDPDIICHKSAQPGAISASVTAGKDVELQWTEWPESHHGPVITYLANCNGDCSK

SEQ ID NO: 52161 - protein, 157 aa, Sorghum bicolor
  Clone ID: 11064798.pep
ARGSVTKAYYAFCASMESEQKESSKDQILSKKSVGSPGKKQVSSSPGCTLTEDILSKLKRVVVNKRTTKVAIQRLKQKRFKKEKKKNANSRRLHLGNERKKRGGCALLVRGSNKESGSGTDGFVPYEWKRTIFSWLIDLDVLSVNTKLKCMDESNSK

SEQ ID NO: 52162 - protein, 105 aa, Sorghum bicolor
  Clone ID: 11064808.pep
MADKGLEDIEAAQIESNYDETTDSFDAMDLKPELLRGVYAYGFERPSAIQQRAIMPVIKGNDVIAQAQSGTGKTATFSISVLQKIDPNVKACQALILAPTRELAQ

SEQ ID NO: 52163 - protein, 170 aa, Sorghum bicolor
  Clone ID: 11064821.pep
VGISGAEGMQAVMASDVAVAQFRFLERLLLVHGHWCYRRISVMICYFFYKNVTFGVTIFLYEAFASFSGKPAYNDWFLSLYNVFFTSLPVIALGVFDQDVSARLCIQYPQLYQEGVQNILFSWRRILGWMLNGVMNAVLIFFFCITSFEDQAFRQDGQVAGLDALGVVMY

SEQ ID NO: 52164 - protein, 133 aa, Sorghum bicolor
  Clone ID: 11064831.pep
MDEAEKLRWPFSDGSVTDLLDARSLHGSPDIKKKVQFHSSLVQKLALEKEMEGHAGCVNAIAWNSSGSLLVSGSDDTRINIWNYNNRELVHDIDTGHSANIFCTKFVPETCDEVVVSGAGDAEVRVFNMSRLS

SEQ ID NO: 52165 - protein, 159 aa, Sorghum bicolor
  unsure (1)..(159): unsure at all Xaa locations
  Clone ID: 11064832.pep
TRGECTNLQMLALNXNSFTGGVPRELAALPSLLKLYIYRNQLDGTIPPELGNLQSVLEIDLSENKLTGVIPAELGRISTLRLLYLFENRLQGTIPPELXQLSSIRKIDLSINNLTGTIPMVFQNLSGLEYLELFDNQXQGAIPPLLGANSNLSVLDLSD

SEQ ID NO: 52166 - protein, 185 aa, Sorghum bicolor
  unsure (1)..(185): unsure at all Xaa locations
  Clone ID: 11064833.pep
TRIALIAKAVTEGPASVREQLEANAKSIKARADSPRTNDPQVKERQSKVTQKDYERKSEFTVRISQQQKKLNLPLFPTTTIGSFPQTKEIRVQRNKFTKGEITAEEYDRFIEKEIEENVKIQEELDLDVFVHGEPERNDMVQFFGERFQGYAFTTHAXVQSYGSRCVRPPIIVGDISRPNPMTVK

SEQ ID NO: 52167 - protein, 154 aa, Sorghum bicolor
  Clone ID: 11064840.pep
SNYATELENGALDISESVLGVSVSLSPLHKSIKEFRKAVLKVDSELKALQTWKFWAPWKNSPLKVRDINDRLMMTERAFTDREGLSGRPWYKHLIYAPSLHNDYGAQVYPGVDDAIQKAKKTNTSESWQSVQHEIYRVSRVINQAALVLSGDLT

SEQ ID NO: 52168 - protein, 102 aa, Sorghum bicolor
  Clone ID: 11064847.pep
EQWRRRRPRRHVRREQTPDDGEAAQQQGGADEAHAPVQRAAQPVAFRLGGVHRDLLLNAAPHSPGGSTRPPSPISSIPCMLSTSAICLFAAAAAGVTSSSVT

SEQ ID NO: 52169 - protein, 147 aa, Sorghum bicolor
  Clone ID: 11064860.pep
QSQSLNIHMKEPTMGKITSMHFAGWKMGLKTGMYYLRTMAASAPIQFTVDQEQLQVADTNVARETSAYKKRVGGGTSSASSAVPREENGHAEQEAPRATAEAPAAPNGGEAEQGEQENGEQESGDIFSQQVLQCSIENKDACIMCQG

SEQ ID NO: 52170 - protein, 158 aa, Sorghum bicolor
  Clone ID: 11064861.pep
PIVLKGIQTHEDAYLASLHAPAVKAIILSNHGGRALDTAPPAVHTLLEIRKYCPEVFDRIEVWVDGGIKRGTDVVKALCLGARGVGVGRAALFGLGAGGKEGVARVLEILKAETETCMRLLGVEKVEQLGMHCINTRAVERDIWDGPGLERAVVKAKL

SEQ ID NO: 52171 - protein, 99 aa, Sorghum bicolor
  Clone ID: 11064866.pep
GHGLESLSFRSCFQSMPAPSYGFLGFVHGVDVFFVGMNDGVLFSFDLKSGRVRKVYKGECDEDGLLGRVPCVVPYTSFCTPALRLVATEEEPEAIAASP

SEQ ID NO: 52172 - protein, 121 aa, Sorghum bicolor
  Clone ID: 11064873.pep
SRIVFAPSGDAYHPKNRKVKLSVTVKELGLSRHAFRRLRDVVGKRYNSGKDELTIISERFEHREENRKDCLRTLYTLIIDAIKADKLVEDARNAYVKGRLKANPQFMERLKRKTEKLMAAA

SEQ ID NO: 52173 - protein, 61 aa, Sorghum bicolor
  Clone ID: 11064889.pep
GNSEPTYTGMYGNPDATYTAQAYPDAYSTNQAHMHTGANSHYMSQPVSYGQYEGQHTNVQR

SEQ ID NO: 52174 - protein, 128 aa, Sorghum bicolor
  Clone ID: 11064910.pep
ALGDNVAELENTGVILDTGTSLIALPSTMAELLNKEIGATKSWNGQYTVDCAKRDSLPDLTFTLAGHPFKISAYDYVLEVQGSCISSFMGMDFPEPVGPLAILGDSFLRRWYSVYDVGNNAVGLAKAK

SEQ ID NO: 52175 - protein, 88 aa, Sorghum bicolor
  Clone ID: 11064914.pep
LSTLSLGFFVSSALVAAVHKVTGDRHPWIADDLNKGRLDNFYWLLAVICLANLLVYLVAARWYKYKAGRPGADGSVNGVEMADEPMLH

SEQ ID NO: 52176 - protein, 137 aa, Sorghum bicolor
  Clone ID: 11064928.pep
GRIPRGENLVIIVRHEGPKGGPGMPEQLKASAALMGAKLTNVALITDGRYSGASHGFIVGHIVPEAAAGGPIAIVRDGDVVTIDAETNELKMDVSEEEIQQRLREWKPPAPHVTRGVLAKYARLVGDASHGAMTDLF

SEQ ID NO: 52177 - protein, 167 aa, Sorghum bicolor
  Clone ID: 11064935.pep
WTGERVEGKGEYVNLTDIGFDTIPLHVKGGSILPLRAESANTTTELRKQNFVLWIAPNATNQASGTLYLDDGDSLEQPATSMINFSFNNGAFSMSGDFGYKTDCVIQNITILGTGQSVQGPVSLTKNWEHNFGSSLPEVSTSAASGRRGVTAAWGAVVGFASLFLSL

SEQ ID NO: 52178 - protein, 95 aa, Sorghum bicolor
  unsure (1)..(95): unsure at all Xaa locations
  Clone ID: 11064955.pep
XRPRPPAXRHPRAHRPPPPTATATTPAPTPSPPPRPSPPPPPSPRSPTPSPPPPXPPPSTAPSPPPPAPSPTTTTPASPSPRASRSPTSSSGSTT

SEQ ID NO: 52179 - protein, 109 aa, Sorghum bicolor
  Clone ID: 11064982.pep
MAEDHFSSAPSAPSAAATAAAAAAAAVGSSVIPIVNKLQDIFAQLGSSSTIDLPQVAVVGSQSSGKSSVLEALVGRDFLPRGSDICTRRPLVLQLVHQPRRPADAEADE

SEQ ID NO: 52180 - protein, 163 aa, Sorghum bicolor
  Clone ID: 11064985.pep
HEVRLRPLPLLIAAAFAASYRLLFHLAPAPSYYQSLLLSLGSNDTAAAHLHALTIRPHLAGTGANALAAAHVASALSSHSFPTRLTSYSVLLSYPAHRSLSLSAPDRDTVLFALKQETYAGDPYDAVSDEAVPTFLAYAASGSVTAEAVYANYGRAEDYAYLA

SEQ ID NO: 52181 - protein, 147 aa, Sorghum bicolor
  Clone ID: 11064995.pep
TRGRTVEVKRTVPKEEMSSKDGPKTKKIFVGGIPSSLTEDKLKEHFSSYGKVVEHQIMLDHSTGRSRGFGFVTFESEDAVERVMSEGRMHDLGGKQVEIKKAEPKKPGGGDSSSNGRHSRGGGHRDSYRGSGGGSGVSGNSSGGGYG

SEQ ID NO: 52182 - protein, 153 aa, Sorghum bicolor
  Clone ID: 11065003.pep
RTGWWRTARCTRAPTPPAAPRDAGWTPSAPPARRRAARAGPPRPPAPRGSRARRPRRRRGGATRGATRGPAGSSATAAGRRASTAGSLACAPWSWSSPSPPYAAALAVGWDAEEEKRFSLAGAPVRAPVSLAGCLALLLPGLVVVQTRDQPRA

SEQ ID NO: 52183 - protein, 141 aa, Sorghum bicolor
  Clone ID: 11065005.pep
HEGNRKSNQKNLGTIRSSNLCTEIVEYSAPDEVAVCNLASLALPTFVDAARGEYDFGKLHEVVQVLVRNLNRIIDINYYPVPEAKKSNMRHRPIALGVNGLADAFLALRLPFDSAEAKQLNIQIFETIYHGALTASSDLAK

SEQ ID NO: 52184 - protein, 95 aa, Sorghum bicolor
  Clone ID: 11065006.pep
AILTPRVAPSPSSSRSAPSPSLLSRVTRLRCPGHTLSPRSSGRALGPGGRDCGHDDTTIARLLLVATAWWSRTGMRRHDDHCVVRLLDTREQNIL

SEQ ID NO: 52185 - protein, 116 aa, Sorghum bicolor
  Clone ID: 11065007.pep
MAKVFDYAEVAQHNTAESCWVILYGNVYDVTRFIPEHPGGSKVILQLAGTDATEEYDPIHPPGILEENLEASDKLGTINPDTLPKEEKTPEETGEAQDEGPVDLDSLLNLDEIEEV

SEQ ID NO: 52186 - protein, 111 aa, Sorghum bicolor
  Clone ID: 11065013.pep
MELPADVVEEILLRLPPADPVSLVRAALVCKPWCRIVCARSFRRRFKELHRTAPLLGFLCNPLFARFVPTSSFRRRSATASSSTPATASSSSTSSWVTTRWTPSSSGTRQR

SEQ ID NO: 52187 - protein, 88 aa, Sorghum bicolor
  Clone ID: 11065019.pep
NMLPAHVSVFPFARRSSVLFVDGSSAWLLTNGCKHFFPLVTFSSIEIRIHLRFFLSFFLVDQSSVLISYSSRLLCFRIGFIQEAEPVH

SEQ ID NO: 52188 - protein, 109 aa, Sorghum bicolor
  Clone ID: 11065024.pep
MAIHLRAHAFAANPLRGVSAATTAVSPSAAAEVLRSLLDPSSAAAANPQPYLSKILPFRRGRPLARSTDPPPASAPAAAPAWCLAWLPPSRVPGLAPDAFVFLGAHVEG

SEQ ID NO: 52189 - protein, 160 aa, Sorghum bicolor
  unsure (1)..(160): unsure at all Xaa locations
  Clone ID: 11065025.pep
HEAPEFISAQAPATPGLMEETVPSRVHESPVLSPQRKASPSTNDETAKADTPAPASDFLHSATGNASDIVGAEMTELESAKPVQVESSVVHALVQQHTGEGLPTQGQASHLEATADMLVGSDGIAALXETVTVNATIEDVPLAVNDSEHCVDGSTEPSAV

SEQ ID NO: 52190 - protein, 188 aa, Sorghum bicolor
  Clone ID: 11065032.pep
ARGPTAWSSFMFDFHILLFLFPAGLYFCFKRLSDATIFIVMYGLTSMYFAGVMVRLILVAAPAVCLISAIAASATIKNLTTLIRAKSRSPQTTSGKTTGSKAAAKGAVDQSLPFQHNAAIALLLGAFYLLSRYAIHCTWVTSEAYSSPSIVLAARGHNGGRVIFDDYREAYYWLRQNTPPDAKIMSWW

SEQ ID NO: 52191 - protein, 126 aa, Sorghum bicolor
  unsure (1)..(126): unsure at all Xaa locations
  Clone ID: 11065037.pep
MAARRGPHVIKLHDPNPPLLGRAPGPAAAAVSAPSRDEGILAQHPRAAPSSASAAHPAFALIEERLVARDQDIQELLVDNQRFAATHVALQQQLIAAQHELRAVSVAATRARAEREGEVRALADXA

SEQ ID NO: 52192 - protein, 155 aa, Sorghum bicolor
  Clone ID: 11065046.pep
ARGPLLARLADPTGVAVPRGLRKLKALHTLGMVNIAQEKTVLQDIRRLTRLHKLAVTGINKKNCQEFCLCLAHLSSLESLSVRSWEKEGLRGCLDSLSMPPKDLQSLKLFGTLGKLPEWVTGLQNLVKLKLERTKLTELDVTMQVLGKLPNLAIL

SEQ ID NO: 52193 - protein, 165 aa, Sorghum bicolor
  Clone ID: 11065059.pep
MKSFTLLTASALLGSAAAEVHKLKLNKVPLSEQLNTHNIDAHMHNLGQKYMGIRPEKHQDLLHDTSINPASGHDVLVDNFLNAQYFSEIQLGTPPQTFKVVLDTGSSNLWVPSQSCSSIACFLHSKYDSSSSSTYEKNGTEFEIRYGSGSLSGFVSQDTLQIGDI

SEQ ID NO: 52194 - protein, 142 aa, Sorghum bicolor
  Clone ID: 11065060.pep
ARGFQVVLGYTGLMSLFLRLINPVVVSPTVAAVGLSFFSYGFAKIGTCIEMGILQLLMVVIFALYLRKIKLFGYRVFLIYAVPLGLGITWAVAFVLTATGVYSYKGCDANIPASNNVSAFCRKHVLRMKSCRVDTSHALRSS

SEQ ID NO: 52195 - protein, 144 aa, Sorghum bicolor
  Clone ID: 11065062.pep
MGIDLNMVGGEGHDRRPPPPVSRELWHACAGPVVALPRRGSLVVYLPQGHLAAAGGGDVAADLPPHVVCRVADVELCADAATDEVYARLALVAEGEAFGRNLHGGGAEGDDDMEDLDAERKSRMLHMFCKTLTASDTSTHGGFS

SEQ ID NO: 52196 - protein, 75 aa, Sorghum bicolor
  Clone ID: 11065065.pep
HACLRSVKHAGASVFLIIDRRCNRHLNTNHSGENCRHLMSRQSLSFKQVICRSLLPACLPARVMLWNETHAGGLI

SEQ ID NO: 52197 - protein, 193 aa, Sorghum bicolor
  Clone ID: 11065067.pep
ARGYIDIDKINTAAWPALVADLGAGDQSITALSFGFTRLFQPNKPVTKGQAALAISTGDSGEVVLEEVARIEAEKIAEAAVNAHGALVAQVEKDLNARFERELKEEREKVETLEKLAEEARMELDRLREEREEEKNILLRGRAAVESEMEVLLKLRSEVEEQLQNVLSKKVEVSFEKSRIEKLQKEIENDNLA

SEQ ID NO: 52198 - protein, 147 aa, Sorghum bicolor
  Clone ID: 11065075.pep
MAGGKIQKKRHGAAGGAGGGGARLQGGIPFEKSKGQHILKNPALVDSIVAKAGLKPTDTVLEIGPGTGNLTKRLLEAGVKAVVAVELDPRMVLELNRRFQGHPLSSRLKVIQGDVLKCDLPYFDICVANIPYQISSPLTFKLLSHRP

SEQ ID NO: 52199 - protein, 99 aa, Sorghum bicolor
  Clone ID: 11065080.pep
WPCCSEWPSRLPISSAAALPAGHRFASPTIFVAVNEHDARRDNQEAVVSELPSQQMVGTTRRNYSRLCSPRLFMPRMHFSGFFLFLPLRNLLGRAITDG

SEQ ID NO: 52200 - protein, 161 aa, Sorghum bicolor
  Clone ID: 11065087.pep
MALLRESILLAFVFLTCSVASLPPTATSNTTDYLALMLFKSLVKGDPMRALESWGNRSIPMCQWHGVACGSRGHRRGHVVALDLTGLNLLGTISPALANITYLRQLNLPQNRFYGILPPELGNIHDLETLDLSYNSIEGQIPPSLSNCSRFVEILLDSNKL

SEQ ID NO: 52201 - protein, 141 aa, Sorghum bicolor
  Clone ID: 11065102.pep
HEDNGTFPPWTLWKGSLGLEFLSHKYSEHADQHTLYPPWIVGSDEENYPLTRQVQRDIWTHQHPRNCSDPGLRFLVADWERLPGFGIGAQIAGMSGLLAIAMKEKRILVTNHYNRADHDGCKGASRSSWSCYFFPETSPDC

SEQ ID NO: 52202 - protein, 193 aa, Sorghum bicolor
  Clone ID: 11065109.pep
ARGKGYGPKFETQDVIGCGINFRTGHAFFTKNGVHLGTAFTGLKNIELYPSIGIKKSGEHLRANFGRNRFVFDIDGMMAEERRHVRNQLNQADVTQLHPPDDENALIQKLVGQYLAHEGYVETSKAFAADVRNRATPLATSSSDSPSPGGEDDLHTMNRQKIRRAILDGDIDKALKYTHTFYPLVLQDKRNED

SEQ ID NO: 52203 - protein, 141 aa, Sorghum bicolor
  Clone ID: 11065110.pep
MVKLATARECRTYSLGAGAGSGTASRNRWEYINAGVYILAAVLLVAGFLAQLPPWGRGWSGRPGLVVTAIGLAGVLAVNAHDLLAHVAGVDYRLGTVAGLDAQLALVELAVPAVQIVGTLLMLVAVIFFEIQMERGDRHSL

SEQ ID NO: 52204 - protein, 159 aa, Sorghum bicolor
  Clone ID: 11065120.pep
ISSSQSFILPFTPAFSTTPRSVDTSYLFVFLFIRRRTAWAYYGDIRSDCLAINALTAARPAGHLTTCLPTYLPAPHRTAPHRIVLQKHSRIPFTKYVHIHTDEYTENVSYTPGTNLKRSESNPNLLEPQLITTPIQRSPTTRPTNNRKRGIESRIGNNH

SEQ ID NO: 52205 - protein, 111 aa, Sorghum bicolor
  Clone ID: 11065122.pep
PISSSSLPRRSRRRRRHHYLAVRSHPAPPTPATQPRIPRRRTESGDGGGDRAGGVGAHPPRLPAPLRRRPRRGAPPPLLLREDCGARHRVLFPLRRGHRTLPPVPARLPHP

SEQ ID NO: 52206 - protein, 165 aa, Sorghum bicolor
  Clone ID: 11065123.pep
ARGSYEGSSELHALALKSLVDLSSREPKLVSLRYAERINWLRTLLGHVDSDAREAASRLLGIASSALSTSSALSLLSELTSTLSQNRPSRFENYHGVLCAIGYLTAGALKQSYISEDMVKNVVDILVKVVISEGSTLASVAMESLGHIGLRCALPSINQNSSTGT

SEQ ID NO: 52207 - protein, 163 aa, Sorghum bicolor
  Clone ID: 11065126.pep
ARGQLDPFQSEAIRCVDNGESVMVSAHTSAGKTVVALYAIAMSLRNQQRVIYTSPIKALSNQKYREFKEEFSDVGLMTGDVTIEPNASCLVMTTEIWRSMQYKGSEVMREVAWIIFDEVHYMRDRERGVVWEESIVMAPKNSRFVFLSATVPNAKEFADWVAK

SEQ ID NO: 52208 - protein, 175 aa, Sorghum bicolor
  Clone ID: 11065128.pep
TRRRRRKRDRKSKHKSKRIIKGDSEAESTSDSSSEDDRSKRHRRGRKSKASSQVSEENLAAVAALKDAISPQQKSGIPRSPAQDVSTLQNGEIHTNGVNESKIERSAAVMPVLTGNRSKSRSQSMSANHSMSKSMSISPRRSPMKRSITSPKRSVSRSPVHHNRIVRTPKRSESR

SEQ ID NO: 52209 - protein, 100 aa, Sorghum bicolor
  Clone ID: 11065141.pep
LQFAAMRPIQSGFRESASPSASWSSRPRSKHPALTTAVRLTSRILPSRYESASCSPNQQLRARSATHLGVCRSSAPTSASTTSLMQSKSPPRVLGGREVV

SEQ ID NO: 52210 - protein, 139 aa, Sorghum bicolor
  Clone ID: 11065145.pep
MQGLDELYYATNIESGGDESTTPAEKKKYLSLTIPPHSVQGPHKSSPVPPTPSPKIPVSPAALSKLVRSVPAVHAPPSLDGSVSSDQVSSTSAPATPDLQSVADNDWNTEEVRVHLDLNLEGSQNPDTADPNTSSDVHG

SEQ ID NO: 52211 - protein, 47 aa, Sorghum bicolor
  Clone ID: 11266114.pep
LKTALQKMAAIPSRKILAVEVLWTPQNENDTLSERELLEDYPLLRPL

SEQ ID NO: 52212 - protein, 94 aa, Sorghum bicolor
  Clone ID: 11266136.pep
ITDSPQPPPERITFTLPVINSASNIAIVSTGDDKANAVHLAVSDTTEGLDAPTSLPARMVQPTDGKLVWFLDKEAASSLESMTDDDASFDRHEY

SEQ ID NO: 52213 - protein, 129 aa, Sorghum bicolor
  Clone ID: 11266181.pep
PMPASDIGKHFGMLLESMDGPDISFTIDNETFHAHRAVLAARSPVFKSELLGSMAESTMPNITLCDIAPATFRVMLRFMYTDALPRDDELGDSPLEMMRHLLAAADRIFLPLLMSFERGWDYNLVGHTG

SEQ ID NO: 52214 - protein, 166 aa, Sorghum bicolor
  Clone ID: 11266196.pep
PPSRRASTDFGRPVFTAAAFYLCAKRHKLKVDKLKLIDLCGTSSSEFTTVSTSMTDLCFDVFGIAKEKKDPKSIKGNRELLDVLPSKRKHEDDSDSSGSDESSDDDQDELDLPTHKRRKKMEKEAYNDWKSSVLSSNKKTKTDPAKPRRQAQLNFKKPAEVPSAAN

SEQ ID NO: 52215 - protein, 173 aa, Sorghum bicolor
  unsure (1)..(173): unsure at all Xaa locations
  Clone ID: 11266216.pep
RIPLEIFKTGKTGWGVRSLSSISSGSFICEYTGELLKDEEAEKRQNDEYLFDIGNNYHDEELWEGLKSVVGVGSSTSSSETMEGFTIDAAECGNVGRFINHSCSPNLYAQNVLWDHDDMRMPHVMLFAVENIPPLQELTYHYNYSVGEVYDKNHEEKVKHCYCGASDCXGRLY

SEQ ID NO: 52216 - protein, 153 aa, Sorghum bicolor
  unsure (1)..(153): unsure at all Xaa locations
  Clone ID: 11266227.pep
YRKSVKQATVRAAHICFVCRYPHLIGRIEVPLKGLHCIGEQLLELPVQGRRREERAPAGEVCASTGTGTGTRLALQWILVKXLDCTHSNYQTLTRPXIVIYCHYLPVSGLGNLRACCLXLDVVAVSQAPSPESNPNSPSPVTTMVGPYPTIES

SEQ ID NO: 52217 - protein, 37 aa, Sorghum bicolor
  Clone ID: 11266264.pep
ISWLKGPKIEFPSQVLWRTTAVYLASLPGGPMHSDDE

SEQ ID NO: 52218 - protein, 45 aa, Sorghum bicolor
  Clone ID: 11266299.pep
IVSVSFVHMDFYLLIPIMRPIDVADKRKKILNFLLEIRCVGIFGP

SEQ ID NO: 52219 - protein, 64 aa, Sorghum bicolor
  Clone ID: 11266402.pep
NASRPNQRALYTSWGTSSSSSNIYGVVSSSFSCSCCTLEPHVILSRSSFLPRSSTRLTTKISVS

SEQ ID NO: 52220 - protein, 40 aa, Sorghum bicolor
  Clone ID: 11266418.pep
LGILADLGVEARPDHLLAGDDATRCDGVEMLRGWREVPRA

SEQ ID NO: 52221 - protein, 89 aa, Sorghum bicolor
  Clone ID: 11266460.pep
LEDVDYLEAPLMIPKDDLLPPTPAAGDEEDERALVLLVHVTSFACGGFVVGFRFSHAVADGPGAAQFMNAVGELARGAENALSVVPPST

SEQ ID NO: 52222 - protein, 81 aa, Sorghum bicolor
  Clone ID: 11266520.pep
FFFFLFSFFFFFFFFFFFGGKGFIYLSRGVTSCQVPTRTAGLQLKQPTGRHGWMDTSNSRSKSKLLQGYMSPSAKNYILAS

SEQ ID NO: 52223 - protein, 147 aa, Sorghum bicolor
  Clone ID: 11266564.pep
NFATFIELIKILEESQMEHQKQLFQLQKKFEAFVADEEKYLMEKVTGLFAESNARKKNMVQDDICSLNRTASERSNNLQTETTKLHDFTSSMKEQWEAYMKRTEEAFQQNVSSIEQKRCFLVGNLQQCKGRVESCSEQWITAQNLVL

SEQ ID NO: 52224 - protein, 61 aa, Sorghum bicolor
  Clone ID: 11266576.pep
ARGQLAPSPEGGFRRTQSRKPPSSSTSESSPARVPESREHEPRSRRPQVLLSSGESLQDDF

SEQ ID NO: 52225 - protein, 97 aa, Sorghum bicolor
  Clone ID: 11266592.pep
MERESSTTYEPKRNCEIRVFESSDEISTDLAEYISQISEISVKERGYFAIALSGGPLVSFLGKLCEAPYNKTLDWSKWYIFWSDERAVAKNHAESNY

SEQ ID NO: 52226 - protein, 120 aa, Sorghum bicolor
  unsure (1)..(120): unsure at all Xaa locations
  Clone ID: 11408855.pep
QGIDKAVYCDPFSICGHMWRIVCYPRGDIGSDSGEYLTLYLELLSTXTIGKAICDILLLNKNGKPCSRIASSRVCVPLPHSRNAAEWVFITSMYISFNNLEENFLTEGHITWVCSIMVTR

SEQ ID NO: 52227 - protein, 104 aa, Sorghum bicolor
  unsure (1)..(104): unsure at all Xaa locations
  Clone ID: 11408858.pep
TRLHHGKKVRDDSKTLIQAGIGQDDMLDNLGFSLEPNCTQNPQVXXXEDISFLETIDTTEPLARIAPADSCSKHGEVDVSQELALTPLAMNYQGSDHDSVHSPR

SEQ ID NO: 52228 - protein, 106 aa, Sorghum bicolor
  unsure (1)..(106): unsure at all Xaa locations
  Clone ID: 11408859.pep
TRREQPKKKIRMGMPATQWISVYNARRPMKQRYHYNVADSRLAQXXXXGNEDGLFISSVASCSNLWALIMDAGTGFTSQVYELSPYFLHKEWIMEQWEKNFYITAL

SEQ ID NO: 52229 - protein, 131 aa, Sorghum bicolor
  unsure (1)..(131): unsure at all Xaa locations
  Clone ID: 11408887.pep
ADLALKNCIKTKSPVRVIHGFKGQSRSEGGHSKGKQTTTFTYDGLYXXXECWQEGPKGEMVFKYKLQRIAGQPELALHAVKATRKSKVREGLCLPDISQGTERIPICVINTIDDMKPAPFKYITKVIYPAL

SEQ ID NO: 52230 - protein, 33 aa, Sorghum bicolor
  Clone ID: 11590084.pep
QALLELSMAPSNLYWKGVHLKSSTISAYSGLSE

SEQ ID NO: 52231 - protein, 37 aa, Sorghum bicolor
  Clone ID: 11590092.pep
NSTKEMCNNSPEEVSSTIMQFIWHRCHYLQNDTSTSP

SEQ ID NO: 52232 - protein, 42 aa, Sorghum bicolor
  Clone ID: 11590098.pep
LSYPMNDVAETVNEIGATVRRVMGGTTGILYDILCKAAYASL

SEQ ID NO: 52233 - protein, 32 aa, Sorghum bicolor
  Clone ID: 11590102.pep
FGGTNPLMAFTCSSTQVVFFQAHLWIIHQHNT

SEQ ID NO: 52234 - protein, 33 aa, Sorghum bicolor
  Clone ID: 11590106.pep
MMPTEKGVLTVRGNVYTAYTCEEESFKITEEID

SEQ ID NO: 52235 - protein, 39 aa, Sorghum bicolor
  Clone ID: 11590112.pep
AKHASEAVGTMGVALSVCTLPGQVTSDRLGPRQMELGLG

SEQ ID NO: 52236 - protein, 44 aa, Sorghum bicolor
  Clone ID: 11590119.pep
NRHSWRHYFKTPFLKQAHRPVSSINIINHKSISQQPFKLSHLKT

SEQ ID NO: 52237 - protein, 44 aa, Sorghum bicolor
  unsure (1)..(44): unsure at all Xaa locations
  Clone ID: 11590120.pep
CLNYWCPLKYHRLPYFQSHSTNRLSQSRIAQEVXIIPFYNSELN

SEQ ID NO: 52238 - protein, 37 aa, Sorghum bicolor
  Clone ID: 11590136.pep
CPQLSYPQSCWKNEIRKLEMLRVQCLEDTRCFEWDIN

SEQ ID NO: 52239 - protein, 38 aa, Sorghum bicolor
  Clone ID: 11590139.pep
RVRCCIYMLLSLNSRIPLAARIRSCTCSDVTALQVQLP

SEQ ID NO: 52240 - protein, 39 aa, Sorghum bicolor
  Clone ID: 11590181.pep
RLCRTADGLLLFVSLRVDCQYVFALTSALPTYKNAQSLL

SEQ ID NO: 52241 - protein, 36 aa, Sorghum bicolor
  Clone ID: 11590195.pep
LKEMSRDGQRPNVVTYSMLIDCLCKSGLHAEAREIF

SEQ ID NO: 52242 - protein, 47 aa, Sorghum bicolor
  Clone ID: 11590202.pep
LVQKWVHTAIKEQLATTCILPGSRNGAFLAILCRSGCILSWIAASYL

SEQ ID NO: 52243 - protein, 36 aa, Sorghum bicolor
  Clone ID: 11590204.pep
NSCRRTQYAHFGDTVTFNTTYRTNLYGLPFILFVGV

SEQ ID NO: 52244 - protein, 49 aa, Sorghum bicolor
  unsure (1)..(49): unsure at all Xaa locations
  Clone ID: 11590207.pep
KMRGXXNXIKTHRXKLVITSPPALTALWAPHKDKRFSHTYKAAGKTSRL

SEQ ID NO: 52245 - protein, 46 aa, Sorghum bicolor
  Clone ID: 11590211.pep
QCLVMEMTCIAADFYFYFWKGLHNSRQVQQQRGMVVKNDKLLAVVL

SEQ ID NO: 52246 - protein, 50 aa, Sorghum bicolor
  Clone ID: 11590214.pep
LSPTMPPSLSPIGSIRHPCFPCFRCYYPSPADGSMLKPPCIVRDPRLPPL

SEQ ID NO: 52247 - protein, 35 aa, Sorghum bicolor
  Clone ID: 11590217.pep
LHCCAKHKRLVSLIQAMRKFLYRSTVGVLRSRCQL

SEQ ID NO: 52248 - protein, 34 aa, Sorghum bicolor
  Clone ID: 11590230.pep
VPPLPTMYSGAFRGLVKSMLRKSPDHRPSAAELL

SEQ ID NO: 52249 - protein, 48 aa, Sorghum bicolor
  Clone ID: 11590238.pep
DVLSREILKSENRLKIIRCISFWEPGHMVRLTSNCVVEMVKNKRKFFL

SEQ ID NO: 52250 - protein, 41 aa, Sorghum bicolor
  Clone ID: 11590240.pep
NPVQYLLRLHPDQEGMSKAETVRAKLGKFGLPGHNHLTPIV

SEQ ID NO: 52251 - protein, 41 aa, Sorghum bicolor
  Clone ID: 11590249.pep
EWANPQKDTYVLCHHGMRSMQVAKWLQSQGFKKVYNVAGGI

SEQ ID NO: 52252 - protein, 56 aa, Sorghum bicolor
  unsure (1)..(56): unsure at all Xaa locations
  Clone ID: 11590254.pep
SLDSQEMLKWGVSGLLHNTQVKAFCIFSWLWLXMTYESFFQNKMTFENFFHAIQTL

SEQ ID NO: 52253 - protein, 42 aa, Sorghum bicolor
  unsure (1)..(42): unsure at all Xaa locations
  Clone ID: 11590264.pep
LXGVYDRTAMGAIRISXXSMPSXXRXXCGXXXXXIVSXXQXV

SEQ ID NO: 52254 - protein, 36 aa, Sorghum bicolor
  Clone ID: 11590268.pep
RYKAIAGLVLHLQASGYSPVSFKLLDNHMAVSLGDA

SEQ ID NO: 52255 - protein, 40 aa, Sorghum bicolor
  Clone ID: 11590272.pep
RSYMYMLSSFRIVWIWRSSRTDHASRKDIQLTTEELIISQ

SEQ ID NO: 52256 - protein, 43 aa, Sorghum bicolor
  Clone ID: 11590283.pep
IQCVVMYSDSDSASSADGYICFRQWWCTNSVSVISCGGNFVVL

SEQ ID NO: 52257 - protein, 41 aa, Sorghum bicolor
  Clone ID: 11590296.pep
DRHPEQLGRLNRWISLHCNGLLIDHYLFLGPNPPSTSWTQH

SEQ ID NO: 52258 - protein, 39 aa, Sorghum bicolor
  Clone ID: 11590321.pep
HYRNVHNAKLATVLGGCKLLCRYISVRNQAFVSIRAARP

SEQ ID NO: 52259 - protein, 36 aa, Sorghum bicolor
  Clone ID: 11590323.pep
ARAVKRKLEASRIPPNDLDRRTGKERKVAAYEFRQL

SEQ ID NO: 52260 - protein, 35 aa, Sorghum bicolor
  Clone ID: 11590329.pep
ANYSEYSTSDNQQSVGIGNSFPDDVMSACQSGQEI

SEQ ID NO: 52261 - protein, 35 aa, Sorghum bicolor
  Clone ID: 11590335.pep
QIYDSRHKWANPYLKEKFCPSRLVPKEMRVQKTCL

SEQ ID NO: 52262 - protein, 34 aa, Sorghum bicolor
  unsure (1)..(34): unsure at all Xaa locations
  Clone ID: 11590347.pep
EXAWFVNSEDQELRTDSRSRSWRSEEGSQRFLSS

SEQ ID NO: 52263 - protein, 30 aa, Sorghum bicolor
  unsure (1)..(30): unsure at all Xaa locations
  Clone ID: 11590353.pep
IPGXYKTVSVISELMDFHWHGTQAADDQKG

SEQ ID NO: 52264 - protein, 35 aa, Sorghum bicolor
  unsure (1)..(35): unsure at all Xaa locations
  Clone ID: 11590354.pep
ELVAELWKANIKAQFVPQEDPSLQXQYEYASDHDI

SEQ ID NO: 52265 - protein, 41 aa, Sorghum bicolor
  unsure (1)..(41): unsure at all Xaa locations
  Clone ID: 11590364.pep
QDXXMXQMVKIGGLGSGEMEEXKXVMXVVVVVLMAQRTNLL

SEQ ID NO: 52266 - protein, 43 aa, Sorghum bicolor
  Clone ID: 11590367.pep
RCLVPYAVSRSSTLCNLYMYLSMNMNGTRWLRFSFSKKKKKKN

SEQ ID NO: 52267 - protein, 40 aa, Sorghum bicolor
  Clone ID: 11590378.pep
VDVAFDLRDTMLSVGLTPNIVTYNSLIYGLCKSGELSRAV

SEQ ID NO: 52268 - protein, 37 aa, Sorghum bicolor
  unsure (1)..(37): unsure at all Xaa locations
  Clone ID: 11590379.pep
TSKWTEWHTGYSPKMKFGYNXAKQLFSGXPXXGXXLS

SEQ ID NO: 52269 - protein, 36 aa, Sorghum bicolor
  Clone ID: 11590383.pep
TSVYTVISGISCLTRPDIFNSSYILFGGQIHCGILL

SEQ ID NO: 52270 - protein, 50 aa, Sorghum bicolor
  Clone ID: 11590412.pep
TAPEHARFFLYETWHFERIVGYKVLYAKSNCVCAIILQDALGPTLSKSCL

SEQ ID NO: 52271 - protein, 46 aa, Sorghum bicolor
  unsure (1)..(46): unsure at all Xaa locations
  Clone ID: 11590421.pep
XVKAALEKQSKSEGRVSTKVNAMDDDDLLDRGLERGVELAVEDEKV

SEQ ID NO: 52272 - protein, 28 aa, Sorghum bicolor
  Clone ID: 11590423.pep
EAYPLAQSDDNCMINRNISEQKLKTMFS

SEQ ID NO: 52273 - protein, 38 aa, Sorghum bicolor
  Clone ID: 11590424.pep
ETCSRFWYSFSICHVCRCEGGDGPAILEQRTPCFASLV

SEQ ID NO: 52274 - protein, 58 aa, Sorghum bicolor
  unsure (1)..(58): unsure at all Xaa locations
  Clone ID: 11590476.pep
HPYAASEQXKPQXVREEDMSACLQRLKKLESLCDHLMSKPPDMPKEKELLLLQSFDRI

SEQ ID NO: 52275 - protein, 34 aa, Sorghum bicolor
  Clone ID: 11590487.pep
GEEAVLGLLIRSTGWTIHLLPCIAAAPRRSCHDL

SEQ ID NO: 52276 - protein, 35 aa, Sorghum bicolor
  unsure (1)..(35): unsure at all Xaa locations
  Clone ID: 11590493.pep
TRXGVAYSSVHSGNKHQPNELQSQPKHCSDGNGPG

SEQ ID NO: 52277 - protein, 37 aa, Sorghum bicolor
  unsure (1)..(37): unsure at all Xaa locations
  Clone ID: 11590501.pep
KRFKDEPMYIERPPPSEDNISXQPQDTPLAEKTVAEL

SEQ ID NO: 52278 - protein, 41 aa, Sorghum bicolor
  Clone ID: 11590515.pep
DNISWWYMSCKPCKKKMDPQAAGGYRCPKCYGTNALPRYLV

SEQ ID NO: 52279 - protein, 37 aa, Sorghum bicolor
  Clone ID: 11590520.pep
NLRLSAGEGTRPLTITGRWPRTITNSCQCSSAYSGLS

SEQ ID NO: 52280 - protein, 30 aa, Sorghum bicolor
  Clone ID: 11590536.pep
EESCTRERRTRGIMVPSALWLCHKVIFRCS

SEQ ID NO: 52281 - protein, 54 aa, Sorghum bicolor
  Clone ID: 11590537.pep
PLLREQAAIGRSTGQMDNVISQAQATLGSLMTQRSTSGGITTKISNVSSRLPTI

SEQ ID NO: 52282 - protein, 50 aa, Sorghum bicolor
  unsure (1)..(50): unsure at all Xaa locations
  Clone ID: 11590574.pep
XKLTYSYRLHGQLRISMPHSLSSQTIRQEAKVIYNIAQQQSSLSTLVLLE

SEQ ID NO: 52283 - protein, 40 aa, Sorghum bicolor
  Clone ID: 11590577.pep
VRKMLNRDPRKRLTAHEALCHPWVCVDGVAPDKPLDSAVL

SEQ ID NO: 52284 - protein, 37 aa, Sorghum bicolor
  Clone ID: 11590578.pep
DEIAGLREMFKMLDTDNSGQITLEELKSGLKRIGANL

SEQ ID NO: 52285 - protein, 39 aa, Sorghum bicolor
  Clone ID: 11590583.pep
QQEGDHEHASTVVSSPPLPTVDSAEETAADIPVNHTALA

SEQ ID NO: 52286 - protein, 34 aa, Sorghum bicolor
  Clone ID: 11590586.pep
LAILVHYCLQIQVMDVCFPYLLAVLAEMLYTTDA

SEQ ID NO: 52287 - protein, 36 aa, Sorghum bicolor
  Clone ID: 11590636.pep
MTRNLHRFPGGVTHSFTDSAEDRDRLLSFEKMFIGD

SEQ ID NO: 52288 - protein, 85 aa, Sorghum bicolor
  Clone ID: 11921784.pep
AQHLEADRWSGSPEDRVPSAIYIIYAVSPYASMHLSPVILYFYPVLLLLLLFLLLVGLYAPFNYEPLPYIIFAILLLLFLIYGPS

SEQ ID NO: 52289 - protein, 139 aa, Sorghum bicolor
  Clone ID: 11921803.pep
WCGTRAPPSSPAATPYAASAPASSGSAAATARFATASSRRSSTSSDGSSSPPSLFIYLLIGPCTYVHGIIAVDHHRLALLPILDEDVSGRCATPESVKLKLVDEFDFELANTKLLLGVCYTAYIFFFCDVIDCSSMLLQ

SEQ ID NO: 52290 - protein, 183 aa, Sorghum bicolor
  Clone ID: 11921815.pep
WTGGDGAAKAVSKILPENLGYILSHPETKERVQSCADASDVLRYAFTLTEDAIDHQYEGCTGTALLIWFDQNKDCFAQCANLGDSACVMSVNGRTIDMTEDHRVASATERARIARTGQPLKDGEVRLNGLNLARMFGDKFLKEQDSRFSSEPYVSQAVRITKACTAFAVIASDGLWDVISTKK

SEQ ID NO: 52291 - protein, 87 aa, Sorghum bicolor
  unsure (1)..(87): unsure at all Xaa locations
  Clone ID: 11921838.pep
KGFSTGLXYMYSSLSEVSQWCKTVDYLGKRRKITLISDFGEISGSRGMERQILYLISKSSYNTSSSRITCWKNIMLTHVPHGQGSII

SEQ ID NO: 52292 - protein, 43 aa, Sorghum bicolor
  Clone ID: 11921839.pep
DVWVLPAIARRKSAKCRGVAYFCRVLGCAIFRACTWHLLLCIN

SEQ ID NO: 52293 - protein, 59 aa, Sorghum bicolor
  Clone ID: 11921842.pep
VGFKGRRLDIPSSVDPKVAPVIESCWARDPWRRPFFASIRESLNPFIKTFPPNQLLEEN

SEQ ID NO: 52294 - protein, 108 aa, Sorghum bicolor
  Clone ID: 11921850.pep
GSGAPARVKSTAVDKDPLAVYVINAVVEPVELFKPAPSPTPAPAPAPAAAADAPKAGKKGAARHAPPAVADAPGPNADDNAAPVDQKDANKKSAAAGAPCDRWWLATV

SEQ ID NO: 52295 - protein, 115 aa, Sorghum bicolor
  Clone ID: 11921855.pep
DLLTVGRWQAVSLQVFDALTNDFMKPAINEVDELLSYGVNVTVYQVQLDVICSTLGTEAWVKRLKWEGLHNFLSLPRKPLHYCHPYYLTNGFVRSYKNLHFYWILGAGHSVPVDK

SEQ ID NO: 52296 - protein, 122 aa, Sorghum bicolor
  Clone ID: 11921867.pep
LATTFMIEVRSLLRRLRCVAWPPALRPVVRPLLPSPAGARALVRSRSRSRARAWRGGGEECEGEERSVLVIFLLLFPSASLSSLFPLLVFFPPFFSRLFSWLFFYPLVLIGLPSEQQGYSVD

SEQ ID NO: 52297 - protein, 98 aa, Sorghum bicolor
  Clone ID: 11921875.pep
VVVGSFIAEGKKPKEEQPKREPTSVPPHTAGFGAASTASPPSDGTSSEHSDDPGSPMGPNGSTFTNAGLPLHSTFAPAGWSLSGNQSRYDPDLKMMTD

SEQ ID NO: 52298 - protein, 125 aa, Sorghum bicolor
  Clone ID: 11921896.pep
FSCEVQSLTPLVTCILRRLGGDIDPDRLPQILYEDEDQDKVVLASDDDLIAAVDHARLAGWKGLKLFLDYSGTTGRRKAVASSSGGAMAVGMSSRDAWAAAYSGVAAGAALVTGIGVMAYLRRSA

SEQ ID NO: 52299 - protein, 139 aa, Sorghum bicolor
  Clone ID: 11921947.pep
HLLALTVCMSSIWPILSGVAVGAGWQVPVAFINVGCYYLVGIPMGILFGFKLKHGTMGIWIGMLTGTFLQMSILLAIIFTTKWDKQAALAEVRMAEWGGKNENLPLMETTHTADNHMAPAQEKILAHDSQKNVELVRTD

SEQ ID NO: 52300 - protein, 65 aa, Sorghum bicolor
  Clone ID: 11921962.pep
ASPENAAIYNQNLINHVGRGTPRHPGAIETILFSMFNENLKENGVEQNWGLFYPNMQRVYPISFN

SEQ ID NO: 52301 - protein, 130 aa, Sorghum bicolor
  Clone ID: 11921967.pep
WFYAHVSVQGVGFVLGAVGVAAGFKLRDDVPGADSHQALGVAVLVFGCLQVLAFLARPDKGSKVRRYWNWYHHYVGRAAVACAVANVFIGLSIAHEATALSAFYGVFLAVGVLASVVLEVRLWRTARSSH

SEQ ID NO: 52302 - protein, 90 aa, Sorghum bicolor
  unsure (1)..(90): unsure at all Xaa locations
  Clone ID: 11921968.pep
ASIMTLLSAASPARSLVICPDRXSNIARFINGINNHTPEGRKKQNLKCVRFDVGGECRVLLVANRDISKGERLYYDYNGSEHEYPTHHFV

SEQ ID NO: 52303 - protein, 97 aa, Sorghum bicolor
  Clone ID: 11921981.pep
CHLCQLRLRVPAAASSAVVNFGFERRHELVAVRMLRPAGAAHRCMLRVRGHQVLCPYRLMSRQLQDAFLKIRLTPHQRRIGGVRPSSIKMNICSNHV

SEQ ID NO: 52304 - protein, 124 aa, Sorghum bicolor
  Clone ID: 11921983.pep
NLAVLHSRLMLIWLHGTIFVAALLLKAGDAAVICLVSLQLPLSPTAQLLNSSSHGQDEWPVGMVDDVQDTLPGCEKSLEAIKLVCFTNAEHNGKTVRHVPLHKPPPSHLQVEIIGATTDDASHV

SEQ ID NO: 52305 - protein, 120 aa, Sorghum bicolor
  Clone ID: 11921985.pep
AQSSDNQCLALMTELREMQERVENRRRYEESGRAFMLAGLSSHSWQRATARGDSTEITTTIHTYQTPTMVDMLQRSQILVAPTADMLNRSPTVAPSQRSPHRFSRSSRSRTTKSFSEQLL

SEQ ID NO: 52306 - protein, 86 aa, Sorghum bicolor
  Clone ID: 11921991.pep
PFFVPGDTEVTPTVIPSTEYCAAPQACSSAHGKPHTYCLVVIIHQRALLAAVEFDREEENTCGGAGQRAHAAAARSPPQRRRLQQS

SEQ ID NO: 52307 - protein, 94 aa, Sorghum bicolor
  Clone ID: 11922002.pep
TADVDNSGKTDAETAPRPQLAPTAPVLVAVPVPVTEKMGGYDVAYPDRGTVISRYKEKRKNRRFDKQIRYESRKARADGRMRIKGRFAKSGGEV

SEQ ID NO: 52308 - protein, 41 aa, Sorghum bicolor
  Clone ID: 11922005.pep
KLKRLGTVQDMAAAAAFLASDDASYITAETIVVAGGTQSRL

SEQ ID NO: 52309 - protein, 152 aa, Sorghum bicolor
  Clone ID: 11922007.pep
MAKGKEELPNAKCKEEEADASVDAANGDGDADSAPTNAPKTGLGLKLDADEVLKAWSDKGSMFAEGSGPESPTSAAEVRAKLADIDLFPENGAGGGIREASVLRYKEKRRTRLFSKKIRYQVRKVNADCRPRMKGRFVRSPSLLQQALEEES

SEQ ID NO: 52310 - protein, 157 aa, Sorghum bicolor
  Clone ID: 11922009.pep
DTSSSGSGSGSVGLLESMLIGDEHLMLRPNPSMVKVPSMPALSYREPAGSRLLPAHGVGSDGDVTSHAHALCPPGEDIHHGATWDFTFEAVKPAKRRTASEVGISDMFAIAPAGDWFGTCGGSTGPSSAVTDDEFNLEMQQFMSLLPLSIDEHGCNA

SEQ ID NO: 52311 - protein, 149 aa, Sorghum bicolor
  Clone ID: 11922092.pep
WPPPPVHRPPPRRRQAWAVCEGFRWPSDPRLLHLDLHHEGQYQGQAGAPKAGHGAVAVPAAERQRARRPAVAVQLQPGAPAGDRAQHARAVVVLVVRPHAVVPAQRQAAAAAAGQAQADCGGGRRRVLRVAVVAHAPHAARRPRVPTQQ

SEQ ID NO: 52312 - protein, 146 aa, Sorghum bicolor
  Clone ID: 11922114.pep
MSCNGCRVLRKGCSDACVLRPCLQGIDGAEAQGHATVFVAKFFGRAGLMSFLTAVPETQRPAVFQSLLYEAAGRTINPVSGAVGLLGVGSWQTCQAAVETVLRGGAIGPLPEFDVGRDTFALAARRAVGCSTFSTAKRAPTTTRTN

SEQ ID NO: 52313 - protein, 100 aa, Sorghum bicolor
  Clone ID: 11922135.pep
ILKERPSPRCPINHYLLLKTSANVWLHHLSFHAGRVGKDILTDLPGEKAFYVRFPSPANPEVSSSSRVMLLSPCHHRWVVLAKLQRLLLLLVRKHIRLCL

SEQ ID NO: 52314 - protein, 34 aa, Sorghum bicolor
  Clone ID: 11922138.pep
RDLKVLVEVNQLAVHHGVRHHLVVVVSHLQLVLG

SEQ ID NO: 52315 - protein, 69 aa, Sorghum bicolor
  Clone ID: 11922157.pep
LGDAVRCKMLSPKWSKGYYREGQALILLKEYEKACDTLSEGLELNPMCDELDKLYWEAMDLKNSSTGAA

SEQ ID NO: 52316 - protein, 155 aa, Sorghum bicolor
  Clone ID: 11922159.pep
MREVVKKEVIKLLHAGIIYPVPHSEWVSPVQVVPKKGGMTVIMNEKNELIPQRTITGWRMCIDYRKLNKATRKDHFPLPFIDEMLERLANHSFFCFLDGYSGYHQIPIHPDDQSKTTFTCPYGTYAYRRMSFGLCNAPASFQRCMMSIFSDMIEE

SEQ ID NO: 52317 - protein, 113 aa, Sorghum bicolor
  Clone ID: 11922172.pep
CAAVSEIAPAASAAYGVLLLGGGAFAYARSGSKGSIYGGLAGAALMGAAYYLMQSPETMAAGDAVGFGSAFLFACVFGIRLYNSRKLVPSGLLLALSLGALGVFYSAYLQDKV

SEQ ID NO: 52318 - protein, 182 aa, Sorghum bicolor
  Clone ID: 11922190.pep
MKDSDGEGAGGGVARSHPSNLPLPAPQSDPNLQYSGGTDDESSNRNSSSSATGGASPGYYSDYPSSFSGECSPYNMSPWNQTMASPWSHHSEASAAGLGGAAPTMAPGTSLISSLVREEGHIYSLAAKGDTLYTGSDSKNIRVWRKQKDSGGFKSSSGLVKAIVISGERIFTGHQDGKIRVW

SEQ ID NO: 52319 - protein, 76 aa, Sorghum bicolor
  Clone ID: 11922213.pep
TRIPSRTGSNLALFDLAPSPSAASSSHEGGPAVSSGSATAASPYCALLRAALFGPDTPDRVASSATACSSSSSPGP

SEQ ID NO: 52320 - protein, 102 aa, Sorghum bicolor
  unsure (1)..(102): unsure at all Xaa locations
  Clone ID: 11922233.pep
ARGNSYPTKDTRFRQSDNEISPLHEALRGKTTMPTLSSSEPNDHAHSFKSYYNNSEAIPHQLHSVSTPIPPTSIIAXXXLEQSLKKEQELMRMFLTTPVSED

SEQ ID NO: 52321 - protein, 71 aa, Sorghum bicolor
  Clone ID: 11922237.pep
SITAASIPHLIALPSTRFLDGIIKGRGPARSYSLIISTALSASSLIPCSLFHENSPVEFVLGFVESTEPSC

SEQ ID NO: 52322 - protein, 137 aa, Sorghum bicolor
  Clone ID: 11922262.pep
MGIRSPTGLLCLMLLIQLGLGLGEAATVSNGTTDGKERWGYVEIRPKANLFWWFYQSSQRVSTPEHPWPTILWLQGGPGESGIGSGNFQGIGPLDVDLKPRNPTWLQKADLIFVDNPVGVGYSYVEDESALVKTDLE

SEQ ID NO: 52323 - protein, 138 aa, Sorghum bicolor
  Clone ID: 11922273.pep
LHSTALQPSTAPCCLPLQESGRPATTSSPPPPAPPNASASAIASSIHTSPPCPRASACSLSLPAARRPASSFIGRHTPGTVRCCELARWAWRRVGACPKHEEAVVPRHGARVLTAPRGRRVRRRVARGARRRDRDRKR

SEQ ID NO: 52324 - protein, 61 aa, Sorghum bicolor
  Clone ID: 11922283.pep
KVNYHILAFICLTCIFPLFFSWLLHVYICLHSCFFIYKGIPCFLGKHIYGSCCLLSLSTWF

SEQ ID NO: 52325 - protein, 95 aa, Sorghum bicolor
  Clone ID: 11922295.pep
MGCFSCCCVADDDDIGRRKKHDDAYVPIPAQVDNFGPSRPPAPIPVIPTGRDQPIAVPPIHLEELKEITKNFSSDALIGEGSYARVYFGVLKDGT

SEQ ID NO: 52326 - protein, 156 aa, Sorghum bicolor
  Clone ID: 11922299.pep
TRELETRIRNQLRRPQLPPSLYDTAWVSMVPMRGSHHTPCFPQCVEWILQNQQDDGSWGVSQSGSEVNKDVLLSTLACVLALKRWNVGRENMWRGLHFIGRNFYVAMDEQVAAPVGFNITFPGLLSLAIDMGLEIPIRQTDVCGILHLREMELKRQ

SEQ ID NO: 52327 - protein, 132 aa, Sorghum bicolor
  Clone ID: 11922307.pep
MVGGMSPPRRTLSMGSGGAMGRRVAAAAAAAAVMSDSPKPVLSRSMTMGGERTVKRLRLSRALTVPESTTVLEVCRRMAARRADAALLTDSNALLCGILTDKDIATRVIARELKIDETPVWKVMTRHPIFVI

SEQ ID NO: 52328 - protein, 164 aa, Sorghum bicolor
  unsure (1)..(164): unsure at all Xaa locations
  Clone ID: 11922335.pep
ARGPFAETLGSKYRKTWLRLVHRTLELAGPAFIKWGQWAATRPDLFPSDLCTELSKLHTKAPAHSFKYTKKTVEKAFGRKLSDIFENFEENPVASGSVAQVHRAVLRFRYPNQQTKRVTVAVKVRHPGVGDSIRRDFNIINAVAKISRYIPTLNWLRLXESVQQ

SEQ ID NO: 52329 - protein, 152 aa, Sorghum bicolor
  Clone ID: 11922342.pep
GYDEKAAAAGNGGWWPASAWEDPQVLRLEDVIVPTTSCHGLQPLLTPPSPENRSSGGEMADEVVRQLGELAKLEATVAAAYAEMEPADGEQLPPWASPELAIGHADFGALDAGAAWHDAATIAAVPSTEEQEAWIAAGCDVDAAGRTDEEAR

SEQ ID NO: 52330 - protein, 42 aa, Sorghum bicolor
  Clone ID: 11922346.pep
MDVKCRRLEGKVAVVTASTQGIGLAIAERLGLEGAAVVISSR

SEQ ID NO: 52331 - protein, 143 aa, Sorghum bicolor
  Clone ID: 11922348.pep
TRLPQPSPIPHTPLCLSLSLSLNNLSLSLILQRIQEVPLLLSPFVLNPNTASQLSSGNSPAFFFNSCALGCFFTLLLLLFLPQRRSACAAAAKTFTFFFTSSSSKVLLVPLGFLNFLGELDRLGSAISCPSVLGFMVVELIQE

SEQ ID NO: 52332 - protein, 149 aa, Sorghum bicolor
  Clone ID: 11922382.pep
MKQKQIQLNQKAYFEIISSCTMLRDWKTASQIIEHLDSSLSSISFGTLNHILNFLGKCGRTESMMKLFYKMVTACSTVGLSTYTILLRNLLVVGKWRKYVEVLQWMEDAGICPTLYMYQNVLPYIWRDNSMDYVTLMQEKINALREKVT

SEQ ID NO: 52333 - protein, 126 aa, Sorghum bicolor
  Clone ID: 11922407.pep
ARGGRLQRKRRAVQRSIYHGSKPTFGVYKCRSPGTGPGATIEAGRGLRRVRECDPPAARSYSPSCLCRVVPMGAGARDEEAAAAGAGAHHGSLAMEKPQHGAAEYAQDGSVDLRGNPVLRSQRGGW

SEQ ID NO: 52334 - protein, 139 aa, Sorghum bicolor
  Clone ID: 11922414.pep
PQTTPLPPRAPSDPPPTAHPIVPASRAGRTGRPAHPPASLPPCRARPRSSSPPPPRAAAGRCGGCSPRRPSPRPASSSASPASSPPRSRSRAPRPSLTAAARIPRARSPSPSRGIAARGMAPPRAPRSSRPRSPPDRAA

SEQ ID NO: 52335 - protein, 154 aa, Sorghum bicolor
  unsure (1)..(154): unsure at all Xaa locations
  Clone ID: 11922426.pep
SGWLGASPDGVLGCEPDGGILEVKCPFNKGKPELALPWRAMPYYYMPQVQGLMEIMGRDWVELYCWTPNGSSLFLVPRDRAYWALIHEVLRDFWWGDVMPARELALLGKEDEARSFKPQPKHRLTNLVLYRSRKLASEAKXLCMDVGGHVEFFK

SEQ ID NO: 52336 - protein, 81 aa, Sorghum bicolor
  Clone ID: 11922439.pep
TRQWARYYGGGGLSLGTPVICLPPPTTTPFLLSPAVINVSFPQQPETLTTLATIVAASCASSIKIDFDFISRLKKRISVFN

SEQ ID NO: 52337 - protein, 118 aa, Sorghum bicolor
  Clone ID: 11922443.pep
YAPPEFSNSENAMATVKSDIYSFGVVLFELVTGKKPLGDEYPDQKEASLVNWARAMVKANHGPSIIDPKIRDTGLERQMEEALRIAYLCTAELPSKRPAMQQIVGLLKDIEPKVEEGD

SEQ ID NO: 52338 - protein, 60 aa, Sorghum bicolor
  Clone ID: 11922451.pep
SACSHGFWHDRPGNLFFSKVAPSLCSRAPSNVYILYFFPCHMNDILFVAQQIQFFPLFEV

SEQ ID NO: 52339 - protein, 114 aa, Sorghum bicolor
  Clone ID: 11922460.pep
LTLGRSVGRLQKERWDRSLLPITPSVTCVLGGEASGAFNASARVRASGGGQCPRARHLSVRSSPLSSSMAVVARVLNRFARDYFRLRGCDRRWRRTRKIGASNLRVSTFIRAIS

SEQ ID NO: 52340 - protein, 50 aa, Sorghum bicolor
  Clone ID: 11922470.pep
LHGASIRKSSRPHRQFFDPPLGPVQQKNHSRIFLFLRNCPNSQNLFFPCP

SEQ ID NO: 52341 - protein, 63 aa, Sorghum bicolor
  Clone ID: 11922476.pep
SCSPATSGRTTSTSTTAGTGTTASPARGSKRSDFFFSCTRFATCSVGICNMYHHITCICISPC

SEQ ID NO: 52342 - protein, 97 aa, Sorghum bicolor
  Clone ID: 11922481.pep
WGLQRLKRIPFDLMSMISRIPNKSKSPSIPFDPLLPPLEGINQTWPNWYSPPVKPCSPCTPAMSLAINDHMHTQVLYSRRYLVVQRYKLFGFRYSKY

SEQ ID NO: 52343 - protein, 81 aa, Sorghum bicolor
  Clone ID: 11922482.pep
LPGRSSQENKPFLLLCIATSSLPVVSNKTETNQKLFTVCVMSWKILSLLPIFSFTAGLVSQLVGSLPWPFPSAAAGSSSST

SEQ ID NO: 52344 - protein, 73 aa, Sorghum bicolor
  Clone ID: 11922498.pep
LSDSKISPPAGITRPRRLSETYEGSAYDIFGTMDDQKGVDLGVFSSMPRLPARRRVVLRKVGSLFRWKSFTNK

SEQ ID NO: 52345 - protein, 57 aa, Sorghum bicolor
  Clone ID: 11922511.pep
KKPRKGRAMTSSEPRISLSSHLKKAQACKNRWPWNQHHKSIWSEPIILIYPLSHPRS

SEQ ID NO: 52346 - protein, 189 aa, Sorghum bicolor
  Clone ID: 11922515.pep
SNEWFVLVSESCIPIFDFNTTYQYFLNSSQSFVMAIDDPGPYGRGRYNWNMTPEVELDQWRKGSQWFEVNRELAIEIVKDTVYYPKFKEFCRPSCYSDEHYIQTMLSIETPQSLANRSVTWVDWSRIAAHPARFGRGDITEEFLREVREGQTCLYNEQNSTLCFLFARKFAPSALGPLLELAPTVLVLD

SEQ ID NO: 52347 - protein, 77 aa, Sorghum bicolor
  Clone ID: 11922523.pep
KYEEALDELERLKEIAPHESSMFALMGKIYKQLNILDKAVFCFGIALDLKPPAADLAIIKSAMEKVHLPDELMEDDL

SEQ ID NO: 52348 - protein, 111 aa, Sorghum bicolor
  Clone ID: 11922532.pep
IERATGCVPLVHVDDLCRAELFVAEEVSAAGRYICCSINTTIAELARFLADKYPQYDVKTSLLSGERLEKPRVRLSSEKLVKEGFEFRYRTLDDMYDDMVEYGKTLGILPS

SEQ ID NO: 52349 - protein, 180 aa, Sorghum bicolor
  Clone ID: 11922535.pep
GDRLPHTAADAEAEDPWYKKLPKYLLLLAALAAAVTYQAAMSPPGGLWGYGQAGHIAGDPVLRSTYPRRYKAFFYCNATSFMASLVIMVLLLIKRVSSAQSAILALHAAMILDLFGLMGAYAAGSCRRVRTSAYILALVVGVSTYIVVLVVVSIGIAKWMKRVMCGMRERLIRCFSVEDL

SEQ ID NO: 52350 - protein, 70 aa, Sorghum bicolor
  Clone ID: 11922536.pep
MEVSIASLAELVMLAMAIIANDVSHFGFLAILSVSSVAGAAWMFCRWLTNPTDEQRELFMFDPLYQVQAV

SEQ ID NO: 52351 - protein, 58 aa, Sorghum bicolor
  Clone ID: 11922555.pep
KTVSPLSYFRNLSLAKKKKTTLNNELCRINPKQNCCFSFLFFPCIHSEAGPLTPTLHT

SEQ ID NO: 52352 - protein, 112 aa, Sorghum bicolor
  Clone ID: 11922556.pep
ADSSIEKVFGRYWDLANTEIDLNIEARESRVNCNIQLSQNEEPIGGSLADLLIMIAQGAMEENLNDLNMAGIRGLEEALGDALAVIRNKLTMKVTGCLGGPEPEVCTFFHQQ

SEQ ID NO: 52353 - protein, 111 aa, Sorghum bicolor
  unsure (1)..(111): unsure at all Xaa locations
  Clone ID: 11922591.pep
RRXYAIFALESWRSHIPTVLKEILAPSCRAAGADGIHGERREGGEGEAGAAAAQGVPVGDAQGVPAARLGAVRGRHAHGAARPRGGGGHAVPAVAGGLTRRRRRRRGGGGG

SEQ ID NO: 52354 - protein, 60 aa, Sorghum bicolor
  unsure (1)..(60): unsure at all Xaa locations
  Clone ID: 11922594.pep
MPTGDGPPAPGQGGSTVSITVVGASGDLAKKKIFPALFALXXXDCLPEHFTVFGYARSKM

SEQ ID NO: 52355 - protein, 114 aa, Sorghum bicolor
  Clone ID: 11922599.pep
LHNNQPYAAYHILKGKKMPESRYLFATSCFRMNLLREAEETLCPVNEPNMEVPSGATGHYLLGVIYRCTGRISAAAEQFTQALTLDPLLWAAYEELCILGIAEDTDECFSESTA

SEQ ID NO: 52356 - protein, 68 aa, Sorghum bicolor
  unsure (1)..(68): unsure at all Xaa locations
  Clone ID: 11922608.pep
XRATKSTTTGLSVSAPCRELVVSPVSLCHAREVVTGDRRKRRLVASKAKNVGRRHEEDCVRDRRERLH

SEQ ID NO: 52357 - protein, 128 aa, Sorghum bicolor
  unsure (1)..(128): unsure at all Xaa locations
  Clone ID: 11922613.pep
LQILVFLCKPVGDWLGNVQGTLRRFLKLEQIPPQGDADEQAQGLFDRQGNLDADQLLKKSRMYLLLLGILAASVTYQAGLNPPGGFWQSNATDGLHHYLAGDPVLHITYPRXXLVFFYCNATAFVASL

SEQ ID NO: 52358 - protein, 125 aa, Sorghum bicolor
  unsure (1)..(125): unsure at all Xaa locations
  Clone ID: 11922614.pep
WVIIDSFFFIYSANINLNVCNVTLRDXXXYPERRDAVGGSGPQAQRPRAREAAAAADEGRLWRGEESGVCCGGGEHPHGSSVVAAAAARLLMQPSQWQGPPGSSGSAQGSGSFWKHGPAPAAALS

SEQ ID NO: 52359 - protein, 54 aa, Sorghum bicolor
  Clone ID: 11922636.pep
ATQASSSPLARLFSSVGCPPTQGLGKIEMEVGAAARRRARAAHQQEEIRESKAG

SEQ ID NO: 52360 - protein, 178 aa, Sorghum bicolor
  Clone ID: 11922648.pep
HEAKEITRILVSHPINAKRAAEGKNIANVVLLRGCGIRIEVPAFETKHGLAPCMVAPTKIIAGLGLSLGIDILEAPGATGDYRTHLTSKAKAIAKALSAPMDTPPRVFVPGEDEYKAGRENGYDFGFLHIKAIGDAGHDKAVKLKVRGLEAVDRAIGQLARLLWEAEKAGHYQYFLCV

SEQ ID NO: 52361 - protein, 139 aa, Sorghum bicolor
  Clone ID: 11922658.pep
MKMLVRRSWEESRLLLRLAFPALLTEVFQFSIGFVTTAFVGHLGEVELAAVSVVENILDSSAYGVLYGMGSALETLSGQAVGAGQPEKLGVYTQQSWIISVATAVALAPAYVLAAPLLHRSLHQPGAVSRAAGPYARWA

SEQ ID NO: 52362 - protein, 122 aa, Sorghum bicolor
  Clone ID: 11922668.pep
RVCVVLFQLAYFRMIKHKICIRSKVRHKLSWSLFSYSLMYLLIRFQLQDAICRQQSCTLTHHSTVFLQVCSMVSREMLAAAEALEFFIEKESFGVRNVQTQCTLLIFSLPCCSPCYVFHLNC

SEQ ID NO: 52363 - protein, 125 aa, Sorghum bicolor
  Clone ID: 11922672.pep
MASQSAASMLATAALLLGVFANIAPTVVESIGVSYGMSGDNLPPASSVIGMYKDNGISLMRIYAPDQAALRAVGGTGIRVVVGAPNDVLSSLAASPAAAASWVRNNIQAYPKVSFRCVCVGNEVG

SEQ ID NO: 52364 - protein, 93 aa, Sorghum bicolor
  Clone ID: 11922674.pep
MGAGKGGDGGGGGGEAAAAAPEAAQPVVLKMELHCAGCAHKVKKAIKRVPGVESIVTDVAANRVVVAGTADAGALKARLEAKTSKPVEVVSAG

SEQ ID NO: 52365 - protein, 126 aa, Sorghum bicolor
  Clone ID: 11922677.pep
MKPRSSCSPSPGTSRALVVLLLCCLCSSVAMSQTADSCTSTSTTTGLAAVSRLIPFDTSNLTCFDAWTSQGFILRYGKSGQNNTWSFVLSAPDGGGYISVGFSSDGSMVGSSAVAGWTTGGSGVGV

SEQ ID NO: 52366 - protein, 106 aa, Sorghum bicolor
  Clone ID: 11922678.pep
MGAAGQLRRRTRARTPPGPRPEAAAAGDDDDVRCEACGSGDAAPELMLCDGCDRGFHIFCLRPILPRVPAGDWYCPSCRSPASSKSQSAAAAAHTVVAKKPKQFPL

SEQ ID NO: 52367 - protein, 176 aa, Sorghum bicolor
  Clone ID: 11922682.pep
MFPSGKGSKDSLTVSSSVEVNTDVADADMKDSTDIGEGEQETNITIDDSDNADNLKTKEGTKVDCEFGEVTASSYKKSNSTPIRTEHSDYPLHRCMRIVAHDQNSGAFFIAVLHKLSPLNENQVIDGVKGEQNISKDKTEKLEKDLGSDKASSEENIVHHEVIDNTNVLDGEQNED

SEQ ID NO: 52368 - protein, 143 aa, Sorghum bicolor
  Clone ID: 11922685.pep
ARGSSSQVLPSRSRKLWWRLFLWSHRNLHKPRSPRTAHQAACSPGRHGGYTSDTFEEGPAADRKDKKVMVDDSPPPSVPNQWVAFCAENSIHDRISAWVSSIESEPPFHIAEEDDNYDGEDDEEHGGECASERPRHLELGEPS

SEQ ID NO: 52369 - protein, 49 aa, Sorghum bicolor
  Clone ID: 11922690.pep
YIINNKISPLGVNSIYLHTVFKVFSFLQLVRNLSYILLQNPRGNARGIT

SEQ ID NO: 52370 - protein, 191 aa, Sorghum bicolor
  Clone ID: 11922692.pep
ARGSPVGQSAVPQSHPPLKPKMQQRRSGPPSQSTPNSSGLAPRAPIQSYGTPRRATPTMASSWQSTSCSAWRRRTSSRSPPPRPCTAGRTAPWAPPHPWTTGLDPGSGRAVGIHDLVAWIHDPTRSMTWWPRSALQCSPAPYHFPPPHYRIPSLLVPCRQQAVLGSNGIPGRPHLHTVPPLPTSAPGTGSG

SEQ ID NO: 52371 - protein, 159 aa, Sorghum bicolor
  Clone ID: 11922694.pep
ARGFFFFPDNTTLSESQYDPFVDYVEPPKVGNTNNLKPSNISSNISSQHTNQYANAHACLIAPDRGRSSSLDDIIKVKAYDRKKDAAYNNEKTRDFRFHLAEHIKELVKPIWKKGNLSKDAHRLVVKKSVEKVVDSIEPNQVPTTEELITKYIATCGPK

SEQ ID NO: 52372 - protein, 179 aa, Sorghum bicolor
  Clone ID: 11922697.pep
TRLDVSGSMAGTKIALLKNAMSFVIQTLGPNDRLSVIAFSSTARRLFPLRRMTLAGRQQALQAVSSLVASGGTNIADGLKKGAKVIEDRRLKNPVCSIILLSDGQDTYTLPSDRNLLDYSALVPPSILPGTGHHVQIHTFGFGSDHDSAAMHAIAEISSGTFSFIDAEGSIQDGFAQCI

SEQ ID NO: 52373 - protein, 142 aa, Sorghum bicolor
  Clone ID: 11922713.pep
MGRCACAWQMVVVGALAVLVAAATTARAAPQVPCYFIFGDSLVDNGNNNFIVSMARANYPPYGIDFAGGPTGRFSNGLTTVDAIAKLLGFDDFVPPFSGASSQQLLRGANFASAAAGIREETGQQLGGRISFSGQVQNYQSA

SEQ ID NO: 52374 - protein, 68 aa, Sorghum bicolor
  Clone ID: 11922717.pep
ETPDHHYYHLAFFTNKKVEAFEELTWDYGIDFDDVEGPSKPFRCMCGSRYCRDPNNTRRMGRAASKRK

SEQ ID NO: 52375 - protein, 116 aa, Sorghum bicolor
  Clone ID: 11922719.pep
CSSRVQRSVVHGCGTARRVAAAHWLAGDGCGKAAATSPRMCAQPGQAAAVSLGRARVRSALHLAGLRTGTRAPRPGTCACPTAHAHQSPAIKKKIRLFDECRLPSSLLRGCYTCGA

SEQ ID NO: 52376 - protein, 49 aa, Sorghum bicolor
  Clone ID: 11922747.pep
AHENPVAMPVSAAANEAFKKARSLGLGDQDFSAVYEVVKGAGGSGFGQA

SEQ ID NO: 52377 - protein, 99 aa, Sorghum bicolor
  Clone ID: 11922761.pep
RRHNHSIKNKEECQDPGAIICETEAVPALCGFRAIWVVPSRRRKRIASKLMDVARKPFCEGRTLGISQFAFTPPTSFGKGLACRYCKTSSFLVYKDGPV

SEQ ID NO: 52378 - protein, 49 aa, Sorghum bicolor
  Clone ID: 11922767.pep
LVHDYSHRASGGAARAPDPWSLSYKFLSLMYFKKRLKLSQDRRSSLELS

SEQ ID NO: 52379 - protein, 152 aa, Sorghum bicolor
  Clone ID: 11922785.pep
MRAAVNTPPPHCYSRRRASATLLDARHVFDHVPQRPLPTLAAELRARPVAAATRRPAQRSAASAAAPTCGPASVPRLFRTFLQIPAASSSTSRVRLTLSAFLPSRRNFEGYIPRSCSSSSIQIYSRSSLLNLSPTSALMVSSQLTSSDVAQR

SEQ ID NO: 52380 - protein, 184 aa, Sorghum bicolor
  Clone ID: 11922797.pep
SPSPPDTEPVMSYGSGFIIKDGPPTSLVLTCQHVVVDAVSVRIRRVVVGVGVEEFEATVINGNSGTDVAVLRVRGLRSERAFSLALSFTSPLQVNEPAVTIGYCNPENLLDEISLAGLPATSPGCIREAPDDFLEALREEDGKRMLGKGPGGVVHELILLNCVSMSGVSGGPVVDRHGVVGMAK

SEQ ID NO: 52381 - protein, 116 aa, Sorghum bicolor
  Clone ID: 11922798.pep
TRHPHTILLPVSTPATMATWPNPAVPLLLVAALLALEDWLSTPSCSGAPPAAHGSGDLRAMMVADLMLLGSDASFADRHFRDHVMSKFFAVSDRIRISDASECPEVLRNFVTYLEI

SEQ ID NO: 52382 - protein, 151 aa, Sorghum bicolor
  Clone ID: 11922800.pep
ARGDSRLDGTGAVVKSIDVTEKLVSTEDGGDGDDPGRMDSSDIVTSAVSSSLASQEVSPRPVTDDVKNASENVDATQKGNRALSVKVPFRGASPRRRLASDGIDTITKSMDFAEKDKKPMTVSVPSRGMSPRRTARSDSANIMSKSMDFAD

SEQ ID NO: 52383 - protein, 168 aa, Sorghum bicolor
  Clone ID: 11922801.pep
HEDLSGNRLGGYIMGAFQEQLRVIDLSNNAFSGLNFSSGYAGSALMYLDLSGNELTGEFTIAGRFQNLRHVNLAHNQLCNANLLESMGEISGLEYVNLSSTGLHGQIPADFSSRLVGLKVLDLSRNNINGVVPDISSLCLYVLDLSVNNLTGEIPVALVKKLASMDRF

SEQ ID NO: 52384 - protein, 63 aa, Sorghum bicolor
  Clone ID: 11922820.pep
QPPADDEVAARVRAATAGDFKPEHVNGFPIRPDAGSIDLVCFLLTRILDSGFPLFPLFLLSLP

SEQ ID NO: 52385 - protein, 146 aa, Sorghum bicolor
  Clone ID: 11922840.pep
MTKKQRSEAGAKRRRDRHHHHRRQLRDERCVSCTTFNILAPIYKRMDNENCRESQYRAYWFSRNEKIIDRLLADHSSIICLQEVWLGNDELVDMYQKRLGDANYMLFKLARTNNRGDGLLTAVHSNYFNVLDYRELLFNDIGDRVA

SEQ ID NO: 52386 - protein, 169 aa, Sorghum bicolor
  Clone ID: 11922847.pep
TRSDSEGGSPLSKHSWNYIRRYEGQCSSSSFTKISHFSESSIITEAKKQLSERWSMVTCDENSQVQPSRRKCTLGEMLSIKEAKKDEATTGMFSVSSKQSCGLQNELTTRSTNVTISRKNDHNGERSSKKLPRSKSVPVISSTSDNMVVNVQASNPESLKLNVAVVSNK

SEQ ID NO: 52387 - protein, 99 aa, Sorghum bicolor
  Clone ID: 11922849.pep
MAAAAGRARAVSLAAAVRVVAATARPASSAAAAAGVGAMALIVQGEDTAFGSLEWWAYAGISCFLVLFAGIMSGLTLGLMSLGLVELEILQRSGTDAEK

SEQ ID NO: 52388 - protein, 128 aa, Sorghum bicolor
  Clone ID: 11922867.pep
MASAAAAPTSLSLAARAATRAATAAAAAAAPLRRGGLAAACQPARSLAFAAGDARLAVHVASRCRQASSARGTRAMATMAKKSVGDLTEADLEGKRVFVRADLNVPLDENQNITDDTRIRAAVPTIQY

SEQ ID NO: 52389 - protein, 81 aa, Sorghum bicolor
  Clone ID: 11922868.pep
MEVGFLGLGIMGKAMAANLLRHGFRVTVWNRTLAKCQELAALGATVGETPASVVYKCRYTIAMLSDPSAALSVVFDKDGVL

SEQ ID NO: 52390 - protein, 72 aa, Sorghum bicolor
  Clone ID: 11922878.pep
MSRLSFRPRPLDIHKKLPILKSVREFEDDEPGVAPLSSARAGVLLRHSGAELTASGANNATESEGNQAPSKK

SEQ ID NO: 52391 - protein, 147 aa, Sorghum bicolor
  unsure (1)..(147): unsure at all Xaa locations
  Clone ID: 11922883.pep
HEADCRRLLRISPRRQQRQTGEGRGEHVGRRSEAMQPKISAFFKRQEADPDPNSGDGEGNGHGSDIAATEAKRKAKGCRRDELVSKKRNYAQFHLELGQPDFLHHTCSVCGMMYARGNDEDEKVHRAYHKNYSXGVPFKGWKNETVM

SEQ ID NO: 52392 - protein, 100 aa, Sorghum bicolor
  Clone ID: 11922888.pep
IKSLGLWSLHAIFFVLGIYSLLLFFVHDEMVGWNRFLHGGSVEDAGNNYGVDILTDLTTRRLLFPNDDRRSWCCRHGKIFSSVLRFIVVRSSHNEGLGLV

SEQ ID NO: 52393 - protein, 136 aa, Sorghum bicolor
  Clone ID: 12497451.pep
LLLLGHWLRRLSLPALPNRGLRLRLRLRIRIRWRHRHLGLRLRLRRGSSSRGGAELGAADERAEVAAAALELLGRRIHGGGAPASRTGPGCGSPRAQRASISACPDWLALPAVFSLLLWGCALRFGKGGGREEPRA

SEQ ID NO: 52394 - protein, 160 aa, Sorghum bicolor
  Clone ID: 12497484.pep
ARGEVDEESALPPPEEQSFFDDINRHCTLNTTQRLYGFAICLAAGLTCTFLSMIVFFNPVKFGVTFTLGNLMALGSTAFLIGPKRQFDMMLDSVRIYATAIYIASIIVALFCALYVHSKLLTLLAIILEFGALVWYSLSYIPFARSIVSKVMTSCFDTDF

SEQ ID NO: 52395 - protein, 143 aa, Sorghum bicolor
  Clone ID: 12497571.pep
LSKTIIFLEAQRSGKLPPNNRVKWRGDSALDDGKLANVDLTGGYYDAGDNVKYGLPLAFTVTTLAWTVLAFKPELEQTKELEHVHEAIRWGTDYLLKCAARKNKLWVQVGDPNLDHQCWVRPENMKAPRTLYEIDEKTPGTEI

SEQ ID NO: 52396 - protein, 165 aa, Sorghum bicolor
  Clone ID: 12497601.pep
VIQSSLIDFTDNCPEDKKASDDKISPPNNVDWPYKLNSTVDYDICRSINNDEGSEELVPQDQLYQSCSDKFNLSSVMPEISNAEESKKLSAGDQNSSAISLETDVQIQKPEFFVDEESIEEHAPKVLLSKRKIMSPMSQEKLCSALTGIDLCDGVQRSKSKIIIE

SEQ ID NO: 52397 - protein, 161 aa, Sorghum bicolor
  Clone ID: 12497607.pep
HEGGGGGGGGGGESAAKRARLSSGDADSAAATGEDRLSALPEDVLVCILLHLTTSAAARTSVLSRHWRRIWALLPVLCFRYPPDPRQIGRALEAHEAALLRLYVCTQDADPDSMSAWLPVAARRLSGGLLFHNVVVRERGAQEGDEEEAAQSGAFELPCLE

SEQ ID NO: 52398 - protein, 160 aa, Sorghum bicolor
  Clone ID: 12497659.pep
MVGGGKPLGDSVFAGHAAAGAAAISASAVAVHPLDTVKTLLQLGAAGQKEKMGLRQVVDRLLAASGPAGFYSGIGWSIMGKLPGLGARFGTYELLTAFYKDGREDNYVYYSEAMLAGIAAGAGEAVFCTPFELFKLRNQVSSVIPSKVMGPANVAQESFP

SEQ ID NO: 52399 - protein, 169 aa, Sorghum bicolor
  Clone ID: 12497677.pep
HEGCVQINKKNPLLPPMALRPVTYGDPPSPGSSVRRRRAPPSSASHPTTMARTLPMLDAAWQRAAGFRSQAAALCPDADGAHLATSFLPRWPCSPCGTTRSHGMQAKGAGGGSPACPQRTTATACGNITVLTASLACYGRWCWRCCGAMAGSSSPTHEGGRSSPAPAAG

SEQ ID NO: 52400 - protein, 189 aa, Sorghum bicolor
  Clone ID: 12497691.pep
FGTRAHSDELKLEVLDDLKRDFYHSEDYWDWLARLQLSNSNSSSNSNRKDAISNRLNRSIQVYDEAVRRLSNSKMYSLYAKFWMDVLYPDREDSITLFEDSEFDASEFTSSILKVYENAESCGCLTEDLACQYISLYLKLERLEEAKTLAEKLCDGPLSNAAKLWSLRASMEINSIATAPGSSSLSKEN

SEQ ID NO: 52401 - protein, 92 aa, Sorghum bicolor
  unsure (1)..(92): unsure at all Xaa locations
  Clone ID: 12497695.pep
MWPLCVISEKLFKMAGDDAVQGAAGSPSLDGQIPLARRSYYVDVPHVQQAFTXDCGLACVLMVLXTLGIDCCDGIAHLERLCRTTSIWTVDL

SEQ ID NO: 52402 - protein, 42 aa, Sorghum bicolor
  Clone ID: 12497749.pep
NKVSTLNSLFFYNCVEISQLSLTSRSKERMNSNTIIIYLFPL

SEQ ID NO: 52403 - protein, 64 aa, Sorghum bicolor
  Clone ID: 12497870.pep
DPAALAAAREFADEVRRAEEEIDRRNADTGRRNRCGAGVLPYELMAPTSGPGITCRGIPNSVTI

SEQ ID NO: 52404 - protein, 107 aa, Sorghum bicolor
  unsure (1)..(107): unsure at all Xaa locations
  Clone ID: 12497886.pep
MAAHVLVVPFPAQGHMNPMVQFAKRLASKGVATTLVTTRFIQRTAGVDAHPAMVEAISDGHDEGGFASAAGVEEYLEKQTVAASASLASLIEARASXAADPFTCVVY

SEQ ID NO: 52405 - protein, 163 aa, Sorghum bicolor
  Clone ID: 12497922.pep
LHGGGKRVHISLDERTGAGFASQAAYLHGSFSARIKLPADHTAGVVVAFYMSNGDVYERTHDELDFEFLGNVRGREWRVQTNVYGNGSTAVGREERYGLPFDPTEDFHRYAIHWSRHRIIFYVDDTPIREVVRTEAMGAQFPSKPMSLYATIWDGSSWATSGG

SEQ ID NO: 52406 - protein, 200 aa, Sorghum bicolor
  Clone ID: 12498025.pep
FIVVYELFERMAYYGIASNLFIYLTEKLHQGTVEASNNVTNWSGTVFLTPLLGAYVADAYLGRYWTFVIGSAIYFLGMVLLVLSVSLPALKPPPCDAAKVCPKASALQVGVYFGGLYIVAFGNGGTKPNISTIGADQFDEFDPREKMHKLSFFNWWMFTIFLGILFSSSVLVYLQDNVSWPIGYGIPTLGLLVSIIIFLA

SEQ ID NO: 52407 - protein, 207 aa, Sorghum bicolor
  Clone ID: 12498053.pep
TRLLCVTVKNIAPIHVKDIIVFIDAITIVFEEASKGGAPLSLPIASIEVGHGHSLPNLALRRGEEHSFILKPATMSSRERKTNGYAPPTLSLPTMTGATLNTNTPKVGEPYADLSDQYAVLVSYRCNYTESKLFFKQATSWRPSATSDLMISVSSELSLRNPSLGARVPQLPVQILTLEATNMTSENLTLNVLAPEASGSSSVVSLN

SEQ ID NO: 52408 - protein, 72 aa, Sorghum bicolor
  unsure (1)..(72): unsure at all Xaa locations
  Clone ID: 12498069.pep
KKVVVIGGGDTGTDCIGTAIRHGCSNLVNLELLPEPPRERAPDNPWPQWXPRIFRRDYGHQEAASKFGKDPR

SEQ ID NO: 52409 - protein, 68 aa, Sorghum bicolor
  Clone ID: 12498116.pep
MPRLDSKRLALALKKEFDTAYGPAWHCIVGTSFGSYVTHSLGGFLYFSVDKAYILLFRTAVEPLGHPR

SEQ ID NO: 52410 - protein, 123 aa, Sorghum bicolor
  unsure (1)..(123): unsure at all Xaa locations
  Clone ID: 12498261.pep
DMENIAAXLIRSLKHMKSIVDESLSTEAYSLLPNFNIAEIRAASEDALEVERTTRKWLSIMNKDCSRFCKILSLAKKNDVSHPEAPRKQRKITFADEAGGMLCHVKVFKDGQASLLSECQSDL

SEQ ID NO: 52411 - protein, 147 aa, Sorghum bicolor
  Clone ID: 12498315.pep
GLRSGIARDCVYGGIFFSTWQFLHSAMLTWKAVNMSPEPRNLEEAGPVPPFASSVAAGFAGVVAAAASHTFDTAKSRSECTVVPKYIAMERKFLKWKPPGTWIERKTGISPADRNVLFRGIGLRMARSGIASFVLVGSYYLAVNHLL

SEQ ID NO: 52412 - protein, 127 aa, Sorghum bicolor
  Clone ID: 12498371.pep
SGQVNFVTSCSTSERNELLSNCLCVLYTPKDEHFGIVPLEAMAAYKPVIACNSGGPVETVVNEVTGFLCDPSPTEFSKAMLKLVNDHDLAVRLGEQARDHVVQKFSTKTFGDLLNGYVLNVYHERME

SEQ ID NO: 52413 - protein, 73 aa, Sorghum bicolor
  Clone ID: 12498405.pep
LVSENYVRHILHSFSDRYLTTYAANHIYHSLQKQVQAGQFIFTQTSPFLPHTATHTSVHMRPSRAHLCIVCPP

SEQ ID NO: 52414 - protein, 120 aa, Sorghum bicolor
  Clone ID: 12498409.pep
SRHDAPDDDAARTAAVTKGCATFLVGEEGEAPRRVAVPVARLGHPRMLELLGEAREEYGFAHQGAVVVPCAVERFMRAVEEASAGNRHEHRHGHHHHHHHHFRLPHVRIARCFRPSRVLV

SEQ ID NO: 52415 - protein, 79 aa, Sorghum bicolor
  Clone ID: 12498522.pep
RRFLQADGQQGAPELQQASGLRGSQLQRSKVADQGRRRSQVLCRRRVLIKWRQEPDAPATIRELHVALLAWHAYIFVRW

SEQ ID NO: 52416 - protein, 119 aa, Sorghum bicolor
  Clone ID: 12498536.pep
VPMVAMALWTDQPTNARNVELAWRAGARARRDAGAGAGAGMFLRGEVERCVRAVMDDGEEASAVRKAVGTWRDKARAAVAAGGSSDRNLDEFVQFVRAGATEKGKALVLKEGDVAGSEM

SEQ ID NO: 52417 - protein, 145 aa, Sorghum bicolor
  unsure (1)..(145): unsure at all Xaa locations
  Clone ID: 12498708.pep
LTKRFIGDENGXVKALEVVRVEWSKVDGRFQFKEIEGSQEIIEADLVLLAMGFLGPEAAIAKKLGLEQDNRSNFKAQFENFATNVEGVFAAGDCRRGQSLVVWAIAEGREAAAAVDKYLSREKTNVDENVVAPGPCECLVQPVAA

SEQ ID NO: 52418 - protein, 104 aa, Sorghum bicolor
  Clone ID: 12498741.pep
MSPPRQENRRQVIVKAEPVPSITLKVLDQQSRRAFHTMRMNDRLQGVMDAYYKKVSDDVTYGTGIFMFDGSVRLRGCNTPAELDLNDGDQIEFFESMIGGGCMG

SEQ ID NO: 52419 - protein, 114 aa, Sorghum bicolor
  Clone ID: 12498743.pep
ARGGVLRGSARPKDAASINLRSFYLVGTPVALVLAFWLHYDFKGLWFGLLAAQATCMVRMLLVIARTDWASEAKRSRQLTGAKDSDDKAGGDEKSRLLLGDTDMEKANAHSDQC

SEQ ID NO: 52420 - protein, 72 aa, Sorghum bicolor
  Clone ID: 12498767.pep
KQVMSDENLLFSPRLGIAGSSGLFDHKTNKNRGRNTMEMKPIDEFHACLKLDVCYWRLRVNPPRDAVLPETV

SEQ ID NO: 52421 - protein, 56 aa, Sorghum bicolor
  Clone ID: 12498779.pep
CKQSKGRTNRREVLNIVKTFLYRNLICLFYFNHLSALTLLQSSRIFPLCSSVNVYL

SEQ ID NO: 52422 - protein, 63 aa, Sorghum bicolor
  Clone ID: 12498801.pep
WFGGDEDDHYATAPAPAGHNFTFLPFGGGRRGCPGAGFAMATVELVLASLLYHFDWGMPAGGP

SEQ ID NO: 52423 - protein, 106 aa, Sorghum bicolor
  Clone ID: 12498828.pep
KPQEPVIDILPQLYDIGSSGSRGPSTGMWSRTLRLKVTGRDGVLKIDARIPAGFLEGMTRVIPGLAGANIMERLRNAPIDTDNPQNGQILLDFEDAMGDRIQVFIA

SEQ ID NO: 52424 - protein, 137 aa, Sorghum bicolor
  Clone ID: 12498915.pep
YMENTASSFTNMMNSAMTSGEPQKKARQQHHFPSPQYPINYSSQFPTSFHPQYSHMFNPFGSQSNYPQFPFSSQGSYQGTSYQGMVQYPQGLLMHHKLDPWVSSEVAEGLIHELMRVALLVQLLQCPKSNIRLMFLL

SEQ ID NO: 52425 - protein, 39 aa, Sorghum bicolor
  Clone ID: 12498936.pep
VAVELTTGKGVVQNVGLTAPLQTLALALTGVVGVLTAFI

SEQ ID NO: 52426 - protein, 97 aa, Sorghum bicolor
  Clone ID: 12499023.pep
SSHVNVLGKAFHAHNDGLEALLGCWSVHMDGISCFRVLVAIFVVSLHICIINAHVYIYASHGKQTKHLIPWPNCFLCYMCLLPESTCLYFCNLIGNR

SEQ ID NO: 52427 - protein, 34 aa, Sorghum bicolor
  Clone ID: 12499055.pep
LALSLVRLHYVISICSIFIQLITQASTPSLWVPR

SEQ ID NO: 52428 - protein, 140 aa, Sorghum bicolor
  Clone ID: 12499089.pep
QSTNPSIHSSVFSINARRRGGRRASQPASERLADDDPLPVHGSTARMGAASPPLLLRLLTLALALAGAAAGRISGPRTPISRDIYHSSDSLLREIKSLVARHSDKLSMDTIRTSNKGYSAELFVVTFNHVNESMDNGSKV

SEQ ID NO: 52429 - protein, 86 aa, Sorghum bicolor
  Clone ID: 12499105.pep
CLLLVTPYCEDLIMSMKCKLMLVDSVVSGSAVAETIVLLQKHKNKAKGYVVSLPYHRRDSTATINVLVNSQSKRLRMTGQRKNLLI

SEQ ID NO: 52430 - protein, 174 aa, Sorghum bicolor
  Clone ID: 12499135.pep
ARGLVPKSNSNKWPVVEGRALAATSILCSEPYYARDGVSMMKRSFGLDSSSAASSSDLGSSRQSTICFERLRSGKRGDFEKSQISSTMSRQSIASVSDMSICSSSASLCPQSDAVGGSCFPIDTLESSTSRTLISSEENDAFYKDALPSAMECSSSSQVIADDASPSDLKIQSY

SEQ ID NO: 52431 - protein, 75 aa, Sorghum bicolor
  Clone ID: 12499137.pep
SAGFPEVDFSFGFLAQLLSLFPSGPFRVPIVERARRLAVATCDRIVCSGAAAVHAGVKRFNFPIALSSAKLVREM

SEQ ID NO: 52432 - protein, 74 aa, Sorghum bicolor
  Clone ID: 12499161.pep
HSHYKHESFQISLLTCYSITCQVKSMVTQLEYCSSDQCRQMPPLHQLASCAYRISLPRSASRVVSKPGMMVLNS

SEQ ID NO: 52433 - protein, 125 aa, Sorghum bicolor
  Clone ID: 12499191.pep
AQAQMRFVKSKNDGETKWQKKYIAQMLQIKARGIARDVQKQIDMVCKSDSTILGMCWSVQQLKYTLLELELPRLLAPDLPSNGSSLRDLDCTHSNYQTLTRPVLLFIVTTSPCQDWVICAPAAFL

SEQ ID NO: 52434 - protein, 113 aa, Sorghum bicolor
  Clone ID: 12499211.pep
TSQAELPVGSSFVTPQKKQPLVVTVPKDSAGILNTGSSVISGSVTHTLSGSSKSASNDCRNNVKYAAKDSSQVSGSSRKRTRKGWTTLKQIAEKDELEKKEKMGNFVIPFFMH

SEQ ID NO: 52435 - protein, 84 aa, Sorghum bicolor
  Clone ID: 12499223.pep
HHSDPTSLVTNRHVQIYGFPSLNSRVQKQSRVPALNVSCLCSSESTIGNHSCTRNSDQRATPTYAFFGIHSRIKQVTGVSVSVL

SEQ ID NO: 52436 - protein, 70 aa, Sorghum bicolor
  Clone ID: 12499235.pep
KLMANASGYILLAAQELQMMCYRNKQTGLTKESFCNNSPRLLGKMTRSYFISSTMFVQGIRKIHSTIFVH

SEQ ID NO: 52437 - protein, 75 aa, Sorghum bicolor
  Clone ID: 12499266.pep
SFPKEESLPKLPHRRTPNRKVKRKRLEGETTTTETAEKDAVAKDSPPVCSASGIARNSDNMKPPKLESKCNCIIM

SEQ ID NO: 52438 - protein, 89 aa, Sorghum bicolor
  Clone ID: 12499286.pep
WPNIFETSPHVINAVMEAIEGMRVALGAAVILNYCLQGLFHPARKVREVYWKIYNSLYIGAQDALVASYPALEDDGDNIFSRPELAMFV

SEQ ID NO: 52439 - protein, 53 aa, Sorghum bicolor
  Clone ID: 12499316.pep
PPHMVPYGYPPYPAMVPVPAEFLYGPPGIRSSPPQESYNNMFNEDNANSCSLM

SEQ ID NO: 52440 - protein, 97 aa, Sorghum bicolor
  Clone ID: 12499322.pep
VVIITGHEKTSRTEAETNAVDVVQAIVTVLTTDLGLEVLIGPGSCPPVSSKPKATTKSRSNLEQVSKEFTRRPQGMIKIPLNSLNHWLKKKAVRIAE

SEQ ID NO: 52441 - protein, 119 aa, Sorghum bicolor
  Clone ID: 12499342.pep
SPGLLKIQYTRVPCNWNGMDIAFKVDGGSNANYLPVLIEYESGDGELRSVELMQRGGAAWAPMQRSWGAVWRYNSGAALQAPFSVRLTSGSGRTVVATNVIPAGWSPGATYRSVVNFNN

SEQ ID NO: 52442 - protein, 130 aa, Sorghum bicolor
  unsure (1)..(130): unsure at all Xaa locations
  Clone ID: 12499384.pep
ECGRALNKAXYLHHKRRNCPRLDPIRSTSKKADQVSASNKIERVAQMSRSTSRGNNESMDEGSEKTVERTAVTVQPLHRSRRLARSSRMWIIGVWALSIVVFLLVISMFFTEQRRNVSRSRVSRSLKAHV

SEQ ID NO: 52443 - protein, 94 aa, Sorghum bicolor
  Clone ID: 12499394.pep
FEYKAATGSFTPDRVAVYCKCEMPYNPDDLMVQCDACKDWFHPSCMCMTIEQAKKLDHFVCSDCLKENGSKRLSNAYATSPNSEPKAESKRQRR

SEQ ID NO: 52444 - protein, 109 aa, Sorghum bicolor
  Clone ID: 12499400.pep
NSWIYERRTTAKAFAKDVFINQERKLGARRRSDTVLVSTINDADQGSADVAYRTPPAPYEKSKSLGSGGSMVARLKLKGIDGRAYMNAKACTLLQIKRVNSMENFPCAT

SEQ ID NO: 52445 - protein, 60 aa, Sorghum bicolor
  Clone ID: 12499457.pep
TAWSGDASVSGYSDVDDCRRADYNIISGTSMACPHVAGVAALIMNKHPNWTPAMVRSALM

SEQ ID NO: 52446 - protein, 149 aa, Sorghum bicolor
  Clone ID: 12499468.pep
HEACVENKDLKLALHLFEEMKTHQLKPNLVTYKTLLAARSNYGSLLEVQQCLAIYQEMRKAGYQANDYYLKELIMEWCEGVLSSRGDNQDFYNLDLQPKRKESFNLFLEKVVTVLQKDTDQNQTVDVRGLSKVEARIVVLSVLRKIKEQ

SEQ ID NO: 52447 - protein, 74 aa, Sorghum bicolor
  Clone ID: 12499474.pep
FWILGQPMRFAPVDKCCSALLSIRPCLVHSQINLRSSLTPHIQILLIWCGSSRGTGLHTHSTYLTLSSSLMQKG

SEQ ID NO: 52448 - protein, 172 aa, Sorghum bicolor
  Clone ID: 12499530.pep
DPNIKRGLFLSIECINTLNEGLLLHHASVGCPKPQWSKYLSFLKSRRFSELTKPKYWKGQQVDSIVTMQHVALSKANSEYPKIHTLFSTECSSYFDWQTVGLMHSFRLSGQPGNITRLLSCTDEDLKNYKGHDLAPTHYVPSMSRHPLTGDWYPAINKPAAVLHWLNHVQTD

SEQ ID NO: 52449 - protein, 118 aa, Sorghum bicolor
  unsure (1)..(118): unsure at all Xaa locations
  Clone ID: 12499544.pep
MAKTKQGKKDVDSYTIRGTNKLVHVGDCVLMRASDSDNQPYVARVEKMEADGRGSVRVRVRWYYRPEESKGGRRQFHGAKELFLSDHFDLQSAHTIXGKCVVHSFKNYTKLDNVGPED

SEQ ID NO: 52450 - protein, 84 aa, Sorghum bicolor
  Clone ID: 12499566.pep
HEAQTEIDQYTTLKDLDLNFIFRLKKQWFHEFQRQVTRDCEFLEQEKIMDYSLLVGVHFIDNREKLLTEGCIDYEIINDIPTPR

SEQ ID NO: 52451 - protein, 157 aa, Sorghum bicolor
  Clone ID: 12499594.pep
TRLPATQIKYSDGLHLYSYLNSTKNPAGFITKPATVLGTKPAPFMAAFSSQGPNTITPEILKPDITAPGVSVIAAWTRANSPTDLAFDPRRVAFNSQSGTSMSCPHVSGVVGLLRTVHPQWSPAAIKSAIMTTAIEMDNKGELILNSSSRSSSPFGY

SEQ ID NO: 52452 - protein, 139 aa, Sorghum bicolor
  Clone ID: 12499664.pep
TRRLLTYLDMSQNNLSGKIPPAISGMRILNYLNLSRNHLDGEIPPSIATMQSLTAVDFSYNNLSGLVPGTGQFSYFNATSFVGNPGLYGPYLGPCGAGITGAGQTAHGHGGLTNTVKLLIVLGLLICSIAFAAAAILKA

SEQ ID NO: 52453 - protein, 58 aa, Sorghum bicolor
  Clone ID: 12499670.pep
MAMAQQASFPCSTATTQWRELTNTSWRDDDYRRMVMAYLIEAGYLLELERQERRDAAA

SEQ ID NO: 52454 - protein, 65 aa, Sorghum bicolor
  Clone ID: 12499714.pep
TRGGSYQKHDDTTAWDKEYHLFQPSGAIKFPLQVTTTDAWLEKIKRLELLLTVKESAMDVPSNVE

SEQ ID NO: 52455 - protein, 80 aa, Sorghum bicolor
  Clone ID: 12499774.pep
ARGSHLAGLVPTMQRCIERAADAILAPGVQQNGDGDVDVDVDFSDLSLKLATDIIGQAPFGVDFGLTASGDPGGEAAEFI

SEQ ID NO: 52456 - protein, 71 aa, Sorghum bicolor
  Clone ID: 12499786.pep
AIYRIVAIDVRSRREGRDLRKVGFYDPIKNQTCLNVPAILYFLEKGAQPTRTVYDILRKAEFFKDKERTLS

SEQ ID NO: 52457 - protein, 97 aa, Sorghum bicolor
  Clone ID: 12499798.pep
MASRVLLLCVSVVLAAAAAAEARDFVVGGANDAWKAPAQPDALAKWSSANRFQVGDKLVFKFAGAADSVLEVTRDDYNRCSTASPLAVHKADAGAGA

SEQ ID NO: 52458 - protein, 133 aa, Sorghum bicolor
  unsure (1)..(133): unsure at all Xaa locations
  Clone ID: 12499817.pep
ARGFTQQVLEKSLNQLVDRIPIPLLFMRTVIQALDAFPALVDFVMGILSRLVNKQIWKMPKLWVGFLKLSFQTQPRSFDVLLQLPPPQLEFMLNKYPNLRTPLSSFVNQRNMHTTLPRXLNILGFFSEPQQTP

SEQ ID NO: 52459 - protein, 132 aa, Sorghum bicolor
  Clone ID: 12499833.pep
KGKAAQSNSENGGKKQGKDSTSKPPEPPKDYIHVRARRGEATDSHSLAERVRREKISQRMKLLQDLVPGCNKVVGKAVMLDEIINYVQSLQRQVEFLSMKLATVNPQLDFNNLPNLLPKDIHQSCGPLQNSH

SEQ ID NO: 52460 - protein, 117 aa, Sorghum bicolor
  Clone ID: 12499859.pep
MGYNRHRRGRGSSSSSSRRTKQEVSCFSDDGPGTSLPRQEEDTEDEFKGSRIQLAMWDFGQCDVKRCTGRKLSRFGLLKELTVTNGFGGVVLSPVGTQCVSNEDHPIVQRKGLAVAD

SEQ ID NO: 52461 - protein, 135 aa, Sorghum bicolor
  Clone ID: 12499941.pep
LPPVGRGTSSVTASAVVMAETPCARLSPSTAHYSDLQRWSVYVTKRMGHLALPRVSKGWSPLSSGSASTQPAHLQGGAACCRDRWSRACPHTHTHTRICRAAPRAAGIDGAARVRTRTHAHAHLQGGAVCCRERS

SEQ ID NO: 52462 - protein, 130 aa, Sorghum bicolor
  Clone ID: 12500058.pep
TREEGYKVMTSNFRRYSYRELVKATRKFKVELGRGASGTVYKGLLEDDRQVAVKKLENVKEGKEVFQAELSVIGRINHMNLVRIWGFCSEGSHRLLVSEYVENGSLANILCNEKSNILLDWKGRFNIALG

SEQ ID NO: 52463 - protein, 67 aa, Sorghum bicolor
  Clone ID: 12500086.pep
ARGFPGKYALEMSSDVYKSWNFNEQALPADLVKRGVAVPDQSSPYGVRLLMKDYPYAVDGLVIWWAI

SEQ ID NO: 52464 - protein, 133 aa, Sorghum bicolor
  Clone ID: 12500137.pep
LASAADAGAVVDLQDVFRRFAFDTICKISFGLDPGCLDLEMPVSKLADAFDTATRLCAMRGAAASPLLWKAKRLLNVGSERELREAIKLVDELSAAMIRERRKLGVAGSHDLLSRFMASSGDARHDVDDKYLR

SEQ ID NO: 52465 - protein, 35 aa, Sorghum bicolor
  Clone ID: 12500181.pep
TSPTLQSISDELYIYVCIWLNVYYVSARQTISGRQ

SEQ ID NO: 52466 - protein, 127 aa, Sorghum bicolor
  Clone ID: 12500207.pep
KYNATVMAMFNGAPYTCPTGEAPHRISDLNYPSITVVNVTSAGATARRRVKNVAKPSTYRAFVVEPAGVSVVVNPSVLKFSAKGEEKGFEVQFKVKDAALAKGYSFGALAWTNGVHFVRSPLVVKAA

SEQ ID NO: 52467 - protein, 48 aa, Sorghum bicolor
  Clone ID: 12500319.pep
PSECSKIRCRGSLTIHTPSILNYKMFGFSKYIGFAMHLSTVIWNGENN

SEQ ID NO: 52468 - protein, 45 aa, Sorghum bicolor
  Clone ID: 12500343.pep
LGGKHVVFGKLVEGMDVVKKIEAEGQATGVPKAKVVIVNSGQLPS

SEQ ID NO: 52469 - protein, 92 aa, Sorghum bicolor
  Clone ID: 12500359.pep
SRRTTSARSPASVEQRGRHPCAHIPFGIGPRACVGQRFALQELKLSMVHLYQRFLFRRSPQMESPAELQFGIVLNFKNGVKLVAVERCAAMS

SEQ ID NO: 52470 - protein, 62 aa, Sorghum bicolor
  Clone ID: 12500373.pep
VFLSTLRSNDRVAPLACTLIQDYFTSLNKNCQKNHNFAIVIGAALSLSEIEPDLFILVFECF

SEQ ID NO: 52471 - protein, 136 aa, Sorghum bicolor
  Clone ID: 12500381.pep
VKELQQLEKQLECALSQARQRKTQLMMEQVEELRRKERHLGEMNRQLKHKLEAEGSSNYRTLQHAAAWPAPGGTIVEHDGATYHVHPPAHSVAIDCEPTLQIGYPHHQFLPSDQAANNIPRNAPGGENNFMLGWVL

SEQ ID NO: 52472 - protein, 130 aa, Sorghum bicolor
  Clone ID: 12500385.pep
EVTRDDYTRCSTASPLAVHKADAGAGAATVPLSRSGPYYFVGGAPGSCQKGERLLLVVMSDKHGRGRLRGLAPAPEPAAESPFAASFVGGPAAAPAPATGAAGRTAAAGNTGGALLVGAAAVLGALLVWR

SEQ ID NO: 52473 - protein, 97 aa, Sorghum bicolor
  Clone ID: 12500415.pep
IGPLIATGKMQQKHIRSGHAHYGICFPSVPMGALTKYPDCKGASFHTHCYWARCYYRLWGSCSLGLGWQVSSPAARDGVPLVLTFFAPHCRCRKKLV

SEQ ID NO: 52474 - protein, 119 aa, Sorghum bicolor
  Clone ID: 12500440.pep
LSCVEALSAALIICGEEDTAHLLLGKFKWGHAFLSLNRDLLKAYSQCENGSEIINVQNSWLSSNSSVPKPPVNGTEEARQSTEEGSEGDSDDDLPPLEKNLNHLNLDEDEESEEESESE

SEQ ID NO: 52475 - protein, 71 aa, Sorghum bicolor
  Clone ID: 12500448.pep
TCRINDPKIQTETTQTLFKQKISKTLVSKPKHLRCCGFTWLDLASFGQSHHTLSTQTLHLSCNSFWLIGSL

SEQ ID NO: 52476 - protein, 55 aa, Sorghum bicolor
  Clone ID: 12500506.pep
DEAPCRYRRFSHGEYSRHYVTSRLADPMIHDNLTDRTALVPATHHSNFCPINFRW

SEQ ID NO: 52477 - protein, 82 aa, Sorghum bicolor
  Clone ID: 12500627.pep
VAERMGAGVRVRVRADDDGGVVVEAHELARCVEAAAASDAVAARAAALMGKARAAVADDDGGGSSHRNLTEFLRQIARGPGE

SEQ ID NO: 52478 - protein, 109 aa, Sorghum bicolor
  Clone ID: 12500760.pep
RPDHTVCCSACMSPYNCTRAYVRNCTYVCRSRTAPPAGRRRRRQTQASQDDEMVRSRFRAAGLLSSSFTAAATRRAPAAGAGSSSSSLMELEPSASSLLASSHRPIDSV

SEQ ID NO: 52479 - protein, 146 aa, Sorghum bicolor
  Clone ID: 12500799.pep
QDAMDYACGMGGADCSAIQPMGACYNPNTLQAHASYAFNSYFQRNPSAASCDFGGAGMLVNVNPSSGTCMYQTSSGFGAGYSPGTTGGGVPGGYTPGMSGTGYNPAGGMSGTMGGGSGSTVLNANNPGGSMYGGYDNPTGLTAGSD

SEQ ID NO: 52480 - protein, 121 aa, Sorghum bicolor
  Clone ID: 12500838.pep
PTTTTTYGCSYLPTTSASSPAARRTLHYKKRKRRVFELESTHPSSAFRATQRPDGRHPSSMSRLHRSSVSFRRQGSSGRIWDDPLRGLDLKGLSTSTTTTPSVVLAGDPSPRVVSSSLMRH

SEQ ID NO: 52481 - protein, 129 aa, Sorghum bicolor
  Clone ID: 12500917.pep
GPHLHTVYPHGSTDTLPFATMGSGSLAAMSVFESKYKEGLTREEGIQLVSDAICAGIFNDLGSGSNVDVCVITKGKTEYLRNHQLPNPRTYASSKGYSFSKGQTEVLSTKITPLKQKVEVTEGGDAMEE

SEQ ID NO: 52482 - protein, 63 aa, Sorghum bicolor
  Clone ID: 12500953.pep
SPLTPSTHAHVLLGCQESYACKAGASCCGCWYMANELDRDTGREYLDRRKLPAATSSAGSTGL

SEQ ID NO: 52483 - protein, 117 aa, Sorghum bicolor
  Clone ID: 12500987.pep
RHGGDAGEHEHPSGGEANVEPAAAAAAASAGAPARETMPAPPPEAITYDDRCCRRRRGRALPLPALVPIILVGLVAGKLPALALAVLCAAFSSRSVERIPVPVPASGDPIPKVAAGS

SEQ ID NO: 52484 - protein, 32 aa, Sorghum bicolor
  Clone ID: 12500989.pep
RCFARHASFYLLHRCLGSVLVSSSLLRVRCCS

SEQ ID NO: 52485 - protein, 154 aa, Sorghum bicolor
  Clone ID: 12501070.pep
QNSILGCQSHRPSLWVRTLFTPMKKTGSSVHPYALRYSEPIAHFALSTGAFSDPPVRLYTAKKLYHQLEQARTEFIQANVMVRKQTIFLPKVLHFYAKDASLELADLIDIVCESMPELQRKEIRQYLRRRIDKCIEWLPYKSSFRYTVHGSLAE

SEQ ID NO: 52486 - protein, 91 aa, Sorghum bicolor
  Clone ID: 12501105.pep
CIFCLELVGENFSELNKVAKPLGGLIQHGSCTTTGRTSGLPCLISSSPISLYKTMCQERALKLILMVMDRLSSRVPHRPQADDHPLDFLML

SEQ ID NO: 52487 - protein, 90 aa, Sorghum bicolor
  Clone ID: 12501206.pep
RSSYHDVVRVSEIEDILDISDVQTYVINSARVVFLNERPQLRASGVPICKAPSSSTHSCETCNRALLDAFRFCSLGCNVSYHKVPKDVIF

SEQ ID NO: 52488 - protein, 97 aa, Sorghum bicolor
  Clone ID: 12501232.pep
SEEFAAYIKQRGYDLHDVEAYGQMLKSAGFRDVIAEDRTDQFLGVLEKELAKFEKNKDDFLSDFTQEDYDDIVNGWKAKLQRSSAGEQRWGLFIATK

SEQ ID NO: 52489 - protein, 135 aa, Sorghum bicolor
  Clone ID: 12501234.pep
KREAEARLKEIEAEKKKPFARTRDDPELDNMLKERIRWGDPMAHLVKRKDPEFILEDLGDDEKMKESGFIVPQNVPPHSWLKRGVDAPPNRYGIKPGRHWDGVDRSNGFEKDMFKLKNEKQAMEQEAYLWSVSDM

SEQ ID NO: 52490 - protein, 135 aa, Sorghum bicolor
  Clone ID: 12501242.pep
LYIKMEKYSDAAAFFLRLGSSADKCNAINSQCKAYLSAIIVYLYAHDFQQAQKCYNDCSEVQAFLNSDQNRCATKLLSAYEEGDAEEIKRIAQSSAFNHLDHVVIRLARKLPTGDLQAIKKADDGEESLDEDDLT

SEQ ID NO: 52491 - protein, 62 aa, Sorghum bicolor
  Clone ID: 12501348.pep
GWRAWYYRQQVPGWAVEYEEGLTLVTVRGAGHQVPLFAPDRSLAMLYHFLRGQALPAARSSG

SEQ ID NO: 52492 - protein, 53 aa, Sorghum bicolor
  Clone ID: 12501372.pep
TVVSVDIFLFYDSGSDTRLLGVGWGGFKFNVRHEHVIPLYWPDSPMDVSVDAM

SEQ ID NO: 52493 - protein, 90 aa, Sorghum bicolor
  Clone ID: 12501390.pep
QWQQTYNLLEGLVYRYYSRKVKKFILIYYVRWMLNSVPNPNYVQFSMSATAKLQLQSLIAFAFMLAMLSSTLGGTGSSTIVGLLGGFLLA

SEQ ID NO: 52494 - protein, 50 aa, Sorghum bicolor
  Clone ID: 12501396.pep
SQIEPSMNPTPPNKSISCPGIQFFANRKPFLNTCRTNFDKPFFPGRPIQF

SEQ ID NO: 52495 - protein, 111 aa, Sorghum bicolor
  Clone ID: 12501429.pep
NSIQPVLSGVAIGAGWQSLVAFVNIGSYYLVGLPLAAVFGFKLKLNATGIWVGVLIGTVLQTVILFVILSRTKWQKEAMLAEERIRVWGGNVELPQTQETRPSENTAATVS

SEQ ID NO: 52496 - protein, 39 aa, Sorghum bicolor
  Clone ID: 12501447.pep
TVRWNGPPAVGGPEGNLKWVLNEHEVRSPIVIPPAKAPG

SEQ ID NO: 52497 - protein, 133 aa, Sorghum bicolor
  Clone ID: 12501483.pep
DAEEDSLCIRSIFVIEGSILVCIEDLDQFGGIPYDSSPPYFSLDASCSISNIREVVMDQGNDKCLTLILDSRRQGEFQDSIQNPQNKQSDEIGTVHTWKLKWFSEEASLKFISVLKALYSTAAASSLPVKCIS

SEQ ID NO: 52498 - protein, 41 aa, Sorghum bicolor
  Clone ID: 12501487.pep
HTRGSSHPAGRLAPDGSQTVHRQAAAVQQYPVTFTSMARHS

SEQ ID NO: 52499 - protein, 57 aa, Sorghum bicolor
  Clone ID: 12501491.pep
SRGQGQFGVFLYPMFWEFLYPPSPCGMCSCGGSLVSKGNPCWPWSVFLFISPLFKTR

SEQ ID NO: 52500 - protein, 84 aa, Sorghum bicolor
  Clone ID: 12501503.pep
AIRVRDDMLLAASEALAEQVTEEHFVKGLIFPPFTNIRAISARIAAKVAAKAYELGLASRLPRPDDLVKYAESCMYTPTYRCYR

SEQ ID NO: 52501 - protein, 122 aa, Sorghum bicolor
  Clone ID: 12501557.pep
EVTAFKRKLCFGQKDGKKKGKVHFEEDEDLFEDGSDSDSPHGSPVYGESQDSSSASSDDEGDDDVEGDKGDGGTACVTKGDGAGASGSRVRGSSCIGIGKHIHIGPRSTRKKKPTLKSVKDL

SEQ ID NO: 52502 - protein, 90 aa, Sorghum bicolor
  Clone ID: 12501589.pep
EKKCPRPSASSPSVELMIHACTSGTNNSTCISSSIQCFANLRGPVSGILHFVQSLLPFFSSVLIRKCVSKTRLAQRVSSVGGKIMYVFHN

SEQ ID NO: 52503 - protein, 145 aa, Sorghum bicolor
  Clone ID: 12501591.pep
LNNDMAEEYVDMWANQDELITMHEKASPMFRYELSRISASVFIALGKGRIQCPSDTRSQLFHGWFRPMLMDFGWLQRCSKGLDVRVLEENLGQALLTLPLHQQQSLFVEWFQCFASRGTECPNLSRAFQVWWRRSFVRSSVEVRQ

SEQ ID NO: 52504 - protein, 69 aa, Sorghum bicolor
  Clone ID: 12501597.pep
ACCGLGKYGGLIMCVLPQMACSDASSHVWWDEFHPTEAVNRILADNVWSSQHTKMCYPLDLQQMVKLKL

SEQ ID NO: 52505 - protein, 45 aa, Sorghum bicolor
  Clone ID: 12501608.pep
TNELPLQCSNYPPKHHPRDPAVIEILLRSVKPVLGLNSMVNGNRG

SEQ ID NO: 52506 - protein, 174 aa, Sorghum bicolor
  Clone ID: 12501651.pep
KLFSLDLLKKGENRGKFTEFLVQKSDSPPSNHFTKEDGDRYLEERTSIYYCTGWSEQCQQDQSKWPWARQQLRRNLLLTSLQISGTPGNVGGRQKMVHTATKVRNIRQGHIVAITDVCVPEGSRGPSFPFHGPQILSMHTEIMTARMFLLVLGLCILCFPVYTAHFLRFFWCRK

SEQ ID NO: 52507 - protein, 105 aa, Sorghum bicolor
  Clone ID: 12501653.pep
MSSAAASASSRRRSKYAGLTQDPCFWARVEEAREQTESARSERDVAELAMKLEELQEFESYSRELVASKEVSVDVLAPQSSYTLWVEEWNQLKLRDEVRAMLLRF

SEQ ID NO: 52508 - protein, 62 aa, Sorghum bicolor
  Clone ID: 12501679.pep
TPCLKKHIVVYSGSFPDVEMGKEYQSGSGGSDAGDASIRLSFHRHAYGLGEHYNSVIPAESS

SEQ ID NO: 52509 - protein, 143 aa, Sorghum bicolor
  Clone ID: 12501681.pep
LPVSNVHVPQGTMIAVPMEPIHYDEQIYPQARSFNPFRFADPNGVSNIVDSFTAKEDLEAGKEGAGERKAKSTATLDDAFLGFGFGRHACPGRFFALNEMKVFIAHMLLNYDVEHMAVRPKPLDTVWLKLPLHGGKIRVRRRS

SEQ ID NO: 52510 - protein, 49 aa, Sorghum bicolor
  Clone ID: 12501709.pep
WIQRTKSLSAHSGRPSKLGESSMAWTRQAQPNETRIMWWGLKLCCLMGR

SEQ ID NO: 52511 - protein, 135 aa, Sorghum bicolor
  Clone ID: 12501715.pep
KSLVVPYSRNQPLPHALSVVPLPNLLQLVRGVRTQPLCRVSLLPRACIVGVNPPCRRKCADARELFHPGIMQAPALLLPVIVIVFAVPVKLHIDDQKSSIIIREREDVAARGRCSKVWAGQWLDCHDDGVAIIGG

SEQ ID NO: 52512 - protein, 69 aa, Sorghum bicolor
  Clone ID: 12501755.pep
SLKKNGIMRPSIQGSIVRNVNNISYQSQIMVLTMVLLCKKYHSLRTSGRMTHPSIAFFFNKFHCYCSVL

SEQ ID NO: 52513 - protein, 106 aa, Sorghum bicolor
  Clone ID: 12501761.pep
TEHHQLIVIIYRHCYKVVPRYSNNKSRQIQNHRIPPPPLVYSRSCRKWRPQSNVASGATTNRATCGCGAAAADASPVAMLASQETPPSLLLAPRSTLPWLSPASMP

SEQ ID NO: 52514 - protein, 57 aa, Sorghum bicolor
  Clone ID: 12501765.pep
KYRRVAFHCIIEIDRCRMAWILYNKQAFKQFLCLIVWQNHLQDHKHFHAQKTNDGPF

SEQ ID NO: 52515 - protein, 77 aa, Sorghum bicolor
  unsure (1)..(77): unsure at all Xaa locations
  Clone ID: 12501787.pep
STIMNFFRIPLNLFXCVVLYNVNAFPITVMFGMCSIFLFMAAILQRRLMVVSDLHRSTMEMTAEDEAFEPLENNKTI

SEQ ID NO: 52516 - protein, 59 aa, Sorghum bicolor
  Clone ID: 12510226.pep
CNNIIIYIVRPKVLEVYPDKSEGKLYYFIKCEPTNNACNASKNHQFSLTIYEDTFHTRS

SEQ ID NO: 52517 - protein, 54 aa, Sorghum bicolor
  Clone ID: 12510239.pep
KEMEFCTATPKLKTPYRCPNMCRSYKSSNAITFLRQILYYRRKTFVPLTTTVHF

SEQ ID NO: 52518 - protein, 103 aa, Sorghum bicolor
  Clone ID: 12510318.pep
REEEDTTGFVFLKGKVYGVGEVYLGRVTAPDSRVIFSDTYLSRTVNAAGWTTIGYTGSTDKVMLAEFNCTGPGADVTNRVPWSRRFSQNDAAKYLTIDFINGK

SEQ ID NO: 52519 - protein, 169 aa, Sorghum bicolor
  Clone ID: 12510328.pep
LMHGFYKANGCCGYVKKPDFLMQTCPDGKVFDPQADLPVKAILKVKVYMGEGWQKDFKQTHFDTYSPPDFYVKVGIAGVPLDSVMRKTKAVEDSWVPVWEEEFTFPLTVPEIAVLRVEVHEQDVSEDDFGGQTALPVAELRPGIRAVPLFDHKGLKFRSVKLLMCFEFA

SEQ ID NO: 52520 - protein, 79 aa, Sorghum bicolor
  Clone ID: 12510371.pep
EREEKKIWFPRSDSTRGFRSLPSSPSKILGMRRGVECMGRKPKVAGDDDCRYGYEDSVSTSSSKFLSRCKQAIKKAVHK

SEQ ID NO: 52521 - protein, 55 aa, Sorghum bicolor
  Clone ID: 12510409.pep
KIIIYNNKIVNQRCRRLEPYVYQWLVDYQKMNWGERYEVEDSGIVCVRGFTFLVW

SEQ ID NO: 52522 - protein, 34 aa, Sorghum bicolor
  Clone ID: 12510425.pep
YGTEYRHPNLMKKIHIKDYTKLKGLRRNNYKDDS

SEQ ID NO: 52523 - protein, 108 aa, Sorghum bicolor
  Clone ID: 12510449.pep
GEDYMVVMNKSGVYKMIFTTYETHLLPRLIMLKNFLKMSVPLLLCTHRHLRRKTNTDLRWWIMRYLFNIWYHFHVLLLPQDSIKTQKFPPECTSNSPDYGIECGCYKT

SEQ ID NO: 52524 - protein, 56 aa, Sorghum bicolor
  Clone ID: 12510451.pep
FWLDISECFSTQKSPYGTVGKGRLNIKRAYLFPPLFLVKFFFLYFKSWDLQRYLRV

SEQ ID NO: 52525 - protein, 135 aa, Sorghum bicolor
  Clone ID: 12510467.pep
NSPSIDRRRSPDHAGRTSRPAAASHRVRLLAWTNARYMCFIAWLMALNNTSCGYTGLTRKVSSPRPDGTSTGGGSGCTQRSSSHLHSHAGQPPSTHSGAPVVTIVACCNMSCMFTVTNAAATLPGEPMAVGRCIW

SEQ ID NO: 52526 - protein, 149 aa, Sorghum bicolor
  Clone ID: 12510471.pep
RAAEEVGFEAIVNESDVANDIAQVGGLINSCDAMVGVHGAGLTNMMFLPPGAALVQIVPWGGLQWMARADYGDPAEAMGLKYIQYEIGVDESTLKDKFPSGHKIFTNPTELHKKGFMFIRQTLMDGQDITVDVARFREVLLQVLNNLAQ

SEQ ID NO: 52527 - protein, 66 aa, Sorghum bicolor
  Clone ID: 12510473.pep
YQKRINDDQALGLISSDTSFLLHLFCFLHSKQGLNSSQNDLSGIELAKFEAIDHSLLSPWAFSNLN

SEQ ID NO: 52528 - protein, 81 aa, Sorghum bicolor
  unsure (1)..(81): unsure at all Xaa locations
  Clone ID: 12510477.pep
WPNFFFNISTYSHCTDTPTKWYVKKSRLVYKHAPKPVYITIISKLGGHTTSRYNTNPSISICGPVGXTSXRESXTREKFKA

SEQ ID NO: 52529 - protein, 35 aa, Sorghum bicolor
  Clone ID: 12510479.pep
HTHVHTHVRTCAKMQAYHSVHDDTYVHTERFLFRN

SEQ ID NO: 52530 - protein, 88 aa, Sorghum bicolor
  Clone ID: 12510507.pep
RTPKGQQTKTTTNLTHAKELSHLQNKLLPTTIIPFNLDRQACKMENLMFIRHLRCLFLIPRQRLLPMLECRSSCRGNLHRRNFLRTPL

SEQ ID NO: 52531 - protein, 67 aa, Sorghum bicolor
  Clone ID: 12510530.pep
LNTTAAPYRAWFQGKQVGGWTQVFGGGALSFATVRGASHEAPFSQPERSLGLFRAFLAGQQLPESFQ

SEQ ID NO: 52532 - protein, 60 aa, Sorghum bicolor
  Clone ID: 12510532.pep
LLSVKLLVEKDLEEELGNELLSNKFAGVEKMLAPSPSTGTKRERLKKSIVLLRQSKEVVA

SEQ ID NO: 52533 - protein, 63 aa, Sorghum bicolor
  Clone ID: 12510570.pep
APGRGPYNFNLTAKCGEPGASACADPTTHWSWDGIHLTEAAYRQIARGWLHGPFGDQPIVQSS

SEQ ID NO: 52534 - protein, 118 aa, Sorghum bicolor
  Clone ID: 12510580.pep
ANWVHILYQSRHDAQKALAKHGQQLNIVLIIGVKPVDPWQRQYLNENTNENYQGSATITFTSQPVAPSGFATRNALAPLPSNSVPNGSCNESNRGASGAIASPTKSVLSKVMDLMFGL

SEQ ID NO: 52535 - protein, 72 aa, Sorghum bicolor
  Clone ID: 12510626.pep
RIYKISIHLQDNHLWPAIRHRLPELVAGGQEQAGPARARPWSSARQATKTKYLAKTMAKKASYLWVSMTIAS

SEQ ID NO: 52536 - protein, 69 aa, Sorghum bicolor
  Clone ID: 12510649.pep
IAVLQTLWAVTMGAGVLPGRSHVDGPDGEMAYMRGSFEHTVGSRDSESLYMVGPPGGDCPELAIFFVRL

SEQ ID NO: 52537 - protein, 89 aa, Sorghum bicolor
  Clone ID: 12510741.pep
ARGKAASPRASPPHTPPPGTDSEAEEADQAGASAAEMGTYKCCIFFTRRFALADTSTPEDVRALFSRYAGGSPYMLADDLRRYLAGWGG

SEQ ID NO: 52538 - protein, 118 aa, Sorghum bicolor
  Clone ID: 12510755.pep
ARGEPSHASLISSSHPLESTSLASSSHIASDNSFSLHTKSNNRATADGHSRERAQPLGINSERTHQALALEHLEDMWTKGKSYKSENAKHIKKVSVGSASLSSTSVQQSVPCSTSICQ

SEQ ID NO: 52539 - protein, 80 aa, Sorghum bicolor
  Clone ID: 12510771.pep
QMRRHSLPPSTGIPRTPAESASLVAAAAGRGVSFSSSEAEAEAKLAALGRQAPAQRAREGEVVVKCDGPLCSAGGGEPRA

SEQ ID NO: 52540 - protein, 113 aa, Sorghum bicolor
  Clone ID: 12510775.pep
TCRYGTDQSMLLQKSEALHHLGFSRPEDDENMNHVGKGNVDKWLHMLMDNQQEDHAVYHSSDEHDNDEENASDEQQMQSRIDEESCRNGVTECSDEIVEVEDEIVSDQGAERG

SEQ ID NO: 52541 - protein, 99 aa, Sorghum bicolor
  Clone ID: 12510786.pep
HEGQHGDGSSSSGGRSGIGGGGVAGIIISLLVVGSVVAFFLIKRRKRKAAMEEHFEQHQPFTSFPSNEVKDMKPIYESTAVDIESLASPASINLKPPPK

SEQ ID NO: 52542 - protein, 99 aa, Sorghum bicolor
  Clone ID: 12510798.pep
ARGYDVIDVNNDREVHCFPRIVIGSTFHRAMGIDASRSPGGETVADFKRVLRRAFKLERAVASRSGAPRRKDRPRLLIISRKSSRRFVNERAMARAAAA

SEQ ID NO: 52543 - protein, 141 aa, Sorghum bicolor
  Clone ID: 12510807.pep
TRSVTLLSWSAVEYRDEVAAAGHLRYLRSAIQWGADFLLRAHTSPTTLYTQVGDGNADHQCWERPEDMDTPRTLYKITQSSPGSEAAGEAAAALAAAYLVFRDDRDKSLATQLLAASRSLFDFANNYRGSYQLSCPFYCSY

SEQ ID NO: 52544 - protein, 70 aa, Sorghum bicolor
  unsure (1)..(70): unsure at all Xaa locations
  Clone ID: 12510837.pep
MRECIXIHIGQAGIQVGNACWELYCLEHGIHADGQMPGDKTAGGGDDAFNTFLTETGAGKHVPRAVFVDL

SEQ ID NO: 52545 - protein, 147 aa, Sorghum bicolor
  Clone ID: 12510848.pep
KIVRKCCELGIQMNSNPCFIHISKMAVLSDPHRLKEELNKAKQAAVSKKQRLQLLFCPMSEQHPGYKTLKLICDTQLGILTQCFLSDRANKPNGQDQYMTNLALKINGKLGGSNVQLFDSLPRVGGGAPFMFIGADVNHPSPGNVES

SEQ ID NO: 52546 - protein, 43 aa, Sorghum bicolor
  unsure (1)..(43): unsure at all Xaa locations
  Clone ID: 12510877.pep
HEDWTRLLETNNFPEFTGRVCPAPCEGCCVLXGIIENPVSIRS

SEQ ID NO: 52547 - protein, 85 aa, Sorghum bicolor
  Clone ID: 12510878.pep
VFALHTHTHPIHPAPLELPSIFEGEPESLCRSLTTLCFVSTPYDADSLLVCRHCRRSCRVKDMATSGKKSLNSVTLLFKLPYYTQ

SEQ ID NO: 52548 - protein, 85 aa, Sorghum bicolor
  Clone ID: 12510903.pep
QKYRTKKASQFLQGLGRAFQLSVLALAHHLCMGLSTTPTTILNFCLNVIKTNLPRDGFWSYISSFMQYLTTVMHRESAGISVATE

SEQ ID NO: 52549 - protein, 81 aa, Sorghum bicolor
  Clone ID: 12510953.pep
ALRKMRKAKRGGGDLTTNFCKNRKACKTEWISGRLRDGDSSQDVCTKLPDWGKSVVSISLCNGDITLFSCSGMAIGHNGYR

SEQ ID NO: 52550 - protein, 81 aa, Sorghum bicolor
  Clone ID: 12510966.pep
VSVHCGFYSDNGGFKISEEDRRYMRACKIVVSTCAFGGGDDLYQPIGMTNSSIGRVCYVAFTDEVTRSTQEAEGKVIGDDG

SEQ ID NO: 52551 - protein, 102 aa, Sorghum bicolor
  Clone ID: 12510975.pep
MAASSSDQVPPAAMKLEGKVALITGGASGIGECTARLFVKHGARVVVADIQDEAGAALCAELGADAVASYVHCDVTVEADVAAAVDHAVARVGALDIMFNNA

SEQ ID NO: 52552 - protein, 68 aa, Sorghum bicolor
  Clone ID: 12510981.pep
LLQEPTPHEGAHDLGGDVGAHQQLLADVQHPHALVARLEDELVRQALLGGQLGEDRRRDGRLLGIGGG

SEQ ID NO: 52553 - protein, 155 aa, Sorghum bicolor
  Clone ID: 12510991.pep
HEGRALMLQSYLEKRYLGGIEDGNSAAEYIDTQGYELSPDARAQADIKLTYVVSCQIYGQQKQMKKQEAADIALLLQRNEALRVAFIHEEENISRDGKATTKEYYSKLVKADVHGKDQEIYCIKLPGNPKLGEGKPENQNHAIIFTRGDAVQTID

SEQ ID NO: 52554 - protein, 102 aa, Sorghum bicolor
  Clone ID: 12511000.pep
GNLPLQHYAAAPSPLAIRDATTSSLCDGRAAKAMSIPNTGSSSSCPLHPKMSPTTSSSSHSKKEKSPSRAQLNPMERLLQEIERCFFFLAIVVAWELVATSS

SEQ ID NO: 52555 - protein, 167 aa, Sorghum bicolor
  Clone ID: 12511015.pep
TRQIRRMVTNIRLFHAKKMHTTSRVLPVPMTWLVFTLLLSSVAAAAETVKVITTPVFAQIPRFQSSKDFQVLVRVEAPPAAQQQRRVPIDLAVVLDVGTGPVRLDAVKKAVKFIIRQIHDDDRVAVVGPSSNSRLVTGFLSTRDARRDAENSVDELEPRGEFTSGAG

SEQ ID NO: 52556 - protein, 143 aa, Sorghum bicolor
  unsure (1)..(143): unsure at all Xaa locations
  Clone ID: 12511017.pep
MNEVSNFVDPAPLNALDDPPYRINNSGVRRPINNKTTPASAVHYGGVREYDAHNLYGFLEARATHGALLADTGRRPFVLSRSTFVGSGRYTAHWTGDNAATWDDLRYSINTMLSFGLFGIPMVGADICGFXGNTTEELCSRWI

SEQ ID NO: 52557 - protein, 135 aa, Sorghum bicolor
  unsure (1)..(135): unsure at all Xaa locations
  Clone ID: 12511019.pep
VGCSVICLVFLLSSRPDATAFDTMSPKASLVAARRPVAVXTLRTSSAAAAARGFGGDFHVDVRPQHHDEQTAGDKTITEWVRDTVIVEESSEAEPEETEPGRDASATAAASSNSDDHPAAPGTEKAGHDAAAITV

SEQ ID NO: 52558 - protein, 63 aa, Sorghum bicolor
  Clone ID: 12511021.pep
FRGTLLLPSNPLLWQNLLDYMVHMLRSLSHIPLTALHESHITPRSCRVCLLEYMSMRPMRLGP

SEQ ID NO: 52559 - protein, 43 aa, Sorghum bicolor
  Clone ID: 12511025.pep
ARGPNFYIVIRTPHIWLFPLCSVYSSTMFNYVCWFFPTIINFI

SEQ ID NO: 52560 - protein, 140 aa, Sorghum bicolor
  Clone ID: 12511032.pep
MHNHRKRSRDADVRSTKRASQPVVGAPRRLLQFAVRDAVKTVQPVTSSSEPASKRLRSVVSTLASDSTLDITHIRLQKKTHSDLKIPGATAALRAAAEAAEDALKDSFSGSVFSRLGRMPTRNPTEQSPAHREQDLEGKE

SEQ ID NO: 52561 - protein, 102 aa, Sorghum bicolor
  Clone ID: 12511048.pep
MAPRPAAAAAAAALMDELVEEILLRIPPDDPARLLHAALVCKRWRRIVSDPRFRSRFCEFHRTPPMLGFIRNHERGSSFVSTSSFRAPPADRVNSRAIDARH

SEQ ID NO: 52562 - protein, 111 aa, Sorghum bicolor
  Clone ID: 12511079.pep
MSKKLQMGGPKQAKGATDDGKGDVAGAGGSAVTASAIAASYDDQIRPLLDAVDRLRHLKVTQEGIQLPTIVVVGDQSSGKSSVLESLAGISLPRGQGICTRVPLVMRLQDD

SEQ ID NO: 52563 - protein, 155 aa, Sorghum bicolor
  Clone ID: 12511132.pep
TRHQSPSPHPATPPQATATPSPQPSRGAGLFSSPMRSNGSPAPSAWWTPSREEKPREGSPMDGVVQHQQQSPTTPSGQQSQQQKVALITLPPPREVARPEMPRDSAPAAGRVDEEEWVTVFGFPPGDTNMVLREFEKCGIVLRHVPGPRDANWVH

SEQ ID NO: 52564 - protein, 81 aa, Sorghum bicolor
  Clone ID: 12511144.pep
QNQNTELLASKIKPNKSELFPGTTYGSYAQIILCAYKGTTGMSVKASIPILPTHILVGAHSASFVEENQSKICMDSSMDWI

SEQ ID NO: 52565 - protein, 158 aa, Sorghum bicolor
  Clone ID: 12511174.pep
SDVLSAWSGIRPLATDPSAKNTESISRDHVVFEDYPGLITITGGKWTTYRSMAEDAVNAAVRSGNLKPANGCVTDNLHIVGGYGWDPAAFTVLAQNYKRMKKTYGGKGIPGAMDSAVSKHLSHAYGTLAEQVATIAQNEGLGKRLAHGYPFLEAEVAY

SEQ ID NO: 52566 - protein, 145 aa, Sorghum bicolor
  Clone ID: 12511176.pep
HEGGMPPEIGKCRLLTYLDLSRNNLSGEIPPAISGMRILNYLNLSRNHLDGEIPATIAAMQSLTAVDFSYNNLSGLVPATGQFSYFNATSFVGNPGLCGPYLGPCHSGGAGTGHGAHTHGGMSNTFKLLIVLGLLVCSIAFAAMA

SEQ ID NO: 52567 - protein, 144 aa, Sorghum bicolor
  Clone ID: 12511194.pep
SSGSDRHMLLNIRTGRDRRCGAFRRGGSSSACPAWWRAGDGHSGMMGVLPAASWSSASDDEDDARVLCSGSWLLASVSTSSASDDEDAERVLCSGSWLLASASRSAITEEGADEQGGGVARLLLRSPDRPASSAMDSRRLWPRA

SEQ ID NO: 52568 - protein, 124 aa, Sorghum bicolor
  Clone ID: 12511206.pep
MATSSPGARRKAPSPPKHRHDGTSPLPLGMDWSPPPKRWEGRNTIWPHNPQTGWSYCVMMPSWITQTPETGVTADSFLKSVVFYRIHVGIQSPEGFSSSHGILRRFSDFLKLSSDLKSAFPRKD

SEQ ID NO: 52569 - protein, 184 aa, Sorghum bicolor
  unsure (1)..(184): unsure at all Xaa locations
  Clone ID: 12511234.pep
LLNNPPDFHSFMLGAQCPKMSTTYNWVDTEAQLEHLARLLGEERAFAVDTEQHSIRSFLGYTALMQISTQNDDYLIDTIALHDVMGILRPVFANSSICKIFHGADNDVLWHQRDFHIYVXNMFDTAKACETLSKPQKSLAYLLEVYCEVSTDKTMQREDWRLRPLTPEMIEYARTHAHYLLYIA

SEQ ID NO: 52570 - protein, 65 aa, Sorghum bicolor
  Clone ID: 12616539.pep
NSPIPQIYISYKANPHYMFHLNMQAIHIIFPSLSTSSPTKSHVIPLTSNLLMQPILIKKDVRTCT

SEQ ID NO: 52571 - protein, 37 aa, Sorghum bicolor
  Clone ID: 12616546.pep
PPSRPCPERGGRSSPVKRSAAVAQAVGADRGVESAGS

SEQ ID NO: 52572 - protein, 191 aa, Sorghum bicolor
  Clone ID: 12616553.pep
HEGYLALDEAYRMLDMGFEPQVTRIVEQMDMPLPGVRQTMLFSATFPKEIQKMASDFLDNYIFLAVGRVGSSTDLIAQRVEFVQEADKRSHLMDLLHAQRDTGKPTLTLVFVETKRGADSLESWLCMNGFPATSIHGDRNQHEREYALRSFKSGQTPILVATDVAARGLDIPLVAHVVNFDLPNDIDDYVH

SEQ ID NO: 52573 - protein, 111 aa, Sorghum bicolor
  Clone ID: 12616554.pep
MGCGMSTEDKEGKARNEEIENQLKRDKMMQRNEIKMLLLGAGESGKSTILKQMKLIHEGGYSRDERESFKEIIYSNTVQSMRVILEAMESLELPLEDARNEYHVQTIFMQP

SEQ ID NO: 52574 - protein, 156 aa, Sorghum bicolor
  unsure (1)..(156): unsure at all Xaa locations
  Clone ID: 12616561.pep
ARGTPPVKASKNTELQKQSAPNLTITNGHTSTKEVAKTEHPINDVKRITTWICKNLACKAVRPSEDSFCKRCSCCICHKFDDNKDPSQWLVCSSENDSKNCCGSSCHIECAFRDKRLGCFDLEQIIHLDGSYSCASCGKISGILXYWKRQLVIGKD

SEQ ID NO: 52575 - protein, 41 aa, Sorghum bicolor
  Clone ID: 12616568.pep
LRCLSCERLHFAITGNPLSWSTVGGVHLFPNIRALAFGGSK

SEQ ID NO: 52576 - protein, 151 aa, Sorghum bicolor
  Clone ID: 12616569.pep
MGFHFAAVNLLFLEAPVGVGFSYTNRTSDLRRLGDRVTAQDSYSFLLGWLDKFPEFKGRDFYIAGESYAGHYVPQLAELIYDGNKAASRDRAISIKGFMIGNAVLNDATDQLGMVEYAWSHAIISDELYSAVRRECDSFKEEADGGRPGKG

SEQ ID NO: 52577 - protein, 85 aa, Sorghum bicolor
  Clone ID: 12616570.pep
GKHFCVGNPGSSKNHATAHKHYSYECWLRIWNPELFLILTQGPSPSIRLTNRESRERSSPAMGTCDHGGRVSKPGDCRPRRRALA

SEQ ID NO: 52578 - protein, 122 aa, Sorghum bicolor
  Clone ID: 12616575.pep
LVTKLKPYFRKNEYPKKPPKFYEVTNNSKERPDVWIESPDKSVIISVTSDIRTIKSEVFASPYCLRFPRIQRVRYDKPWHECLDVQAFVDIVHSSNGTTQRVADDNSLKNDDTNRSRTNKKV

SEQ ID NO: 52579 - protein, 147 aa, Sorghum bicolor
  Clone ID: 12616578.pep
HEAAFKVLQGSLFSLRRLEENSVFPSILAALFVIEWECSMSLALVEENYLEGHVEDTEVGVSMSSSSKSYLDEKMHLKANLAESIHAFRQSLSPSFWNNLHSCTSNRLANILAQCVRYAVFQTRDLHAERTAILCSEWVVDMLKLIC

SEQ ID NO: 52580 - protein, 57 aa, Sorghum bicolor
  Clone ID: 12616586.pep
PSMEEEPNSVLCSLESFLSLTFPRRTRSMPSSSTHSTTAASAAGEEEEEEEAELPRA

SEQ ID NO: 52581 - protein, 148 aa, Sorghum bicolor
  Clone ID: 12616596.pep
TRQRRRHYHFLRWYHDGMVGKFASMSNLLRSSDTSASLGEKVPISRNRVYEKRFPCLSLSSTTPPVTIKDEIATVSSPMKRAKLTDGPLSTHCSTRHHETAHVAKSAEMNSLESQNFHPINDPRQNCSKLPRGVLKIRTGCASVIGDS

SEQ ID NO: 52582 - protein, 120 aa, Sorghum bicolor
  Clone ID: 12616597.pep
MRFDLDGLPVHFPYAAIYPEQHAYMGELKRALDARGHALLEMPTGTGKTAALISLITSYSLANPSRPLRLIYCTRTVHEMEKTLAELRLLFAHLPPPAARSLLALGLSSRKNLCVHPQAS

SEQ ID NO: 52583 - protein, 189 aa, Sorghum bicolor
  Clone ID: 12616600.pep
TRVWTIDAWNRIKVTFQDSGKDDSCVVVTTRNQTLAKYCSPPSHIHQPDFLGKEEARTLFLKKTNRSLDELEKGDKTKGIVEKILNKCGGLPLAILTIGAVLANKDTEEWENIYMQLPWDLANNPSLDALRRVVSLSYNHLPSRLKPCFLHLSIFPEDFEIEKKHLVNRWVAEGLVADDTTTITLEEVA

SEQ ID NO: 52584 - protein, 42 aa, Sorghum bicolor
  Clone ID: 12691522.pep
AEDKVIPMRGLEWCATSSHRCVESNLLEMVQPSCHAETNQDL

SEQ ID NO: 52585 - protein, 130 aa, Sorghum bicolor
  Clone ID: 12691525.pep
TREGIQPLILSLLSLKEAARTSIVSRKWRMIWTRHPNLCFDGTKKRPNYEDCVKIERAKFIETVNSVVQQHSGIGLNKFSIRCSLPKNSSDHLDMWIRFAAAAKAKIIDINLWSKRYIGGPIKEQYLFPL

SEQ ID NO: 52586 - protein, 138 aa, Sorghum bicolor
  Clone ID: 12691527.pep
TRAAHVTCFSDALEGHQFFNQQQTPPEADATDHLGLAASSPFLLSGFAHYGPLHHGATSLVQLLEGSVVYAAAGGGGLPDMSNKQQQEPVPAPTCKVGGERERLSLSQDTGLTSDVNPEISSSSGAQRFDHDHLCWGY

SEQ ID NO: 52587 - protein, 47 aa, Sorghum bicolor
  Clone ID: 12691532.pep
ARGRVLRGTSMPKDAASINLRSFYLVGTPVALVLPFWLHYNFKGLWL

SEQ ID NO: 52588 - protein, 138 aa, Sorghum bicolor
  Clone ID: 12691548.pep
MAKEVDVSALEAGGARDYIDPPPAPLVDIHELGKWSLYRAVIAEFVATLLFLYITVATVIGYKHQTDATASGADAACSGVGILGIAWAFGGMIFILVYCTAGISGGHINPAVTFCLFLARKVSLVRALLYMAAQSLGA

SEQ ID NO: 52589 - protein, 70 aa, Sorghum bicolor
  Clone ID: 12691550.pep
WRLGIPNQTPSSVLPCCAAALVRPSNQGGVLVRRAEAEYGEGPRPLHLRQGCRLQLWILWLCIKLELLRT

SEQ ID NO: 52590 - protein, 110 aa, Sorghum bicolor
  Clone ID: 12691561.pep
GSLPHRKLRAMARTHGPVMLLRLGRVPIVVAFSAAAAQEAMKTRDVAFASRYRGPMAERLLYGGRDMAFAPYGEHWRQARRVCVLHLLSHRCVLSFRRVREQETAALLRR

SEQ ID NO: 52591 - protein, 105 aa, Sorghum bicolor
  Clone ID: 12691572.pep
MACYSAVLQHPLGSSLTPCSASRAPPRLQRVGVAATPSVAASARPLARVRISPRCAYSGGAGATPGGSEELPAAALRRVLETPGAHQAPACYDALSARLSKRAGF

SEQ ID NO: 52592 - protein, 139 aa, Sorghum bicolor
  Clone ID: 12691577.pep
MFLRKADQLEIGDIAYRPLQDGDLILINRPPSVHQHSLIAFSAKILPIHSVVSINPLCCTPFLGDFDGDCLHGYIPQSVRSRIELGELVSLHHQLLNMQDGRSLVSLTHDSLAAAHLLTSTDVFLKKSEFQQLQMLCLS

SEQ ID NO: 52593 - protein, 144 aa, Sorghum bicolor
  Clone ID: 12691581.pep
IHGGVSTRTPGKKARLAALGGFVVRSRDGSHRRFVHNRPESRPRRKGNAPRGAETREARVAAANERDRKLSADAAVERRKRRAEAAARAVDRYARDPKYRLLHDCTGDLFAKLLAEDLQKLADGKLSDISLAAKWCPSLDSCYD

SEQ ID NO: 52594 - protein, 125 aa, Sorghum bicolor
  Clone ID: 12691583.pep
HEAIASAVMLCLEMWYYTAVLILVGCLKNPEIQVDAISICMNYQLWTLMVAVGFNAAVSVRVSNELGANHPKAAKFSVVVATATSAVIGVIFTAVALAARKQMPRLFTGDDVVLRATAKLGYLLA

SEQ ID NO: 52595 - protein, 152 aa, Sorghum bicolor
  unsure (1)..(152): unsure at all Xaa locations
  Clone ID: 12691612.pep
RPPPLELVATSQTDPFSELENGSRNMLANGTPSNTMSKLIESSPPHTYPSPQSPPQYKEDILHRRLFLEEEFLQISGHLHSVGSLGSGSSCSDGSSSDFGSCNSEDDCEEIQTKMELSCNGQMVLFPFVNGDDHEAKNNLEHFSXENTLFDH

SEQ ID NO: 52596 - protein, 126 aa, Sorghum bicolor
  Clone ID: 12691616.pep
RAPLYGPAPPDSIYKVARLLEQAKRPVFFLGQRASSHIVVEALHQFLNKHPIAVVETFQAAGAVSQEMAPKIFFGRVGLFRNQVGDKLLQNSDLIVTLGYDPTEYDASSWNPNGTLPIVHVDYTSC

SEQ ID NO: 52597 - protein, 52 aa, Sorghum bicolor
  Clone ID: 12691617.pep
ARDAFDHGEWPRMSGSERGRIMARFADLVEQYADELAALESLDAGKYPAITN

SEQ ID NO: 52598 - protein, 51 aa, Sorghum bicolor
  unsure (1)..(51): unsure at all Xaa locations
  Clone ID: 12691619.pep
ARGISRRVGSRRPRREASEAARYLPLPTLPPAVDRVGLSGGTAYPAYRAVX

SEQ ID NO: 52599 - protein, 88 aa, Sorghum bicolor
  Clone ID: 12691627.pep
MAGGGVGDAYGEDRATEEQLITPWAFSVASGYTLLRDPRHNKGLAFTEAERDAHYLRGLLPPSLASQELQEKKLMHNLRQYTQPLHRY

SEQ ID NO: 52600 - protein, 143 aa, Sorghum bicolor
  Clone ID: 12691650.pep
MDGSGSSGGTNGGSGGDGAGWLRPMDAEQLRECGHRMVDFVADYYKSIETFPVLSQVQPGYLKELLPDTAPNKPDTLEALFDDIREKIVPGVTHWQSPNYFAYYPSNSSTAGFLGEMLSAAFNIVGFSWITSPAATELEVIVL

SEQ ID NO: 52601 - protein, 38 aa, Sorghum bicolor
  Clone ID: 12691659.pep
EEVLHGRCPIPPERWREVRLGVVGLHEDGHVLDVLHVT

SEQ ID NO: 52602 - protein, 164 aa, Sorghum bicolor
  Clone ID: 12691661.pep
ARGLHDRRPNSQERESSYSRSPSRKSERRHEKKPDDGETNSSRSLSVSDNNDDRKKETLLSGDDKEDHEIQLKQIRQDMELLRDDKSHLEIILDQKNAEVRKISSRVNDLDLQLRKEKEECHRMTSKMKKFIKAHTRFLKAQEELKRSQARFERLGDLLASDIL

SEQ ID NO: 52603 - protein, 109 aa, Sorghum bicolor
  Clone ID: 12691680.pep
HEGGSGVFGGSDAGSASDRFHYAYRRAGSSAASTPRLRSGGAALSSGDATPSMSVRTDFPAGDDEEDDEMASEAAGGCGGGGKDDDAREWVAQVEPGVLITFVSVAQGG

SEQ ID NO: 52604 - protein, 94 aa, Sorghum bicolor
  unsure (1)..(94): unsure at all Xaa locations
  Clone ID: 12691681.pep
PRERAAVLGAVRDARERAAPXARARRGAADGVVRRVPHVSGGAGHRRACRRRRGRRGSLALLLCWAGARGLAQHGAKAAVAMGGSRGRLPPAAS

SEQ ID NO: 52605 - protein, 72 aa, Sorghum bicolor
  Clone ID: 12691682.pep
HEGDYHNGMSEADHKILSAEVKLESQYYFYMETQAALAIPDEDNCITIYSSTQMPQLAQSLIARCLGIPFHN

SEQ ID NO: 52606 - protein, 119 aa, Sorghum bicolor
  Clone ID: 12691684.pep
MAVAPLLTLLLLLFLSGSGPRRCSAAATANSTSSPSPPPRPAPLVPALFVIGDSTADVGTNNYLGTLARADREPYGRDFDTHRPTGRFSNGRIPVDYIAERLGLPFVPPYLEQNMRTGA

SEQ ID NO: 52607 - protein, 60 aa, Sorghum bicolor
  Clone ID: 12691691.pep
ECALGDAAIGEETLNYDGDDVEMADADSDTEEALAAEVSAGTGGAAGGGGHAEKDGPEGK

SEQ ID NO: 52608 - protein, 115 aa, Sorghum bicolor
  Clone ID: 12691693.pep
FLSFFSSVAFFSALRCTFFFFFKSFFRSFKKEEKLKCYPRLSFFCLYIFSPKYIPSSRYIRRRKCPALNNSYRQPISHIAPYSTDLTLRAVSLIACLRSFLPTYRRLYLELPGEV

SEQ ID NO: 52609 - protein, 104 aa, Sorghum bicolor
  Clone ID: 12691697.pep
HEAGFDKGLVVELAVAAMEELVRMAHLGEPLWIPALVVDRATIETLNEEEYARGFPSGVGPKLPELRSEASRETVVVIMNHVNLIEMLMDVNQWATLFSSIVSR

SEQ ID NO: 52610 - protein, 42 aa, Sorghum bicolor
  Clone ID: 12691710.pep
GHRACLASPCRPLMQLHSHNDVRRDGVRGAEEEPWDDIVPRA

SEQ ID NO: 52611 - protein, 71 aa, Sorghum bicolor
  Clone ID: 12691717.pep
DMIKNVLKIKDTQVREVMTPLVDVVAIDAIATLIDFKNLWETHQYSRVPVFEERIDHIVGIAYAMDMLEYV

SEQ ID NO: 52612 - protein, 63 aa, Sorghum bicolor
  Clone ID: 12691720.pep
MCGIFAYLNYNVSRERRYILEVLFNGLRRLEYRGYDSSGIALDADAAAQLPSPSPAYAGAPPL

SEQ ID NO: 52613 - protein, 133 aa, Sorghum bicolor
  Clone ID: 12691724.pep
ARGKSSKAETESLQCQVTALLAQVEKIEGEKRELEIALADARDQLGTSCDTLMVANNKLIDLQMQLDLANESKHAAFGEAERLDGERKDLALQLESKSAQVNELELMVASLEERVDRKELELQLELISAEAAD

SEQ ID NO: 52614 - protein, 61 aa, Sorghum bicolor
  Clone ID: 12691726.pep
MEETLAVESAAGETAAAQAPERKEETLEEVLSRHRKEKSKLQDKETSLKKAAAKGSKAEQK

SEQ ID NO: 52615 - protein, 98 aa, Sorghum bicolor
  Clone ID: 12691728.pep
ARGELIITPTQALLPLSILFVAYHAIRALFFGPPASKHWEQLPVVGLGKGWLAWVWATLKSVRKTQDWAFEGYRKVWSNAMRVNTLLNSLFPVCPPKQ

SEQ ID NO: 52616 - protein, 152 aa, Sorghum bicolor
  Clone ID: 12691732.pep
HEARLEEPQRVLHNVPRVHPPQSGGKIKKLTKNLCQYSDESLNGSGSLDCCHQGRPGRRKNQDYTADPGRNDLPVAAHEPQVVLLGSDRRYNSYWLFLGPCREDDPGHRRVYFESSEDGHWEVIDSPQELLSLLSVLDSRGTREAHLLTSME

SEQ ID NO: 52617 - protein, 99 aa, Sorghum bicolor
  Clone ID: 12691741.pep
KVGLVLNLHFGVGFPVFSIFCYQSLIHQPQLSVSMLLWFQKVQSTCFGITAFFSLEERKPSISIRDHPVSSLSDSPAFFHFAPCCLKFLHRILQYNWFA

SEQ ID NO: 52618 - protein, 129 aa, Sorghum bicolor
  Clone ID: 12691745.pep
TRVSNWNVDGIIEQMLPKEYGEKSQSKEAASLKSGRTQTVEVSPEAKKRSLEAKSRGDDAFRRKDYLVAVDAYTQATELDPTDATVLSNRSLCWLRAGQAERALEDAKACRALRPDWAKACYREGAAHP

SEQ ID NO: 52619 - protein, 165 aa, Sorghum bicolor
  Clone ID: 12691748.pep
MRVESVLAAARCLFGTCEGESTSLSASNICSSLETLAPANVLYAGDDAYGIRQKAYFINQHKEMQPACRYLPSDAYDVRAALRRLVESDTSFAVHAGGHSYNPGTSNIEGGVTIDLSRLNSIKLTDNNTAAWVGPGARWRDVYKSLEPHGLTTPGGRVADVGVGG

SEQ ID NO: 52620 - protein, 62 aa, Sorghum bicolor
  Clone ID: 12691751.pep
KRTFTYLRIISHGHFTGSYFFCTRLNILYIWLKGVVASSVTSVISKGILLLGVPSHLVAIRA

SEQ ID NO: 52621 - protein, 116 aa, Sorghum bicolor
  Clone ID: 12691778.pep
HEALAFSLFEAVLGSSTLRSSAHFGCTGFVPVKWREILWGIGFVSETLQLPLLSPCSSGFAQRRNRYNYQRFLLFHSIQPCCFPLKAVSLPIPLLVRQMFIGSSLVLEEDKIFLAD

SEQ ID NO: 52622 - protein, 169 aa, Sorghum bicolor
  Clone ID: 12691782.pep
TRVHWSRERKGKNGQQITQVCNTEQDDEARSIFRESSQDTHHNMDLIWQQADTSRISEDKNITGLLIESTEKASSMTNVDMGQQTATMGIYGQEIRSETTAGTSLPSGSSAKESMLESAARLEKSSTFPVGRFVDELQKGVSDADATSTKKNEKSIVEGIASSLSMSRT

SEQ ID NO: 52623 - protein, 111 aa, Sorghum bicolor
  Clone ID: 12691789.pep
MEMNLRAQSPLCSRGRPALVVRPAAAATGLTLSVMRCSRFTRGELVRCMVSSSDYPKRNPRRTSTSKSKGVASGGYASRPTAESSTKKIEQSSNDEGDFSRANGSLYGEAT

SEQ ID NO: 52624 - protein, 63 aa, Sorghum bicolor
  Clone ID: 12691790.pep
HEAPVLPPRTGHGWACVPVIPSICNIRSENRLCAITKSLPPAQGWSANDSSSFSREEPLYPLQ

SEQ ID NO: 52625 - protein, 139 aa, Sorghum bicolor
  Clone ID: 12691791.pep
TRATTTYSTPQRACAAHTGRLHHSLVIKRRRRAPVRPWRSSSSSSSKSPPARRPRAGRRRRSCSAASPRSPSSCSCSAAPRSSPGRRWCDSSEGEGHGHHRRRRHQRQRRRRPPPLPLHHQRQVNMQQHIFRRRLITPP

SEQ ID NO: 52626 - protein, 113 aa, Sorghum bicolor
  Clone ID: 12691800.pep
MGAGDGEVAASKEKGSGAGGGGVERTSLDGVRDKNVMQLKKLNTALFPVRYNEKYYQDAIASKDFSKLAYYSDICVGAIACRLEKKEGGAIRVYIMTLGVLAPYRGLGIGTKL

SEQ ID NO: 52627 - protein, 192 aa, Sorghum bicolor
  Clone ID: 12691801.pep
ARGVNDKVQFLEPTVDNDYLAKSSDVTHSHAKEPYGVLSYEKSPSSVFDVRPSQCNNTSKIQSTFPQVGLPNFMHLNNGPICFNCLMLNSSKCVSVDLLISRHAIFYNRRTSYNIFHGNHILNRRKRSDALSLIIHIFGIKGCCTNLLKRDCHVSSTTNSNCLCLSLPKLMNKLIRNSKRCQYKKLFLKHWS

SEQ ID NO: 52628 - protein, 144 aa, Sorghum bicolor
  Clone ID: 12691802.pep
GTRPLVNYMHDHLLREKQQLSINGVPIPADFCCPLSLELMSDPVIVASGQTYERVYIKLWLDEGFTICPKTRQRLGHSNLIPNYTVKALIANWCESHDIRLPDPMKSLKLNFPSAASSLQDSSAAGGSPLHPSVVSRANIPGSP

SEQ ID NO: 52629 - protein, 82 aa, Sorghum bicolor
  Clone ID: 12691803.pep
ISLEPDSNSVGLISMAETTPGHASNPSGVVGREQKVFKKGSVDNEKIGEWAVTGCISDSLGSFVWAAAASAVRPRFNSILEP

SEQ ID NO: 52630 - protein, 126 aa, Sorghum bicolor
  Clone ID: 12691810.pep
DPATLATPGDIRRAAIQLAEDSSSSTPDASAAAAAVAVASSASVGQATPSSSAYQAGDDATGAAMYGAEYAAAAMYGAGMDFDHSYYYDGMVGGNEWQSAGSSGWHSNVDAGDDEGAGDMSLWSYY

SEQ ID NO: 52631 - protein, 97 aa, Sorghum bicolor
  Clone ID: 12691829.pep
RQRICFFDTKHFLPITNEFPSGKDFCTWFPMGRAAPRAQHGEWVSPCFASGQQKSHRAFLMWKGKLVLLLHYTPFLCTQACFFFFRLFPKGCTVFLL

SEQ ID NO: 52632 - protein, 135 aa, Sorghum bicolor
  Clone ID: 12691839.pep
SRWSFSHTPANNSRQPRQLVFGSCFVFPALDFAYESLLNTSSIHGVPGSFFSYILRLWVGTASLCAIRNRKVAPIDCAGTHQSVICERPSMQVDLDKPKADKHAVGCGMAFSMISRRTGGLTGMVIWRDEGTSSR

SEQ ID NO: 52633 - protein, 76 aa, Sorghum bicolor
  Clone ID: 12691853.pep
TFLFFLTPYYSLKRVFMRQIYIPLFFFHYPHTKLKKIFVMLRRVHSTTSAHQTIQDLVSRKFYSNDYWLYVNIHYA

SEQ ID NO: 52634 - protein, 99 aa, Sorghum bicolor
  Clone ID: 12691870.pep
TTLSGLANPQPHYCQVKQTTRSYSPPVTTHPDSEPSTSPPHETSQTKITTRDTRHNSTNHPSHNNSKSGIRCNFKRTDQNSLSLSFVFTTLISMENCRK

SEQ ID NO: 52635 - protein, 86 aa, Sorghum bicolor
  Clone ID: 12691880.pep
TGAQKWGKLYNNIMLDVHQPQAAPTLSHSGTGHTSAINRIPANTIHLHDACIGRLAKARAACCLGSLLFPATMIDSPAMDGLSSGS

SEQ ID NO: 52636 - protein, 140 aa, Sorghum bicolor
  Clone ID: 12691884.pep
DQVRVNIANGDMVGHTGDIEATIVGCKAADEAVKIILDAVEQVGGIFVLTADHGNAEDMAKRDKSGKPLRDKDGKVQTLTSHTLNPVPIAIGGPGLSPGVRFRTDLANAGLANVAATVMNLHGFEAPDHYEPTLIEVVDK

SEQ ID NO: 52637 - protein, 103 aa, Sorghum bicolor
  Clone ID: 12691902.pep
MEYGVADDYGYGYGGYDDQQDLPSSSSVDGDEYATVLSAPPKRPAGRTKFRETRHPVYRGVRRRGPAGRWVCEVREPNKKSRIWLGTFATAEAAARAHDVAAL

SEQ ID NO: 52638 - protein, 176 aa, Sorghum bicolor
  Clone ID: 12691908.pep
FDSYPSNLASIARFHSKRVLKLKEAVLTSYRRNEIKFTELTLDTFRMLQCLEWEPTGSYQIAAKELTENGTVSDQSGPSGLIDIQLSTEISDGSLPSNPQKAIIYHPTAAHLLAVLATICEELSQDSILLIYISASGSTEQSFASQKLGSSSSSRGRPAFPVDKPNSHISSDNHLW

SEQ ID NO: 52639 - protein, 68 aa, Sorghum bicolor
  Clone ID: 12691919.pep
STSRSRVCLISSLLLVLYYSSGLYIYIYIHIYIYMNHGIHGRRYPFSESAMEHDVAHSGGGGAVPAGE

SEQ ID NO: 52640 - protein, 84 aa, Sorghum bicolor
  Clone ID: 12691920.pep
ARGFSIRVFAAAAVLGVGVLLPVNFLDHQLQEIDFTDLPNKSIDLFSVSNVHDGSSKLWLHFSPVYIITGITCYLLYHEYKYIC

SEQ ID NO: 52641 - protein, 190 aa, Sorghum bicolor
  Clone ID: 12691933.pep
TRDDGPVMAAEACQDALKRSIAKVLYHTGFEELQPSAMDAFTGIVADYFQKLVRTFNVYNESEKKSVPTNVEGPRFQPRFTPEEVILHTLDENGHDISSLELYAKDDIDRLGSKLDGLHERMKLHLTDLLRPALSQDAGVDGVGAFKDGSEQFVSGDFAEDLGEDFFGFRALGLDKEMGLDMISVPLHLL

SEQ ID NO: 52642 - protein, 76 aa, Sorghum bicolor
  Clone ID: 12691934.pep
KKSNTIMPWMCFCLQWPKLKIQNSLSLCKCAMIKSCMEEIVALYIKQLNQRCGIWSITSKRGKMYNVHKTKEIIFE

SEQ ID NO: 52643 - protein, 122 aa, Sorghum bicolor
  Clone ID: 12691945.pep
PARKSSARGSSSLSSPSSSSSSSSSSTSSPLLEPPSASASEPESSSASASDKESSSASETSRSESSSGSGRAFGGGTTLLPFFAVGAGGGGCCFLLAMETGLWSPNGGRGAGGEEKKKTKPR

SEQ ID NO: 52644 - protein, 140 aa, Sorghum bicolor
  Clone ID: 12691963.pep
APAGLILACLRVGSCGVPVCLVVAPWCWWWWSAVCFFKWCAAQLCALQWEGRGEASRKSGGPGAPVNPRICPSSTPKAERSCADLTTCARKKNQRWRTEGRERGGDLCWSSPAEVQRPELLLIRGGRGSHRPPAAMASQQ

SEQ ID NO: 52645 - protein, 120 aa, Sorghum bicolor
  Clone ID: 12691966.pep
VRWDDDVDFRRPNRISPWEIELTSSVSGSHLSAPNAKRLKPCLPPDYLVPNGSGCPDFAESAQFHKVLQGQELLGYRTRDNAAVATSQPCEARNMQDIDERSRSNNVSNSIPRVPRIGVR

SEQ ID NO: 52646 - protein, 186 aa, Sorghum bicolor
  Clone ID: 12691972.pep
TRRQITCWDQQCIAESNDTNCNLRFISCENSGSDDYSVWAKNTSIFANCDATNPNNISFNYGMFLSALGKGAVSSPFLEKYFFCLWWGLLQLSSSGNPLITSAFITENLFAIAIGAISLILFAQLIGKMQTYLQSISKRLEEWRLRQRDMDEWMRHHQLPSHLQERVRRFVQVKWLATRGVEEESI

SEQ ID NO: 52647 - protein, 87 aa, Sorghum bicolor
  Clone ID: 12691975.pep
TRETSYARHRDHGGTNPRSKWSSALPLPRPARGLSPQANSNRKNNDYTREGTCLALRPWQDELAIATLKHITLSTGSKARSTDDDLV

SEQ ID NO: 52648 - protein, 110 aa, Sorghum bicolor
  Clone ID: 12691981.pep
HEGIAKEREDRKEPLGENEAVMGDETSLFYSDIMPLLVNEEPSVGEEAYVWFGSVFPLACDVVNARFTYEALTATTANRLHYPAYDRFLKEMDKYAACSMIGPNILHLST

SEQ ID NO: 52649 - protein, 101 aa, Sorghum bicolor
  Clone ID: 12691982.pep
SAFSFSNSLCSCFVISSSFCISAFAEDSCASKDSLTASAVLAALVFTSMFAASSSCNAFSFSTSSSSAFTTSLSFPASVFAEHSCASNDFLTASTAASTFI

SEQ ID NO: 52650 - protein, 83 aa, Sorghum bicolor
  Clone ID: 12691991.pep
MTVVDAESRFHVLAVDDSIVDRKLIEMLLKNSSYQVTTVDSGSKALELLGLRDNGAEDASSPSSSSPDHQEIDVNLIITDYCM

SEQ ID NO: 52651 - protein, 83 aa, Sorghum bicolor
  Clone ID: 12692896.pep
VASATPLHGSDAVLKAHNMAEDVRIQYNDQEDFERLARQFGIFEEWKDGIPRTAFKGVVVFRYNSSQRRIFLVSPDSLSQLGV

SEQ ID NO: 52652 - protein, 134 aa, Sorghum bicolor
  Clone ID: 12692976.pep
DGKISTSYRGQTKWLDQSLALTDSNWKIVAGYNPLLVCNGEETPETTKFYVPFQHIFAKYEVNAYISMGGFCGYFHQDNSILYIGHPSLGDDQTSVDGFFLHRVRPLEMESMLINVEGKLVQRSVVQQHGRGAM

SEQ ID NO: 52653 - protein, 131 aa, Sorghum bicolor
  Clone ID: 12692992.pep
GDLKAAQRVFNRTESKGSMTCTAIIEAYAVNQRHKEALQLFTWMLSNKFVPTKATFNVVLKICDAAGLHDEALGIFNSMVQEYNLETSQENFDCIIRLLAGAGRNSEAQRFADLKSTLFNLPTPVLNSEQD

SEQ ID NO: 52654 - protein, 127 aa, Sorghum bicolor
  Clone ID: 12692997.pep
GSNATGLLRVRGNWACPLALHNLPPEVYETEWDMFMIDAPKGYFAAAPGRMAAIWTAAAMARARRGEGDTDVFLHDVDRRVERMFAEEFLCEKFRVGGTGRLWHFSIPPVSRRGNATATAGDRRPFC

SEQ ID NO: 52655 - protein, 104 aa, Sorghum bicolor
  Clone ID: 12693003.pep
CSQTRGAATTTTTTTAARPSAAWAGSAPCAAAAGRAAAPSSPSPPAAAPSGAPALPPRPRMMAPPPQPPSRRRRPCAPPPYSGTPGTAPAAPCPGRSRRRWGPR

SEQ ID NO: 52656 - protein, 127 aa, Sorghum bicolor
  Clone ID: 12693011.pep
PSSSSYAVDCTGATLDLNYPSFIAFFDPNGGAVVERTFTRTVTNVGGGPASYTAKVTGLSGLTVIVSPEKLAFGGKNEKQKYTLVIRGKMTSKSGNVLHGALTWVDDAGKYTVRSPIVATTVSSDQF

SEQ ID NO: 52657 - protein, 167 aa, Sorghum bicolor
  Clone ID: 12693015.pep
EVNKTEFMTPSAFIFLYENNLFLTFCNRTVAAWNFRGELVTSFEDHELWHPNCNTNNIYITADQDLIISYCKISKQSTDCADSEAGEVSSMGSINMSNIFTGKCVAKISPSDPTLTIAPRKRGGNSRSTIHSTVPEALEDITALFYDEDRNEIYTGNSKGLVHVWSN

SEQ ID NO: 52658 - protein, 104 aa, Sorghum bicolor
  Clone ID: 12693017.pep
NSSSSSSHHHAIQIQGSTGNTSVTKDAGAAIATAAADPITRWPLFAYLGGAMVCLLTSSACHLILCHARGRGVHAESCQQARKQISNAAVLYTCCGLEKRLVKL

SEQ ID NO: 52659 - protein, 103 aa, Sorghum bicolor
  unsure (1)..(103): unsure at all Xaa locations
  Clone ID: 12693023.pep
FPEKVYXNEETMRLCAEAALKSVLGGLDHTYFVGNAPMAHMAVEQTDSSVSPFKRFFFKSQVVGTTKYHIGKCKDFAWVTKDELLEYFPENKDFFNKMIIHIR

SEQ ID NO: 52660 - protein, 169 aa, Sorghum bicolor
  Clone ID: 12693029.pep
VSLFQSVVLMLFNDAQKLSFFDIKDSTGIEDKELRRTLQSLACGKVRVLQKIPKGRDVEDKDEFVFNEDFSAPLYRIKVNAIQMKETVEENTSTTERVFQDRQYQVDAAIVRIMKTRKVLSHTLLITELYQQLKFPVKPADIKKRIESLIDREYLERDRSNPQIYNYLA

SEQ ID NO: 52661 - protein, 36 aa, Sorghum bicolor
  Clone ID: 12693052.pep
LLGHSFFIFFIFLVNGAGCSSFVYFWLGVSFFYFIF

SEQ ID NO: 52662 - protein, 143 aa, Sorghum bicolor
  Clone ID: 12693062.pep
RRNRPGTNVLVLASVKTTEKSVDQVGHRMTAKRYTWPMLRPGPAPLQEPRKVWLWLLLLLLLLLLWGLLLLLLWLLLLDSLLLLVHQAALLPYLALALADEHVKHSDLLHRLGELLLPQCFVPGEGLNHRLCLWVLDESVVRG

SEQ ID NO: 52663 - protein, 79 aa, Sorghum bicolor
  Clone ID: 12693063.pep
AGILFFFFPCYMHVGALHPSYHAEKYAGPRPNHGSKLFETARARATTWDATVHSPGGRAGVEDRNREPAGRPSRRRSAS

SEQ ID NO: 52664 - protein, 78 aa, Sorghum bicolor
  Clone ID: 12693065.pep
LLVYFCKTEGLMVHLYLCVDPGSVSVPWHGGQQIAFVPMTGLHHSNLQSPAPRIGRPRAPPPPYLQSPCTPMIGNKFF

SEQ ID NO: 52665 - protein, 59 aa, Sorghum bicolor
  Clone ID: 12693103.pep
WKTATQMTALTLLLASRDPSLPAQGALAAPGVALLYVSAGLAIWSLVVYMRKIWRILLK

SEQ ID NO: 52666 - protein, 73 aa, Sorghum bicolor
  Clone ID: 12693105.pep
WRHHVLYHSKQEVYTQDAMELHGPEFDAMNASIDKVSVYRAGYAQQMYPVLTIQILVSTCYLVKSYSLSMLAY

SEQ ID NO: 52667 - protein, 123 aa, Sorghum bicolor
  Clone ID: 12693113.pep
NNSWSQNRSSPSILGQPSGDANKSSTWGAPSGAAGGGGSWGKSNEDNWNPSGGSAKEKPSWGGGSGAPPKKEDGGAEGSGSQGGGTGSTWDKAADGGTGSTWDKAADGAWNGNKGTDTGSGGW

SEQ ID NO: 52668 - protein, 129 aa, Sorghum bicolor
  Clone ID: 12693116.pep
MRLRPRCLCPEPYPEANLEFLRAHGIKLFQFGIDGSKEPFVNIPEDRIREALKVILDASNHPVLIHCKRGKHRTGCVVGCFRKLQRWCLTSIFDEYQRFAAAKTRVSDLRFMELFDVSSIKHLPASYPC

SEQ ID NO: 52669 - protein, 75 aa, Sorghum bicolor
  Clone ID: 12693129.pep
LPVINSASNIAIVATGEDRANAVSFSISDCQEGPDAKTIPAGMVQPTDGKLVWFLDEAAASSLEAANGAYEHQGY

SEQ ID NO: 52670 - protein, 107 aa, Sorghum bicolor
  Clone ID: 12693141.pep
WLRAQMGLVSQEPALFATSIRENILFGKEDATEEEVVAPAKAANAHNFISQLPQGYDTQASYLFTTPLLQLAYACNCIVFFLDEKCMQLFCSLRFSLPLEVTVKFSI

SEQ ID NO: 52671 - protein, 92 aa, Sorghum bicolor
  Clone ID: 12693143.pep
LLKSVDEVEDDRIKQALISHSEQAILCKSLATLRSDLPSYMVPFKTADLAYKKPQDDGVKFIKLLRALEAYAEGSSADPIIRRATYLWNKLK

SEQ ID NO: 52672 - protein, 92 aa, Sorghum bicolor
  Clone ID: 12693155.pep
CEIARGAAAPSVAPAWGREMFMARNPPRPAYPHVEYREPAGGVGVDRILTTPAADMVRVPFFFGAREIAGLRQRAPPGMRCSRVELVAACIW

SEQ ID NO: 52673 - protein, 138 aa, Sorghum bicolor
  Clone ID: 12693164.pep
HEGSLYDDLYLDAAYDCSSEPQIPPASAEPAAPPPSSVAAIRDVDGATTTTNAAASCGGVARRGVVAGSRRHPRRWLGTVGAHLASGSWTLSREQGNKLLASRFRGDRLYLCDWPGCVHAEERRKYMVFRGVFHNFAR

SEQ ID NO: 52674 - protein, 183 aa, Sorghum bicolor
  Clone ID: 12693199.pep
ARGGTVIIMCRDEIPEESDLKNLIVGKPTRLESQFRLTYTMILHLLRVEELKVEDMLKRSFAEFHAQKNLPEKEKLLLQMLRQPTRTIECIKGEPSIEEYYEVALEAEKHRESITQAIMQLPNSQQFLTPGRLVVVKSDCDDDHLLGVILKNPSPMLKKYVVLVLTGDCSSSVLAPEFNKNEK

SEQ ID NO: 52675 - protein, 123 aa, Sorghum bicolor
  Clone ID: 12693208.pep
HEETFQWNAQAQESFDNLKVAMTTTPVLSLPNFQLPFQVETDACADGIGVVLMQSGQPIAYLSKGLGEKHKNMFIYEKEFLALILAVEKWRPYLQRQEFQILTDHKSLSYLNEQNLHSDMQKK

SEQ ID NO: 52676 - protein, 92 aa, Sorghum bicolor
  Clone ID: 12693214.pep
IFFMRHRHKHSVCDTLTPCDPMTRVLLAPFGRLALQESRTVRLAPFGGCLTCWAWIHASNNHKVSHVGCCTTVSHITPFQRQSCAHGIGIPS

SEQ ID NO: 52677 - protein, 153 aa, Sorghum bicolor
  Clone ID: 12693227.pep
HEGFSNQNFIASPSNSDDKVLILMNTQNVTAPFKVFDAAVAVLLNATAAYAAANSSKRFGTGVERFQTFDSKNPTIYGLAQCTPDMSPADCRRCLSGIIQMAPKYFNGKPGGRILGLRCNYRYEQYSFFTSTPLLQLPEPTVGAPAPAPAVVN

SEQ ID NO: 52678 - protein, 108 aa, Sorghum bicolor
  Clone ID: 12693233.pep
MGGATSPSPWRRHCALHFLLLLFWGTSEANEEHAVLPPRGWNSYDSFSWTVDENAYLQNAQIMAEKLLPHGYQYAVIDFLWYRKYVEGAYTDSYGFDNIDEWGRPFPD

SEQ ID NO: 52679 - protein, 137 aa, Sorghum bicolor
  Clone ID: 12693234.pep
MEEAADRGRPPWRCTVAVQAALCLALYAAFSLGEPQLIPRGGVNALGRGARGGGGGDVAFLSVAGGARGPIEQARLLRQMETIAKVYEVKFVLDVAQLGEDDPLWQNGSMYFQALNIPWYSTKSSHGAAVGNFLKKV

SEQ ID NO: 52680 - protein, 99 aa, Sorghum bicolor
  Clone ID: 12693237.pep
ARGEAGYMEKVDELCQRYSLESYVDSLVPEKVFCVSDYLDLKKLDVEEIVWVDEINGLLSATSNIEACKIIGMDCEWRPNFEKNTKPSKVSDTLLCTGI

SEQ ID NO: 52681 - protein, 86 aa, Sorghum bicolor
  Clone ID: 12693244.pep
CRPGPCSGGPAHWPSPAGWRCPFLRHPRCRPQPTRTYPAPPPIPRKIELGRGREKGMAGGGRDPVGGQLGGLVDSCRRAGADCPRA

SEQ ID NO: 52682 - protein, 107 aa, Sorghum bicolor
  Clone ID: 12693246.pep
ARGSLLDHLSHRGVPATASAFAALLSACRSLPHARQIHAHLRVHGLDTNEFLLARLVELYLALGATDDARGVLDGMQQHAAGASATAYSWNALLHGHVRRGRGEAAG

SEQ ID NO: 52683 - protein, 119 aa, Sorghum bicolor
  Clone ID: 12693251.pep
MRAPPGRRGLVAAGACALLLAAFLLLGSLLVTTPLAPYLLPPLALSLPCLPKVTAPSGSGYGAAPGVAELAEAAVTYATSETVPQQSPEEISLSLAVLRRRAPLRLLVFGLGHDSRLWH

SEQ ID NO: 52684 - protein, 158 aa, Sorghum bicolor
  Clone ID: 12693255.pep
ARGSILVFASPIATFRRIVRNKSTGDFTWLPYVTTLLSTSLWTFYGLLKPKGLLVVTVNGAGAALEAVYVTLYLVYAPRETKAKMGKLVLAVNVGFLAVVVAVALLALHGGARLDAVGLLCAAITIGMYAAPLGSMRTVVKTRSVEYMPFSLSFFLFL

SEQ ID NO: 52685 - protein, 75 aa, Sorghum bicolor
  Clone ID: 12693258.pep
TRVLQVGNSLRTLDLTNNKLGNQNLFVPVCYIQLSMDISQAQKEFCVLLIFNVSVCFSFICWYFLLFYETDKDYS

SEQ ID NO: 52686 - protein, 167 aa, Sorghum bicolor
  Clone ID: 12693263.pep
ARGSPVALAATTLVFLDACDNLTLLSKNRDKVILCDATASLGDAVSALEVAQVHAGMFLSNDSIRVLYESFSFPGVILSPEDGPLLLQYIRSSRTPKAAIKFEVTILGTKPAPMVAAYTSRGPSGSCPTVLKPDLMAPGSLILASWAENISVASVGSTQLYSKFNII

SEQ ID NO: 52687 - protein, 167 aa, Sorghum bicolor
  Clone ID: 12693267.pep
MEHHHKPGLRVRLRITAARRRAWLSAGLRSTCRKPPRRDPSDSVHKVARREIGGGHRRPPRPAAPSSSAFSCPEKFRNFQLQEEYDTYDDEVHFLVQLPFLWTRTKIIEIVAAKDVIFALAQSGLCAAFNRTTNKRICYLNISPDEVIRSLFYNKNNESLITVSVYE

SEQ ID NO: 52688 - protein, 88 aa, Sorghum bicolor
  Clone ID: 12693268.pep
PGPSWGIPIPTGPTKASRRSQGLVPPVLRCRNSSHPASEAAGSDVNSGGGRHGFRRQQRRRVCGRVSGASAGAGAGDTGGRTGHQGPR

SEQ ID NO: 52689 - protein, 54 aa, Sorghum bicolor
  Clone ID: 12693270.pep
LGPWRCIIPAPFGVVASLGWCSSGPGSGLSCIRPQQCGCVVKLVKTRNHALEAS

SEQ ID NO: 52690 - protein, 160 aa, Sorghum bicolor
  Clone ID: 12693275.pep
TRGHSEQVAASTNKEVDAQIPNYPNLPPQLICQLHNVTMHADAETEEVYAQMTLQPLSPEEQKEPFLPIELGAGSKQPTNYFCKTLTASDTSTHGGFSVPRRAAEKVFPPLDFSQQPPVQELVARDLHDNEWKFRHIFRGQPKRHLLTTGWSVFVSAKRL

SEQ ID NO: 52691 - protein, 112 aa, Sorghum bicolor
  Clone ID: 12693276.pep
MEVQHQHQQQQGEGGAPAPAAELEVSLREFTLSDADAEAFMSWASDPRVVLFQRRDAYDHIDQARRYIADHVLPHPWYRAICAGTSAGAGAPLPVVGSISVKPAAPAEADDD

SEQ ID NO: 52692 - protein, 104 aa, Sorghum bicolor
  Clone ID: 12693281.pep
TRVHGANRLGANSLLDIVVFGRACANRVAEISKPGEKQKPLGKGVGENTIAWLDKLRNANGSLPTSKIRLNMQRVMQNNAAVFRTQETLEEGCELISKAWESFH

SEQ ID NO: 52693 - protein, 74 aa, Sorghum bicolor
  Clone ID: 12693297.pep
TRRAANESLRRGGGVRGPPPAYRQEPHPHQPQYGYGYGYGYGQTQQPSPPYGLVPYNYCHPQPLPPGPQYGYGA

SEQ ID NO: 52694 - protein, 90 aa, Sorghum bicolor
  Clone ID: 12693314.pep
ARGNGLRVGFYGKTCPVAESVISDIVNNEIAMDRGISPGLIRLFFHDCFITGCDASILLDVSPAGDVPEKESSANGFTLVSLRTIDLAKS

SEQ ID NO: 52695 - protein, 160 aa, Sorghum bicolor
  Clone ID: 12693319.pep
ARGLELIKDYDLEVHYHPGKANVVADALSRKSYVNRLQLTFIPAELRAEIEHLNIGFVNHTMGLEVEPTLEQEIRKSQLEDEKLKEIADNVVLGKAPGFRIDENGTLWFGKRICVPEVKAIRDTILREAHDSAYSIHPGSTKMYLDLKERYWWYGLKRDV

SEQ ID NO: 52696 - protein, 129 aa, Sorghum bicolor
  Clone ID: 12693325.pep
TRANTNAAVYPCPEYAEVDPTGRYGRFSDVLGKGASKIVYRAFDEYQGMEVAWNQVKLHDFLQSPEDLERLYCEIHLLKTLKHRNIMKFYTSWVDVSRRNINFITEMFTSGTLRQYRQRHRRVNIWAVK

SEQ ID NO: 52697 - protein, 55 aa, Sorghum bicolor
  Clone ID: 12693330.pep
QEANKEKAGTKLFVEVTLLNMSNQGFMHQMYCILNITCAISSNNATKKREKVYLY

SEQ ID NO: 52698 - protein, 96 aa, Sorghum bicolor
  Clone ID: 12693361.pep
GWKPSRDGTATALPVLRLPRRWEVGLGAAARLGSPCRGIAAPPSACRDVCNGAHPSVERGMEKEKRWRERTSHRRENYGALARKPAHEVSTSHRRE

SEQ ID NO: 52699 - protein, 136 aa, Sorghum bicolor
  Clone ID: 12693369.pep
TSGNPERYTPWSTMAKLSGGTNNSSSPAAADAGSPSDSDDGHESDAAGAGGSSWRQGGGCSSSRWCRASSWVTTMLFAASCLIPRRRIYKSKSDSTRGGSSFSIWWWSCSKLLNWIAARSSRSERDFLIGCSSASC

SEQ ID NO: 52700 - protein, 140 aa, Sorghum bicolor
  Clone ID: 12693370.pep
HEGILAAAGRDVTAHVWDIRSSKQMFKLQGHTKWIRSMRMTGDTIITGSDDWTARVWSLNRGTCDAVLACHAGPILCVEYSPSDKGIITGSADGLIRFWENEGEFLVIVNLISVTALIFLFLVFWGKLGCGFLHTLRWVV

SEQ ID NO: 52701 - protein, 96 aa, Sorghum bicolor
  Clone ID: 12693372.pep
WGTLALSECICLLKTSIVGTLRKRYCFSSSYFYFTAQLALKQKKGTYPERSVFLLTHFKSQIICGDILRLKENEDNKAFPVRGGLYTLLLITKEAC

SEQ ID NO: 52702 - protein, 41 aa, Sorghum bicolor
  Clone ID: 12693375.pep
MATYDKAMESYKKAVTTVASLAASAMLVRGVVNELVPYEVR

SEQ ID NO: 52703 - protein, 82 aa, Sorghum bicolor
  unsure (1)..(82): unsure at all Xaa locations
  Clone ID: 12693378.pep
MAGRLMLAALPILLFLLLVGQCHGGKIGVCYGRNADNLPGPDKVAQLIQQQSXKYVRIYDTNIDVIKAFANTGVELMVGVPN

SEQ ID NO: 52704 - protein, 52 aa, Sorghum bicolor
  Clone ID: 12693387.pep
SRRRAPEYAWFCRSVPLWRHAASPNSKPTGDARERPGLHLAPPPPATMSLAS

SEQ ID NO: 52705 - protein, 85 aa, Sorghum bicolor
  Clone ID: 12693393.pep
LVAVGSLATRAVSQSQFSYRSIYSIIYCPSRFTKTRPQQGQGKVVTSETRRGECARRGGRQRRRRRPRSPADDDMGKDGPTQAAA

SEQ ID NO: 52706 - protein, 171 aa, Sorghum bicolor
  Clone ID: 12693404.pep
HEAKTRPKSPSPFLAGSKLRKIRSKSHIITQSEILKLISPETWETPSHGASPMNKGTAEVSIHENKSPLCSSMGSNQPVLSQCPSSLSAGLLQCIWKNGLPHFELSLDDPIAVYAANPIRVQEKDKALDYVYMIHSGEQGRKDWMGHSSNVSRLVGKMKVSSSLVLNSDKS

SEQ ID NO: 52707 - protein, 126 aa, Sorghum bicolor
  Clone ID: 12774861.pep
LVQEFTASAEKIRAVAHTVISSAERTSLLAMRTSFSEIMQKRHRQPFRITPWATFGCSMVACAGLVMHGDGIECAAEAAPSVPMIASLGRGLESLRLTSQEVRQTKGQNVKEALRALMNSLKKSAK

SEQ ID NO: 52708 - protein, 103 aa, Sorghum bicolor
  Clone ID: 12774884.pep
TDVKKGAETVFPNAEGSHLQYKDETWSECSRSGLAVKPKKGDALLFFGLHLNATTDTSSLHGSCPVIEGEKWSATKWIHVRSFDNPPNVRMDAPCSDDNELCR

SEQ ID NO: 52709 - protein, 95 aa, Sorghum bicolor
  Clone ID: 12774900.pep
SEALNSSRGVDRQQIRPRLHGCLVEHPVAVFAKVPAVAGSNLGSGLHELFLQLEHLIGKLRGIHATAKEPAILADLLEKHRGLWGHAQVVLAELG

SEQ ID NO: 52710 - protein, 62 aa, Sorghum bicolor
  Clone ID: 12775001.pep
FPFRLSSNAWAQVMLWRRVLAGTVCLLGGYAADELIVSATFVRWQYGMLAVGTLFMLPECIL

SEQ ID NO: 52711 - protein, 94 aa, Sorghum bicolor
  Clone ID: 12775012.pep
TDIHLSTIRTKAFRVRSSTHPVCFALTSHKLTYLLICLLDIKLNVPISSGKQGSILECPGVLPPDLGLLLRRVVVLDVQGNADLIRRLAPNLVR

SEQ ID NO: 52712 - protein, 52 aa, Sorghum bicolor
  Clone ID: 12775013.pep
PRYKVDIRVAPGSHATEAAVNKQLNDKERVAAALENPNLLDMVEECLSPTFD

SEQ ID NO: 52713 - protein, 134 aa, Sorghum bicolor
  Clone ID: 12775018.pep
PLAGMIIGNAMTVTGVTMKKLREDIKIQRDLVETALALGATPRQATRQQVKRSLVIALSPDIDSAKTVGLITLPGTMTGLIMGGASPLEAIQLQIVVTYMLLSASTVSSILSTYLCWPAFFTKAFQLDDKVFAD

SEQ ID NO: 52714 - protein, 126 aa, Sorghum bicolor
  Clone ID: 12775031.pep
LQDHVEGLQVMHDGRWLTVDPVPGSFVVNVGDHLEIYSNGRYKSVLHRVRVNSTRPRISVASFHSLPAERVIGPAPELVDEQAGNPRRYMDTDFATFLAYLASADGKNKTFLQSRKLPVPAAAACV

SEQ ID NO: 52715 - protein, 128 aa, Sorghum bicolor
  Clone ID: 12775111.pep
MRGFERKGVRQYNRSEVPRMRWTEELHRQFVEAVECLGGQDEATPKRILQLMGVKGVSISHIKSHLQMYRSSSSSSSSSTHQSSLQKLTSSTAASNSKRVFLSREDHCAYASQDGNTPAPSDKNIYTT

SEQ ID NO: 52716 - protein, 122 aa, Sorghum bicolor
  Clone ID: 12775121.pep
MEEYGGGDLLSEAMGSAARVVVVEDCVEAPGAFVLHLLLKRALASGGAAAFLALAQPFSHYDRVLRKMGCNLSLHRRNERLHFFELLGFPGGAREGTIADRFVQLYNEIQRLVEANRTGENA

SEQ ID NO: 52717 - protein, 173 aa, Sorghum bicolor
  Clone ID: 12775126.pep
TRDEFSPVSNPATTPVSNPVTVPATNPVANPMAPGFVTVPSTNPGNGFATNPNMPPLYPEPTTPATMPMPDPTTPTMPPVTVPSPFTNPVSAPTTMPGTVTNPAAPAVTNPATTPSQFPGTSPVTNPVTTYPQQGGVGVGGGMPATQPVYQPPATTMPGTGTVQPGAPTMAGQ

SEQ ID NO: 52718 - protein, 125 aa, Sorghum bicolor
  Clone ID: 12775153.pep
QQVRRPPSPGLCLPSVLHALELELGCLSGVRSWTAALLPARRNPGRTSLHAAVENRREMAAEALGFMARGANGGRAAELVTRDFLGGCAGSDDARDAASARNDAVPGWVSQQKHACPATPRDLNL

SEQ ID NO: 52719 - protein, 78 aa, Sorghum bicolor
  Clone ID: 12775161.pep
MRTLLLRVRRRGMPHAGAERGRDPPPPPRGPLLALAVVCPDDDDDAGRRRRGRGGHHVWALHYDACRCGGAGAAAPAD

SEQ ID NO: 52720 - protein, 176 aa, Sorghum bicolor
  Clone ID: 12775176.pep
QNLKVGLLNFNSTEYGSWTQLLSDSHVSIIRLEHAKDSITWQTLYPEWIDEEEETEIPSCPSLPEPDVRRDVRFDVIAVKLPCTHVAGWSRDVARLHLQLSAAKLAVTSSKRNHKVHVLFVTECFPIPNLFPCKNLVRHEGNAWLYSPDSKALREKLKLPVGSCELAVPLKAKSRL

SEQ ID NO: 52721 - protein, 169 aa, Sorghum bicolor
  Clone ID: 12775200.pep
ARGWRDEGKDSEPLNFMSLEELRKKVCLVANALDALELPKGSAIAIDMPMDVNAVVIYLAIVLAGYVVVSIADSFAAPAISMRLKISEAKAIFTQDYILRDDKELPLYSRVVEVNAPMAIVIPVRGSLPIKGLRVDDLSWQDFLGRVNNTEAENYIAVKQPGDAFTNIL

SEQ ID NO: 52722 - protein, 140 aa, Sorghum bicolor
  Clone ID: 12775241.pep
MGTSVQVTPLSGAYGEGPLCYLLAVDGFRFLLDCGWTDLCDTSQLQPLAKVAPTVDAVLLSHPDMMHLGALPYAMKHLGLSAPVYATEPVFRLGLLTMYDHFLSRWQVSDFDLFTLDDVDAAFQNVVRLKYSQNYLLNDK

SEQ ID NO: 52723 - protein, 156 aa, Sorghum bicolor
  Clone ID: 12775262.pep
HEAEFPRHFPSSLPPETRTRKASPRHDSRHASDARRRRRLPPAMPTSPLKRTSGGSGGRLRRLLASLRPPARAGPLPVQTGFPTSLADIVVKNHGRLRNSRRRHRAPGAAVPPAAELQQRSNLSVSHHDAAAPAPVPVTTRPGKGAGFSIRPGLLV

SEQ ID NO: 52724 - protein, 157 aa, Sorghum bicolor
  Clone ID: 12775274.pep
TRQEIMLLRELSHPNIVQYYGSDLCNETLSVYLEYVSGGSIHKLLQEYGPFGEAVLRNYTAQILSGLAYLHGRNTVHRDIKGANILVDPNGDIKLADFGMAKHISAYTSIKSFKGSPYWMAPEVIMNSNGYSLSVDIWSLGCTILEMATAKPPWSQY

SEQ ID NO: 52725 - protein, 121 aa, Sorghum bicolor
  Clone ID: 12775304.pep
SSFPFGVSSSPRKPLCLSACSRPAFAISMADGCSVLSVTKCQGQACNIYHELLLRAMSCQKKKNIVVWIGCLRTVKFQSAKQSMYRLPCRLQRRKARRGACKRTRGRRWRELNENDEQELC

SEQ ID NO: 52726 - protein, 107 aa, Sorghum bicolor
  unsure (1)..(107): unsure at all Xaa locations
  Clone ID: 12775321.pep
MPVCRTAGGKEVLIKPIAQAIPTYSMSCFKFPERSMKTYRXVLHDFWWGSMEGKWRTLXWVAWDDMSKPKCMGGLGFRNIELFNPALRARQVWRLLQDPEMLIWVTS

SEQ ID NO: 52727 - protein, 145 aa, Sorghum bicolor
  Clone ID: 12775323.pep
HEVLGYSPDTLFSIHADQEDGTPHCGGSLPPPFPSPCTVRTALTRHADLLNSPKKSALLALAAHASDSKEAERLTHLASPAGKKEYSQWIVTSQRSLLEVMSEFPSAKPPLGVFFAAICPRLQPRYYSISSSPRIAPTRIHVTCA

SEQ ID NO: 52728 - protein, 125 aa, Sorghum bicolor
  Clone ID: 12775324.pep
MDNLRLFSYGEIRAATNNFNQSNKLGRGGFGTVYKGVLRDGTEFAAKVLSSESEQGIKEFLAEIESISQVKHANLVRLLGYCVQRKNRILVYEYLANNSLDHALKGSGDGAAAVNLPWSRRSDIC

SEQ ID NO: 52729 - protein, 129 aa, Sorghum bicolor
  Clone ID: 12775351.pep
MMEVSPSPEQGVMAGREPFGLPKTPATPPSSGVTQSLRMAYTTDGTAIFTPVSSAPPATATYHQPVAASSLAGVGGNGGAPVHSGGAGEPVAKKKRGRPRKYGPDGSMSLALVPVPASIAAAPAPAPAA

SEQ ID NO: 52730 - protein, 67 aa, Sorghum bicolor
  Clone ID: 12775375.pep
MKREMVPSWLEILLATQFFTTCANHLLACRNECNLFCTQCEATPAAFCNYCRSINHSTHRVIQVRNV

SEQ ID NO: 52731 - protein, 178 aa, Sorghum bicolor
  Clone ID: 12775391.pep
TRINGHYKNASFMCADVTSEDLVLPASSIDLIFSNWLLMYLSDEEVEQLVQRMVKWLKIGGYIFFRESCFHQSGDSKRKVNPTHYREPSFYTKVFKECHTFDQDGNSFELSLVTCKCIGAYVKNKKNQNQICWLWQKVQSTEDKGFQRFLDNVQYKTSGILRYERIFGEGYVSTGGIE

SEQ ID NO: 52732 - protein, 174 aa, Sorghum bicolor
  unsure (1)..(174): unsure at all Xaa locations
  Clone ID: 12775392.pep
TRHQDPEDISPPRRRKHQDPEDISPPRRRTHQDPDGDLSPPRRNNLGQSHKSATDELSPRKKRDTSPSRNSKKERASKHVMKAGLMTAEEVKEDIRKIKETEMAKFASQDPSLVGKGAKAVFRDXGRRISEEEMRKAKEPEKPKEIHIEWGKGLVQKREAEARLKEIEAEKKKP

SEQ ID NO: 52733 - protein, 166 aa, Sorghum bicolor
  Clone ID: 12775430.pep
ARGRLIGPLSVPEETKQFVLALREPGGSTQDPHRDGAGVIYILAAQNLSEQSASDAERLIREVRPRAVVTQVARTALEDVRIEEDCLAGSGSGGVPVPASPFQVIKRCVTEKRSKDQYVKAAACQVLQEIFGVGFYGHLLAAKRAAEETGSCFLLLESPYERNCGG

SEQ ID NO: 52734 - protein, 135 aa, Sorghum bicolor
  Clone ID: 12775454.pep
GFYDPARVTQLSWRPRAFLYSGFLSDTECDHLINLAKGSMEKSMVADNDSGKSLMSQVRTSSGAFLAKHEDEIVSAIEKRVAAWTFLPEENAESMQVLRYEIGQKYDAHFDYFHDKNNVKHGGQRFAPVLMYLTD

SEQ ID NO: 52735 - protein, 146 aa, Sorghum bicolor
  Clone ID: 12775458.pep
HEARFTTPVLTTTAILHYSNSNGAATVPPPAAPTVEIDFSLNQARSIRWNLTASGPRPNPQGSYHYGLVNTTRTIILANSRATINGKLRYAVNSISFIPADTPLKVADFYKIPGVFTLGSMPDNPTGGGAYLQTSVMAANMRDYVE

SEQ ID NO: 52736 - protein, 120 aa, Sorghum bicolor
  Clone ID: 12775466.pep
RRRFLLQRAQLPLWVVAGVEAHLDGATVPPAPPQVAPPARERPCADGLLEDEVRQDAPPQVVRQRRDAIHRDRIRTHHLASVPLLINPLLLCSTVVADAGAVVGIADRHFSLVPQSGPRA

SEQ ID NO: 52737 - protein, 156 aa, Sorghum bicolor
  Clone ID: 12775470.pep
TRHPSPPWHQPSPSPFPHAATARPPPSASPPLNPILRLPTPSSSCPRRPTPPAPSSSFVTHPPAEAATRPGAGRGARCRTGVRPRWRPPPCPSVRQPSSPQLHPPTEADMQPRRRRRRTSARRRALSSPSAHQAASSQPLPTAAAAAATTMTRLPA

SEQ ID NO: 52738 - protein, 124 aa, Sorghum bicolor
  Clone ID: 12775536.pep
HEAKPKRPKSLRIYETHVGMSSPEPKINTYANFRDEVLPRIKKLGYNAVQIMAIQEHSYYGSFGYHVTNFFAPSSRFGTPEDLKSMIDRAHELGLLVLMDVVHSHASSNTLDGLNGFDGTDTHY

SEQ ID NO: 52739 - protein, 139 aa, Sorghum bicolor
  Clone ID: 12775549.pep
TRTTSATCSISVTRKTLHRPGAAPPSRSPPPWPPRGKSRRRRRHRRRPPLFPPALALTVAEAAPLSFLLTDYVVRPTTGGLPSSLRSRSVRLIAWPRPQILESPCSCSSWVAPVPLCSSIYKFLLGSSWTWDGAAVSVC

SEQ ID NO: 52740 - protein, 123 aa, Sorghum bicolor
  Clone ID: 12775578.pep
TRPRNFPFVLAADPSGLLLLSAILDAPLTRVHVDRPGEQSVRLSYSDPRYFVLDAATGSALRLPDPDPKLPIQHQALVGVLACPSGAGRYVVAELLPFMGTDKGDLRCFDSDVGEWVNKRVRY

SEQ ID NO: 52741 - protein, 128 aa, Sorghum bicolor
  Clone ID: 12775596.pep
MERHAGMAFLDLVAKQVDPGAPGFWRDFLLGMLKPVAATAVVAMAVALSFSQRLGLEGEMLYATARAFLQLSVIGFVLQFIFTQKNALWILLAYLFMVTVAGYTAGQRAKQVPRGKYIAFVSILVGTA

SEQ ID NO: 52742 - protein, 98 aa, Sorghum bicolor
  Clone ID: 12775610.pep
DRRRGGNKDGGGAGAVGRGQDVPVGQPGNAAVGEVPDAFHQAGAVVVGGLLLMVMAVVVLSHRGCCCSCSCLLQLGVGQVDDRHWRRRNQARITSLFS

SEQ ID NO: 52743 - protein, 122 aa, Sorghum bicolor
  unsure (1)..(122): unsure at all Xaa locations
  Clone ID: 12775615.pep
EYTKWKIVYFRAKAPMEXITKMLLTLMIILPHTSRTSLCSQGDAVFDGGITGQSALESTKTFWPLDTQVRKVCAACHCCPGNSSKSCYMAPSCCIELRCNGPHEPEGNCLIIKHSCTCTNCS

SEQ ID NO: 52744 - protein, 148 aa, Sorghum bicolor
  unsure (1)..(148): unsure at all Xaa locations
  Clone ID: 12775627.pep
MARSPAASSSSSYTDSTGSSSDSGSTSSGSDRRRRHHHRHRSSSSRRKEGAASSSSSALKARKDRRSRHKRRRREREHFAXRSPSDDDSYSSTSSYDSDREVSGRSRKHKKSSRSRKSRERERSKDRHHKRDKSKHKEKKESEHADGP

SEQ ID NO: 52745 - protein, 80 aa, Sorghum bicolor
  Clone ID: 12775672.pep
MATDVPMTPELEQIDGEIHDIFRALQNGFQKMDKIKDSNRQAKQLEDLTVKMKECKRLIKEFDRILKDEESNNPPEINKQ

SEQ ID NO: 52746 - protein, 197 aa, Sorghum bicolor
  unsure (1)..(197): unsure at all Xaa locations
  Clone ID: 12775687.pep
RRYRHEVSSLMRQLSENKLXLEKNKDHVKVDAAVHSLQGELEDEKRLRRHSEDLHRKLGMELSEIKSAFLKSVKDLEKEKKGNRLLEDLCDQFAMGIRNYEEELRVVKQRNVKSYELNFDNSVLHISEVWLDERMQMQNTDVNGELAHKTTITERLSSEIQAFLLSRKAGSSMNNEKHMNDSTRLRRQSLESVHLNG

SEQ ID NO: 52747 - protein, 127 aa, Sorghum bicolor
  Clone ID: 12775710.pep
TMVCRTNRVPAARHLLELEEGEGRPGVSTVDVGGAQGHGALNLGELGQDNLLAKSVLLELRQQRVPDHQHRRRRVFCRSVMPRRLGEAAVSAAFVGGRCASACEQLHRCVDGIVVRAMEVEHSRARL

SEQ ID NO: 52748 - protein, 135 aa, Sorghum bicolor
  Clone ID: 12775736.pep
ELTCQVGSERSENVSDLKEYSEMDILDTEGAISFQNDNQSSEVDWSGGNVPLDSISSTTTQTNEEEGSSESVHLEEWEDCSNQCVLQLVSMEKAIKSASDKMEDKKVESEELDLWQYENTAEAAKTICSGVKFLW

SEQ ID NO: 52749 - protein, 73 aa, Sorghum bicolor
  Clone ID: 12775745.pep
LNQCVTRATVSDYCSETDTEGGCASHNMLDAENDYGQAANNYSEEPDDDVTLASLVHTSGSSSKIKAPKIWSS

SEQ ID NO: 52750 - protein, 119 aa, Sorghum bicolor
  Clone ID: 12775746.pep
MGSNAAGKPPAAAAAAVSWEFHATGPRNLSTPGWRDLIRSSWRDPNYRRIAMSCFVQAAYLLELDRQESRTGEAALAPNWWKPFKYKVVRPLIDSRDGSIYGALLEWDQLSALTDLIVV

SEQ ID NO: 52751 - protein, 100 aa, Sorghum bicolor
  Clone ID: 12775747.pep
MPDSRDGRRAALADLSSGVGGGGFFIRRVASPRALAVRGAGKPLARRYMSPSRNKENLLPIWALRATPAKRSPLPGWYPRTPLRDITAIAKAIQRSRARI

SEQ ID NO: 52752 - protein, 86 aa, Sorghum bicolor
  Clone ID: 12775763.pep
CLLLDKACAYTTFATTVAAAQACVIALDGAHALQWTKLCNIYTRFCEQIAGSLVLGMLAAVGTAVLSAASARNVFRHYSPGTYAAH

SEQ ID NO: 52753 - protein, 111 aa, Sorghum bicolor
  unsure (1)..(111): unsure at all Xaa locations
  Clone ID: 12775767.pep
AYIARQAAKSIVASGLARRCIXQVSYAIGVPEPLSVFVDTYGTGKIPDKEILKIVLENFDLRPGMIIIDLDLKRGGNGRYLKTAAYGHFGRDDPDFTWELVKPLKWENPSA

SEQ ID NO: 52754 - protein, 122 aa, Sorghum bicolor
  Clone ID: 12775786.pep
VRIQASNRRVLRWAHAYGYFLDPERDAAKRALFDDLQNQANRWLECLHAAAELERTDLFGDGKGKKAADAPAVVVDAEAFRAYRQKVANLTGVTRKFLGNLVRAFETDLPEVAAAVNPNPAK

SEQ ID NO: 52755 - protein, 173 aa, Sorghum bicolor
  Clone ID: 12775795.pep
QVITAVKEACREAVLQSKPRLVKPMYFCELTTPTEQLGAAFAVLGDCRAKVLKEEMQEGTSLFTVQAHLPVAESSDFPEKLRKRTSGAASAILAFSHWEVIPQDPFFTPKTPEEIERFGDGSSIGPNLAKKLMNSVRRRKGLHVEEKVVEHGTKQRTLGKKVYFIHENRKLVP

SEQ ID NO: 52756 - protein, 111 aa, Sorghum bicolor
  Clone ID: 12775798.pep
NIDDLYKYSDAKDKLEFMERTLRWRHLAPTAPNSLGCYPYTDKDPFLVESCPHVYFVGNQDKYETRLLEGPEKQKVRLISIPRFSESGVAVMLNLRNLECSTLSFSTSFDA

SEQ ID NO: 52757 - protein, 40 aa, Sorghum bicolor
  Clone ID: 12775833.pep
HFAHQANHIWRAQRHFCHKIMHYNLQHEVRKILLKFLIDG

SEQ ID NO: 52758 - protein, 100 aa, Sorghum bicolor
  Clone ID: 12775847.pep
YRRSPRGFTFFARDLSQYPNHHMSISSLSNSKTCLLKQLKPSTRFVLDLIPVYLTPYIALYATYTPHYIIYFNLLSLPLKHQFVPLIASSESDELNPASS

SEQ ID NO: 52759 - protein, 74 aa, Sorghum bicolor
  Clone ID: 12775858.pep
HECGSRWRDLNSGLRELSALRNCVPASFSFSYWIPSASRRPYTTHLLQWWALLLMQQRSRGGKKMRAGASDPLL

SEQ ID NO: 52760 - protein, 99 aa, Sorghum bicolor
  Clone ID: 12775919.pep
HFVSHGRRSIPNANVPSEIRNPEQMQKSRQQKAMEITRLKNKSAKDGKFQNKFQKNRRPDGNGNGKGRGSGKGAGKGFSKGAGGKGGKGKGKVKGKGGR

SEQ ID NO: 52761 - protein, 93 aa, Sorghum bicolor
  Clone ID: 12775950.pep
AAPAHDAPRRSKKPAPVPARPAGARKPAPSAAVAAADADTAAAHRIAHLARGGLGVPVPPGGTPRRTFLPYREELVGFFANVNGISRSHHHPF

SEQ ID NO: 52762 - protein, 163 aa, Sorghum bicolor
  Clone ID: 12775964.pep
LILINQPDLDGYQCLLGDITLPPQIMYMHLDILNDGHAFGATLFKVLRMCSGLRRLSFEFYTNSDLEAQVTCPPGCICDEQEKWKTEEFLLNRLQIVEIIGLRGSQYEVSFVKQVFHWAKAVKWMKFTFNSSVSENMAKELCQVFQSFSRPEICMEFYNTSPN

SEQ ID NO: 52763 - protein, 106 aa, Sorghum bicolor
  Clone ID: 12775978.pep
VSGDGDALATAPAPAPVLSSGRRLVLTGPVRSPSPNGREKVFRVEKHGRGGYKLVWCGGAASGSTSSSCQDLGVFRDDGDRRAWLGTTETDRAHAVKFEKAATVHA

SEQ ID NO: 52764 - protein, 106 aa, Sorghum bicolor
  Clone ID: 12776048.pep
TILYAGIVVLGIAWYIMTWCINKGGPHFVSVFQPLQTVMVAIMASIFLGDKLYIGGVIGAVVIVAGLYCVLWAKSKETKSDSDLLSERSLEQNLLHEENYIMREDL

SEQ ID NO: 52765 - protein, 109 aa, Sorghum bicolor
  Clone ID: 12776058.pep
KLLMRPAKVVRDGEMSAPCGAMVLHPEGGGNIHALRAITPCAILDILTPPYSSEDGRHCSYFRRCPRSDPSGVLLNRRKGSEFVWLEEYQPHDNFIIRRDLYTGPALKL

SEQ ID NO: 52766 - protein, 77 aa, Sorghum bicolor
  Clone ID: 12776063.pep
IVAKRMWLCQFPPPFSALARVLYYVQGAFSFYFVLKYHEKTSAAVKCPLIMSLHQAQNLMAAGCYLPLILSYAKHTL

SEQ ID NO: 52767 - protein, 58 aa, Sorghum bicolor
  Clone ID: 12776078.pep
AAAAGGTPPPPPPPSPAPRGPGPPPAARPPPPAPRTRPAARPPPSPPTPSPPPSLCCY

SEQ ID NO: 52768 - protein, 200 aa, Sorghum bicolor
  Clone ID: 12776121.pep
GSLLDHLGYQGGGIPQHESPTLDHGLLVDPADAIPYLSTDSPPFMNDQITCNVMKSASASPESSMKQPQEPLNIESDVQNDAAEQNVHNCNSEEQITSLGCDEHQNTEVIGAVLPPKLLESSGNDISNFQPETTYSDAYHGDSLLTENSSKGYQLNNSGAPADDIPNSPALQMENEEMEKLHETSHNENSGSEDDQMNGR

SEQ ID NO: 52769 - protein, 146 aa, Sorghum bicolor
  Clone ID: 12776153.pep
MGDHEGRGDDFEKKADQKLSGWGLFGNKYEEAADLLDRAGNFFKLAKNWSRAASVYKKIADCHLQGDSKHEAASAYVEAANCYKKFSPQDAAQALNNAVNLFLEIGRLNMAARYSKDIGDIYQQEQDLENAAVYLNRAADLFDSEG

SEQ ID NO: 52770 - protein, 105 aa, Sorghum bicolor
  unsure (1)..(105): unsure at all Xaa locations
  Clone ID: 12776166.pep
ARGTPVGRRSMLKLAQRMTDNFCAGVCASAAQKWRRLDEWRGVGEGGGGSSAGNGGGGAAGEGEEKVRMMARQSVGAPGEPPGVVLSATTSVRLPVTSPXRVFDY

SEQ ID NO: 52771 - protein, 175 aa, Sorghum bicolor
  Clone ID: 12776238.pep
ELSALAFSERLKSFRPKQTILEAEGEAAKARNSKGSNQWLDVMKKKREVHEGIINLVHQKSSEDPRPEVEEVDDISNWEKKEVCGKKRKLQSFRDEDYYISTVPQNQHLEAGLSVRDNEGFVENRFDAAVLDLVDDEASGMQAQKTRYHWMKNKFVKLNAGDRVTATGKIKTEGG

SEQ ID NO: 52772 - protein, 146 aa, Sorghum bicolor
  Clone ID: 12776270.pep
PAGTAAPADELFADGRIRTFYPVFGRGASSHGGCTTRPAAPAAAPPRVRGQLGKLFLEETRERNSSTSSTSSSSSSSGAATDDDGLEGVAPESYCVWRPGSSASPSPPTPPRKSGSTGSMARWLRISDLAVGRSHSDGREKFLFLA

SEQ ID NO: 52773 - protein, 197 aa, Sorghum bicolor
  Clone ID: 12776285.pep
PEVRFNPAPDGNRIRDALDARDDATSSLRRISVTAKDAASDSVAAWLPSAARHLVGDLIYRVVGPKSSVNEEDEEDEDEEDEEEVVKEAGERGVVELPCFEKASKMQLKLRYQRLAFPLQGVFNKLTSLLLSRVRFHGPGDLGNAVSEPHSPCLQKLCVLESRGLHNLSIHSKSLLKIKLFNLGRSLRQLTIVAPNL

SEQ ID NO: 52774 - protein, 103 aa, Sorghum bicolor
  Clone ID: 12776298.pep
MGIPRAARLLVLVSVLAAISLSCGAAAAALPPVYDTDGHELSADADYYVLPVPHGSGSGGGLTMAPNGLRCPLFVAQEADPLRKGFPVRFTPLPQQGDRTVRV

SEQ ID NO: 52775 - protein, 126 aa, Sorghum bicolor
  Clone ID: 12776306.pep
MSMILRLQKEKSALEIEARQQRRTADERCAFYEDEVEELRDIVLVREREARALRKEVDAYRRLLGLGPAEDDEEEDDEQEMVTPHSFLMSEGEPSSSRSVDANRMQHFRNNSSGFSFKTPSLREQL

SEQ ID NO: 52776 - protein, 151 aa, Sorghum bicolor
  Clone ID: 12776313.pep
RPRSSRAAAVTASNSSSSSDAVASGRRLATGGSPAIAAVPASALTPPTRARVGGLSRPLTSLVVISERIGAAPRRGPGQARSLARRWLGGLFALLGSRRHRWVCSPRNRGLCLEEEEEEEEEDERGEMLGLDASPRCFSLAKAREEQGRER

SEQ ID NO: 52777 - protein, 138 aa, Sorghum bicolor
  Clone ID: 12776371.pep
MAMEEGAMAKVKLVAAVLVLEMLIAGFHVVSRAALDMGVSKMAFLVYRNGSALLVIAPVAYFLEKKDRPPLTLRLMIDFFMLAAVGVTFTQGLYILGLYYLSPTYVSVIQNSVPAITFVMAAVLRIEQVNIKSRHGLA

SEQ ID NO: 52778 - protein, 90 aa, Sorghum bicolor
  Clone ID: 12776383.pep
MPSTTMDANAIQKLYEVCKVSLSEKGPLSSESVDNVRAVLDMITPADVGLECEAEAVRVWRSPRALSRKRVFHSSPAIRYRHIYECKSFS

SEQ ID NO: 52779 - protein, 41 aa, Sorghum bicolor
  Clone ID: 13064782.pep
CSWKKKSVAKITKNCCNFSLFHFTAPWNPPKKNICGNPHQA

SEQ ID NO: 52780 - protein, 67 aa, Sorghum bicolor
  Clone ID: 13064788.pep
VVCLISCRQSSSGALGLYQTDDRANAHCPVKNHVIHFGINHLGFMDHGGIHYTCSTDTGILGGSVWL

SEQ ID NO: 52781 - protein, 113 aa, Sorghum bicolor
  Clone ID: 13064828.pep
VKIKILLLQTILQNRTSTKLASALRCFIDDVLCIIGYWIFLLGSAVIRDELLVAAFRCLVVSVSGGQVLYCELVISLLKCTGRANSAHARRVEENNKFCLGSWNLSLGLAPTR

SEQ ID NO: 52782 - protein, 110 aa, Sorghum bicolor
  Clone ID: 13064876.pep
PALCFKTLFFPCGTFSRIASVAKDRPMSSGEACNDIMAYSLILSCCCYTCCVRRKLRQKLDIAGGCCDDFLSHLLCCCCALVQEWREVEIRGAYTEKTKVTPPPCQYMEH

SEQ ID NO: 52783 - protein, 163 aa, Sorghum bicolor
  Clone ID: 13064908.pep
RSFDNFQFVNFTAIMSKMISHSKKETEFALSALMEIPLQYKATLELGILGRRIGESPERISLPPPFASYSTVSRAESSWANSYRSVPSHPREEPTVDSTNTASVTSPSAAESRVLEPQMCPVCLSKPRDMAFGCGHQTCSECGPQVADCPICRRPIDTRVKLY

SEQ ID NO: 52784 - protein, 96 aa, Sorghum bicolor
  Clone ID: 13064918.pep
ENSFLRVKVINFGSDAVTLTISTTGLQASINALGSTATVLTSANVMDENSFSNPTKVVPVKSDMSNAAEQMQVTLAPHSFSSFDLALAQSKLVAEM

SEQ ID NO: 52785 - protein, 41 aa, Sorghum bicolor
  Clone ID: 13064924.pep
ESHIMTLAKAILERSLPTAIPTTRSNLGALGDHYATHDAYV

SEQ ID NO: 52786 - protein, 43 aa, Sorghum bicolor
  Clone ID: 13064950.pep
MALDYPEFVAKLRPRCSSYPCSGSLATKVSHFRRCRTLWYYTV

SEQ ID NO: 52787 - protein, 97 aa, Sorghum bicolor
  Clone ID: 13064970.pep
LSQMTLHSSHSCPDIVHTGSFNIVHTADLSKRHLCIVHTASFNRRVVAGSGGKSCFSWEASAGIEAAAKDALSFLGIVGLPNQHVVPEESPSHAANI

SEQ ID NO: 52788 - protein, 97 aa, Sorghum bicolor
  Clone ID: 13064984.pep
LRDCLAGLLSGSGSSSSKRTLPNVFLEKPFFFIKNRGASREEFCQTPPKACSLVCIPSKMMHSKCIQTKLCFSRRPLFLYSSFTFTLAPAHVPPHQP

SEQ ID NO: 52789 - protein, 66 aa, Sorghum bicolor
  Clone ID: 13064998.pep
GRRITGCVFGDVKGKSQLPAIVDKYVNGDLNINFDGFITHNMPFSDISKAIQLLEEGKSLRCVLHL

SEQ ID NO: 52790 - protein, 39 aa, Sorghum bicolor
  Clone ID: 13065026.pep
TLYSANMYRHREAVYCSLQLSIKYDGTSLHIHRKFLSRS

SEQ ID NO: 52791 - protein, 153 aa, Sorghum bicolor
  Clone ID: 13065028.pep
PAWGSMVTSTVPGASQYAAYRFGVAIRLLKNVCLWKDILAEHVVEKLALDELLRGKILPHMKSIILDVHDAITRAERIAASLSEVWPKQSQKLQPFVDLVVELGNKLERRHTSGISEEETRGLARRLKNVLVSLNEYDKARAILKTFQLREAL

SEQ ID NO: 52792 - protein, 97 aa, Sorghum bicolor
  Clone ID: 13065058.pep
CPHIDTEHVYSCYSAMVQDDDKSPTRSTSTGVASSGVSVAAHAGSGSGSPSPGASVSVGANNAAGTATPDNHSNKRRREGVAKNARIQMGARFDSSD

SEQ ID NO: 52793 - protein, 111 aa, Sorghum bicolor
  Clone ID: 13065108.pep
QNATLAFEAAIWRWMTPMKRKQPSAHDVFVGNWKPTKKDTLSKRYRGFGAAMNILYGDAICGKGSTDKMRFIISHYQHYLGLMGVGRERSEDNLDSSVQVAFNPSSESCDF

SEQ ID NO: 52794 - protein, 111 aa, Sorghum bicolor
  Clone ID: 13065156.pep
CLGALMIEIISGRVPDPDDHKPICSWASEYLKDKNYSKLVDASLKEHKDSELEAVCEVIQECIDADPMQRPSMRDVVGKLQPPLGISPEAAAPRLTPLWWAELELLSVKST

SEQ ID NO: 52795 - protein, 118 aa, Sorghum bicolor
  Clone ID: 13065174.pep
GFSALPTHCLQLCAGFFAFAVLANLARDLLPRGVARFVPLPMAMAVPFLVGASFAIDMCVGSLVVFAWHKIDSKKAALLVPAVASGLICGDGIWTFPSSLLALAKIKPPICMKFTPGS

SEQ ID NO: 52796 - protein, 88 aa, Sorghum bicolor
  Clone ID: 13065220.pep
ARVPHHRLRGPGRGRGVVGVGEAGDGLALGGLVRWRERDDDHPVELRLLRPRRGRRRRRHLRRDRGRRSPGRRGGGSDEAAGASHASC

SEQ ID NO: 52797 - protein, 101 aa, Sorghum bicolor
  Clone ID: 13065226.pep
HEGHAHLCSSPSSRIPPEFICSTPHGLTKHPPLHLCTGELNCPDWSVRRTWQPAAATPFSLSSLGSMQSFWLPRRSTSRRSPYWWIAVQQKRARTPMGGNG

SEQ ID NO: 52798 - protein, 122 aa, Sorghum bicolor
  Clone ID: 13065244.pep
TRIGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSW

SEQ ID NO: 52799 - protein, 128 aa, Sorghum bicolor
  Clone ID: 13065289.pep
TRVAFKASTSSTTQQHWPSPTKDRCQYGFTQLSRQKYRKKFAALHVTATSGKLDLDFTDPSWNQKYQEDWNRRFSLPHITDIYDLEPRRTTFSLKKNRIPLGDGDGSSADMWNGYVNKSDRALLKVIK

SEQ ID NO: 52800 - protein, 73 aa, Sorghum bicolor
  Clone ID: 13065329.pep
VARGNTGAAGEPETHKSGGGPIAVHLASPQDVPAYEVRDNFWPFHALGFCWGGYELSLIGLVLNLSRLSHSYV

SEQ ID NO: 52801 - protein, 65 aa, Sorghum bicolor
  Clone ID: 13065361.pep
HEDGLRCLPFPLRTHFVHHRRRRRRRCRWRRLLLLLNAFFQRFSRTEACPPLAKAHLPGPQTTCA

SEQ ID NO: 52802 - protein, 45 aa, Sorghum bicolor
  Clone ID: 13065415.pep
MAERLEAAAPAAADEYTQDGTVDLHGNPVLRSKRGGWKACGFVVV

SEQ ID NO: 52803 - protein, 46 aa, Sorghum bicolor
  Clone ID: 13065421.pep
HEATRPIFLPLVGCKQQCHLSVSSVTHMVGMRGAYGGGGGANNDSE

SEQ ID NO: 52804 - protein, 36 aa, Sorghum bicolor
  Clone ID: 13065451.pep
MTDLNLPSIFVPLVGLVFPAIAMTSLFLYVQKNKIV

SEQ ID NO: 52805 - protein, 59 aa, Sorghum bicolor
  Clone ID: 13065462.pep
SSSPGIPDEGSLGEPPTPTIVHVRSILDLTNCPSYLLYLFDSPSFCLSRVFQWHVSASC

SEQ ID NO: 52806 - protein, 79 aa, Sorghum bicolor
  Clone ID: 13065464.pep
MGHHSCCNKQKVRRGLWSPEEDEKLIKYITTHGHGCWSSVPRQAGLQRCGKSCRLRWINYLRPDLKRGSFSQQEEALIV

SEQ ID NO: 52807 - protein, 101 aa, Sorghum bicolor
  Clone ID: 13065470.pep
ARALCILLPDYSCYNSIVTAPVTALLLQNLLAASHAMHAACSRNRLSELLRSRSQRHWRCQCPYQLSSARGMTRGRSVKDRSKKKRVHALEVATERWKVLS

SEQ ID NO: 52808 - protein, 131 aa, Sorghum bicolor
  Clone ID: 13065530.pep
HEALLIGMSGFLAVVGKIGTFLLWVLFLVLQTATRIVGSLLASPAEQQEDHQQESAVGRRRSPPASPRRELYEPASAPPAQLWDPPPLPYLAFAPAADENPSSSFRRRASAPLPRADEDVVVSSSAYSRPT

SEQ ID NO: 52809 - protein, 87 aa, Sorghum bicolor
  Clone ID: 13065542.pep
TRQQLLSADSPRASPRCTIAPRWRSLHGEGGWEGLLDPLDSDLRRELLRYGDFVQAAYHAFHSLPTASARHRGLMLPDRSYRPTRRL

SEQ ID NO: 52810 - protein, 88 aa, Sorghum bicolor
  Clone ID: 13065544.pep
MVDACSTRVDKWKPMGTGKDAAPRAILCFLFLFCLGCKCLASELEATQTATLTVDASPQLARKIPDTLFGIFFEEINHAGAGGIWAEL

SEQ ID NO: 52811 - protein, 158 aa, Sorghum bicolor
  Clone ID: 13065548.pep
ARGSADHIHDSRELVPKISMKAHDGGVVAVELSRVMGSAPQLITIGADKTLAIWDTVTFKEIRRIKPVPKLACHSVASWCHPRAPNLDILTCVKDSHIWAIEHPTYSALTRPLCELSSLVPPQVLAQHKKLRVYCMVAHPLQPHLVGTGTNIGIILSE

SEQ ID NO: 52812 - protein, 145 aa, Sorghum bicolor
  Clone ID: 13065568.pep
MKTHAGGFTSSMLNPDGDYGNVLSNHGGSSYQGQPTETMYAQYLQANPDSPLGSAASMSPFQGRGFTGSGHLDSPGYQKAYLGSLFAQQKLQYGIPYLGKSGALNQNIYGNDPAFGIGMTYLTSPPSSPYISSPQGHVQGDRLTR

SEQ ID NO: 52813 - protein, 111 aa, Sorghum bicolor
  Clone ID: 13065580.pep
PREPMTACRPGSARPPHAGFKLRKRQSLTGSPCTGCLRARRGSSWVVACRGCPPLAMVTHDAVSCEAATANPRLASSSTAYRRDLERRIAGSSPTRCGRSRLAAVARCRVP

SEQ ID NO: 52814 - protein, 137 aa, Sorghum bicolor
  Clone ID: 13065584.pep
GKTLLTRKNHLTGVEYRDDPTILAWELMNEPRCTTDPSGDTLQRWMEEMAAYVKSIDKKHLLTVGTEGFYGPTSPQEKLNVNPGIWKDNNYGSDFIRNAKIPDIDFASIHLYPDTWLQQQHATVDEKLKFVKRWVAS

SEQ ID NO: 52815 - protein, 106 aa, Sorghum bicolor
  Clone ID: 13065586.pep
ARGILAISTKVQNKTEVHLATNHTEPLILHWSLAKKAGEWKAPPSNILPSGSKLLDMACETEFTRSELDGLCYQVVEIELDDGGYKGMPFVLRSGETWIKNNGSDF

SEQ ID NO: 52816 - protein, 117 aa, Sorghum bicolor
  Clone ID: 13065592.pep
MARPRGKKRTASQAAATDSVELEAAAGASSKPEAAAAEPATRGRGKRVKAPPKPKPETDYFPEKRNLEDLWLSAFPVGTEWENIDKIKEFNWSFENLEKALEEGGELHGKTVYMFGS

SEQ ID NO: 52817 - protein, 118 aa, Sorghum bicolor
  Clone ID: 13065604.pep
APDIAKKEDKKSDRHEKKKRKEKDKHKEKKKEKEAKKEKGEHNHKEHDKTRENNISYPIDSFNLKPSVPPLAPAVDDGKSVVPDENLKKRKNHEMNGYLQSEFLAFLFFALNSICSLV

SEQ ID NO: 52818 - protein, 114 aa, Sorghum bicolor
  Clone ID: 13065614.pep
LMLQSKLKKLHGWHWLSPQRRKQRRSMTRSTLNPSRLHPSTSLGFFGAGGQCRWRSVPVLFAADGGESCRGPSSSSPPLPWEHLLDGSLSQDLPLQTHGELGLTCNSGVEREIV

SEQ ID NO: 52819 - protein, 82 aa, Sorghum bicolor
  Clone ID: 13065624.pep
LAHRYPAVASGPAAAAAVCVLVDLGFGAGGAHANHHHHREARNMLAVLAWVFLWWVTGAVPLAVASMAPLFLFPLFGVASAD

SEQ ID NO: 52820 - protein, 79 aa, Sorghum bicolor
  Clone ID: 13065630.pep
MAANGKSSLANGASSTQGKPINCKAAVAWAPGEPLVMEEVEVAPPGRLEVRVRVLFTSVCHTDLSFLKGENELQRKFPR

SEQ ID NO: 52821 - protein, 174 aa, Sorghum bicolor
  Clone ID: 13065640.pep
TRIDECAVNVPRPCPGHCINIPGNYSCPNEMPPSSSGPVVLVVGLSTGVVIVVITITGTYLILERKKLAKIKRKYFHQHGGMLLLQEIRLKQGTAFSIFSEAELIQATDKFDDKNILGRGGHGTVYRGTLKDGSLIAVKRCVSMTSEQQKKEFGKEMLILSQINHKNIGKLLGC

SEQ ID NO: 52822 - protein, 100 aa, Sorghum bicolor
  Clone ID: 13065662.pep
ARGSFSSISPGFLPQPPFQLSRPFLAAHARRVSVRCPSWRATLWGLLLWLPLFSPVLAVFWFRRSAWLRSAVPCLVSGCYSRCLHFLSLVDFSHSGLKLS

SEQ ID NO: 52823 - protein, 137 aa, Sorghum bicolor
  Clone ID: 13065664.pep
SQQWIKNGAVPVILVPIPLLSASFFFPTIVFLLAPIPILTLLPSLLRPSMSYHKTRSGRPSRVSSLLDQALSFGIGSSNLMLRIYRCIPFSCFRRQDHGLSLSIQHICWERMLIDLHRLLSFGTIKFDSPRFNSPRA

SEQ ID NO: 52824 - protein, 179 aa, Sorghum bicolor
  Clone ID: 13065666.pep
HEAYLSAASNAAQAAAAAARESSNLPPELDEFGRDINMQKRMDLKRREENRRRRKTQSETKRLASAVKNKGIEKIEGELSTDESDSESTAYVSSRDEFLKAADHVFNDAKEEYSSLRTVKDKFEGWKTQYPSAYRDAHVALSAPSVFTPFVRLELLKWDPLHETTDFFDMDWHKGLFDY

SEQ ID NO: 52825 - protein, 88 aa, Sorghum bicolor
  Clone ID: 13065698.pep
MGDAAAAAASTSAPDTPTSILICREDGGGFLADADDDGDGADLVVARDERLLVVDQDEEYVALLLSEESASGSGGAPAEEIEEWMKAA

SEQ ID NO: 52826 - protein, 141 aa, Sorghum bicolor
  Clone ID: 13065700.pep
TAAAAQASTTGAQPPPVDPQAHVPVQGAGAGSGSGVARGCRHHAYSRKQKSLGLLCSNFVALYDREDVEVIGLDDAAKRLGVERRRIYDIVNVLESVGILVRRAKNRYTWLGFGGVPAALKELKERALREMSGLPVLLPME

SEQ ID NO: 52827 - protein, 143 aa, Sorghum bicolor
  Clone ID: 13065794.pep
FRGRIPREFGGLFALEVLDLSSNKLDGTIPEEIGAMPLLKQLSLHDNQFQEGVQAIADDQEGCLSRKLGCWSLLYKSDFKDWISLNGLREKYNTNVPNFSEAHVMKNLQSFASAMRRRLLSETDNLPALLGNDAKSSDPQNPK

SEQ ID NO: 52828 - protein, 63 aa, Sorghum bicolor
  Clone ID: 13065806.pep
TRRLSRPLSGFLTRASPSPLLPSLSARVLAAAASTGSGVQLRPHEPRAGFLARSISSDFSLAQ

SEQ ID NO: 52829 - protein, 102 aa, Sorghum bicolor
  Clone ID: 13152047.pep
ARGSGATRRYLVPAISDDVEAGPSAPTDDSLDLQYQAKSPIIRKAVDKLEVMVKKAKRAMTTTADTTTQALVAEFLHGFEDVLQDLGEIQNNSDLAVAPFHS

SEQ ID NO: 52830 - protein, 54 aa, Sorghum bicolor
  Clone ID: 13152063.pep
TRPFGFSAISADTINPTELISATGDEVVAVVLPAGCSARAPPLPAILRLVKQVA

SEQ ID NO: 52831 - protein, 99 aa, Sorghum bicolor
  Clone ID: 13152065.pep
SARSRRSCLRPSTHHMSSLQGHTPALLLLLASATPRTLTKGSLNGRGTRRRTLCLVNPTFGKMTMRHIFVPTATWCNRFRILQRVVSEGHRHPSTNSWT

SEQ ID NO: 52832 - protein, 86 aa, Sorghum bicolor
  Clone ID: 13152071.pep
ARGLAVELMSRNELTTEVSSLRTECSNLKQQLEEIKCSKLSHNKFDVQGKTMIKYGNYILATESIHHLQTEWLQGLLLLESKLQQT

SEQ ID NO: 52833 - protein, 155 aa, Sorghum bicolor
  Clone ID: 13152093.pep
TRWKCTMLHWLPGMNRCDISEDETTEALNALFAIPATAATFSSGGPHTAGAGTGTATSSAYNISGQFERSRKRKNAPSNGKDLAGSSYRTPLLTPSMSNQQDPIRDERTTDDMHYSSKTDSVSKHGPRPVSKSADLVSEKLKPKHRNHSSYSDEG

SEQ ID NO: 52834 - protein, 177 aa, Sorghum bicolor
  Clone ID: 13152104.pep
HEGSDELRVGVELDSRADILVSEILDSELLGEGLIPTLQHAHDMLLVKNPKTVPYRATTYGVLVESVSLWKMHDLHSNEANAEDGVWLTPSGTQNVLSVKSQQHAMQCDALADEIRLLSEPFKVFEFDFSKRPDSRRETKIEIKATADGHAHAIVSWWVLQLDSAESIFYSTAPRWV

SEQ ID NO: 52835 - protein, 138 aa, Sorghum bicolor
  Clone ID: 13152112.pep
DEVDELLDHRSPRTTKQRRRRPPGRMYMYVARPPALPHTNPSQTNNLSLPEGRNSSPSAQLNSPNQLIPSPAAEFSSPGSLRSARNRRRLPTTRSPECSPRPAGSGESGREGGWSRTALRVHRWRRRRRDEESEERDG

SEQ ID NO: 52836 - protein, 68 aa, Sorghum bicolor
  Clone ID: 13152126.pep
GCLGPFVQYFVTLSLSSMTSFKWLSNSYLSFRSRLICFFLRLRSYSLFSLLFTTASIALRVRKRVEFP

SEQ ID NO: 52837 - protein, 198 aa, Sorghum bicolor
  unsure (1)..(198): unsure at all Xaa locations
  Clone ID: 13152135.pep
ARGKFIDAIEFNTHSSSTPVRVTAAWALANLCSCIRFRALEVHTDPYAGVLNKSSISLLVEVALRLAKDSEKVKSNAVRALGYLSRFIRFNYQAGTINDPSNSDSVFYGDPVWLERMVQALVSCVTTGNVKXSSVYSILLLLIRDSNNYKIKMHAAVALAVPVSRLDYGSSFPDVVRGLVHALESLNSNNSSLPSNFK

SEQ ID NO: 52838 - protein, 174 aa, Sorghum bicolor
  Clone ID: 13152141.pep
TRLNPKAVSQVSAISKRQSVKKLCSRRRLRVRHPLNNAAANRGRFAAAADRRLRSLSSGPRSRSNGTGPRRRGLGGSQGRDPNPSARAAHGPAASTADPTDDGGVPPGAPAPGGAPVAPDPHGAPARGHRLHGRVSEPLPPQVHFRRGDCAFARGRTEEGAGSTRARQDSDGVG

SEQ ID NO: 52839 - protein, 138 aa, Sorghum bicolor
  unsure (1)..(138): unsure at all Xaa locations
  Clone ID: 13152166.pep
TRAIPINARPYHYSPHHKSEIESQVQQLLTDGLITHSHSPFASPVLLVKKXDGSWRMCVDYRKLNAMTIKNIFPLPIVEEILDELSGARLFTKLDMKSGYHQITMCPSDEYKTAFKTHQGHYEYKVMPFGLTNAPATF

SEQ ID NO: 52840 - protein, 81 aa, Sorghum bicolor
  Clone ID: 13152174.pep
WTEQRKMEALKLYYRVLESMCRAESQILSGNNLTSLLSNERFHRCMIACSAELVLATHKTVTMMFPAVLEKTGITAFDLSK

SEQ ID NO: 52841 - protein, 77 aa, Sorghum bicolor
  Clone ID: 13152179.pep
LVPSLMECVIAFYEVLWALPYAIQTQVKSHKPLIEAISIHPDTSSSHFSFFGALVLELLLSHLCLPFCLQSFLVIAL

SEQ ID NO: 52842 - protein, 194 aa, Sorghum bicolor
  Clone ID: 13152182.pep
KIVSWSAPLYDYKNLAAVSTSHDEFLKKKLPLATPLAAATLPALNLELDTGSLPTLEELKCFLKDIAPEDNWAPLKSMSAISILKKTISQRKIKSNATLSTSNGENIEDITMDSGASRKRIINSMFASENSLEVRGGTDITLDALAAYLKYLEGTGNASWQELHDKVRLAETRYGASFYVLFGPAIQLGVISRR

SEQ ID NO: 52843 - protein, 62 aa, Sorghum bicolor
  Clone ID: 13152183.pep
LRSGGGSIVVQITSANRTSLYGFSDVQPTLRSEDECESVVFARSVFSYAAVLNRPFPFGGFS

SEQ ID NO: 52844 - protein, 148 aa, Sorghum bicolor
  Clone ID: 13152189.pep
MSKAKTNNGYLGVTEPISLSGPTDKDLMQTTEVEKYLSDAGLYESQDEAVLREEVLGKLDQTVKAWIKKATRISGYGEQFVHEANAKIFTFGSYRLGVHGPGADIDTLCVGPRHATRNEYFFRWLHDMLAEMPEVSELHPVPDAHVPV

SEQ ID NO: 52845 - protein, 72 aa, Sorghum bicolor
  Clone ID: 13152205.pep
ASGGVPDMPRSHRRRRRATSARTMTPATAMPATIQTRGLEAIVPPPPAPPDCDEEAMWGPGGVRKLGFKPRA

SEQ ID NO: 52846 - protein, 157 aa, Sorghum bicolor
  Clone ID: 13152211.pep
ARGGDRATELGSSDLPRPFWRLSSTVGHSCFLPVPEPSPHLERSSSSSIGPRALGFLMGDSTRHERWDGWLRRPALGLNSLMQIPDKIQSSLKVHFGRFLNKDGHGRRMSAEVSSEKAKQSCSAAASASAEFRLDRQLQAWWDNPSWTDEPPEIKVT

SEQ ID NO: 52847 - protein, 153 aa, Sorghum bicolor
  Clone ID: 13152213.pep
HEASLSSRVEHPETHRPPITKRRRRRRHSKMLSRARRLHPAVRRFLLPNTPAPSRPAPLPPQHSASAQTSKTFSILFRRHLCSSPPAPPPSTSPPPAVVSSDLPAVRVNEVCPGCGISMQSSDPALPGFFLLPSAKSPDYRARLAPVTTDDTR

SEQ ID NO: 52848 - protein, 157 aa, Sorghum bicolor
  Clone ID: 13152224.pep
MPGMPTDGVGAIVPFTGEPGQGAPPVRPIRHGVPPPIFRIYVSWSSGNLLQVACLRPPNSEGGGGTEEVVGSVVEVNLGDGGSEAEEKIDEAEMRRIEYGSVPAFALLQSRKNTLADAATMSHLPSVPDHAEWWQYVLEYSKTIGNLLGNPDPPVFM

SEQ ID NO: 52849 - protein, 210 aa, Sorghum bicolor
  Clone ID: 13152226.pep
ARGVNIGYGPMAVGPRWLAYATNTPLLSNTGRLSPQNLTPSPGVSPSTSPSSGSLVARYAMESSKQLASGIIDMGYKTFSKYCQELLPDGSNSPLSSSPGRRSGKIPSSVHPLEADNAGMVVIKDFTSKAVVSQFRAHTSPISALCFDPSGTLLVTTSVHGHNINVFRIMPTCIANGSGATRYDWTASHVHLYKLYRGMTSAVIQDISFS

SEQ ID NO: 52850 - protein, 165 aa, Sorghum bicolor
  Clone ID: 13152229.pep
LPAVAGTAVGVVFVTAGAVVVAGVADAPFSSSSSSCSSSSSPGVLAGDDSSGSILMLEFICSWSWSSALPKGVAQYLALTMLRTQRDSSMAPMMTPLLTRRGSCRVLSDDFIPPSAVLLLPLAATAAGPDLRGAAPRRAQSSPLYSRRDAARGRGRVGRRQESGR

SEQ ID NO: 52851 - protein, 148 aa, Sorghum bicolor
  Clone ID: 13152236.pep
MGSERRQEQTTNDATQEVQREHSESVIRREMGNQVTHVESEQPGSHRVHAGKQKGLVAASNSVLQLRRSKRLAKDSSAATDRQLVMDTEVIHRQNVGCQAVSPNGLMPMTIIDAEQTESEPDEQLVVSPERSSDLSDTNRIINNLCNS

SEQ ID NO: 52852 - protein, 161 aa, Sorghum bicolor
  unsure (1)..(161): unsure at all Xaa locations
  Clone ID: 13152241.pep
HEDRFGWLLFLALRIQTFSRFKDLVTSTNELVSVLAVLIIHVPVRLRNFDIKDSSYFAKKSDRGVSLIASLCEKYHTSEDELSKALEKTNTLIMDVLKKKPCPATSACQQDNLSFIDPXDSLKSSLLILEKEYENAINTKGELDERMFANDEDSLLGSGSL

SEQ ID NO: 52853 - protein, 66 aa, Sorghum bicolor
  Clone ID: 13152250.pep
GLATLGPDGSPPHAYPVETDASGAGQAASGRPFRWKGKLAAGSAATERTSSRERRCGAIEALRSTA

SEQ ID NO: 52854 - protein, 204 aa, Sorghum bicolor
  Clone ID: 13152256.pep
RRLEAARAEMGEVREENERLKSMLSRIVSQYQSLQMHFLDVVKVQEQASSAAKVAEKKLPVAPAPAPNPGTDDDGPDDLVSLSLGTRANSGGAPRRKGHERSSSSSGTAETTTAADADDQGHHQLSLGLGFARGNGLPSSTTTATDDDKASHASTAPVLNLTSDSSGSADDNDDAKPALAAAGTARKSPSAGAGAGDRSADDEV

SEQ ID NO: 52855 - protein, 96 aa, Sorghum bicolor
  Clone ID: 13152263.pep
ARGQQQHDILARSTGRCTHPRRPGIAGPPLPAFPSPEAEPSAKRTTRPPRATSSDSERILHETPDFLLEPPPPPPNPLTGPRPSETTRGFRRRRRG

SEQ ID NO: 52856 - protein, 83 aa, Sorghum bicolor
  Clone ID: 13152273.pep
MISTRLARMGALAPKSRLFLGARRGLATVGDNPLDKKVEMTHWEKGNYINYKKMSENLDIVRQRLNRPLTYAEKILYSHLDDP

SEQ ID NO: 52857 - protein, 50 aa, Sorghum bicolor
  Clone ID: 13152278.pep
SSPKQKTDALLIRCQHPAPDIPEPNHLHPFAVLLFPFAGFRLSFTRDHYG

SEQ ID NO: 52858 - protein, 120 aa, Sorghum bicolor
  Clone ID: 13152280.pep
APRRRDRDRARARRLARRRPHDRAGVLGVARADGRRRRGEEGQVGGRARGDGGRERGGRRRRRPLSTLLARAPLGPAAAEAAEARHRFELEQDGGGAQLVASCLVFSIASNYGEILQQSR

SEQ ID NO: 52859 - protein, 49 aa, Sorghum bicolor
  Clone ID: 13152283.pep
RQDVLGRKMSFCPQFYTCLLRGFSETCEAFHISIQRLHRVSSIRKWSSC

SEQ ID NO: 52860 - protein, 187 aa, Sorghum bicolor
  Clone ID: 13152291.pep
EVKIPLDKCAKTNDEYLVTKRRNGGHSCDDDDTGSIEARYFGNQDSAWSKGAKHGFGNAKRLLTQEKLSEKKNHLSTTTLKISGEPIEKLFLWGQSSCVFTVGEEQQVLTFGGFGGPGRHARRNYSLLLDHKSGFLIEMIFKASPSPRMGHTVTAVGNSTYLIGGRGGPSEILDDVWVLLTTGNTWS

SEQ ID NO: 52861 - protein, 151 aa, Sorghum bicolor
  Clone ID: 13152304.pep
ARGEHPDYTIDGEEVLGVPDNTARYQDQRNIYPGSSRIVPAEKRHGEPISQVRHQAQNLTSSHVIRAKQPYQQNPDRVIEALQNPVNFALFSESGRVADINDTTSTDINGTVGRSICPRTVSVERGIMQTAQQITQKSQKQHSCYVTSLEL

SEQ ID NO: 52862 - protein, 194 aa, Sorghum bicolor
  Clone ID: 13152306.pep
TRAPFKINFERLIDDFVFMCFFVGNDFLPHMPTLEIREGAINLLMSIYRSEFTSMGGYLTDGGEVILDRVEHFIQSVAVNEEQIFQKRARIQQARENNEEKHRIQRENSEENQYVDKVKLGEPGYRERYYAEKFKEEAESKPIDQVRRDVVQKYVEGLCWVMRYYYQGVCSWQWFYPYHYAPFASDLKGLAELE

SEQ ID NO: 52863 - protein, 187 aa, Sorghum bicolor
  Clone ID: 13152318.pep
ARGGRGTEQHRSSSDNSSAMAASRRSSVELPVADPAADRDQVRLRQLGYKQELKRGLSVLSNFALSFSIISVLMGVTITYNTGLRYGGPVSMTLGWFLVSALNGCVALSMAEICSAYPTSGGLYYWSAKLAGKDWAPFASWLTGWFNIVGQWAGTTSVDFSLAQLVQVIVLLATGGLNGGGYMASKY

SEQ ID NO: 52864 - protein, 55 aa, Sorghum bicolor
  Clone ID: 13152331.pep
QEAISGFSVQGKERGSIAETNNRIHRENNDRDGHGSTAPDLALTDAHKVFDELLT

SEQ ID NO: 52865 - protein, 149 aa, Sorghum bicolor
  Clone ID: 13152345.pep
HEAPGKVSILNDGSIAVEVGGIELGQGLWTKVKQMAAFGLGQLCPDRSQELLERIRVIQADTLSNVQGGWTTGSTTSESSCEAVRLACYVLVDRLKPVKEQFQEKQGNVSWDELISKAIMVGVNLSAREYYIPGPSGSYLNYGAAASEV

SEQ ID NO: 52866 - protein, 103 aa, Sorghum bicolor
  Clone ID: 13152348.pep
VLVMRSNFMAFRVASGSSRCSSILDHAGGGAAGAEKPRGRKSSEPPSDSTVAAGAATGAARASCGTGPAGGGGCSGGGQSPTSSPPRAVGCFSGRGEENLPSC

SEQ ID NO: 52867 - protein, 180 aa, Sorghum bicolor
  Clone ID: 13152350.pep
ARGCRSRRPARFPLPSSSGQSQRLPRFAAASLPGGKSSLSGEKSRRREGVREARGKEAKPLRPCRACSLGAFNWRQQWAGGRLLQHGGLHKLAPPASAPSVPLSSRPVSPPIGPSSITRTPAGACASRASSAGEEPSSSSAAAPAPGRRCSSSSAAREEKERGMTVTARGRSGGGVGMEE

SEQ ID NO: 52868 - protein, 201 aa, Sorghum bicolor
  Clone ID: 13152354.pep
HEATLRGPVVGILTNQRVLIASADLDILSSSSTKFDHGLPSYRSMLWVGPALIFSSATAISMLGWDNKVRSILSTSFPRSVLLGALNDRLLLVNPTDINPRQKKGVEIRGCLVGLLEPLLIGFATMQQHFEQKLDLSEVLYQITSRFDSLRITPRSLDILTKGPPVCGDLAVSLSQAGPQFTQIMRCNYAIKALRFSTALS

SEQ ID NO: 52869 - protein, 149 aa, Sorghum bicolor
  Clone ID: 13152356.pep
TRNVPLQSREEDSCSLRQKLSRSSHQENAGKRGCPTRIVVLKPNFDKPHDIEETLPLHHKPPHSDYRSHKECPEVGRWTPYTEDYMCQVPLGDSETLNRMGKGSREIAREITKQMRAARGGSRKHAVKPEIRTPASDERSQFLPSVTKL

SEQ ID NO: 52870 - protein, 173 aa, Sorghum bicolor
  Clone ID: 13152368.pep
TRVQSPVSSKSGEISSSSMGGQFGSAVTSAVIGAQKDKFAANSSAAVGFPSVASSPNDSMHRIQQPAVASSKRKTNSVPKTQPPVSAVGSPASVSNMHAPLNASSPSIGTTPMGDQAILDKFAKIDNISHRYQLLNKKNKVDKISQKKTITNQSHPDVARCLNSCFHSEDYID

SEQ ID NO: 52871 - protein, 209 aa, Sorghum bicolor
  Clone ID: 13152369.pep
TRLRIKRPRISATSVTAGRSIDPRSHASAAQALDGPIGVSSELNHPQIGASTRYHRPTADGVPSLGNAAQKRAIQMMDEDFQHAVFLREPKPEPDTDDLQCTAPASSCQNAQPGCITSHLLNASTSDTPPVHAPLQISGANGRTAQHYRRSAASTSFVEPINSMMKQPQSLGNGLDYATVMHNSGTGSAAGKTQEAPCLHTIVASSAMG

SEQ ID NO: 52872 - protein, 45 aa, Sorghum bicolor
  Clone ID: 13152382.pep
GAIRFHPIRHGAYHSSHHGSPTRSSPCHLIFPTSEDNLISMKKFS

SEQ ID NO: 52873 - protein, 105 aa, Sorghum bicolor
  Clone ID: 13152383.pep
ITGDSLYRCSCVPGPASANLTKRLLLTRGTTTKISGAQMELLSFHSTNPRTLWRTKESEPEERNSQQSKILLPLSAFLCPASRFSGRYFFRERRGRAGEGGREKS

SEQ ID NO: 52874 - protein, 113 aa, Sorghum bicolor
  Clone ID: 13152385.pep
ARGGDQPHRLAGFLAVCAVAFVVTCLLHWCFPGGPAWGRWWWTTQARRVAAAAVPGPRGLPVVGSMWLMTGLAHRKLAAAADSLRARRLMAFSLGGTRVVVAAHPDVAREILN

SEQ ID NO: 52875 - protein, 183 aa, Sorghum bicolor
  Clone ID: 13152395.pep
HEGEAEVLPSAEAISGFPAAKRRVVNRPHPSVLALLEAERSARSGDAPTVAPPALENISHGQLQVLSGVLPDHPSLATDPDKPSLYVCTPPPLMEGHGVPKQFQGRLHVVPKHSDWFSPGTVHRLERQVVPHFFTGKSPGHTPEKYVMLRNKVIAKYLENPNKRLAFAECQGLVGSTAELYDL

SEQ ID NO: 52876 - protein, 170 aa, Sorghum bicolor
  Clone ID: 13152406.pep
DLKSMKITSDAEISDIKKARLLLKSVTQTNPKHPPGWIAAARLEEIAGKLQVARQLIQRGCEECPKNEDVWLEACSLASPDEAKAVIARGVMSIPNSVKLWLQAAKLESSDLNKSRVLRKGLEHIPDSVRLWKAVVELANEEDARLLLHRAVECCPLHVELWLALARLET

SEQ ID NO: 52877 - protein, 144 aa, Sorghum bicolor
  Clone ID: 13152425.pep
MPKPHILVGVVKESESFDFCMCNPPFFESIEEAGLNPKTSCGGTAEEMVCPGGELAFVTQIIEDSVSLKNSFRWFTSMIGRKANLKLLISKVREAGASVVKTTEFVQGQTARWGLAWSFIAPRPRKMVLSSTAPAKNHHSFMLQ

SEQ ID NO: 52878 - protein, 170 aa, Sorghum bicolor
  Clone ID: 13152434.pep
RTKMEKTVSLEELRKHFAGSLKEAAKNLGVCPTTLKRICRQHGINRWPSRKIKKVGHSLKKLQMVIDSVHGNEGTVQLSSLYENFTKTTWSERELQGDASYPLSEEKGLLEPSVPDQHCEGRFTSHTSGSNSLSPSCSQSSNSSHGCSSGSKSQQHGSASQLAVKKEVFM

SEQ ID NO: 52879 - protein, 141 aa, Sorghum bicolor
  Clone ID: 13152444.pep
TRLIPGVISTMYEHQREAFEFMWTNLVGGIRLDELKHGAKPDVVGGCVICHAPGTGKTRLAIVFIQTYMKVFPDCRPVIIAPRGMLFAWDEEFKKWNVDVPFHIMNTTDYTGKEDREICKLIKKEHRTEKLTRLVKLLSWN

SEQ ID NO: 52880 - protein, 166 aa, Sorghum bicolor
  Clone ID: 13152445.pep
HEAAATAAPLSGAVTASAPDGVDRISSLPGGILRDIVSRLPVKDAARTTVLSTRWRRVWHTTPLVLVDAHLLSSASIGTGRSRLGADPRDLFGTSRSLADAVSTVLAAHPGPFRCVYLTGTPMETHPDELALWLQHLAAKGVQELIFLSRTTKLDSAVHLPATLFR

SEQ ID NO: 52881 - protein, 185 aa, Sorghum bicolor
  Clone ID: 13152447.pep
HEADTSGQDNLKSTANVPPPSVIDRVMKDLFSDETGNYMEAENKYSRAMRGAPADSLFGQFCLHALWFGNCNIRAIAVLWIDFVREIRWCWEESERLPRMKSTSSIDLSSCLIHQKLQMLTICIERKKSLNHEKGAGYKDETSNSTAVDKSRKGSAGVVPKMMLLNTFQEMHAPYTQDAPLMTED

SEQ ID NO: 52882 - protein, 180 aa, Sorghum bicolor
  Clone ID: 13152452.pep
HEASSHSLRSYCLLVHLLSRAALFRNASVLLESAISRHSSSSAPASCFIDTFFAAYEDSGTAATTRGLHLLVHAYARLRLPAEALEACRYLARRGVLPSLSAFNAALHAAQRAGSFGVAWEVFELMTLKRLYANKSTVELVIGVLSREGKLARTAALVERIHGKKCAPGIVAHVALTLRM

SEQ ID NO: 52883 - protein, 153 aa, Sorghum bicolor
  Clone ID: 13152464.pep
HEGQKYMGYRPTSSYQDSSIKPEGGHNVLVDNFLNAQYFSEISLGTPPQTFKVVLDTGSSNLWVPSSQCTSIACFLHSKYDSSSSSTYKKNGTEFAIRYGSGSLSGFVSQDTLKIGDLEIKHQDFAEATQEPGLAFAFGRFDGILGLGFDTIS

SEQ ID NO: 52884 - protein, 177 aa, Sorghum bicolor
  Clone ID: 13152474.pep
MADSRGTASRPARLRVMRPEVKEFLTSPRRSRPKKQPPPPPPPPPPPPPRREKVKERKQKEKEKAATGEEKFERAQYNCAFQDEDEGGRDFAPPELVWGKVRSHPWWPGQVFDAADASEIALQHRKAGAPLVAYFWDRTFAWSDPSALLPFRTNFRRLSAQSNMSSFVSAIDSALQE

SEQ ID NO: 52885 - protein, 117 aa, Sorghum bicolor
  Clone ID: 13152479.pep
MSDGLNQARAMRVAEIINDYRTLLLHISQQNVNASQEEYWEEGFVVLRESLASAQTLMSANYQPCPVTGQGNVETEKAELQRVILDSSARRYQAHKIYLRAAAARRWAMARASILQG

SEQ ID NO: 52886 - protein, 166 aa, Sorghum bicolor
  unsure (1)..(166): unsure at all Xaa locations
  Clone ID: 13152480.pep
ILAQTMFQVLQIASNWWMAWANPQTEGDAPKTDSVVLLVVYMSLAFGSSLFVFVRSLLVATFGLAAAQKLFIKMLRCVFRAPMSFFDTTPSGRILNRVSVDQSVVDLDIAFRLGGFASTTIQLLGIVAVMSKVTWQVLILIVPMAIACMWMQRYYIASSRELTXIL

SEQ ID NO: 52887 - protein, 92 aa, Sorghum bicolor
  Clone ID: 13152483.pep
AILFMFQACTVFSKMHCSSVKCITCYILSPCNKCVDLVCDVLISAGEAFYCQCDGRCGANRDKFCVVHMPLHVLTLLQSQIWMEEARHNQIR

SEQ ID NO: 52888 - protein, 217 aa, Sorghum bicolor
  Clone ID: 13152488.pep
QSESSLLSNFRSQRGERILEVDGTLTTQPVLEHVGISTWPGRLILTDHALYFEALRVVTYDKPKVYELAEDLKQVVKPELTGPWGSRLFDKAVMYKSTTLTEPVIIEFPELAGHSRRDYWLAIISEVLYAHRFIRKFDISGVDKEDTILKAVLGILRLEAIEELHFEVPNRYESLLMFNLCDKLPGGDVILETLASSISSRTSDRTNQPGTSRRMHA

SEQ ID NO: 52889 - protein, 108 aa, Sorghum bicolor
  Clone ID: 13152491.pep
MAMVRSDSSHHGVVDNSPNGCAQARCDEARKLGPSWYFSRKELEENSPSRRDGIDFKKESNLRKLYCKFLQDLGMLLKMPQVTIATAMVFCHRFYLRQSLAKNDRRII

SEQ ID NO: 52890 - protein, 174 aa, Sorghum bicolor
  Clone ID: 13152496.pep
MMVMGSSRLAGAALQVALTALLPLILPAYYVYKVTTYLLGAVFPENVAGKVVLITGAASGIGEHLAYEYAKRGAYLALVARREASLREVGDVALGLGSPGVLVLPADVSKPQDCESFIDDTIRYYGRLDHLVNNASVWKVCKFEEIEDVSHFRALMDINFWGHVYPTRLAIPHL

SEQ ID NO: 52891 - protein, 128 aa, Sorghum bicolor
  Clone ID: 13152500.pep
IPHWGSDDVAFETFRAAPRPFGNAVSYVNSAFLARTSGSHLIEDICLAFGAYGVDHALRAKKVEDFLKGKSLSSFVILEAIQLLKDTVSPSEDTTHREYRISLAVSFLFNFLSALANSLNAPSNIDTP

SEQ ID NO: 52892 - protein, 185 aa, Sorghum bicolor
  Clone ID: 13152517.pep
TREGDDICNNSPPKANVRKFAVIGTHRPSVELISLEPGEALRVLTIGTISVNNAFGAPMSGCIPENVRFVAAERFYILAGLRNGMLLRFESEASDYLPGFFYKDSSIPSINTFLQLISIRRIGITPVLLVPIHDSANADIIVLSDRPWLLHAARHSLAYSSISFLSASHVTPVSSVDCPNGLLFV

SEQ ID NO: 52893 - protein, 62 aa, Sorghum bicolor
  Clone ID: 13152535.pep
TRLVLIWLQLETAGERRHGAADAGADAQEQVPHHTNRALRYEKRMCYARRTNRITDLYSSII

SEQ ID NO: 52894 - protein, 165 aa, Sorghum bicolor
  Clone ID: 13152539.pep
ARGSFLRTKARQLDRDLATVRRREETVWRVVRAVTHHIRDSIDARTILHTTMLQLAAALGLSNCAVWMPPLQQRAGTGTGGGVLQLTHQLLPDEDDDKVLHRSGGGATARAISVRDPDVAAVLASKDAKVLSRPGSALKAASCRSLPRAGAAAAIRIPNFPIRPA

SEQ ID NO: 52895 - protein, 125 aa, Sorghum bicolor
  Clone ID: 13152553.pep
MSDKRLEATERYVGGTVAEELGSHEMKGYTENDRIDMRRMGKKQELRRNFRFISTVGYATCVYGTWEIYLTANTQGLIAGGLAGLFWSLVWCYTGQTFIVLSLAEMASMAPTAGGQYHWVSEFAP

SEQ ID NO: 52896 - protein, 194 aa, Sorghum bicolor
  Clone ID: 13152557.pep
ARGCLEGNKPLLVYEYLENGSLDKALFGSGKLNLDWPTRFEICLGIARGLAYLHEESSIRVVHRDIKASNVLLDANLNPKISDFGLAKLYDDKKTHVSTKVAGTFGYLAPEYAMRGHMTEKVDVFAFGVVILETLAGRPNFDNTLDEDKVYILEWVWQLYEENHPLDMVDPKLAQFNSNQVLRAIHVALLCTQG

SEQ ID NO: 52897 - protein, 159 aa, Sorghum bicolor
  Clone ID: 13152563.pep
HEAQSPEITSKELEDQNNVKVKVLSERLSSVVLDIRAKDDLVKQHSKVAEEAVLGWEKAEKEIASLKAQLNAATAKNSALEDRLVHLDGALKECVRQLRRAKDEQDQTVQDALAQQARQWESHKADLELRIVELTARLEAKSERSAVATTDGNTGSRLA

SEQ ID NO: 52898 - protein, 203 aa, Sorghum bicolor
  unsure (1)..(203): unsure at all Xaa locations
  Clone ID: 13152564.pep
ARGFPPPPXSASAGKMPVYRIRGVDVDFPFDAYDCQITYMDRVIESLQQGKNALLESPTGTGKTLCLLCASLAWRRTFGEFLRVGRGGGGGGTQQLPYGSQPSVSQQSEDSTSQQQQSRYPVIIYASRTHSQLRQVIKELKATSYRPKMAVLGSREQMCIHNEVSKLRGRAQNNACHFLCKKRRCPHNNHVSEFMKNKPELGN

SEQ ID NO: 52899 - protein, 159 aa, Sorghum bicolor
  Clone ID: 13152576.pep
HEGERELVSSFSFMGGKGGSLWKQMTFHLSGQRANCGGTLITQDAYGYTAKNFIKEGFLEFLNKEIESIQYNEKDYEGLPFEFHGGFVGYLGYGLKVECDASSNNAKSSTPDACFVFADNTVVVDHSNGDVYILSLHDEFYSSNGDGICKNSTHTSWLV

SEQ ID NO: 52900 - protein, 199 aa, Sorghum bicolor
  unsure (1)..(199): unsure at all Xaa locations
  Clone ID: 13152579.pep
ARGWHLGDWITDIDLVREFDAVGIMKPEGFLYTSQYFVGLIASSIFMGAEGRRRNLSNTTIASFVLLSSIGSLGYSLSLFFITILYTPLTLQRGDTPRHDALFTPYAAVYDAGIVASLITLNLFPQLVSEFGDKSMMRVGYLAMPLAFAFAPQLIPFSLGYEHISKAAAHRSYAKVFYALSLASILLYWRVWATXLYVN

SEQ ID NO: 52901 - protein, 133 aa, Sorghum bicolor
  Clone ID: 13152586.pep
MAVLTAASTTLPLLLLVWLWLPLLASACDRCVRHSKAAYYTSSLTLAGGSCGYGTEAASFSAGFLAAASPALYRAGVGCGACFQVRCKDKKLCAAAGARVVVTDRARTNRTDLVLSSTAFAAMARPGVAKRLA

SEQ ID NO: 52902 - protein, 126 aa, Sorghum bicolor
  Clone ID: 13152599.pep
MASAKETYRAELRAAARQLGERCLYSAAKWAAELLVGVEPDAAPVPSAVMDTPSSSSATSAGRLLHLHRSGGSSFRHRPRPAGGGTSSEAGTPLGGVSYVSTPIPDDDAFDSGGDKYLLAKTYFDC

SEQ ID NO: 52903 - protein, 165 aa, Sorghum bicolor
  Clone ID: 13152653.pep
VPAYSNIGNQHGQFGSPHGESKFSNHPPQVGYGAQLPQSGYRFEPQQEQAGFGNRGALPAYVASSQPSYGTRWSSSGYGSTQGQLGYSGPQAQSHESQLPHHQASFGMPHVQHNNDFYKYNPGYRPSNGLQGFDATHGDSETASSKDHQETTPPEDGQQVAFMKA

SEQ ID NO: 52904 - protein, 81 aa, Sorghum bicolor
  Clone ID: 13152698.pep
YDRQAEKDHLSKLVFSTEDEFNNVRNMLSRAEMDHCSKLISEDKVLEEMTSHDQLKGMFLKIHYPPTESNIVYTYNQITPE

SEQ ID NO: 52905 - protein, 158 aa, Sorghum bicolor
  Clone ID: 13152699.pep
SFLRCFPNVETLYIQSENDDFKFWGPQATGTGKLNLKFWKEAGPIQCVQRHIKKVVLREFRGTRSELDFLKFIAEHARVLEKMVIVLTHGHSPSGPVGTNLRTRMASANWANACCELMIFQTPFPQEGTAWCYLSAFNLSSTDPFDVSKCVDGTCQGH

SEQ ID NO: 52906 - protein, 66 aa, Sorghum bicolor
  Clone ID: 13152706.pep
KKKILKLPRHKSATWKAGAPPSLRLHYHERMGHKCRPLYVVYVKHRLDLICQVTKYCLRQQFVVDS

SEQ ID NO: 52907 - protein, 152 aa, Sorghum bicolor
  unsure (1)..(152): unsure at all Xaa locations
  Clone ID: 13152717.pep
TGEMINIPXRRKAYWEVDFDAITLGHNTAELEDTGVILDTGTSLIALPSTMAELLNKEIGAKKGFTGQYTVECDKRDSLPDLTFTLAGHNFTIGPYDYILEVQGSCISSFMGMDFPEPVGPLAILGDAFLRRWYSVYDHGKGSVGLAKAKSS

SEQ ID NO: 52908 - protein, 125 aa, Sorghum bicolor
  Clone ID: 13152726.pep
FYNEECDRFMLCMVHKLGYGNWDELKAAFRMSPLFRFDWFVKSRTTQELARRCDTLIRLVEKENQEYDEQERQARKEKRLAKNMTPTKRAALRNSEGENTPLSSFKRRRQSLMDDYVGSGRRKRG

SEQ ID NO: 52909 - protein, 124 aa, Sorghum bicolor
  Clone ID: 13152732.pep
DPKCPYAAGWEIIPQRKSKSKSKSTKAITNTKQGDISYNQKHTRKRNPDFVSSSFPFISEDGNSRDQRFPAPHVIPPSGPMPEKIIADTYAKRPHVAFVPVSFRHYCDPTQRRMASKDGSSSTQ

SEQ ID NO: 52910 - protein, 185 aa, Sorghum bicolor
  unsure (1)..(185): unsure at all Xaa locations
  Clone ID: 13152742.pep
PVLVKTPVMAPLNGSGLFNKQNNPKPGTSSSLFGQKESPGTPRQRSTFNSIQAKPATIERSRVFNTDLLGQVPSTGLFGEAKDFGKDSKFATDTSKAALGVHKQSATDSSKPNADRTIPNFGTVKSPFDTFTFSXYEGIGSVGSKFSHIIPTLGLCIFIPATSLRYFGSAFYYHISARGFFITFT

SEQ ID NO: 52911 - protein, 104 aa, Sorghum bicolor
  Clone ID: 13152745.pep
LHRFNRNITYKKMNATVTRSMSIRACFVHIYTNVCWNLVNIAARLSSICKLQSVAGHIILMFRSTAILGTASSGTIEDTCSSTCTPHHTMNSCQFPKKTIQNHM

SEQ ID NO: 52912 - protein, 57 aa, Sorghum bicolor
  Clone ID: 13152749.pep
HSQSHKSQTRINYRRTKSPREKKKKHTHTGHQNTQTFKLNCPRVLTISSSSSSSSSC

SEQ ID NO: 52913 - protein, 152 aa, Sorghum bicolor
  Clone ID: 13152750.pep
NASKAAALNFYDTLRMELGGDIRITEVVPGVVESEITKGKMLTKEGEMKVDQDERDAILGPTPAEPVGDFARTVVRDVCRGARYVFEPRWYMGVYLLRACIPEVLAWNSRLLTVDRVGASTTDTLGKWLLDLPGVRRVAQPPSLRSPEIKEQ

SEQ ID NO: 52914 - protein, 176 aa, Sorghum bicolor
  Clone ID: 13152783.pep
EDNEMIDVIAVTKGKGFNGVTSRWGTKKLPRKTHKGLRKVACIGAWHPAHVQWTVARAGQDGYHHRTSVNHKIYRIGKGDDEGNASTDFDVSKKRITPMGGFVRYGEVKNDYILLKGACPGVKKRVMTLRKSMFTHTSRRALEKVELKWIDTSSKFGHGAYQTPAEKRQYEGVLKK

SEQ ID NO: 52915 - protein, 77 aa, Sorghum bicolor
  Clone ID: 13152788.pep
QLTLMVSPDHHISICHGRLWSSGARRRRPGMRGPPVASVTDQLVQGDEGHPGHDGLAGDRRDFLLHLRLLEPRGDPE

SEQ ID NO: 52916 - protein, 129 aa, Sorghum bicolor
  Clone ID: 13152792.pep
LLADSDAMSMEVTRKLLERLGCQVLPVSSGAHCLSLLGGGAADPSFELVVLDLHGHGGAAAMDGFEVALRIRELSRSTCWLLVLVAVEAGGVDDGVRDLCRRAGVDGLIHKPITLPALGAQLRRVLQNN

SEQ ID NO: 52917 - protein, 154 aa, Sorghum bicolor
  Clone ID: 13152796.pep
LCQKHGKVAQFETWQKGGMTMVNVFVGGEMVGLGSSEQKVIAKLNAARDALGKLIGGAKQQVLINGIANGLVDEIVELRECKQKLTEQCIGKHWPKPIFKLEKEGGPAHERNFVCSVQVDTKTGTFVTIGDPMSRVKDAENSAAQKMVELLLKL

SEQ ID NO: 52918 - protein, 154 aa, Sorghum bicolor
  Clone ID: 13152806.pep
SRWIGTVNPHLHVPANAIIATAIFTCVVSLINIGSTVAFNAVLSLASNAMMGTYLISIGCVTYRRVCRLPLPKCRWSLGRAGLPINIIALAYACWCFVWSFFPNAYHVTPVNFNWACVLFVGLMGFASLMYIFHARHVYEGPVVRVLQMEGDTD

SEQ ID NO: 52919 - protein, 61 aa, Sorghum bicolor
  Clone ID: 13152814.pep
DKVVRPPAELVDDANPRAYPDFTWRTLLDFTMRHYRSDMRTLEAFSNWLNHGGHLSSPPPP

SEQ ID NO: 52920 - protein, 96 aa, Sorghum bicolor
  Clone ID: 13152825.pep
TSKLKFVDLIHSSNVNIKTIFIAMTKCTHCNVKYQLACHMWCCQQIHISFFSFPKYILLINMGSYPFENLIEPNTNRWACLKMSVVDNAPVRFGFR

SEQ ID NO: 52921 - protein, 104 aa, Sorghum bicolor
  Clone ID: 13152831.pep
TPKKRGRPSKKANGSTGSASAAGAVRRSTRGKVHSPESDDMGSFISEPDTTYQPSEETKRAVEAMESDGVAADGDVVSAGESTALALFLTFLGGLGQLAAGTLG

SEQ ID NO: 52922 - protein, 86 aa, Sorghum bicolor
  Clone ID: 13152837.pep
DVAQVGSSNWKFMTRDNGPAWSTSQAPPGPLQLRVVVTGGYDGKWVWADREVLPRRWRAGEVYDTGVQITDIAQEGCFPCDTHEWE

SEQ ID NO: 52923 - protein, 208 aa, Sorghum bicolor
  Clone ID: 13237391.pep
QPGDNATVTFVFLPKLLGSSSAHLVVQTNFGGFIIHAKGMAVSSPYQILPLTGIDVVIGGQLERNLSIYNPYDDTLYVEEVAVWMSSLESTRSLYEEEISANARTRTLGSMLQVEDSHDVKPMVMRAVKADDRILRQWKSHGTSDGISVLMDPEMLFPVVQIGSQFSQWIKVHNPSLERAAMQLIVNSEEIIDQCKTVTNVCELTFSS

SEQ ID NO: 52924 - protein, 158 aa, Sorghum bicolor
  Clone ID: 13237392.pep
VSIIQKLARKGASLILNTNPDSNHRVPGRGGKKAQHRSKKEDGLLQLQGWKAQRANWYYIYFNPWPYQTKATAAPDTCGEERKSFGLLGSKQLKGKNIIFPSIIICARERTAQETLKQLGNRIRGELLPAYLPDWWCGDEGPNSNSDLREATPDGASC

SEQ ID NO: 52925 - protein, 95 aa, Sorghum bicolor
  Clone ID: 13237395.pep
KININRYVTLCHNFLWHLIFSPVATHSKNQSQDLHRLRLTNNKYNVSFLSFSRTMHKLIEIYTIYIKSKSNLEIIIQKFIRLLSTREYKVPLRVK

SEQ ID NO: 52926 - protein, 98 aa, Sorghum bicolor
  Clone ID: 13237402.pep
MPPPLPPDPIEPCAPAPAMDAALPAAVVATILSRLDVRSLLLAAAACRGLRACASHALAFLPSFHLLEVALTHELLRPLLPLNPSLRSLRLDCARLED

SEQ ID NO: 52927 - protein, 142 aa, Sorghum bicolor
  Clone ID: 13237403.pep
HEDKLKFVSAFCQSNCGDVSPNVLGAFCTDTNRPCDFNHSTCNGQNELCYGRGPGYPDEFESTRIIGNRQFLKAVDLFNSASEEIQGKVDYRHTYLDFSQLEVNVSSSTGGQHQTVKTCPAAMGFAFAAGTTDGPGAFDFKQ

SEQ ID NO: 52928 - protein, 128 aa, Sorghum bicolor
  Clone ID: 13237414.pep
TRQPHSDSARGGSSRGRIKKTTARKKVGAGPRRRLGAGVESGIDSEMLGQEGWAGDEDGGDGRAEEVRGININEAAQATDGTGRVNVSNAGGVEDMGNFHIDVDATEDILGNLHNLPFLRVDNLGRMI

SEQ ID NO: 52929 - protein, 172 aa, Sorghum bicolor
  Clone ID: 13237419.pep
ARGNGNFEEAPAKSELNGTRVKGRDAIPHWEISGFVEYIGPGQKQGDMILPVPEGAYAVRLGNEASIQQRLAVTQGARYSVTFSAARTCAQAEQLNVTVATDSDVLPIQTVYTSSGWDSYSWAFEATRSAVTLIVHNPGVTEDPACGPLLDAFAIKTLQPPPVLAKNNMIQN

SEQ ID NO: 52930 - protein, 159 aa, Sorghum bicolor
  Clone ID: 13237431.pep
MAAATASTAGEGGVGGDNSAGALLRIFVGGLAESVGAADLEALFASAGRVAGVEFVRTNGRSFAYVDFHCPNDKALAKLFSTYNGCKWKGGKLRLEKAKEHYLTRLKREWEEDAAAAASKEAALKDNAENQKPKLEKAALEGMKINIYFPKLRKMKALP

SEQ ID NO: 52931 - protein, 112 aa, Sorghum bicolor
  Clone ID: 13237435.pep
MSKPWGGVGAWALDAERAEEEEREQALSFPAPEPPAAAGGAASFPSLREAAAAGAGGKSKKNKNKGTTLSLSEFTTYGAAAAQRRAEPVEPRGLTHDEMMMLPTGPRERSAE

SEQ ID NO: 52932 - protein, 52 aa, Sorghum bicolor
  unsure (1)..(52): unsure at all Xaa locations
  Clone ID: 13237446.pep
KLKIVSKQKRSRIASGRASRFATWSAWGSSSCVFPLSXLIQLALPASTPLFD

SEQ ID NO: 52933 - protein, 174 aa, Sorghum bicolor
  Clone ID: 13237467.pep
SPAPASSDSAPLAALLACNATRFQPACVSTLSGAASDASTADLLAATLSTLRARLPPAVTTAKSVLASSSNVNLTTAATNCLTFLALSSHRLSPSPSPSLISASTAMLHLYDCWSAYKYVNFSRTISDAMAYLDATITVNSNYISMLAARQRYGDDTSLWRPPQTERDGYWPPP

SEQ ID NO: 52934 - protein, 43 aa, Sorghum bicolor
  Clone ID: 13237471.pep
VRRSTHTGTYEQELLYQSPSTLDISSETFFKSKSPVSSYKLVN

SEQ ID NO: 52935 - protein, 186 aa, Sorghum bicolor
  Clone ID: 13237478.pep
GSRIILRKTSSECRLPAVRLADIPVNLPQEESISVAKVAIKQRPQKNFHGMNSSSAHSSRENLQKSVEERKEEYNKARARIFNNSNSSSATDGRSAEEVTLPSTLHRSTSLELNSSSRMGQGAEITLERSLTTTSASSRSNRSKIDKEPAVNRSRQNNRVAIFRDRESEREDPDYDRSYDRYMQRF

SEQ ID NO: 52936 - protein, 169 aa, Sorghum bicolor
  Clone ID: 13237489.pep
MADGAEMDEEAMRAFFPLSFGKAPARPGSAASSAHSSTLRKPQNPSNPKPPASTATDDDGAAMIGPPRPPPAPAEEDDDDKDRGGVMIGPPRPPPPSARGEGNDDDGDGMIGPPRPPPADDEDVDDDDDDEEDDGEEMEDDGEGGFNRIPLSNEIVLRGHTKVVSALAV

SEQ ID NO: 52937 - protein, 135 aa, Sorghum bicolor
  Clone ID: 13237506.pep
MAAAADGVAEDKEDPADGATTKGGSLIEELEDAIYKNQKAPISYSELAALKEGRFNASIQHRLAELEGLPSTTGEDLQMKCLLELYGLKLLDLQKKVRSDISAEYWLHKKCAYSERQLSDWGLMRIQYPLSMYGI

SEQ ID NO: 52938 - protein, 202 aa, Sorghum bicolor
  Clone ID: 13237514.pep
TRALRRGDRQRASMLLSNFHHTKEALTKEDFSYILEYCAEAPDPLFVMETLELMEEKAIGMSKSIYRYVIRALSRGGYAREALHWLAVLGEKESTHATIPIFNIFLNAFGSRADLKDAECCLEILESLFLGKSEITYCELLKLAVLQGNLPAAYDIWKDCSRYYSPSIITQRRFIRALTALGDLQSAYHILQHMVVLAARSS

SEQ ID NO: 52939 - protein, 172 aa, Sorghum bicolor
  Clone ID: 13237517.pep
TRDNRKDKMLAMLVEDEPRRKKKSLLPARDPKKMSAPRLKTMSYNDDEDFDAVLDGASVGFMETEREELIRKGLLTPFHKLKGFEKRVELPGPSHWQNDPSEQAEETIEASRIARVAQSMQQIAQSRPTTKLLDPESLPRLDAPTAPFQRLGRPLKRPVSPGSEQERKRQRN

SEQ ID NO: 52940 - protein, 110 aa, Sorghum bicolor
  Clone ID: 13237520.pep
ARGACEMTYGFLPCTDTAPGNLFLVLAYGFLMFKAATYLSAGSELLLQILGPGIAGGLFLPILGALPDAMLILVSGLSGTKEVAQSQVLIGMGLLARSTVMLLTLLWGSC

SEQ ID NO: 52941 - protein, 172 aa, Sorghum bicolor
  Clone ID: 13237524.pep
HEGKNSVEVAHDRRLLGVIYTGLEQHEQALEQNEISQKVMKSWGAAGSDLLHAEIDAANIKIALGKFDEAVSVLKNVAKQVEKDNEMRALVFISMAKALANQEKVGDTKRCLEIACDILEKKEFATPDKVAEMYTEVSSLYEMVNEFEKAISLLKRGLGMLERIPQAQHLEG

SEQ ID NO: 52942 - protein, 181 aa, Sorghum bicolor
  unsure (1)..(181): unsure at all Xaa locations
  Clone ID: 13237533.pep
SPPLPPPSATAAPPPAPRAGLSRLRRRPQPPAPRRSRPPNLAKSPRRSRRPXKKKRDKPEPQVGGKRKKQQASADAATPAKKRKKGGEGPEPKPQKEATPAKKHKPSGKPEKPATPGKKQKPAVKPATPAKKQQPAGKSXRRPRRSRSQQANPRRPRRSSSQPASPRRPRRSSSQPASPPR

SEQ ID NO: 52943 - protein, 132 aa, Sorghum bicolor
  Clone ID: 13237534.pep
MVLPHRTAELLEADEAQSFVHKLQLSVSKGLPHAVPVPGLRTEEHELVKAVFQVLQGFETSWLYWDSNVPRYREKAGIYVAHLSLTGLRSLLSPFLFTATCLKQVELFVGKVRMRRHEIPTLDAFASSVDSW

SEQ ID NO: 52944 - protein, 67 aa, Sorghum bicolor
  Clone ID: 13237542.pep
MATAAAAAVAAPEQPRRRKPAPGRGGVALPAGISEEEARVRAIAEIVSAMGELSRRGEDADLNALKS

SEQ ID NO: 52945 - protein, 175 aa, Sorghum bicolor
  Clone ID: 13237543.pep
ARGNYASESILGVVTIRAFAATERFIHSNMQLIDTDATLFFHTVAAQEWVLIRVEALQSLTIITAALFLVLVPPGAISPGFAGLCLSYALTLTAAQVFLTRFYSYLENYIISVERIKQYMHLPVEPPAIIPENRPPTSWPQEGRIDLQDLKIRYRPNAPLVLKGITCTFSAGNKI

SEQ ID NO: 52946 - protein, 162 aa, Sorghum bicolor
  Clone ID: 13237715.pep
SGTTIHVEPEIVEIEGPSPVLPQISEQESNLIRSPSPHGPGAMTRKGATTVDRQNSEISYYADDEDGNRKKYTKRGTFRHKFLRMLLPFWSSALPTLPVTAPSKKDSDAPEGSRPRHQRSSRMDPTKILLAMAILACILTMGILYYRLSQRGLSENFLEDAQ

SEQ ID NO: 52947 - protein, 158 aa, Sorghum bicolor
  Clone ID: 13237717.pep
LRRVMHPIDLVDKVCQHDEAHAIACSMPKLRHLEMGYMLIATEAVLEILGQCRDLKFLDLRGCWTVDDKFLRERHPGLRVLGPRVDDCYENSYWEECSDYSDDSSIYSWEFMDDDYYAVGSDDEAIWDDGQGLENLEVRFYGGGFSESFAGFDWPPSP

SEQ ID NO: 52948 - protein, 220 aa, Sorghum bicolor
  Clone ID: 13237726.pep
TSTDSASAHTELSSVAAAPEINSNGGRAISSETDDHGSSLESFWADLLESSMKNDTPIGASSCGGSLASNQQTNNGTRDSGNNILHANATSNAIFAPTTNVVSEAYANPGHNQASENYFGSLKHQANNSPSLLTSDLDSQSKQHANSLMKAPVYGNMPNDVPARQNSLGLWKYLDDDISLENNPSSGILPTEQVTDERPFHITDISSEWAYCPPPFFCYA

SEQ ID NO: 52949 - protein, 75 aa, Sorghum bicolor
  Clone ID: 13237728.pep
LRWLGITGSLNRVMVDALSRSRPFLHMACRGEELGSMLWDTSSDWYRHNDDDLDELEQWLLEGEPVSDDDTIMEE

SEQ ID NO: 52950 - protein, 51 aa, Sorghum bicolor
  Clone ID: 13237740.pep
HLVASREKLAKILLGSPVNILPTPLFFSRYTPSVLNYKMFCFFRYTCFCYV

SEQ ID NO: 52951 - protein, 183 aa, Sorghum bicolor
  Clone ID: 13237745.pep
AKNNMIQNGDFEEGPYIFPDAPWGVLVPPMDEDDYSPLSPWMILSTTKSVKYLDAAHYAVPHGARAVELLSGVETALAQDVATVAGRPYRLEFSTGDAGDGCSGSLSLRAYAASGSVTVPHESQGRGGHKRGVLDFTATADRTRVAFVSMAYTMKSDGTLCGPVLDDVSLVGLHSRAARRFLL

SEQ ID NO: 52952 - protein, 171 aa, Sorghum bicolor
  Clone ID: 13237757.pep
MALASSSTKNESAQNIGSTEPRKGYSWTQKSAWRDLVGGMGSTSFSISQVLPNNNPAPALHLNVTESERSSKSLEATTQLSSEQRLPSSMGMLSTGTTDESTDHAIGGEPKESNKPQKVRVVPKITISEVCPFMRNTESQKQWSKAKKVITGFTKKRNESSAGKGKPSNKQ

SEQ ID NO: 52953 - protein, 93 aa, Sorghum bicolor
  Clone ID: 13237761.pep
SQLESQLEQLSRELDDKIRFGQRPRSGAGRVTTHAPTSLGEEPQATVVDRPRSRGGMEPPPRQEERWGFQGSRERGSFGGSRNSDRPMARQRW

SEQ ID NO: 52954 - protein, 183 aa, Sorghum bicolor
  Clone ID: 13237765.pep
TISIWDIRTGKKPCISVKAHKADVNVISWNRLASCMIASGCDDGSFSVRDLRSIQEDSLVAHFEYHKKAITSIEWSPHEASSLAVTSEDHQLTIWDLSLERDAEEEAEFRAKMKEQANAPEDLPPQLLFAHQGQKDLKELHWHPQIPSMIISTAIDGFNVLMPSNIDTTIPGNTDTAMASAEP

SEQ ID NO: 52955 - protein, 163 aa, Sorghum bicolor
  Clone ID: 13237767.pep
HDHGVSQNSVPKAANHANQTGSQNNSNHSALVPVKPAPKRRGRKPKRVLPKQLDIPDICDRLTSSLACEEILYCEEVKNQAVSEIDALYDEIRPAVEEHERDSQDSVSTSLAEKWIEASCCKYKAEFDLYAAIIKNIASTPLRSKDDVAPREQNGLKYLENGS

SEQ ID NO: 52956 - protein, 126 aa, Sorghum bicolor
  Clone ID: 13237834.pep
RLPSAFHRCLQIHVIFFTITTTLLMIMMYGGSSATIITMRKYHLLMHMATMMNGTLTMLTLSSMKPKIISSLKQTGTTLLILSDFILKEIVFFSLRYGTISYNLNTSKFQQLGSRINIPVGVRTYF

SEQ ID NO: 52957 - protein, 79 aa, Sorghum bicolor
  Clone ID: 13237843.pep
NSTKRPARVQQRPTQYHACNRSISDTRCIAILLQSTFVTINCNYNIIVPKSKHHQINHNKFWVPAIVTCNTSNSSVTAM

SEQ ID NO: 52958 - protein, 91 aa, Sorghum bicolor
  Clone ID: 13237861.pep
VRIAKLQKGLIYGCPLEDVITVHLRSKTCSCRYWQVYVIPCQHDDMPLQKSNPLHLQGRRRDLDGRDRRKHGLGRASDAPAPDNSPGDFEP

SEQ ID NO: 52959 - protein, 159 aa, Sorghum bicolor
  Clone ID: 13238063.pep
HEALKSFMNHFFPSVDKVLSLDSRQECSNVIRSLCTATPKGIRWRDERSWMLIENIQWPETAADVVDDVVVTGVVRGKGLKADRIAHVPGWGDFQIDSITAAPLPTGRAKRDDAMNIDDNESTQVLDTPTAEQDDMAVVAPEEIEMEDEMLPEPEAEQK

SEQ ID NO: 52960 - protein, 203 aa, Sorghum bicolor
  Clone ID: 13238064.pep
HEALDLGDIPLIADEDTAHHTSQKFAEDWSRHVGDKARSRRRVVGSNSLALVLLKCFLGEILLTGFYALLRTLSIAVAPLLLFAFVWYSNQEERDLRVGLVLVGCLLITKLIESLSQRHWFFTSRRTGMRIRSALMAVIFQKQLRLSSQGRKNHSTGEIVNYIAVDAYRLGDAISWLHMGWSSPLQLVFSVATLFWALKLGAL

SEQ ID NO: 52961 - protein, 173 aa, Sorghum bicolor
  Clone ID: 13238072.pep
ARGYITGRFLPDKAIDLVDEAAAKLKMEITSKPIELDEVDREIIRLEMEKLSLKNDTDKASKERLSKLEAELESLKQKQKNLSEHWEYEKSLMTRIRSIKEEIDRVNLEIEAAEREYDLNRAAELKYGTLLSLQKQLEEAENKLVEFQQSGKSMLREEVTDVDIAEIVSKWTG

SEQ ID NO: 52962 - protein, 201 aa, Sorghum bicolor
  unsure (1)..(201): unsure at all Xaa locations
  Clone ID: 13238075.pep
ARGVASSSSQKKDKIHQRTINVTQDSSNNSASTELRASDSAAPLSDEQLALLLHQQLNSSPRVPRVPRCHQAAGAQMLHPTGASVFSKRYSSHGGRDHAAVIKKRNREDSLKDSEDTKRTEKRHRVSSTEHAPVKDSCRSAENIASEQKNRGICSTGANTGLAKDDLMDTVVSHNLPGLIDEIISXDRNITYGELCDAIHQ

SEQ ID NO: 52963 - protein, 193 aa, Sorghum bicolor
  Clone ID: 13238078.pep
ARGHDPLTVVIGESDPYVSIGGREINHLHAASVLMTVIMILAFLTSIAIARRIMIATSVLKVAAKVIGEVQALIIFPVVPYFILAIFYMFWFSATLHLFSAGQVIRNDCNNDCCSYDLKLGKVNCDSCCGYSIHYTPHIGIAILFHFFGCYWATQFFIGCSSTIIAGSVASYYWARGEISRDIPFHTVVSSLK

SEQ ID NO: 52964 - protein, 71 aa, Sorghum bicolor
  Clone ID: 13238080.pep
MMSRFRCNSKGYIGANVICINGSSCIGKTELALEFAYRYSQRYNMVLWIGGEARYLRQNILNISMNMGLDI

SEQ ID NO: 52965 - protein, 185 aa, Sorghum bicolor
  Clone ID: 13238089.pep
TRVKSPPPPTPVSAPPPPVKSPPPPPVPVKSPPPPVKSPPPPPPVSSPPPPVNSPPPPAPLSSPPPPVKSPPPPAPVSSPPPPIKSPPPMRSPPPPMKSPPPPAPVSSPPPPPVKSPPPPALVSSPPPPVKSPPPPKQLPPPPAPVISPPPPMKSPPPPAPISSPPPPPVKSPPPPAPVISPPPP

SEQ ID NO: 52966 - protein, 198 aa, Sorghum bicolor
  Clone ID: 13238097.pep
ARGLVLVPTRELCLQVYGIAQQLVHRFHWIVPGYIMGGENRAKEKARLRKGISILIATPGRLLDHLQHTASFVYSNLQWIVFDEADSILELGFGKAVEDILEHLGSRNGAPGQIKSKGEHIRRQNLLLSATLNEKVNRLAKISLRNPVMIGLDDQNKPSGKSNNVGNNHTSLLSDDEEDEMMGKQNDLVEHAGDDFKL

SEQ ID NO: 52967 - protein, 65 aa, Sorghum bicolor
  Clone ID: 13238099.pep
NLLGRIQIGFFWHFLDPLLAKHTSIVLKIYRKSISMIEEAMVLSCVWQRHYIAVVSFLVDIYRHL

SEQ ID NO: 52968 - protein, 151 aa, Sorghum bicolor
  unsure (1)..(151): unsure at all Xaa locations
  Clone ID: 13238106.pep
PCGGAAAXAAKTAPRSGPSPAPRGGCGGDSTAAGKHKAPLLSSPRSSSSAAAAANSSDRIAHLRAPRRKGHRGEVWRSRCERGDWRRWLGEERAMGRLAPSNRATGWRRGDERGGREARSLVFPPRLGVGTRSSVEKGVKSWFGLRIAILV

SEQ ID NO: 52969 - protein, 186 aa, Sorghum bicolor
  Clone ID: 13238109.pep
ARGLDAVEGPDGSARPSGAFSASGGGAAARRPNAHGGVLSRPLQPLSNRTQKLASHIRATPLEEWEGRMNVGMSNSVTTAIRDSIRDTAIGKIRNTEKADRATVEQAIDPRTRMVLFKMLNRGVFNNINGCISTGKEANVYHATKTDGQELAIKVYKTSVLVFKDRDRYVQGDYRFRHGYCKHNPR

SEQ ID NO: 52970 - protein, 131 aa, Sorghum bicolor
  Clone ID: 13238112.pep
MGAADKWLLPLVSVSFVSLLLFLSALSGFSASSALFARLPPPSYVRRGAAAPPSFAYLLAGGRGDGRKLLRLLLAVYHPRNRYLLHLSADAPASERAELAAAVARAAPAVRAFGNVDVVGRPTAGTPMGSS

SEQ ID NO: 52971 - protein, 180 aa, Sorghum bicolor
  Clone ID: 13238114.pep
MESPYALHLALAALVGASFAAASAYYMHRKTLDQLLRFARDQQRRRNRLLPDADELEGGEDDEDYPPAHRDHDRRTLPIPPGLPPLHTGREGGRPVISPGSTKRVGPIVRPTTPKSSVPTVSAFDRIEDSDDEEDLVPDAKNDTAYLAPNGAVGSDLTDKASQNGELKSAPSTQMIRSHS

SEQ ID NO: 52972 - protein, 98 aa, Sorghum bicolor
  Clone ID: 13238116.pep
PIPDDLFFCSGNDPFVSSIDCSVHERDQHQLDLMITLSKHGMELLHRPALSDSTRLYPLLPLSLSLSLSAGGTNTHPESSVLAAASRGHVNRRLSPQP

SEQ ID NO: 52973 - protein, 184 aa, Sorghum bicolor
  Clone ID: 13238118.pep
ARGSALFGLPDSLYARPNTFGELMRAIISPSSKVQEAVDWVLKGANPDIVLHTRMMANRPVRARKAAVLCIKRALQISHIKGTPLVALVSDTPAFVKELKSDISEFAEVLYFDYKLFAKTSGLEIVGNDKPLDFRSRDWGSAPRWVAFVDFFVAAQARYAVVTGAHRRVGTTYAQLIAALAAAN

SEQ ID NO: 52974 - protein, 61 aa, Sorghum bicolor
  Clone ID: 13238132.pep
NPRKNKSRLEHIGTLQCDLETQLNQPKDNICVCKNIDYIWETFYTESCDIFDTVILATNIL

SEQ ID NO: 52975 - protein, 166 aa, Sorghum bicolor
  Clone ID: 13238133.pep
MAVYYKFKSARDYDSIPIEGQFISVANLKERIFESKHLGRGTDFDLMISNAQTDEEYADEATMIPKNTSVLIRRIPGRPRKPIVTEPDESKAAEDGVEQVMPTASAFLGDSSMKYHEESEWDDEFGNELYVSDSVPSQPACQAVDDSENKVDEDSKIKALIDTSAL

SEQ ID NO: 52976 - protein, 92 aa, Sorghum bicolor
  Clone ID: 13238135.pep
MLHELLLALLGFTGDFVLDASPPRRRAASQEAGGDGDGDGDGEVGPAFRLAPDLTLLQPSERTAIERLISLGFYYRELNRFATESRDLSWIQ

SEQ ID NO: 52977 - protein, 88 aa, Sorghum bicolor
  Clone ID: 13238152.pep
KYTLSWFRFIKKFRCTKQFDETKMTMDDPDPSQEPTEIYGTAVTDDFIKSVPAPSLHLPIFFPFVLSRHKSSRFSFKLNKSTLIPAIT

SEQ ID NO: 52978 - protein, 156 aa, Sorghum bicolor
  Clone ID: 13238171.pep
ARGSNVLNFSAAQIVKDLMSNSFLHKTTVYKRIKTFLTEGFHMCGRKYSFLAFSSNQLRDRSAWFFAEDRMRTVETIRKWMGRFTSKNVAKHAARMGQCFSSTYATVVMQPHEVNECLEEVERNGYIFSDGIGKITCDLALEVAQKLRLTDNPPSA

SEQ ID NO: 52979 - protein, 82 aa, Sorghum bicolor
  Clone ID: 13238172.pep
DHTTVHEACPRPRLSKVLMIPDHMTMHEPCRRMASHKVDIMLLPDSPTLLLCGELRCSFIFLCLCYLRCSRFITVAANKISC

SEQ ID NO: 52980 - protein, 182 aa, Sorghum bicolor
  Clone ID: 13238183.pep
ARGKDAAFDYYHINSVDKDTQGNYLISARHAHSVSYVDGSTGAVLWTLGGKTNDFKDLSDGTATDFHWQHDARWRDNNTITLFDNTAHSNEDPEASSRGMRIHLDFESRTAELEVAYHHPQILKSTSQGNMQVLDDTGNVLIGWGHSAAYTEFTPDGNAICDVHFGASLYYTFGRVVSYRAF

SEQ ID NO: 52981 - protein, 150 aa, Sorghum bicolor
  Clone ID: 13238188.pep
TRHKATSTGLLDAGGLEEVLKVHVTWCSYLRRRAFLSDSTDEDIDVAEVGIRSAIESVQELGEKKYGPAYQGDPMFRLERIYIRFLSESGSWDSARETFRGLVARRGGSYEFWLAHYSWELICWSKFVQGEATVDAARRTPNPSYATAVL

SEQ ID NO: 52982 - protein, 148 aa, Sorghum bicolor
  Clone ID: 13238190.pep
MWRLKVARGGPWLRSTNGFIGRAVWEFDPDLGTPEERAEVDRVRREFSDRRFHRRESADLLMRMQCAKQKRYQRDLPCLKLEEDENVTEEIVVSSLRRALDQFSSLQASDGHWPGDFSGIMFIMPGLIFALYVTGSMNVVISPEHRRE

SEQ ID NO: 52983 - protein, 110 aa, Sorghum bicolor
  unsure (1)..(110): unsure at all Xaa locations
  Clone ID: 13238193.pep
MKLFSPAQALAALSLLSTDVVRPLTQALTLDPNSPDSIKDVSSKIAKQLVAQYATIDDKGVHVLXGYPGILYPPYYWWQAGAMFGTLLDYWHYTGDDQYNDMVRESLVHQ

SEQ ID NO: 52984 - protein, 109 aa, Sorghum bicolor
  Clone ID: 13238199.pep
HEAPWNGVKQQQFVPKDWWVEDLTDLDIDAYKQVITAIKTKGMVPKDVIGEAIKAYTYKKLPSLSKVSMIHGDAKVRAMLVTITCLLPSEKGSVSCSFLLKLLNATNLL

SEQ ID NO: 52985 - protein, 149 aa, Sorghum bicolor
  Clone ID: 13238200.pep
TREDPKNPLNWPSSTKWLHVAIISIGTFTIPLASSIFAPGVVQVGQEFHVDNQLLQTVVVSIFVLGLAFGPLLAAPLSEMYGRWICYTVFNILYTVFTVACAVSTNMSMLIVFRFFAGATGSAPLTIGGGSIMDLFPMERRGLALSFVT

SEQ ID NO: 52986 - protein, 184 aa, Sorghum bicolor
  Clone ID: 13238207.pep
NDAPSEEAKNLEGSTGPLVSFCSAISSSSWASSSSPSSLPPSSSLPSSSPSLSPLASSSPLPSMSSSTSEPPSTPSSSSLSSSSSSSSPLSPSIASSSLLSSSPLPLTSLSESSERTGFPRPWRRCEIFSSMEVVRRRACSAATDSAYDENSHGDCAGPPRAGAPAASSSELSGSNRKLGSMAK

SEQ ID NO: 52987 - protein, 161 aa, Sorghum bicolor
  Clone ID: 13238216.pep
MAAASAAAAAEANGESKDEFLIRDDAPGLLAALKEMKDGLDLVRGKVEAITRKVKENQLPTANGIGYLDAKNQLLLGYCQDIVYYLLRKAKGLSVDGHPVVRSLVEIRLFLEKIRPIDKKAEYQIQKLTNAADNAIAREKTGNAEAKGKGEHSDEDDPLKY

SEQ ID NO: 52988 - protein, 195 aa, Sorghum bicolor
  Clone ID: 13238229.pep
HEAFSQMRLSEASAHLASFSARIRDEASHTQLNSSKEVSVIAEWVAVTAVKAADAVLSTCPSIYEKRCLLQLLSEVDFADGGTSSSNFSRRYWKINLSEPSLCKDGDIYNWNDLMDDASLLTSLEKDGQWEQARTWARQLESSGIAWESTLDHVTESQAEAMVAEWKEFLWDIPQERAALWGHCQSLFMRYSFPP

SEQ ID NO: 52989 - protein, 173 aa, Sorghum bicolor
  Clone ID: 13238245.pep
MHGNGPRFMPGLMPHQLQRPNGLMPPQMQPPRQHGMLPIQQSSPQFSQLHAQMIGPHHSPPQSMQMFGPQHPPSQVMSRFDVNFAMPDLSDPRARSMLQHGRLGQRYPHQGYELNNIRMDNGWPRFRSKYMSTEEIENIARMQQAATQINDPYIDDYYHQACLAKKSASAQLK

SEQ ID NO: 52990 - protein, 118 aa, Sorghum bicolor
  Clone ID: 13238257.pep
HEDLAAMASQLAVLLILLLPLAGASTDDGFIRQVTDGRRSRAGAGALGLLPEAQFAAFVRRHGRRYSGPEEYARRLRVFAANLARAAAHQALDPTARHGVTPFSDLTREEFEARLTGV

SEQ ID NO: 52991 - protein, 162 aa, Sorghum bicolor
  Clone ID: 13238260.pep
QVCSPEAVIFGADFAQSLYCHLLCGLLYADEVRIVSATFAHSLVLAFQTFERVWEDLCADIRAGSLSQTRVTAPAVRRAVEALLTGPNPALADEVVRRCAGLSNWYGVIPALFPNARYVHGIMTGSMEHYVKKLRHYAGGLPLVAAEYGASEGWVGANVEPE

SEQ ID NO: 52992 - protein, 151 aa, Sorghum bicolor
  Clone ID: 13238261.pep
MVIPVQKPLLAKPYGLTWQLFCCSYQNYLTKETSDLLLSLLKPVLVLSGHDHDQCTVVHSTPFGPVTEHTLGTISWQQGNLYPSFMLLSAGPKVSQNSTDPEHEVVTNLCFLPKQTHIYVWYICQFVVTILLLVFWPTNGLSSLPCMNTLV

SEQ ID NO: 52993 - protein, 166 aa, Sorghum bicolor
  unsure (1)..(166): unsure at all Xaa locations
  Clone ID: 13238272.pep
LILKNNNLVGVIPSTLSQLPNLKILDLAQNKLSGEIPNLIYWNEVLQYLGLRSNSLEGSLSSDMCQLTGLWYFDVKNNSLTGTIPETIGNCTXAFRDLSNNHLTGEIPFNIGFLQVATLSLQGNKFSGPIPSVIGLMQALAVLDLSFNELSGPIPSILGNLTYTEK

SEQ ID NO: 52994 - protein, 187 aa, Sorghum bicolor
  Clone ID: 13238273.pep
HEGRCSSPCSPSASSSSPRSSPSTSSAASATAAAAAPAPRRPPPPPPTAAPQATTTTTMTGTRRDAASSRRQCPPPPPTPAPSFSTSAPSPPRRRRDRSTPGPAPIYALARRSSALCRRFRASDRRPASSHPAAPPPTPAPCLPPPLPMPRPPRSLPPRRRLPHPRSAPAPSISARRPSRSRVAELP

SEQ ID NO: 52995 - protein, 143 aa, Sorghum bicolor
  Clone ID: 13238285.pep
VLAIALPIVAAAILATIVLCSCLWRRKRKPGKSTLPDTTNPEDIQSIDSLIIDISTLRAATENFDEANKLGEGGFGSVYKGILPDDQEIAVKRLSQTSRQGMEELKNELVLVAKLQHKNLVRLVGVCLEDHEKLLVYEYMPNK

SEQ ID NO: 52996 - protein, 32 aa, Sorghum bicolor
  Clone ID: 13238295.pep
DWRWAGSPILTIFVFPLTRLAILFKVTSRVNY

SEQ ID NO: 52997 - protein, 96 aa, Sorghum bicolor
  Clone ID: 13238297.pep
KKNWARDQAKRESMPPCGPDGEYDPSPGNVRALLAAADEMLKQRNVESVLFEGRRVGEQTNAEKLDWFAAELVAEHRCRGSRIAPTVAFKQAPQKP

SEQ ID NO: 52998 - protein, 139 aa, Sorghum bicolor
  Clone ID: 13238308.pep
LVFKTRQSQNDDPEVLDAADSEPLDINNLDLIGTGTVVAPDQARVVAKRAILTGHPFKIHKKVVTIRYMFFNAEDVNWFKALQLWTRRGRSGFIKESLGTHGYLKATFDAKLNPQDSVGISLYKRVFPRKARALEDVVY

SEQ ID NO: 52999 - protein, 79 aa, Sorghum bicolor
  Clone ID: 13238310.pep
IDSATDAILQKVIRQQFSSCTVITIAHRVPTVTDSDRVMVLSYGKLLEYETPAKLLEDKQSAFAKLVAEYWANTKRNST

SEQ ID NO: 53000 - protein, 149 aa, Sorghum bicolor
  Clone ID: 13238318.pep
EAVYEIMKKQVIEMARQTFRPEFLNRIDEYIVFQPLDTSEINHIVEIQLNRVKNRLKQQKIHLQYTTAAVELLGSLGFDPKYGARPVKRVIQQMVENEIALGVLKGDFKEDDTVLVDVSSAAIAKGLAPQKKLVLQRVENRNEELVAND

SEQ ID NO: 53001 - protein, 99 aa, Sorghum bicolor
  Clone ID: 13238321.pep
MRTRPERDSEGSADLHQDDLPRGKRKGRKRRRLELKGRRVRDTRKRSSIDSSSEDAAATLSDSSSDRNNNPMDDENKEDNSVAPEIGGCIDAKGADSSS

SEQ ID NO: 53002 - protein, 122 aa, Sorghum bicolor
  Clone ID: 13238322.pep
LRNLDEIERKVASHRRRLQSEYGLSTSADGANRRSSERTSSERKERRDDAHDYPRKRRRSQSRSRSPPRKSQERDREHNRSRDRSHGNDAGRDRVREKSASRGRDDHYDRSRDREKDRRKGR

SEQ ID NO: 53003 - protein, 91 aa, Sorghum bicolor
  Clone ID: 13238328.pep
NYECMRALRACLRMQLAGFIPFRSCSAPTCSAGLMYMVEELRDRWMTEEEEDEDDDEEKDTLYVAGSSSLVYSRPGGRLLLPIEFVVTDDC

SEQ ID NO: 53004 - protein, 66 aa, Sorghum bicolor
  Clone ID: 13238334.pep
SGWKPVPLVDIIEGAAVKKAYQKALLCLHPDKLQQRGAAMHQKYIAEKVFDILQESWKEFNSITFG

SEQ ID NO: 53005 - protein, 53 aa, Sorghum bicolor
  Clone ID: 13238342.pep
GKPSRNLILDVIRRDYNRIDVTSIHSIVWCSPTKPQHTITCIMSLQGNKSIDY

SEQ ID NO: 53006 - protein, 96 aa, Sorghum bicolor
  Clone ID: 13238352.pep
NVTHYDELVGSGVPFARKFKENEPLLDKIDDKVLRRWRHRPVPGAWCTGRRRWFSDPCSQWSNVNIVRPGPQAEKFRTYMNRILEESKSSNNSCKQ

SEQ ID NO: 53007 - protein, 73 aa, Sorghum bicolor
  Clone ID: 13238359.pep
QIRPLAQNSLGNARLCAYALIHHPISICYLHSDLITDQQQRYTNTCAADHQNWHRLGHDKKITSMANLKAWPL

SEQ ID NO: 53008 - protein, 80 aa, Sorghum bicolor
  Clone ID: 13238374.pep
PSMEISRSLKSGCTPREKIKHAMKILSLEVCVFLPIVGTVHHTGGSRRVAILSVGQGENGVVILPQILSRFSLGFGLRNF

SEQ ID NO: 53009 - protein, 75 aa, Sorghum bicolor
  Clone ID: 13238392.pep
SLHGGCAVIRGEKWSATKWIRVASFDKVHYPQGNCTDENESCSKWAALGECIKNPEYMVGTTALPGYCRRSCNVC

SEQ ID NO: 53010 - protein, 136 aa, Sorghum bicolor
  unsure (1)..(136): unsure at all Xaa locations
  Clone ID: 13238432.pep
YSTNLTTTRMTIAEKXEQLFTEKPSSCIPGHTLERLLGLTPRPDSEIFRLNMVMHYGQDAVAGIIRALVSVNGLRGPVSSFMLICVRLMIDQSLENLTEVGASPWTWPVNEQIIDLVHKSMYAFATGYLVDDKWLR

SEQ ID NO: 53011 - protein, 97 aa, Sorghum bicolor
  Clone ID: 13238438.pep
KRKRHKENHRSRNINKSKANANPIHAVKEFAPGTLSLHLDFMPVTSAAWRGSHRCSFWASRRRPWCPYGQLGSVSVRGRGCVVSVRGHPSGPVAEVA

SEQ ID NO: 53012 - protein, 101 aa, Sorghum bicolor
  Clone ID: 13238444.pep
PHQCGMKWWSTGFDGIGIGGVGPQMTALNVISVLNAQRVPAPYSHSTGGTSKGDPGLGSGSDDDRLPKFEKEITTADKAGAAILTILAAAMFIGGSYWMLI

SEQ ID NO: 53013 - protein, 171 aa, Sorghum bicolor
  Clone ID: 13238450.pep
ISGLGYLGLGTGNLIGLVVFSATSDRYMVLQAQRFGSAKPEHRLMLMIISGPIIAVGLFWYGWSAQAKIHWMMPIVGSGIVGLGNMLFFLPMVGYLVESFTVYAASAIAANAVLRSIGGALLPLAGYRMYDTLGYGWGNSILAFMALVFTPVLVAIYRYGEYIRTRWPVRL

SEQ ID NO: 53014 - protein, 88 aa, Sorghum bicolor
  Clone ID: 13238469.pep
LISLYIAKQCHQASALGNNRFFLPASVQPSSAQVEVARFLPSVIVSSASSPSSAASSATIDQCLKCRMPVKTRATPYLLQQSTASWSR

SEQ ID NO: 53015 - protein, 102 aa, Sorghum bicolor
  Clone ID: 13238479.pep
LHLDLVEAKDLRRDLSSTESTIIVSSVSSQLSICGDESFDTLFLERIALKLNESMCTVPKPLLSPRSSLSPLGFLIILPSIRWLTLQLTSLAQQLQNYLEKQ

SEQ ID NO: 53016 - protein, 90 aa, Sorghum bicolor
  Clone ID: 13238486.pep
FDLELMKDKGIEEEMVAMLQLALSCAAAAPEQRPKIGYVVKMIDEVRACGVAVEGSASPSHESMSMDESSGVSDSPAVSEGGGGGGALSQ

SEQ ID NO: 53017 - protein, 115 aa, Sorghum bicolor
  Clone ID: 13238508.pep
NFTAVPAGDEAQIRAALVRRGPLAVGLNAAFMQTYVGGVSCPLLCPRAWVNHGVLLVGYGARGFAALRLGYRPYWIIKNSWGERWGEQGYYRLCRGSNVCGVDSMVSAVAVAPVP

SEQ ID NO: 53018 - protein, 75 aa, Sorghum bicolor
  Clone ID: 13238513.pep
RGSVVARATAGKHRLEPDSSSILVDVGSEMTSEDGGKLARGSKSRVRKVLQRLFRVIQSIVVIAALNVPLYMMLL

SEQ ID NO: 53019 - protein, 76 aa, Sorghum bicolor
  Clone ID: 13238524.pep
QSQESICLSSVKEMAEWFIGVESGNDEAHMFRIFAGVREFLAMLDRICKEAGEVNSNNWVGATTASWMAAPMGMTP

SEQ ID NO: 53020 - protein, 71 aa, Sorghum bicolor
  Clone ID: 13238568.pep
LFLQGGIRKYGGKAHTLGLHRDINLCVNFPWTRRVQKPHERAGGRAGPQVGRPPSSAGQSACVTWIMLHHL

SEQ ID NO: 53021 - protein, 45 aa, Sorghum bicolor
  Clone ID: 13238591.pep
CCAGCSSPINKNLQSAGEWSASSAVNKLLLAAIYLLRMYCIVCLS

SEQ ID NO: 53022 - protein, 173 aa, Sorghum bicolor
  unsure (1)..(173): unsure at all Xaa locations
  Clone ID: 13238609.pep
EXAFIMPCKGILRFCAMSLPDLWRSRRDLKDVEGFDHSVVNDTLGACGDLPGEQQGPCLPYYVWQCGYTKKLSEVYSLMDFNFSEPIHSCFGETKIEFAHDGTCHGFAIWIDWVLDKENAIVISTGPESRYWKQGVQLLSKPVQVNRANSVMHVEAHFDAEMGELAFKSTTLS

SEQ ID NO: 53023 - protein, 33 aa, Sorghum bicolor
  Clone ID: 13238635.pep
VVTSFSMDSTDFLGWAGDFLPGCATMSAMVLPR

SEQ ID NO: 53024 - protein, 59 aa, Sorghum bicolor
  Clone ID: 13238657.pep
KKSIEKRGVELVLVNPTGEVMEKIQRANEAQNYFRPDCLYLTTAEAVASLSALAKMTKP

SEQ ID NO: 53025 - protein, 57 aa, Sorghum bicolor
  Clone ID: 13238667.pep
DYPYMIKISITPNRSGTSQLASVPQSQPPLQRADSYLSVSSHLPAESAIPDMVATLV

SEQ ID NO: 53026 - protein, 92 aa, Sorghum bicolor
  Clone ID: 13238680.pep
EDGGYASQCKPPPAADVVPQQEGAMARSLIPAVFLEPNKCAAGDFMPEPAMAPVMDFMEAILAGSSSTSAASASSLDSFSANAGMQSHCWIP

SEQ ID NO: 53027 - protein, 151 aa, Sorghum bicolor
  Clone ID: 13238683.pep
KRAVAVMHEILSFMLEKRLVTDHLTHFRREFVMPQKLMRLLLKHYGIFYVSEGGKRLSVFLTEAYDGTELIEKCPLVRWREKLLQLTGYRGRFKNLGKFDVSSDSDDYLLGRDDDDVLDVESENSDYILDGCSLSDDSEMDLGDADEFCKD

SEQ ID NO: 53028 - protein, 125 aa, Sorghum bicolor
  Clone ID: 13238709.pep
LSKRQPPTGPSTQVRSHERLARSAFLTRSLRLIDLISGRRTGDRRSHRTAARAPPAPRRCSCRSPGPPTPRRRKRMPSPSTPTSGRRRCHRDRGRRRRRRRGRGRDAAVKVRRRGLHGEHGQRRG

SEQ ID NO: 53029 - protein, 184 aa, Sorghum bicolor
  Clone ID: 13238719.pep
LRDKLVAQQSLFESSILVSREDFGRVVERMPQAISLGRAAVQKHVNFLTACGFMLSQVSKMVVACPQLLALNMDIMRMNFEYFKNEMERDLEELVEFPAFFTYGLESTVRPRHEMVSQKGFTCSLAWLLNCSDAKFDERMKYDTIGVEEMEREDSSDMNASMEEVESEEYEDSDYDDSDDEFVR

SEQ ID NO: 53030 - protein, 87 aa, Sorghum bicolor
  Clone ID: 13238727.pep
TPAKRHQQSTDDEVMDANWILRKLGKDAIGKRIEVHLTSDGKWHQGMVSNVIGGTLCIQLDNGRSENVELGKQAIRLIASRSKGGKR

SEQ ID NO: 53031 - protein, 162 aa, Sorghum bicolor
  Clone ID: 13238731.pep
LKALSRAITEDELIYIRAQYNLLEPDSGDGRICIDNFSTALLQNCTDAMKESRTLEILNALEPLAYRRMDFEEFCAATISPYQLEAVPRWEEIASTAFEYFEQEGNRAITIEELAQEMNLSAAAYSIVRDWIRPSDGKLSFLGYTKFLHGLTMRSGNTRRHH

SEQ ID NO: 53032 - protein, 150 aa, Sorghum bicolor
  Clone ID: 13238733.pep
LITSLNSGYYERIRNMYWEHPTESGEIISFHQPSHEEHQDSDKKMHNMKALAEIYLLSLSDVMVTSAWSTFGYVAQGLSGSKTWLMFKPENRTAPNPPCRQVMSIEPCFHAPPFYDCKTRKGTDTGKLVPHVRHCEDMSWGLKLVDTGEL

SEQ ID NO: 53033 - protein, 110 aa, Sorghum bicolor
  Clone ID: 13238743.pep
KKQFRITSTSKMEFMDIVATCRYDTYQFFYDMYSELKKSDEHKFAQEERKKEASFKPSRSCNIQEGRGRVKRTPRNLVDGSLLLSRRRRRRLSLGGRLVGLRRQCLLPRL

SEQ ID NO: 53034 - protein, 84 aa, Sorghum bicolor
  Clone ID: 13238758.pep
MEVHMKNDAAANNKEKTKLRMEIRCLRPQLDAHRGRLKEAMDEMKTMDAKYQEASTMLKRELSQNAREVLRLRGMLKELQSASN

SEQ ID NO: 53035 - protein, 184 aa, Sorghum bicolor
  Clone ID: 13238788.pep
ARSRASGVKGTYPVSFTSSCEQSGLRNALCASNQPGEFQDTDGMEPAYMEALNCGDYDGLIDLMDRTGPVLEKLSCETANELLRVIADQFLNKKFFDLALPWLEQIADLSTIYKPSQLFASVRAQKEFLCALEEAATGVSTEPALRIALAQLAFKLTKAFEVGPCRKISTRVCRENETILATAM

SEQ ID NO: 53036 - protein, 140 aa, Sorghum bicolor
  Clone ID: 13238854.pep
PYGVITIDAPELIEFEIDCGAGATTDYKSFSLRAPRLRLLGWRNQYAERIVIDVGRPGSVKLGGIRLMSIYSRGMMYYREQMMRMLQGLLPNIPPENLDDVAEPYLTLGDWSDDDDDEPKHENEKQLTCNLRGLIMSHGI

SEQ ID NO: 53037 - protein, 143 aa, Sorghum bicolor
  Clone ID: 13238882.pep
VASGQVYGGNNRMAPLRNMFPNLVSKEDLASKEEMEPFKKHVTSLAALDFLVCLKSDVFVMTHGGNFAKLIIGYRRYMGRHRLKSIKPDKGLMSKFFGDPYMPWATFVEDVMITHQTRTGLPEPTFPHYDLWENPLTPCMCRA

SEQ ID NO: 53038 - protein, 110 aa, Sorghum bicolor
  Clone ID: 13238893.pep
NKETRHIVDKDVLEALGKDGIVINIGRGANIDEAALVSALKDGRIAGAGLDVFENEPKVPVELLSMDNVVLTPHSAVFTAESRSDLCEHLICNLEAFFAGKPLITPVLLP

SEQ ID NO: 53039 - protein, 106 aa, Sorghum bicolor
  Clone ID: 13238916.pep
SSLPLTLNLFTDGAGRQSVVCVCVRQVVAQRNERRQHVKRASCKMSVRTDWGREISTREKICVGEEIGRKATHFVVDGCQWLTTGQTLEQRQQGGGTAVMRLRRRT

SEQ ID NO: 53040 - protein, 141 aa, Sorghum bicolor
  Clone ID: 13238944.pep
KSKGFCVVCVAEAAGQDLLQKSGATDASGNVIFSDIGVHMQQKIKTHFKDIGVPADVKYIDPTYMVRACRANASDAILCTVLGQNAVHGAFAGFSGITSCICNTHYVYLPITEVITASKRVNPNSRMWHRCLTSTGQPDFH

SEQ ID NO: 53041 - protein, 34 aa, Sorghum bicolor
  Clone ID: 13238951.pep
PPCQTTYKHMDTVIAASSRLQAQSIMQDTKGQGA

SEQ ID NO: 53042 - protein, 65 aa, Sorghum bicolor
  Clone ID: 13238963.pep
VERMRARAQDKLMTQLASARHNADEKRAAAELKRNRAAARTAEQAEHIRRTGRVPPSFGCWNWCS

SEQ ID NO: 53043 - protein, 79 aa, Sorghum bicolor
  Clone ID: 13238969.pep
LHEQTTIESLHRPIKRLIDQVTENKGFIERKREVVSFSPNDKASVDSFLQEEKVSRNASFTRFYASVAENCQPKGRKTL

SEQ ID NO: 53044 - protein, 83 aa, Sorghum bicolor
  Clone ID: 13238984.pep
FPTDSVAGTALIDLLVAMRSGDERAVLLAYLHLEHVLIVLLLRLPLFIFVVVAATAALADHPEEADVADLETVVDAELMPPVL

SEQ ID NO: 53045 - protein, 162 aa, Sorghum bicolor
  Clone ID: 13238993.pep
AIFKMNPDTTQMEMLFCSTVVGLPFLAVPMVLTGELMTAWTSCSQHLYVYAVLVFEAMATFVGQVSVLSLIALFGAATTAMVTTARKAVTLLLSYLIFTKPLTEQHATGLLLITMGIVIKLLPENKEGRLRRLPKKTEERSGDDDDKPLESREADAEKASLV

SEQ ID NO: 53046 - protein, 138 aa, Sorghum bicolor
  Clone ID: 13239010.pep
HEDFLTEEKLLEAVEAGQVAIREICKAIDVLVQSCGKKKMVDAISLPPPELYRHVEDISGDELVKALQIKGKIPRRKALSALEDKVISILSEQGYVSKDASSGVTESLADIVEDEDEDEIIVDGEVDEGDVHIKPVSR

SEQ ID NO: 53047 - protein, 97 aa, Sorghum bicolor
  Clone ID: 13239019.pep
RQGIVPCLLNAPGHLERGVAVRPVIGGGRRAGHVGLLDCLHGRGARWRRPPTLPYAAAAPPPRPAGAARAAAGVAGPRRVGLAHARAGPRHARPPRA

SEQ ID NO: 53048 - protein, 122 aa, Sorghum bicolor
  Clone ID: 13239024.pep
MEMPPQQAAAAAANANANANGAAHGQDEGGSSSPPLSPASAALANARWNPTKEQVAVLEGLYEHGLRNPSAEQIQQITGRLREHGAIEGKNVFYWFQNHKARQRHRQKQDSFAYFTTLLRRP

SEQ ID NO: 53049 - protein, 82 aa, Sorghum bicolor
  Clone ID: 13239047.pep
NPKSRNPSQERLLQAEPSFEPRTTRQHLEPEAVGKDQTFAALERFRNSNKRFGAVPRSKNQEQETSGGFYWWDRGELELGLV

SEQ ID NO: 53050 - protein, 185 aa, Sorghum bicolor
  Clone ID: 13239048.pep
HEACLVRARKGDMRGQVLAVKVISKAKMTTAISIEDVRREVKILKALSGHSNLVKFYDACEDALNVYIIMELCEGGELLDRILSRGGRYNEGDAKIIVEQILKVVAFCHLQGVVHRDLKPENFLFSTREERSPMKIIDFGLSDFIRPDERLNDIVGSAYYVAPEVLHRSYSTEADMWSIGVITYI

SEQ ID NO: 53051 - protein, 120 aa, Sorghum bicolor
  Clone ID: 13239050.pep
MVSSKVQRDRLIGGLLAPGFDEQSCLSRYQSALYRKESPHLISSYLLERLREHEVLQKKCGPYTESYKKAIEQLKSGQDVMVGDCNFLVWVSYSGLGNRILTIASAFLYAILTNRVLLVD

SEQ ID NO: 53052 - protein, 98 aa, Sorghum bicolor
  Clone ID: 13239061.pep
MTSVRSSAASLAPSIRGAAELVRREALRRELDGCQLLAGIWCHGFTVAQLRSIRASLPPTARLVVTKNSDMAAAVAGTRWEALKPCARGMNAWLFVRS

SEQ ID NO: 53053 - protein, 202 aa, Sorghum bicolor
  Clone ID: 13239076.pep
TRRKSQSDHWEEEILNLRSTLLQSELEKERIALELEEEKKAKEQRDRCLIQQAKKIENLSSLVLNSDRDDRSTAFSKNKRRVTWCSGPNAKQFGVEDLGTVQEGSTSSTIRNRRDMGMPPLFEELMQESNDEPCANAYSSGDVSKDSEDVSLPDSHALLHVTNRRKPNAVKKSDQEQFLGRAGELLIPDPCDGNDALHHKNT

SEQ ID NO: 53054 - protein, 113 aa, Sorghum bicolor
  Clone ID: 13239078.pep
SRTRGRWGCASCRRAPPLRPLAPTLPGSRQAPPGGATLGWEVRTPANFPLDRRALATPVAPVRPKLEAGARVARPLGPPAAVAAPAAAAAPPAGAAAAPPAGVAAAAAPVTAA

SEQ ID NO: 53055 - protein, 196 aa, Sorghum bicolor
  Clone ID: 13239111.pep
ARGADTLPPEMIGPFLSCVIDTDAEQKSAVRKECIKVIGTLARLHGNLLAPHMAKMVSSVVKRLKDTDSVVRDACVDTCGTLAMCARSYGDGGAALVTLVRPLFESLGEQNRYIQAGAALCLAKVIDESNYFPGPVLPQMLARVVKLLKNPHFMAKPAAIDLIRSIIQAEGASTEQALSSALTSIMDALKSTDWNT

SEQ ID NO: 53056 - protein, 103 aa, Sorghum bicolor
  Clone ID: 13239112.pep
ARGVHVHTHATHGHAHGQAHDHGGHGHAGPPSPQDASSVAVSIRHRVISQVLELGILVHSVIIGVSLGASLRPSTIRPLVGALSFHQFFEGIGLGGCIVQVCM

SEQ ID NO: 53057 - protein, 128 aa, Sorghum bicolor
  Clone ID: 13239115.pep
GTRPSKVDSTCKSLQEELNSISHPSSHIHAPENPKFMKLMKLAKYSYMKNWEFLQDCAIRFLCVLSLDRFGDYVSDQVVAPVRETCAQALGAVLKYMHPSLVCHTFKILLQMQRRQEWEVRHGSLLGI

SEQ ID NO: 53058 - protein, 150 aa, Sorghum bicolor
  Clone ID: 13239130.pep
ARGVVALEVLSPSRRSGHGRELAGELPAAVGLLAELKEVSFPLHGLRGEIPGEIWRLEKLEVVNLPGNSLRGVLPSAFPPRLRVLSLASNLLHGEIPSSLSTCEDLERLDLSGNRFTGSVPRALGGLTKLKWLDLSGNLLAGGIPSSLGN

SEQ ID NO: 53059 - protein, 136 aa, Sorghum bicolor
  Clone ID: 13239136.pep
MAEPSPPPASNAGLRILLSKDRPAPSPPPTAAVSSHADRDRIIGVFRSALSRNEPPETFSLQTVQEAIKPQKETVLVLEENQSLENALRTLLQELVSSAVQSGKKIMQYGNSLDSGESNCPITRLLDIVLYLCERR

SEQ ID NO: 53060 - protein, 123 aa, Sorghum bicolor
  Clone ID: 13239162.pep
MAMPGGGVVAAKRCMNPACGGPASSVVGAGGDWRKGWPLRSGGFALLCDKCGLAYEQFVFCDIFHQKESGWRDCSFCGKRLHCGCVASKNSYDLLDSGGVQCVTCMKNSAPQSASGQVVPKLF

SEQ ID NO: 53061 - protein, 126 aa, Sorghum bicolor
  Clone ID: 13239183.pep
GRLERAAAERDADGQDRVLVQEAAGGLRLVEVDVPEGEECVEVDLDDGRVEVDVAPRPGQHRQPHGLVEREEGGDLRAELERQRGDAVAAAGARASGSPCLLALAPAAPIHLLLNRRRLGCLSSLV

SEQ ID NO: 53062 - protein, 141 aa, Sorghum bicolor
  Clone ID: 13239200.pep
TRGTNIPANSAQANTGTYSSGPGMLGSSAAPRPVQDANNVPYGSSAAPRPVQDANNVPYGSSAAPRPVQDANNNVPYGGSYGGYQGTVVPPVGRAVESVPNVASGVSYGTTLAHNNTMNVGMVQSNLQQPSLDSHQNQRFA

SEQ ID NO: 53063 - protein, 82 aa, Sorghum bicolor
  Clone ID: 13239206.pep
SLVNEISASTHSSPVGDLQQIGKQMRGSVSGKMDILKQDADSSQHEPMVHEIMTTPNKRTIEKDSRVGQASKITPKTVKMTS

SEQ ID NO: 53064 - protein, 33 aa, Sorghum bicolor
  Clone ID: 13239210.pep
MSTMKFCRECNNILYPKEDRDRRTLYFACRNCD

SEQ ID NO: 53065 - protein, 130 aa, Sorghum bicolor
  Clone ID: 13239211.pep
TRPRSPAASASYRILVAAIACFALAALFSAPSVWARLNAPYLCRKEGIRLHCPRVSQRDSLWENPHAAATSWKPCAERQSHEVSDLVSENETSGFIFIHAEGGLNQQRIAICNAVAIAKIMNATLILPVL

SEQ ID NO: 53066 - protein, 162 aa, Sorghum bicolor
  Clone ID: 13239222.pep
RFRVLELATRASTEQAAAFLAAAAAEPDPPRAAVVMGGRSVRADAAFLDAVPSVRCLLSTAAGVDHIDLAECARRGVAVANSGTVYSADVADHAVGMLVDVLRRVSAAERFVRRRLWPLQEGGYPLGSKLGGKRVGIIGLGNIGSLIAKRLEAFGCVIYYNS

SEQ ID NO: 53067 - protein, 185 aa, Sorghum bicolor
  Clone ID: 13239237.pep
EPAHSSSVPGGSTSGSGNHSTLKLVGYILIGVVLAVVLVLIAMYCLSKYKEKKSRGDIYMKNKIGRVPQKLGEPKIKEAVEMKESPLKLKNNAEKAASNVVSDGREEQKLKMPTSETSNVVYDPSRRDGHNLDSSLAAVPGVVTVNKKEHVIDMEKADNFVEDQLHPPQPIAPRTEKVIVKPSVR

SEQ ID NO: 53068 - protein, 176 aa, Sorghum bicolor
  Clone ID: 13239245.pep
HEETIRGVVRIFTVAVTIVVVAVPEGLPLAVTLTLAFSMRKMMKDKALVRRLSACETMGSATTICSDKTGTLTLNQMTVVEAYFGGKKMDSPDNAQMLSADVTSLIVEGIAQNTSGSIFEPEHGGQEPEVTGSPTEKAILSWGLKLGMKFNETRSKSSILHVFPFNSEKKRGGVAV

SEQ ID NO: 53069 - protein, 164 aa, Sorghum bicolor
  Clone ID: 13239270.pep
HEDATFAGMNARSISAPKSKLAIQRELLALKKKALALRREGKVDESEEELKKGSVLGKQLEELENSSKPPVPKETRSLPSNPPYKVEPPNISLADEVYEPEVTDNDMQDPALLSVLKNMGWEDAGSDSVETTDKPSISSHVVPHKSSKTKGQLQKELLGIKRKA

SEQ ID NO: 53070 - protein, 137 aa, Sorghum bicolor
  Clone ID: 13239279.pep
MASALKTNGSFCSTQQQQFLQSTTDQFLHGSSHLNFKHCKSKKTIKPAPLCVRATSSKVELDFHDPSWKQKFQEDWERRFNLPSITDIYDLKPRPTTFSLKKNRTLTGDENVDMWNGYVNNDDRALLKVIKYSSPTS

SEQ ID NO: 53071 - protein, 134 aa, Sorghum bicolor
  Clone ID: 13239298.pep
RGWGGRLGTGARPLSPARMRTLRWCSPRRRPCILRTWRLHHRRRRRIWRGPWARRRSRRRPPPPRRRPAPCGACPPRAASRAAAWARTRRPGRGTASQCARTPWQRRRRVGGGDLRRRGGGCVARWWRRRRPRA

SEQ ID NO: 53072 - protein, 145 aa, Sorghum bicolor
  Clone ID: 13239299.pep
MIPQTSSVSSSASASAAPTPPVWPSPSGSGGDGMFPGSVSNSGGQQQLAISNGVLLAAVIFLFMVVVFVFLLYLYAKRYLGANPLLAPTSPSSRFLFVAASPLPQRGLPASVLRSLPVTVYAAAGAGSPRDKEKADALECAVCLS

SEQ ID NO: 53073 - protein, 183 aa, Sorghum bicolor
  Clone ID: 13239305.pep
ERGNPTRRFSPSLRYRRGDAEAAMAKKLGKKARKFARKNLQSAAKRNRKIRNQFNHRRGPRRGGSAGREDGDEDVPQQVHDSTMVTNDAAAATLIHGLEFPEDDAELDADLSDSDGYLSEDPGCPYYSDSEDEKAAKDCIMEDGLDRQNDDMNRDIKKQKKKLKKLLDKDPEFANFLEKWQSE

SEQ ID NO: 53074 - protein, 138 aa, Sorghum bicolor
  Clone ID: 13239307.pep
MDEEVGAAGRQQVQWKSYCRTLSLLAFQSFGVVYGDLSTSPLYVYRNSLSGRLNDYLDETTIFGLFSLVFWTFTLIPLLKYVIIVLSADDNGEGGTFALYSLLCRHAKFSLLPNQQAADEELSTYYHPGTDRTVVSSP

SEQ ID NO: 53075 - protein, 118 aa, Sorghum bicolor
  Clone ID: 13239329.pep
MTGGGEEQGRSLFGMSLTDRPRWQQFLICSSGFFFGYLVNGICEEYVYNRLQFSYGWYFTFVQGFVYLALIRLQGFTVKQMVNPWRTYVRLSAVLMGSNGLTKGSLAFLNYPAQIMFK

SEQ ID NO: 53076 - protein, 180 aa, Sorghum bicolor
  Clone ID: 13239349.pep
HYLYSNLNSTRNIKTNMISIISVRIPSVFISTHRACFFLGHIDITLSVHQSPSSKPSAQRPRSNVGPWPFSLNRCSKSNEAVNLTNAAKSPWSLVSSRVWYGRSSPRALPLFFPALISTSPTLVSSRVWYGRSSPRALPLFFPALISTSPTDDFQQKISIQISKLKLPLAPLSKTQTPRA

SEQ ID NO: 53077 - protein, 145 aa, Sorghum bicolor
  Clone ID: 13239383.pep
MQLRQMSWIQVPSIWPFGRLSALTTTEDGGLRFAVEQDCKLYIWSTKDADEVDTRWEQNGIIELNTLLPLDADLTKLDTVGFMDDLCTIFVSVDDAAYAIDLKTYKAKKVYKGAVDTIVPYVSFYTPALEADGTAEGPSAGGSSA

SEQ ID NO: 53078 - protein, 131 aa, Sorghum bicolor
  Clone ID: 13239416.pep
MVFLVDAAAVAAGYSLLQLAARCCGGGAMSSGRGDGGGRGRALSWCVFSCDQALAYVLLAAVAAALQASVVAKRGQPELQWMGICALYGAFCRQAGAGLATAVVAGLAAVLLAFLSAFNLFRLYGSGGTKS

SEQ ID NO: 53079 - protein, 36 aa, Sorghum bicolor
  Clone ID: 13239437.pep
QVRARCRARGAPVAVHRARHQLRVRRLVLQLIIRDA

SEQ ID NO: 53080 - protein, 159 aa, Sorghum bicolor
  Clone ID: 13239457.pep
LDSDWEARVSDFGTARMLGVHLTDAAAQSATSSAFRGTVGYMAPEFAYMRTVSPKADVFSFGVLMMELFTKRRPTGTIEENGVPLTLQQYVDNAISRGLDGVLDVLDPDMKVVTEGELSTAVDVLSLALSCAAFEPADRPDMDSVLSTLLKMSKVCGGD

SEQ ID NO: 53081 - protein, 131 aa, Sorghum bicolor
  Clone ID: 13239476.pep
LFNEYCSSVDQPNGRVPKSEVFDIDDSDSFEDWDQHLNEQACRQKSTELDNYLEEGLVPRKDDFDILNWWMCHATKYPTLAAIVQDILAMPASAVQSEAAFTSSGPVIPKHHSMLSIKTIEALVCTRDWTR

SEQ ID NO: 53082 - protein, 42 aa, Sorghum bicolor
  Clone ID: 13239493.pep
NQGPIDSMDNCFRVIFPEAGWLDIFLQDQLGVLLMGVHNTGP

SEQ ID NO: 53083 - protein, 51 aa, Sorghum bicolor
  Clone ID: 13239502.pep
EAMVSLISIRRFHHGVDPRYSSSSGELNYPHGPATRPSLVSYYISMVKSKM

SEQ ID NO: 53084 - protein, 114 aa, Sorghum bicolor
  Clone ID: 13239511.pep
VGLFLSHSGWNSVTEAAACGVPLLAWPRGGDQRVNAMALESGGVGVWMERWSWDGEDGIVSGREIGEKVKAAMADAAVRARAARASQEAAMAVAEGGTSHRSMQEFIGKLKATT

SEQ ID NO: 53085 - protein, 159 aa, Sorghum bicolor
  Clone ID: 13239526.pep
AEPDLARALARNAELGERVREMGAEGQAWQGIASGHEAAAAGLRATLEQLLLQQAPCAGAADEEGQGEGEAVVEDARSCCFEPERERRHEGGPHDDADDKQARGSGCTRAACRACGAADACVLLLPCRHLCLCGWCEAVVEACPVCAATKNASLHVLLS

SEQ ID NO: 53086 - protein, 98 aa, Sorghum bicolor
  Clone ID: 13239540.pep
NEKEERSKCVTAVECYVREHGVTVQEAKQALTCLVDEQWRCINQELYKSDQAVPIALLDPVLDLVRVMEEVYKGVDMYTKCSGVVDPIHKLLNECVEH

SEQ ID NO: 53087 - protein, 55 aa, Sorghum bicolor
  Clone ID: 13239548.pep
FSERYLGYACMNYTSSLVINNNHGFVIISTLDHIMLSFTVAGTLGARGVWATSLP

SEQ ID NO: 53088 - protein, 103 aa, Sorghum bicolor
  Clone ID: 13239559.pep
TLDQLLLQQQQPAAGADCGGGEAEDAQSCCFETSPSGLVADDAASRGGASSPPSPSCKSCGGGDACVLLLPCRHLCLCRACEPAAEVCPVCAAAKNASLQVLL

SEQ ID NO: 53089 - protein, 55 aa, Sorghum bicolor
  Clone ID: 13239563.pep
ADASRICTADTVDVGQTSYCHAVIHFQERKDNNPLNCTYPDLGLSAMGSNLMLMP

SEQ ID NO: 53090 - protein, 142 aa, Sorghum bicolor
  Clone ID: 13239564.pep
FTAPNPSKELQLTKQGTKVKVVEYGTVVEVVFQDTAILGAESHPMHLHGFSFFVVGRGFGNFDKDKDPTMYNLVDPPYQSTVSVPSGGWVAMRFRAANPGVWFMHCHFNRHMMWGMDTVFIVKNGKTPKTQMMPRPPNMPKC

SEQ ID NO: 53091 - protein, 88 aa, Sorghum bicolor
  Clone ID: 13239573.pep
TPYERRSNPMDKVTEAIMSHLKLHFDSPGAPQSESLSHLAHGMTKARAARLFYQTTVLATFDYINVTQLSPHGEELYGDILISRGSKI

SEQ ID NO: 53092 - protein, 113 aa, Sorghum bicolor
  Clone ID: 13239587.pep
LPAAAAAAAQRSPVQLQHTEIGKEPHRTPQNRPLEQLAETLHPPQKSSYRSSRRSPAVHIMSSSSLPPPSSSPSLKLARLRSFVRSFVRSSWLPVCRPVKHVLCLTGRAGLHG

SEQ ID NO: 53093 - protein, 76 aa, Sorghum bicolor
  Clone ID: 13239588.pep
PPHTPEGGNASAVCCRLHRHSISNSKDASSKAQCSPKSASKTGSATKSRVTKSREDLKASMKKVGQPSAANFTVQT

SEQ ID NO: 53094 - protein, 193 aa, Sorghum bicolor
  Clone ID: 13239601.pep
DAAKLGRLKQAASDETKSSIFVALTAFVWVTRTRALRMLPEQKSKLLFAVDGRLRVDPPLPPGFWGNAITFACCISTASDLLSKPLSVAARSIRDAIVRTDDAFIRSAVDYIELNSGARPSLTATTLVTAWNRLGFRAANFGWGEAMYSGPSELPQKEVAMFLLGMRDSQSIVVVIGMPVSCMQAFQETVDLV

SEQ ID NO: 53095 - protein, 140 aa, Sorghum bicolor
  Clone ID: 13239606.pep
YGNQIPSGGILTALYQFHSRDVSRLVLGTTTLLVIINCLTTYQIYAMPVSDNMEAGYVHKKNRPCPWWLRSGFRAFFGGINFLIAVALPFLSQLAGLMGGISLPITVAYPCFMWVAIKKPRKGTATWNVNWALGILGMAI

SEQ ID NO: 53096 - protein, 94 aa, Sorghum bicolor
  Clone ID: 13239636.pep
LHEILSLTMERRLASDKLDIFHNEYRLPCKLLLCLVKNHGIFYITNKGARSTVFLKEAYENSNLIDKCPLLKFHDRFASLIGRPCSNSDNMLAV

SEQ ID NO: 53097 - protein, 179 aa, Sorghum bicolor
  Clone ID: 13239707.pep
ARGNCTIFAYGQTGTGKTYTMEGGGGKALNGDLPSDAGVIPRAVKRIFDILEAQSSEYSMKVSFLELYNEELTDLLAPEESKFPDDKSKKPMALMEDGKGGVFVRGLEEELVSSAAEIYRILERGSAKRKTAETLLNKQSSRSHSIFSITIHIKECTPEGEDMIKCGKLNLVDLAGSET

SEQ ID NO: 53098 - protein, 176 aa, Sorghum bicolor
  Clone ID: 13239728.pep
TRLPMAYLYGKKFVGPITPTILALREEIYDTPYGEIGWSDAANKCAKEDLVCPRTLLQNVFWTSLYRCVEPVLSSCPVNKLRERALGNLMDHIHYEDENTQYLCICSVNKALNMVCCWVEDPNSDAFKRHLARIPDFLWLSEDGMKAQIYDGCQSWETSFIIQAFCATDLVNEYAP

SEQ ID NO: 53099 - protein, 190 aa, Sorghum bicolor
  Clone ID: 13239734.pep
TRGKIYTYDGLYKVVHDWVQTGVQGHVVFKYKLKRLEGQPSLTTSEVRFTRAEAPTTISELPGLVCDDISGGQENIPIPATNLVDDPPVPPSGFTYLKSLKIPKDIKIPSSIIGCDCEGDCATNKNCSCAQRNGSDLPYVSHKNIGRLVEPKAVVFECGANCSCNHDCVNRTSQQGLQYRLEVFKTASKG

SEQ ID NO: 53100 - protein, 77 aa, Sorghum bicolor
  Clone ID: 13239756.pep
HQRTTKYPNSRAKQFRTIMLIQEKYRLKLTMKRVPSDSKEQLNTLTLMQTNSLFKGPFGICTIASELQHHLNNLLNS

SEQ ID NO: 53101 - protein, 175 aa, Sorghum bicolor
  Clone ID: 13239766.pep
MAEVLSGSHEHHLSSALDGHYDEKRKSNVEYSEDEKKAKIASLKKKAMSASQKFRHSMKRGRKSSKVMSISILDDREPEEVQAVDAFRQLLVLEELLPSQHDDYHMMLRFLKARKFDIEKAKQMWSDMLKWRKEFGADTILEEFEFEEADKVAECYPQGYHGVDKESRPVYFERL

SEQ ID NO: 53102 - protein, 184 aa, Sorghum bicolor
  Clone ID: 13239776.pep
HTGRPFRLQHNSLEGTLPDEIFGLRQLTILSVASNRFVGPIPDAVSNLRSLSFLDMSNNALNGTVPAAVGNLGQLLMLDLSHNRLAGAIPGAVIAKLSTLQMYLNLSNNMFTGPIPAEIGGLAMVQSIDLSNNRLSGGFPATLARCKNLYSLDLSANNLTVALPADLFPQLDVLTSLNISGNEL

SEQ ID NO: 53103 - protein, 122 aa, Sorghum bicolor
  Clone ID: 13239787.pep
SATGLVAWCPGTLCLAASTDMVVWSQGVPAVQINQTSEDPIFTSLYPKSNKTAHLSTEFPGISARRPWRQNGMRSCAAGGRPACLSASASADARATPIQDLSAEWWWWWWWWSCWGWRKAAD

SEQ ID NO: 53104 - protein, 179 aa, Sorghum bicolor
  unsure (1)..(179): unsure at all Xaa locations
  Clone ID: 13239797.pep
MEHHIIQQAGEHEEEEEDGMRAEVAFEGLHSHNTFRYKHKKRSKVWEEYKPVFLNGKVQFAECLYCHSRMSCKDSNGTSHLWRHQKICPGKEDAAFRRLKDSYFPCVLVNQGEPVTPSDPVNQIISETLDDVNSVIPNRFKSKVWREFSPIYVEGKLQAADCVHCRKRXLSANKFGGRS

SEQ ID NO: 53105 - protein, 164 aa, Sorghum bicolor
  Clone ID: 13239810.pep
DVDMISSGQRHSFLGKYKVGFTNEGKILALDLEIYNNGGHSLDLSLAVLERAMFHSENVYDIANIRINGQVCFTNFPSNTAFRGFGGPQGLLIAENWIHHIATELQRSPEEIKELNFHNDGVVLHYGQLLQNCTIGSVWDELKSSCNFVEARKAVNSFNSNSRW

SEQ ID NO: 53106 - protein, 163 aa, Sorghum bicolor
  Clone ID: 13239818.pep
AFEERHVEHVHVSLILGAEEGRGQRGVVGVGSRKGGGLCLRLLLFILVTGERGGALAATLMLGSASSLGGEGGLLPLVFFSSSSFSAIRERRTLLEVESCRGGGILSLCRRRQESSEVVEANPHVRRRVRRGAEQVGEVDWVVVGRPGGGVGGGRGGVVGGRE

SEQ ID NO: 53107 - protein, 202 aa, Sorghum bicolor
  Clone ID: 13239819.pep
MACAGAARKVSAVLYHYPCPDGAFAALAAHLYFSAAAHPVRFFPNTVYDPIRSDSLPLEEIKEVYLLDFVGPPGFVEDISTKVERVTILDHHKTAFESLCGNATLGQNVTKVLDMQRSGATIAFDFFRNKLLTEVSTLRGNKSGKDVAEVKYVPDNKVETVHKLFKFIEDGDLWRWKIPNSKAFSSGLKDLDIEFNVNANSK

SEQ ID NO: 53108 - protein, 99 aa, Sorghum bicolor
  Clone ID: 13239823.pep
TTEPECNSSEDSSRKSTDCRDKTRPSIDQRHSTDRREKPRGSTDRRDKTRKSVDHPDKPRASVDQSDRPRKSIDRFGGMMKSVRLCNIDCFKVTATSGS

SEQ ID NO: 53109 - protein, 171 aa, Sorghum bicolor
  Clone ID: 13239829.pep
MRIKLACLLLIFVQVQRVVLGTHDVYIVTMEGDPVVSYRGGVDGFPATAVDLDEEMDVTSEAVTSYALHLRGHHDKLLDSLLVEGTYEKLYSYHHLINGFAVHMSSLQAEFLRKAPGVKHVERDMKVQKLTTHTPQFLGLPTGVWPTGGGLDRAGEDVVIGFVDSGIYPEH

SEQ ID NO: 53110 - protein, 157 aa, Sorghum bicolor
  Clone ID: 13239832.pep
TRVVSPVGETGMLVVDSVVPEGPAHKHLEPGDVLVRIDEEVVTQFLRLETLLDDSVGREIDLQIERGGVPLTVKLQVEDLHSITPNHFLEVSGAVIHPLSYQQARNFRFKCGLVYVAEAGYMLSRASVPRHAIIKKLAGEDIAHLDDLIAVLSKLSR

SEQ ID NO: 53111 - protein, 130 aa, Sorghum bicolor
  Clone ID: 13239862.pep
MGDLDPKRPSIRTLEESKWTRYFMQPSPLPCSSQPNQRIMDRRDELVWKVRCMIQGFIRNTEDLLLGMKTVDALQRLGLGYHFEEDISKFMHILSRTSMGGDDLFALALQFRLLRQHHYNVASEIFNNFM

SEQ ID NO: 53112 - protein, 51 aa, Sorghum bicolor
  Clone ID: 13239871.pep
AKVDLRAHCLPASQPAQMGRPHRRRPRGAIRRAQGLGSGRRCGPSGPRPRA

SEQ ID NO: 53113 - protein, 147 aa, Sorghum bicolor
  Clone ID: 13239873.pep
HEGYRDGEDASVNQEGGGIQFDIALNQEFDSFAHNFGQTYNTEDRQQPQHNAADVIVLSDSDEENDPIVRPPAVYANATTNGDSFPFVTDAAGTGYPERYQEDAGVGTSGLGLLNNNTGDFEINNWQMHSYPQPEQGFQFFGTDTDV

SEQ ID NO: 53114 - protein, 51 aa, Sorghum bicolor
  unsure (1)..(51): unsure at all Xaa locations
  Clone ID: 13239880.pep
MSSVYVLEPPTKGKVVVQTTAGPLDIXELWPKEAPKAVRILVQLCLQGYYD

SEQ ID NO: 53115 - protein, 154 aa, Sorghum bicolor
  Clone ID: 13239883.pep
MLQANKDKMSSSEDDFTALSEGSSEDDFTALSEGSSEDNLTSLSEHSSEDDFTRLSELTVGKNKCRVRVRVSRLWESFNPKNDISFGLDCLLIDDEGETMQARVLPDDIDQFEEQLTEGKVYALSDFTVGDTRESYMTCSNEFTIYFGRQTVVN

SEQ ID NO: 53116 - protein, 130 aa, Sorghum bicolor
  Clone ID: 13239886.pep
TRGLRNPSISLNGRLYSADCRDGCKLRVYNRELGSWTRFIDTRHHMGSSRSLEAAAFVSLNGKLCIIRNNMSITIIDMSDPTRVTEVDSARMWEAFARKGQHRSFMANLWSAITGRNLKTDIMHCQVLQV

SEQ ID NO: 53117 - protein, 114 aa, Sorghum bicolor
  Clone ID: 13239887.pep
PLHCIFSIARTLLNTRFQFAQIKLANRAHTRHRHTRRPESYLGDLALLHCMLLHSATNVRSTMGGVAKMPAAGLCWLLLGVVLAFGVAASPARASRNTHYDFVIKETKVTRLCH

SEQ ID NO: 53118 - protein, 68 aa, Sorghum bicolor
  Clone ID: 13239889.pep
GAVAAGLRLAGRRFLALLRLRLPWAPLRLMVQARAQHLVPLVVVILTHGVGLAMTSHCWIVRLSSARG

SEQ ID NO: 53119 - protein, 131 aa, Sorghum bicolor
  Clone ID: 13239896.pep
HEAMFFSETDGARFRGMRLEDLDEQYFNVNLGDDDFSHADHRHQAEAVNITLVDNFESGFAETDVFNRFERFDIADDETTVNISPDEHPKVPSTLVPSPPRQEDPPQQEEQYAAPFLVREEPQQGGPEEHK

SEQ ID NO: 53120 - protein, 115 aa, Sorghum bicolor
  Clone ID: 13239903.pep
MAGSWKMVAGVLLLLSLLPLASSSMVFKLDGSVYPVGHFYVTMNIGEPAEPYFLDIDTGSSFTWLECHAKDGPCKTCNKVPHPLYRLTRKKLVPCADPLCDALHKDLGTTKKCTD

SEQ ID NO: 53121 - protein, 102 aa, Sorghum bicolor
  Clone ID: 13239909.pep
MVVLANPPVVDQIPLLRSPGPRDTFSGVPVVDLSSPAAARAIVDACERFGFFKVVNHGVPAATMGRAESEAVRFFAQAQADKDRAGPAYPFGYGSKRIGLNG

SEQ ID NO: 53122 - protein, 68 aa, Sorghum bicolor
  Clone ID: 13239925.pep
TTAGVVGGLGVGGADSTSLIASCLLDDMGGGGGRPLHAARAPALALCCCCCRAPHLFGVLWEFLVGCL

SEQ ID NO: 53123 - protein, 89 aa, Sorghum bicolor
  Clone ID: 13239956.pep
MMERRLGRHVYLIPRTLPFMQLNAMSSFSAGHGRRPKKKLYHREPGLDKAMDLQKKPALLLRLRDLILAQKTGSLLVRDLEKEVGFVQK

SEQ ID NO: 53124 - protein, 97 aa, Sorghum bicolor
  Clone ID: 13239969.pep
RWQSGQITNFQYLMHLNTLAGRGYSDLTQYPLFPWVLADYESDALDLMNPHTFHRLDKPMGCQTEEGEEEFRKRYDTWDDPDVPKFHYGSHYSNAGI

SEQ ID NO: 53125 - protein, 73 aa, Sorghum bicolor
  Clone ID: 13239976.pep
WVVLNFFFCPVLAWSFAIIASVVVAKSSLRRFELQAQQDNVCFVDIGYISFIIVKSISCKKCNNCSSEEVYIH

SEQ ID NO: 53126 - protein, 133 aa, Sorghum bicolor
  Clone ID: 13239984.pep
MSKGAIIGASTVLVVAVVAAVCVVSFKGNNSSKGDGDENMSMSVKSVKAFCQPTDYKQTCEAELSKAAGNASTPSDLAKVIFGVTSDKIHKAISESETLKELKNDQRTSGALKDCNELLEYAIDDLKSSFDKL

SEQ ID NO: 53127 - protein, 212 aa, Sorghum bicolor
  Clone ID: 13239986.pep
FNDLEYVRQEDERRTLEDLYAFPTLLPCAKENALLSEILPMQKDSALASRVLKFIQNMSVKDPLQPVGIIQECLSKCIKRQVDHIGNQILSKLMGEWRLMDELLVLRAIYLLGSGDMLQQFLITIFDKLDRGNSWDDDFELNNLLQESIRNSADKMLLTAPDSLVVSLAKHDTHNGEEGPSTSKKGRALGFGIDALDMLNFTYKVSWPLDLI

SEQ ID NO: 53128 - protein, 174 aa, Sorghum bicolor
  Clone ID: 13239987.pep
MATQQGFSSTDLKTHRKNLPSLLAVAQPFLRGELEKIDPEIPSFLSILRSAGAGERHHKNGAFLAHLLNFHRIVRLWGAPSDIARCGLFHSSYANSYVNVSIFESSTTREDVQRLIGAPVERLAFLFCAVPRHKLIHEELHFQYTDTELRDHLAASDLSIKAARETGTFDASEA

SEQ ID NO: 53129 - protein, 134 aa, Sorghum bicolor
  Clone ID: 13316260.pep
MLPQYNVYPQCHGLPMISSFQFNPAGMNMHSSHLPTQNVWSSASSTPMPEETCNRSERRAAALAKFRQKRKERCFDKKVRYVNRKKLAETRPRVRGQFVRQASNTDITSTGDDISEDEDDDPSSREVDIVSSPE

SEQ ID NO: 53130 - protein, 147 aa, Sorghum bicolor
  Clone ID: 13316291.pep
ALMSMIDPTIPLVVGGSGSSSSGSGTSNGGGSNGSNDSDDDSNSNDDNADGGASGSSSTRASSVGIGVGVVGGAAAYGAGMFWVARRYRKRRQLHQRTNSTVEQQSEGRGGGSPFAAGGRLSPHSLRSNRTQMISAPVMAENSLGWN

SEQ ID NO: 53131 - protein, 147 aa, Sorghum bicolor
  Clone ID: 13316309.pep
GQSSEKTDVFGFGVLLVELITGQKALDFGRVANQKGGVLDWVKKLHQEKQLNMMVDKDLGSNYDRVELEEMVQVALLCTQYHPSHRPRMSEVIRMLEGDGLAEKWEASQNVDTPKSVSSEILPPKYMDFAADESSLGLEAMELSGPR

SEQ ID NO: 53132 - protein, 49 aa, Sorghum bicolor
  Clone ID: 13316310.pep
TPDFSVYSSVVSRLRSAGKDTQANNVIKYMTDKGHYLHLLSRFGGFRRC

SEQ ID NO: 53133 - protein, 154 aa, Sorghum bicolor
  Clone ID: 13316343.pep
IAKMIHDTGMNCRLPQTPRSPAAAASHYFDDVFTRQRRASLSGTRRNSVARSLTRTRSIGARSDWTNGGATSGAPSNAGDEDDDGDDEGASKDGQRSRQWSIYKEDPAEAKTDKDDPINKYVQEQLQRLKTNESAEYSEEIAASGDGADEKRDF

SEQ ID NO: 53134 - protein, 133 aa, Sorghum bicolor
  Clone ID: 13316359.pep
GSWAVCFTYATFFGIKGLADAGRTYQNSLPIRKACNFLLSKQLATGGWGESYLSCQTEEYVDSGRPHAVQTAQAMLALLYAGQVEQDPAPLYRAAKELINMQMENGEFPQQEIVGNFNSSLFFNYPNFRNLFP

SEQ ID NO: 53135 - protein, 116 aa, Sorghum bicolor
  Clone ID: 13316394.pep
WITGVPITHKADVYSYGMVLLEIISGRRNSEKIKEGRFTYFPIYAAVKVNEGGIMCLLDSGLKGNADAEKLERACRVASWCIQDAEDHRPMMGQVVRMLEGVMDVQVPPVPRSLQK

SEQ ID NO: 53136 - protein, 165 aa, Sorghum bicolor
  Clone ID: 13316402.pep
LSNTLASAGEWDEVSKVRKLMRIRGLKKDPAVSSFEGRDGLVHQFFAGDNTHPWMHEIKKTLLELRARLKLAGYVPVLSSVVYNVSDEEKERLLMGHSEKLALSFGLLTLESRSSIRIVKNLRICEDCHLFIRLVSKVEPIEIIVRDNMRFHHFRDGECSCGGFW

SEQ ID NO: 53137 - protein, 122 aa, Sorghum bicolor
  Clone ID: 13316419.pep
FQTIWLKHLLAPEVSCWTVAGERQSTRLRSLYLEAVLRQDIAFFDVEMTTAEAASRMSADTVLIQDALGEKVGKYIQLLTTFIGGFIIGFIRGWMLALVVLACIPPSILSFATVSRLRAQIS

SEQ ID NO: 53138 - protein, 89 aa, Sorghum bicolor
  Clone ID: 13316434.pep
IDVREECIKFGPVDNVKVCENHPQGVVLVQFKDRKDAAKCIEKMNGRWFAGRQIHASEDDGSVSHTLIREYDAEVSRLDRFVEELEEST

SEQ ID NO: 53139 - protein, 49 aa, Sorghum bicolor
  Clone ID: 13316450.pep
THNELEIKVSRLEEENEKLKKQKELEKILFSAPLPEPKYQLRRTGSATF

SEQ ID NO: 53140 - protein, 60 aa, Sorghum bicolor
  Clone ID: 13316454.pep
GGTDSGTYRAKELETLLVQQTVELRGPRNLKHYLCNFDLQQCSSKLTSFPSPISNLFKEL

SEQ ID NO: 53141 - protein, 56 aa, Sorghum bicolor
  Clone ID: 13316473.pep
GVHHRLMTSPTLMNLAQALAYHKTCYEDMPLQDSQATQEQQTIQNLCDTLRTILRL

SEQ ID NO: 53142 - protein, 69 aa, Sorghum bicolor
  unsure (1)..(69): unsure at all Xaa locations
  Clone ID: 13316474.pep
YLVDGRWTLAFSDEQSCKVAESMVIEEMKLQRDAVREQLKPLVEFDMPEDGLXSIPSLHMKPLLMMDND

SEQ ID NO: 53143 - protein, 135 aa, Sorghum bicolor
  Clone ID: 13316475.pep
SDHHSQQKSYRNIMPVMHHPTYMMKEVIVINDSPERRSEPQASMLFPPATPPTLPVPNNMPPHPFYRLPPQSPVFPRERAVGSMPVYANVGSVVGVNSSQGSQTEVANSYMPNPFFVQSRTGYINPPVYYSQNLR

SEQ ID NO: 53144 - protein, 73 aa, Sorghum bicolor
  Clone ID: 13316479.pep
DPAAVAMMEVGLLYQQREPSFMRPITCGIERCLARWLAQQRLQLNIQEMLAFFWQRLIRGRSYRHLMKEIGYK

SEQ ID NO: 53145 - protein, 115 aa, Sorghum bicolor
  Clone ID: 13316494.pep
NILITNHYVQALRKNRLFILDHHDHFMPYLDRINKLEGNFIYATRTLLFLKDDDTLKPIAIELSLPNPKGQRHGAVSKVYTPAHTGVQHHIWQLAKAYACVNDSGWHQLISHWYA

SEQ ID NO: 53146 - protein, 129 aa, Sorghum bicolor
  Clone ID: 13316497.pep
LNLRDEASRVMVAAPILAFVTTHILYLNFYELDKGLNMKVCTVISIAQCLLWALWAVMTRHPSRLKIIFVSIGGAVAVLLEAYDIPPRWGYVDGRAICLAVAIPLSYLWWSFAKEDAEMRTSAILKKTR

SEQ ID NO: 53147 - protein, 111 aa, Sorghum bicolor
  Clone ID: 13316519.pep
SLQRHPRFTAESLEKNKQIYLKIEDLSKKYQCSPAQLALAWVMHQGDDVVPIPGTTKSKNLDANVESLKVKLTAEDLEEIASHIRAEDVAGGRQYNSYAHTSWKYADTPKK

SEQ ID NO: 53148 - protein, 120 aa, Sorghum bicolor
  Clone ID: 13316526.pep
NNSSLPSNFKQKDNLEKQLTFTALHLLSFVSPNDDPSLKDFLTKKASFLEDWLKSLCTSFNNSEHQPLPTEAINDEDGFSPNVTQKVMLSSALQSLVGIYSGRNQQVITQRFEQLARSIL

SEQ ID NO: 53149 - protein, 91 aa, Sorghum bicolor
  Clone ID: 13316533.pep
PYFAGCLKKDPAIDIQLLKKQKLPYSLCQRHEQKKNPVSDVTNNSSFLLLSYSQAKLTSNMIAEPNSLHCTSASLVGAPSYVVAAFLSKLR

SEQ ID NO: 53150 - protein, 104 aa, Sorghum bicolor
  Clone ID: 13316534.pep
AHWCADRAMKKGHSSGRIWVPPPAVTETLMSYFEENKDVDGAEQYVESLKKVQKDLGTPVFEPLLRTYAAAGKKFPGMRQRLKIENVEVGEETDQLLDSICADQ

SEQ ID NO: 53151 - protein, 87 aa, Sorghum bicolor
  Clone ID: 13316535.pep
TIGLRIMCSWSKCWQDICMTFWEHHTCCLQQSSSVSKDGCILKDCFQKSQRAKSRSVRLCHSKQTDFGGKQYSILYLGRWHSNSLLF

SEQ ID NO: 53152 - protein, 105 aa, Sorghum bicolor
  Clone ID: 13316567.pep
ATHNVYVSPLRSSKMDTLLSPSSKSYYACVGESTYAFQSPSKDLKAINNRLNSVSSGKKVNGRLNFDVVSDLVVASSLSSDQNAKPAATEVVPIKTPVKCEPSDS

SEQ ID NO: 53153 - protein, 74 aa, Sorghum bicolor
  unsure (1)..(74): unsure at all Xaa locations
  Clone ID: 13316576.pep
PGSPKTPRPEWQQQPHATIQPQPPPPPRSPPIQPAPPTSQPAPQLIXAHPSPTPPTAASLHPPQSPASAPTQQT

SEQ ID NO: 53154 - protein, 111 aa, Sorghum bicolor
  Clone ID: 13316588.pep
HEGKVRILLCDGDATSSREVLRLLCNCSYHVTCAKSPRQVINILNYEGGEIDIILAEVDLPVSKCFKMLKYIARNKDLRHIPIIMMSNRDEVSVVVKCLRLGAAEYLVKPL

SEQ ID NO: 53155 - protein, 59 aa, Sorghum bicolor
  Clone ID: 13316589.pep
IRNPFLPPRLPRQINTGSQPRRPGSNTDRMHREGREIRTHLPNRTRVRSNEEFVRRGGG

SEQ ID NO: 53156 - protein, 83 aa, Sorghum bicolor
  Clone ID: 13316602.pep
MRWWKRSSSPSRSASSSSASTPASPARAATPRLIGGWGSGASSRRDGSGGSSEPQPRLSRARRMRFVVEDPEVGVSALGVDSP

SEQ ID NO: 53157 - protein, 169 aa, Sorghum bicolor
  Clone ID: 13316607.pep
TRIEHDHDTQAEDWHIAIEALCEVLPSLQPAIVYFPDSSQWLSKAVPRSNRREFVEKVEKMFDQLTGSLVLICGQNIVEASTAAPKDKEPKTLLFHNLSRLSPLSSSLKQLVGSLKGRKPSRSSDITKLFKNRIFIPLPKDDEQLRVFNNQIEKDRKIIISRHNLVELH

SEQ ID NO: 53158 - protein, 82 aa, Sorghum bicolor
  Clone ID: 13316608.pep
LPKQKVRKVHQEKMLDLLVDHDLGPHYDRIEVAEVVQVALLCTQFQPSHRPKMSEVVRMLEGDGLAEKWEATNRPAAGTGPP

SEQ ID NO: 53159 - protein, 171 aa, Sorghum bicolor
  Clone ID: 13316613.pep
TRLVGRICQLYPNASPSMLISRFFRVYSKWKWPNPVMLCHIEEGYLGLPVWDPRRNYRDRGHQMPIITPAYPCMNSSYNVSVSTRYVMTQEFTRAFEICQAIDEGKADWDALFEPYPFFESYKNYLEVNITARNEDELRSWKGWVESRLRTLVLKIERYSHEMILAHPYPK

SEQ ID NO: 53160 - protein, 178 aa, Sorghum bicolor
  Clone ID: 13316619.pep
TRASSSKEKGLLGGLLGGDDSSPTPTAKGSDSTVASPSASSTSEGLVGGLVGGLLGDDKPTPSSSGSASPSPTSKDLVGGLVGGLLGGDSTSSKPLFRPSGSGSSFRVGSPTPTPSEGLLGGLLGGLLGEPSSSGLQSISVNVPTSTPASATSSEGLLGGLLGSLLGPESSTSGSPSA

SEQ ID NO: 53161 - protein, 64 aa, Sorghum bicolor
  Clone ID: 13316639.pep
PLTRHVLERAYSMIPGAQLPPLRAARAISARLCPSRRLCSDGSRNGGESFTDTVKCNGDGVREG

SEQ ID NO: 53162 - protein, 166 aa, Sorghum bicolor
  Clone ID: 13316649.pep
ARGPSSHSSRSPRPSSSRAMASAVAASTATRFLPRRTDPWWPPRRARAALPPLTWRPPAVTVVAASFRPGEAEGGRRGRTRRRRARRAEQEEGVSLSSEKETVNSTPRAQTNKGVEPVPVSSTNRKGAIRRVTLVVLAAVVFGVSIALRDGAEKASEYFAGYLLEQ

SEQ ID NO: 53163 - protein, 153 aa, Sorghum bicolor
  Clone ID: 13316665.pep
MMAGYRRAISFPAPKPAADGAFALATASDKLAAYRIRSSSLPCRFHPLLLQLDDDVAALRLVIGQSSSPPPCGTPTASSVSAAASQVCRVLVSLSDLLHHPQAQEPLRRLGRSSRLAERLLDDFLRLADAHGSFRQALVALAGLQAETRAALR

SEQ ID NO: 53164 - protein, 181 aa, Sorghum bicolor
  Clone ID: 13316666.pep
TRRKGTIVHLNEFICDTIRDKRIIIIVKIEILQTACALIGNPKNYMAQIQGKVQDPNLSAIAAQNSGAPGMPESSVALRADQASNNLSYGGPFIDAQGMVGFSIGRTVERDHSNVFTGGSYGTLSAQNTVNANMVEPRFQQPSLISHQNQGFAVTGTGEALTPPGNAHRRHEHSYQQLPSG

SEQ ID NO: 53165 - protein, 107 aa, Sorghum bicolor
  Clone ID: 13316673.pep
ARGETVLEFLTAARDRNAASLVCRSWYRAEAQTRRELFIGNCYAVSPRRAVERFGGLRAVVLKGKPRFADFSLVPYGWGAYVSPWVAALGPAYPRLERICLKRMTVS

SEQ ID NO: 53166 - protein, 79 aa, Sorghum bicolor
  Clone ID: 13316676.pep
MAFGRGGKMDGRRPSSTSSSFCTTTTVVVFVALCLVGAWMMTSSTVFPLEISSNKKPVVKQQPAPVNFGASQDNAGEGS

SEQ ID NO: 53167 - protein, 77 aa, Sorghum bicolor
  Clone ID: 13316677.pep
MVIIDKHEVKSAEEARLKEDTNRTKYWKKYGPYVAERQWATVREDYSDDGDAWSHFTYDMARSRAFRWGEDGIAGVS

SEQ ID NO: 53168 - protein, 164 aa, Sorghum bicolor
  Clone ID: 13316687.pep
ARGPRASFFERQHESIDALINCVSDNIGFSEGKPVAAITIYKCLVHWKIFETEKTSVFDRLIQIFGSAMQKHDSNEDLAYWLSNSSTLLIMLQKSLKAAGSTGTSPQKRPQTQSSFLGRMVFRSSNITVDMDLVRQIEAKYPAFLFKQQLTAFVEGLYGMIRDN

SEQ ID NO: 53169 - protein, 77 aa, Sorghum bicolor
  Clone ID: 13316694.pep
KIDEHTYTTCSESDPWQPPLTCNRKKILIESSNLKIRTSRSGWASNIPGFTPTQNGGSKQGNITKWRKQAVCGVPHS

SEQ ID NO: 53170 - protein, 92 aa, Sorghum bicolor
  Clone ID: 13316698.pep
MRSPSNGRPPSAGGGAPPAAAADDDDFAFYCSFLQDAAPASATSPLALALDLDLDDPNPTAAGMTNGRRRRQRGAADESGAAAGEEVEAEVK

SEQ ID NO: 53171 - protein, 70 aa, Sorghum bicolor
  Clone ID: 13316713.pep
ANGGMPLRLPACWYCIRGGWYPDRGSGKLTPCCLGTTRSQELTAAATAAAARVPAVTIGAASNGVRVSVP

SEQ ID NO: 53172 - protein, 204 aa, Sorghum bicolor
  Clone ID: 13316724.pep
TRLRDAAVNQKLNPLRIIVQLKGSNVGAARTKQHTTDSISPRSTSLEDQLAQVKSAIDEALKFVPEQIPAVIAKLSHDLRSRAALSAPSLAELLDRFAKLMARSSSMQPSGGSGVSSQNLGNSKAKLESAPMTISAPEPSDMQNSGTLENGLKSVLLENPTAKIDQVSLCPSVEDSLVFTSLGGMKSELKRSADNEIKTKSNAY

SEQ ID NO: 53173 - protein, 166 aa, Sorghum bicolor
  unsure (1)..(166): unsure at all Xaa locations
  Clone ID: 13316730.pep
TRLNCENGEVTCYPIDGIHRYPQKAFTLEVTNMSECESACLRDCTCTAFAYNASCLLWFRELRSTIVLDSDLNGNRLYICRSTKQQSGSRIVPWNGSSKERIVPWKRLVLESMIGVIAVIVMSLILLLRCRQKLLKAXTVGGSGSLMVFSFVQIKNSSKQFSEKLG

SEQ ID NO: 53174 - protein, 119 aa, Sorghum bicolor
  unsure (1)..(119): unsure at all Xaa locations
  Clone ID: 13316740.pep
ARGAALLRFAHLTQPPLETFRVFSGLRRAHGRDLPFLPFAFSPLAKSAAAARSLPAAAGAHAVSLLLGGFDKHRFVENSLIGAYVACGDVGAARKVLDEMVVKDVISWTSIVAAYSXSR

SEQ ID NO: 53175 - protein, 96 aa, Sorghum bicolor
  Clone ID: 13316756.pep
LEQVMYEDASQVVTEAISSIRTVASFCAEKRVITSYIEKCQASMKQGIRSGMVGGLGFSFSNLMMYLTYALCFYVGALFVHEGKSTFKDVFRVSLV

SEQ ID NO: 53176 - protein, 96 aa, Sorghum bicolor
  Clone ID: 13316765.pep
PECAGTEETVQEGEVFIHHQDQAEAPNKAKRRSEQRGRGFASPGTGSRNQRPPQSEIRRRDWRWFVTDQPSAVADRSATSLLACARLKMGRTDPRA

SEQ ID NO: 53177 - protein, 72 aa, Sorghum bicolor
  Clone ID: 13316771.pep
PPDGEEEFTDDDGTIYKWDRTLRAWVPQNDASGSKENYAVEEMTFALDEEVFQAPDILGPSALEEISTLSES

SEQ ID NO: 53178 - protein, 75 aa, Sorghum bicolor
  Clone ID: 13316799.pep
TPFRTSPPPPPPRCSPWRSPPPPSRRRAPSPAAASSASAPPRSPTSPSSTSTARASRSPSRRAPHRRCCTGSASP

SEQ ID NO: 53179 - protein, 47 aa, Sorghum bicolor
  Clone ID: 13316808.pep
FQRPVGAVWECPIHNIHSIWVKPWLGISVVVDIAAVILCQCSRREVP

SEQ ID NO: 53180 - protein, 126 aa, Sorghum bicolor
  Clone ID: 13316812.pep
MRCAPPPAAAAWWPAHVRDGPSATRPGSCGSESELAPRARAVAAWRSGFTNMWLFWRTRNRFSLEELRYLTDQLQKVHVVNEANKDFVIEALRSIAELMIYGDQHDPSFFEYFMEKQIMGEFARVL

SEQ ID NO: 53181 - protein, 180 aa, Sorghum bicolor
  Clone ID: 13316813.pep
VEDPDSSEQLAHGHESNSAANNEVEEWQMDPTSTKESSPCLTSNRDMGPGGPQDNSSITSNGENSNQEHDLPLGQDSLDSPISTASTMSPPAALKDSRTNEEEPGPSTGRTVEEQITGCLNQETKTIPVATEGEQLPNEKPFRCSCKENISRESHQSAVARPMLNFTGKQVPQLHIGSRA

SEQ ID NO: 53182 - protein, 187 aa, Sorghum bicolor
  unsure (1)..(187): unsure at all Xaa locations
  Clone ID: 13316814.pep
TRDEFYIGLKQRRATGQEYSELLDEFMAAVRQNYGQKVLVQFEDFANHNAFTLLEKYRTNHLVFNDDIQGTAAVVLAGLIAALKSVGGTLADHTFLFFGAGEAGTGIAELVALEISRQAKVSVEEARKKIWLVDSKGLIVTSRKETLQPFKKRYAHEHEPVKDLLGAVKAIXPTALIGSAGVGQSFT

SEQ ID NO: 53183 - protein, 149 aa, Sorghum bicolor
  Clone ID: 13316817.pep
ARGTHSHSSHVAYSPPARAHHSASAPLIRLLSPKPHRTLPSPPRRHGRRRPAVARDPAACPRDRPPQPRASPARATAAPLPRTPRRRQVHATLPPPPPAVVRPAPRHRIRRLPPPHAEFSRRRPVVPTSRRPSVSPLAARPPPPPRDRA

SEQ ID NO: 53184 - protein, 178 aa, Sorghum bicolor
  Clone ID: 13316818.pep
MTVSCLFLMSTVSCLLKGRSLSQVDQHSESYLDQRCHLDEVLVLAGMFLYVISLGSSSFVEEEQYTWHFLTSTLYLIFLTKAIHSMLKGSNPTLGHKAEESFDKSNFSYATSFELTPGKRNVYKLCTILIVLVAGRVIRAWHQGGINWVHFPDISKLLAQADSSVVKSLQIISFLAVV

SEQ ID NO: 53185 - protein, 102 aa, Sorghum bicolor
  Clone ID: 13316824.pep
SLRRVAYTSTTVRPVRASFGAIQTISPFAYRTMASSTQKIKVKNPVVELDGDEMTRIIWQVIKDKFIHPYLDIDLKYYDLGLEYRDETNDQVTIDAAEAIKK

SEQ ID NO: 53186 - protein, 134 aa, Sorghum bicolor
  Clone ID: 13316836.pep
MGFLGRRPWLLFLALALASAAVAVAVEASEGDADPLYRACVEGCQKTGSLKETSIKHCLVPTDGQPADKSWYTHEPLYLQWKDWNCKSECRYHCMMERESERAKLGLQPVKYHGKWPLKRASVFQEPLSASLSA

SEQ ID NO: 53187 - protein, 171 aa, Sorghum bicolor
  Clone ID: 13316855.pep
TRQESSYPFHEKIPTDSSVEVEGTADTTATGQVSKARSSKILEHSPDDELEGEMVYLQSRLLDNAVVLKHRYEKLIAKVVQNLSRELNAFSKRKWDLIFVNQFLHDVREANKRGRKEKRHKEAQAVLAAAAAAIASSSRNSTVRKDAKEDAPESSPKLVAGSSRVGQRTSS

SEQ ID NO: 53188 - protein, 43 aa, Sorghum bicolor
  Clone ID: 13316884.pep
RGRARWPRRSSWRRRRVGVAYGDHASAWLYHEKVSYPCDCASC

SEQ ID NO: 53189 - protein, 139 aa, Sorghum bicolor
  Clone ID: 13316892.pep
QARKKHPAKAPEQAHTSRSTYRIVYISAEINPPLAALEACKVLIAAVEQDTASFLLLAERCRCMASPSASGSSRQQQNPAESHTPHHTAVLHHHHHHHSDEKRRNAACRGHCHGRICPLHWLLLPFTAYYKKSLPVYYL

SEQ ID NO: 53190 - protein, 116 aa, Sorghum bicolor
  Clone ID: 13316908.pep
PTHSVDLEQQNSGEDRAPISPTHNGENTRTELPHQAGRPSLVDPELPNSGPRNSGQISTGSPEWRQRGMGVGSGPRHGARFGEGHAPSSPDPGGGGGGSRGHHCSLPRAAGEEGLV

SEQ ID NO: 53191 - protein, 193 aa, Sorghum bicolor
  Clone ID: 13316915.pep
TRPSCCGSDGGGDGEVATKRAKLSSDASAGAGSEDRLSALPDDILVLIVRYLGTRAATRTSVLSHRWRRVWALLPALHFGYAEDPRQIGPALEAHEAALLVLSVLTRDADPDSVSAWLPVAARRLSGSLLFHNTEPERNVQEGDDEEAAQRGAFELPCLERATEVLLHLDFLGLAVPPAGVFARLTELWLDRV

SEQ ID NO: 53192 - protein, 135 aa, Sorghum bicolor
  Clone ID: 13316941.pep
TRGRGLVLKNWAPQTQVLRHEAVGAFVTHCGWNSVLEAVMSGVPMICWPLYAEQSLNKVHVVEDMKLGVVMEGYEEEPVTADEVEAKVRLVMESEEGKKLRERTAMAKEMAADAMKESGSSHVELGEFLRGLGSK

SEQ ID NO: 53193 - protein, 73 aa, Sorghum bicolor
  Clone ID: 13316948.pep
RPQMRAIFRCIGDKLIPLLSHAYRLMTNLYWTPRNWRRTCCNGPLLMKLGHLGLIRGLTLRGLVLANTSTRTA

SEQ ID NO: 53194 - protein, 97 aa, Sorghum bicolor
  Clone ID: 13316969.pep
HAISDSNRSTIYMDWGTKQRYPPLAKAAKRRRTATGMFVLRSVRCVAAAGVKAAQQQRKERLKGCKDSGILSTDELLLPSILLFLEMAGWSYSSPRH

SEQ ID NO: 53195 - protein, 100 aa, Sorghum bicolor
  Clone ID: 13316973.pep
NLYLGGQLLTLDEVKEGLPSHSQKVLSESKWTFITQEEHPHLSKPWLTLHPCATSDWMKLLLEETKATDKERSLQYLPAWLSVVGQAVGLKIPLELHSNS

SEQ ID NO: 53196 - protein, 37 aa, Sorghum bicolor
  Clone ID: 13316981.pep
KFKHGHDGHGKFKHGHGKFKHGKHGHGMFGGKFNKWK

SEQ ID NO: 53197 - protein, 132 aa, Sorghum bicolor
  Clone ID: 13316984.pep
RITRAGHRVADGRAPIGVPWTTRAVRRARGRVGVRGCRNARRRRRRETTLDRITTAVSGGCAVCVDAMLLRRGSRLDRCARWHERWRLGRRTQAEENEGALLSVVCLPECRDKSGGIKLVTVVLGYERDGLA

SEQ ID NO: 53198 - protein, 42 aa, Sorghum bicolor
  Clone ID: 13316994.pep
PSSHASHTPRRIASSIPTRRSSCSTGFELLMHLWLLAPMVPR

SEQ ID NO: 53199 - protein, 100 aa, Sorghum bicolor
  Clone ID: 13316996.pep
GHKEGPYKGHAATGDKVEFHGVAVLKVDEQLRAEDVEVYYDPGELLGGLLKGPKVAAASSEEDRGAVALAERLGEAAAVSASGAVPPPQACPFLNPGKPQ

SEQ ID NO: 53200 - protein, 67 aa, Sorghum bicolor
  Clone ID: 13317002.pep
METPHVTGIVAYAMANATLAGDTGLMKEWVRMQGLQRGDGTVLANNGVWETGEGVKASTVSPNGIKS

SEQ ID NO: 53201 - protein, 58 aa, Sorghum bicolor
  Clone ID: 13317007.pep
VPPHRFLHPYPSASRFICIICRLACSIFFSEILVREYPLLYTTGIYTAMCMLLVLRSY

SEQ ID NO: 53202 - protein, 53 aa, Sorghum bicolor
  Clone ID: 13317008.pep
FLLMVHATCYTKKEPLAMIGTCYNNCMYGCVPLYSACGIHVCLGDPTAKMRSV

SEQ ID NO: 53203 - protein, 93 aa, Sorghum bicolor
  Clone ID: 13317009.pep
PSGVFRPPAEEKDVPRKKITIKQPKGIDQQIHVEPRSGQEPTRKIRKIVELSSFEDKSREDDHWFGGEPSQMNSSHERRLGLDGKRSKAIVQI

SEQ ID NO: 53204 - protein, 63 aa, Sorghum bicolor
  Clone ID: 13317031.pep
SSECCLYSFCRSFRRYACDATSLACLHFAIASRRIRPPQTPAPSLALFPRRAPVPPLHPCLGL

SEQ ID NO: 53205 - protein, 99 aa, Sorghum bicolor
  Clone ID: 13317033.pep
LALISCYIPFFERMTAWPHADCQPEPRTMKANTKTPETNSTSWNTRHAAGGSIFLVVLIPASPVHPFAQLLPENLKGVLIILDSLIMLNNKQTKVCVCV

SEQ ID NO: 53206 - protein, 51 aa, Sorghum bicolor
  Clone ID: 13317038.pep
VSKVMQHPWVRAQHHPEEMESLLEESSMVSLEMTGTGNFSMEKRIVLPSGR

SEQ ID NO: 53207 - protein, 122 aa, Sorghum bicolor
  Clone ID: 13317040.pep
LDIGIERATGIVWNITGGNDLTLTEVNAAAEVIYDLVDPGANLIFGSVIDPSYTGQVSITLIATGFQRQEESESRSSQAGGDSNRGRSGWFSPTSQEDGHALQIPEFFQRKGRSGFPRVCTL

SEQ ID NO: 53208 - protein, 90 aa, Sorghum bicolor
  Clone ID: 13317045.pep
LKKMAQRDPQIHIQFHPTLILRLNQRGARDKMLWQKHPWQRRCDIYGVSSSLLVHIEMLRCTLREKSQANCRTKLVFIILLCILGTFPAA

SEQ ID NO: 53209 - protein, 50 aa, Sorghum bicolor
  Clone ID: 13317061.pep
CWLYIPSWRNHVTAPSCCKSTEPTRIIAAAAVIGVLLRPACCCCAVAGAL

SEQ ID NO: 53210 - protein, 37 aa, Sorghum bicolor
  Clone ID: 13317066.pep
DEVSMSLLAMFRRNLLVILIAGVQATPFDGKMWMVLR

SEQ ID NO: 53211 - protein, 35 aa, Sorghum bicolor
  Clone ID: 13317071.pep
SCWVNGRRSRSQWRSSDGLLETISGVICKTTGWPS

SEQ ID NO: 53212 - protein, 58 aa, Sorghum bicolor
  Clone ID: 13317097.pep
APWGSDGPRPGRGTAPPSSPSWLAGFSQLTTSGLDRTRRNRMIPLTSVDRQQPTGPSC

SEQ ID NO: 53213 - protein, 69 aa, Sorghum bicolor
  Clone ID: 13317101.pep
YKFESWPMGNAAGSPAAEEGRGKVAALLKQQGVDLKGAAKSATPVNEEAPPLLEGGGKLDAWRIDGNDR

SEQ ID NO: 53214 - protein, 139 aa, Sorghum bicolor
  Clone ID: 13317103.pep
TRYPAILVGKRKSSVFMRAILHVVDVNGGNRHGCVLTDPRASSLRPRGDSSRVQHKAISASKAVVDNVTINPVDSSDIPHLTGSNPVASLSPSTLISACDTYRKKFPVANFLHYPSLIANISANPSYVDSVFVASLLSL

SEQ ID NO: 53215 - protein, 46 aa, Sorghum bicolor
  Clone ID: 13317112.pep
VTVVCRTGLDGEWYKCILCLRQTCAFEHLGAPNQTNEREAWWISRR

SEQ ID NO: 53216 - protein, 74 aa, Sorghum bicolor
  Clone ID: 13317122.pep
SCCLYINSNSCAGVRRRYDNSRRSDFANLSINRSQKHLPKPHPLHHRTFPSPQSAPGFFHNCCTLFPGLDTPRA

SEQ ID NO: 53217 - protein, 60 aa, Sorghum bicolor
  unsure (1)..(60): unsure at all Xaa locations
  Clone ID: 13317132.pep
RRPAPPRRGPRRRPRCLPRRPSLEPGVRTAAAAAAVRQQQPRFHFVFXFXAQKRKNQPRA

SEQ ID NO: 53218 - protein, 35 aa, Sorghum bicolor
  Clone ID: 13317140.pep
PAPPASPCARPLRTRPRTCWRWTAVVVSVMRAAPA

SEQ ID NO: 53219 - protein, 65 aa, Sorghum bicolor
  Clone ID: 13317142.pep
MEATATAAADSSGGDRYRSHLAGDGEKHTVWRHGAPPSYDAVNALFEAERTQEWPAGSLEEVVQN

SEQ ID NO: 53220 - protein, 54 aa, Sorghum bicolor
  Clone ID: 13317145.pep
WQCLVVRIKLIVASLLQRRHLGIQVDPASLGGLVTPCRLGRKVYLARLLAFETM

SEQ ID NO: 53221 - protein, 126 aa, Sorghum bicolor
  Clone ID: 13317148.pep
AAGGVAAGVDGVGGAAGELFGLVLLLGMLVLGDGVHALHGGGFLNDRHVGHVGQQVEAVAFHRGGEAAECGVVEDAVNVGVVFVEIQAFEDFFDFGGDGFVAVEDDDVLLRHQTRGVPLPGLPLRG

SEQ ID NO: 53222 - protein, 49 aa, Sorghum bicolor
  Clone ID: 13317151.pep
VEGHVRPNFLPRIALANIWEPASRESCNNNIWEIVKASFGILLGRATLQ

SEQ ID NO: 53223 - protein, 89 aa, Sorghum bicolor
  Clone ID: 13317152.pep
HEDHQHMMPQTQHQQQQQQPAVKLENGGVLGGVKLEQQMGQPDQSVSTQMLRSSSGGVKLEPQVQAWRSLGADKMEHQSSDPSVFLQRQ

SEQ ID NO: 53224 - protein, 148 aa, Sorghum bicolor
  Clone ID: 13317156.pep
ARGTTPLANNLRHRRHRVSAACRAFFLSFFACQRRQKEQRRLLLLAGRRVSASSPSPSRPALRYKHTRFLRVTAHRSERSNEQHAADSPRDLARSQPSPHGTAAGQQQRRQEAQAHAASRRRRRPGGPPRRHARGRPRAPPAGRLLTP

SEQ ID NO: 53225 - protein, 109 aa, Sorghum bicolor
  Clone ID: 13317161.pep
TRPAAAARDERPPPTQRCGAVAAALGRARPPAAARGERLPFPGAVTQRRPTGECALAPGFVYSCLFILPKSGDGAQGTSTAYAISTSVSKIFGNGTTKFDDACMLRSAG

SEQ ID NO: 53226 - protein, 44 aa, Sorghum bicolor
  Clone ID: 13317162.pep
YTHLMGLQTPTSPSVYSANGISGYDGSYGAGLRYGSHMYTSGLY

SEQ ID NO: 53227 - protein, 47 aa, Sorghum bicolor
  Clone ID: 13317163.pep
MLLRSSSTPFLHHPFLSSSPSCRSRSSLHLRRAFCDGHLPSLHPCST

SEQ ID NO: 53228 - protein, 145 aa, Sorghum bicolor
  Clone ID: 13317174.pep
TRPPFTPTAATFDKHGDLIYVGNSKGEILIIDSKSIQVHAVVPIPGGSVVKDIVLSRDGQYLLTNSNDRVIRVFRNILPVKGSGEEIRNISNNSNEYGSHYDKLKANGTSCLVLSCELLDAITKIQWKAPCFSGNGEWIVGASAN

SEQ ID NO: 53229 - protein, 109 aa, Sorghum bicolor
  Clone ID: 13317175.pep
HEVGAGGNPEIGMNAGKESQELVEQAVAGADMVFVTAGMGGGTGTGGAPIIAGIAKSMGILTVGIGTTPFSFEGIRRALQAQEGIASLRSNVDTLIVVPNDELLTAVSP

SEQ ID NO: 53230 - protein, 165 aa, Sorghum bicolor
  Clone ID: 13317176.pep
HEGKNGMIKEMESVLLRMKSKQCRPDVITFNILIDSYGRKQIFDKMEQVFKSLLRSKERPTHPTFNSMITNYGKARLREKAEYVVKKMEELGYKPNYVTQECLIMMYAHCDCVSKARQVFDELVSSQNKVQLSSLNSMLDAYCMNGLHTEADQLLDTALQKCVVP

SEQ ID NO: 53231 - protein, 55 aa, Sorghum bicolor
  Clone ID: 13317179.pep
MAKTKQGKRDVDAYTIKGTNKVVRVGDCVLMRPADTDKPPYVARVERMESDGRGG

SEQ ID NO: 53232 - protein, 35 aa, Sorghum bicolor
  Clone ID: 13317193.pep
LNLTLVDLPGLTKVPIGDQPSDIDKQTRTLILDYI

SEQ ID NO: 53233 - protein, 155 aa, Sorghum bicolor
  Clone ID: 13317198.pep
MATERESKTFLARLCEQAERYDEMVTYMKEVAKLGGELTVDERNLLSVAYKNVVGTRRASWRIISSIEQKEESKGSDKHVSTIKDYRNKIETELEKVCQDVLDVLDDFLIPNAATGESKVFYHKMKGDYHRYLAEFASGEKRKGAATAAHDAYKS

SEQ ID NO: 53234 - protein, 77 aa, Sorghum bicolor
  Clone ID: 13317200.pep
GGTSNSSSREARTEQSRLMTLSKNLIARLPEQVRLTDNSSGGLLTRVLCARRELRPEMQQSSARVRTVDGGGRVPRA

SEQ ID NO: 53235 - protein, 34 aa, Sorghum bicolor
  Clone ID: 13317208.pep
YTITNVKPCLIRKDQAIMSSHENVNIQKINRTLV

SEQ ID NO: 53236 - protein, 113 aa, Sorghum bicolor
  Clone ID: 13317211.pep
FPVNYFLIDLEWSNRFSDLALANTGGFDTAHAAARAYDRAAIKFRGVDADINFNLSDYEDDMKQMKSLSKEEFVHVLRRQSTGFSRGSSKYRGVTLHKCGRWEARMGQFLGKK

SEQ ID NO: 53237 - protein, 84 aa, Sorghum bicolor
  Clone ID: 13317221.pep
MENTKLSSSLFAGTHFDRKRFAADFARFRKGPALPSAAATATAAPSAPSPEKKRKRKSGKAKAKKNKKKRAEDAAAASSNVVEG

SEQ ID NO: 53238 - protein, 147 aa, Sorghum bicolor
  unsure (1)..(147): unsure at all Xaa locations
  Clone ID: 13317228.pep
ARGTIGPFQPSKXEKAKLKVKVRLNIHGIVTVDSATMLEEDVEVPVSSANEAPKDTTKMDTDDAPSDPVSGTDVNMHEPKSADTTEAAPAAENGAQDPEEKSVPMETDAKVEPSKRKVKKTSVPVHELVYGALAAVDLXKAVEKEYE

SEQ ID NO: 53239 - protein, 118 aa, Sorghum bicolor
  Clone ID: 13317239.pep
HEALGRIGNLCVLDIEYCSSLQQLPSYIIGEFKNLRTINFNGCTGLQDLPSTLSCPTLRTLNLSRTKVTMLPQWVTSIDTLECIDLQECKELRELPKEIANLKRLAVLDIEHCSELCC

SEQ ID NO: 53240 - protein, 39 aa, Sorghum bicolor
  Clone ID: 13317243.pep
TSSCMRHVNLINTRSVMAFTGYVYKLYNQWAPSDYATLV

SEQ ID NO: 53241 - protein, 88 aa, Sorghum bicolor
  Clone ID: 13317249.pep
LAHGADITYAVQQLCLYMHAPREPHLAAMKRLLRYLRGTLGYGLLLSRSSSAELVVYTDADWAGCPDTRRSTSGYAVFLGGNLVSWSS

SEQ ID NO: 53242 - protein, 61 aa, Sorghum bicolor
  Clone ID: 13317257.pep
EVVGGDRAQGLVQLGGHAVPLLQLQLLLTMFSKKMRCKAEFLCGIVVGEEEDRIVGPVPRA

SEQ ID NO: 53243 - protein, 60 aa, Sorghum bicolor
  Clone ID: 13317323.pep
PPQLAWQDGGGMLSHDPPQPEHFFQALESNPSLQPTYHTMDMNQQPVPSPGSCYPPDWMA

SEQ ID NO: 53244 - protein, 93 aa, Sorghum bicolor
  Clone ID: 13317335.pep
YEEPEPQHYRMSSRPYKDPAPDPLLSQFICRVAQADDTVPSDGNAEKGISSDDQRLKLNKGATASDDASSKLGLEERLQRIDFLTEILMSTIL

SEQ ID NO: 53245 - protein, 99 aa, Sorghum bicolor
  Clone ID: 13317356.pep
DPSDGTEEALLNELTSFDSHLKDNGPFINGGTISAADLSLGPKLYHMEIALGHYKNWSVPDSLSHVKTYMKSIFSTDSFVKTQALPEDVIAGWRPKVMG

SEQ ID NO: 53246 - protein, 80 aa, Sorghum bicolor
  Clone ID: 13317360.pep
PTILYINIQNKQINSTPQSPWLLSQNRQMIMACQKQDIVLLSIIILIRTKKAIVSNLFNQNPWTPKLMVPQKWGGQTIVA

SEQ ID NO: 53247 - protein, 120 aa, Sorghum bicolor
  unsure (1)..(120): unsure at all Xaa locations
  Clone ID: 13317363.pep
LKKYDAALNFTXCVELRTMDQHEVYPEAFADPEGQVWQVLNAAWDAGIQVASENALPCYDRDGFNKILENAKPLNDPDGRHLFGFTYLRLSNVLFERPNFFEFERFVKRMHGEAVLDLQV

SEQ ID NO: 53248 - protein, 138 aa, Sorghum bicolor
  Clone ID: 13317387.pep
PPSEKLLFAASFAARKLLNGRVKLYIPDFLSVFQHLCIHAGGRAVIDGVQRNFGLSDEKVEPSRMTLHRFGNTSSSSLWYELAYVEAKGRMYKGNQVWMIGFGSGFKCNSAVWECIRPVHDAHGPWANCIDRYPVHIP

SEQ ID NO: 53249 - protein, 57 aa, Sorghum bicolor
  Clone ID: 13317391.pep
LEVSMLDPALQLVMQVVLFCYCSLVEFSVFSAVLDQLSGYCGLWLESQLRTEYASGV

SEQ ID NO: 53250 - protein, 36 aa, Sorghum bicolor
  Clone ID: 13317393.pep
ISIFPVAAGGRVVEAAAAPPQARVGLPPWMLSHLSG

SEQ ID NO: 53251 - protein, 124 aa, Sorghum bicolor
  Clone ID: 13317402.pep
AGSRRTGGPFSREGYGGFGDHRSSSFGDFGGSSDRSGGFRDSGSRYRGGSGGLRRSSSELGRPSFSRSDRFGDFGDSDFSRRGNTDFGRSRSSDDSGSSRYGRGSSGFGTSGSGNLGGFKDSKR

SEQ ID NO: 53252 - protein, 85 aa, Sorghum bicolor
  Clone ID: 13317406.pep
PLLSNLDQKLNAAAEVACWRCPLGANGPESILLQHLHCYRTLQAPHRSPAMAGWTSCSSGRQGIGLRLCKSACPGTQKSRKILGR

SEQ ID NO: 53253 - protein, 106 aa, Sorghum bicolor
  Clone ID: 13317409.pep
LLLRLHPDGALLLLPEALGVRGPADDDGRRRHGDGAAPRRPPGRGPGAGRAAEAGGGHGVAAQAWRRRQGRLTMNDILWKLIAGMHMACFLNCAMHALLAGSMLLV

SEQ ID NO: 53254 - protein, 145 aa, Sorghum bicolor
  Clone ID: 13317445.pep
VVALLVEAEEALDAASPAVTSARSALRVVDAFLVPRFHYDPIKKVFYEHTGRLAVHGEAGDKASLYRDRYQVLLQRLARDKYFSKPAFDTVATEDSSCEITSIQSLIGCTGRRWIMGVISQLEERQFYLEDLTGAVPIDLSNAIS

SEQ ID NO: 53255 - protein, 134 aa, Sorghum bicolor
  Clone ID: 13317452.pep
LCQGLVGLSGIDIRYFRHLKEVTICAEATAQTRQDWERAAQNHPNRPRVMLVKTANSMESEELGPCAMREKRKRFLDQPSLDDSLKKMRLSESSSWTQAVGRQVMTTATIASSSVSIHLHAEESGSWMQKTSHP

SEQ ID NO: 53256 - protein, 103 aa, Sorghum bicolor
  Clone ID: 13317494.pep
ERTANILFVTNIYTVIYLDSKVEVHFSSLTHQCRSSQVLLPLRLRRALEHQAAWLHELLEVSYDHHLLHLLSHWRSDLLIVKEKYTFTENLQKEEKEELETNL

SEQ ID NO: 53257 - protein, 83 aa, Sorghum bicolor
  Clone ID: 13317504.pep
SIKSQHICRPRLCIAKNPHTTMFSVKYQCHHYSSGALKMHFGAHGHQTQYLMRLENCFFDEWHGPLDQTPVVTDAKMEGTNIP

SEQ ID NO: 53258 - protein, 134 aa, Sorghum bicolor
  Clone ID: 13317529.pep
EGAVMLHTFPKTTVDVFALVLESGGSDLPIIISCASLALADAGIMMYDLVTSVSVSCFGKNIIIDPTSDEEAWQDGSLVVAFMPARKEITQLTLTGEWSDGRITNAVELCMDACSKLGDILRDHLKDTATLTSE

SEQ ID NO: 53259 - protein, 184 aa, Sorghum bicolor
  Clone ID: 13317540.pep
EGTKSSSPSLQLRPGVGSGSQSTMMVNLEDSSAVCGEGIDATIEVTKSSSPDRLERKRKHSSERCHDQGSKRSRSTCKIAKSEISSLAIRELKLLKIDKTHGSDRFKEVARTATHSILAACRFEHSPSQSLALSRPVCKHSPKVKQLKSSAITDFCKECLRNFVKEAVSLALSGKQMDQTGTSY

SEQ ID NO: 53260 - protein, 64 aa, Sorghum bicolor
  Clone ID: 13317544.pep
NHAQSAVMKLDIEESVVRPRTWCHWSTFCTPSPPFVRKASTSIPPSQLSFAQFDQSSHIASQSN

SEQ ID NO: 53261 - protein, 133 aa, Sorghum bicolor
  Clone ID: 13317549.pep
SLLKLPNFSSAKPPRPSKPRSVNSRSSASKATATVQPCKSSKIAVSGIDEEMPDILKEPNSPSNCVKTTSPNGKRVSPPHNALSVSPNRKGGRKLILKSIPSFPSLAGDTISGSAMNNTDSTFSVSPLTLGPS

SEQ ID NO: 53262 - protein, 122 aa, Sorghum bicolor
  Clone ID: 13317578.pep
ARGDAGGGLGKSYLFCLTACQPCLQNLSASCSRLAASATTTLPTVTPPSTNLPLKRSSTTSLHQQPPSGLNSQDAPCGDLLPGPTSNSSKKRRGRGPEKLMEPRKEAERPMLIPSGTETILG

SEQ ID NO: 53263 - protein, 173 aa, Sorghum bicolor
  Clone ID: 13317584.pep
ARGLDVTKGPVQINWFKGGKTNICYNAVDRNIESGNGDKIAMYWEGNEPSQDGKLTYSELLEKVCQLANYLKSLGVGKGDAVIIYLPMLLELPIAMLACARIGAVHSVVFAGFSADSLAQRIVDCKPKLVITCNAVKRGVKPIFLKDIVDVALVESEKNGVSVGLCLTYENQS

SEQ ID NO: 53264 - protein, 120 aa, Sorghum bicolor
  Clone ID: 13317635.pep
ARGFFLLTACSGYLKDGRVVAVKRLYNNSYRRVEQFQNEAAILSGLRHPNLVMFYGCTSSQSRELLLVYEFVANGTVADHLHGPRAPERALSWPLRLSIAVESAAALTYLHAIEPPVVHR

SEQ ID NO: 53265 - protein, 134 aa, Sorghum bicolor
  Clone ID: 13317636.pep
MGSMTIGAKYKTTIKDPGTPGILRMNDDRFTFTPNDPRSAMKFNVDFRTIKGHKFNKVEGNKAALLNLSKEDKAGGYIFEFDNVGNRDLCRDFVARVLGKHQGTVPPRPTVAPENSVASAALEQLSVAEVERRV

SEQ ID NO: 53266 - protein, 89 aa, Sorghum bicolor
  Clone ID: 13317644.pep
TIQQKMQKRVGMLQSRDCSYELHIHMASSVQAFSFKVVVANAEVAEGPLFIWATTASANRACYEFSSSTVTYLPFQNPVCILQHLFLSL

SEQ ID NO: 53267 - protein, 147 aa, Sorghum bicolor
  Clone ID: 13317645.pep
ARGNTGKPKGFALFVYRSAESARRALEEPMKNFDGKTLNVQKAIDGRTKGSSGANTNANSNPTTASVAAAAAAAAQMTAPASAAISPYDASAYGATAVPDMSFAQQAAMLGLGAQQQAFAQPNAMLAMIAAMQNPAALGMTPPCLLL

SEQ ID NO: 53268 - protein, 108 aa, Sorghum bicolor
  Clone ID: 13317648.pep
MEEDYCVVCTEALEWVAYGSCGHREVCSTCVARLRFVMDDKKCCICKTVCPFVFVTKAMDKYTRVVTDFSVFPSGVNEGKAGDFWYHEDTQAYFDDADHYRMIRAMGR

SEQ ID NO: 53269 - protein, 88 aa, Sorghum bicolor
  Clone ID: 13317657.pep
VRVQWSSSAIAMEVEACYNYGFPPADRGRGRGSRHQPPPPPSYGHGHGHGPLTHTAAAEEGELWEYFPCPFCYIEVEVPCICNHLQEE

SEQ ID NO: 53270 - protein, 176 aa, Sorghum bicolor
  Clone ID: 13317670.pep
TRLIAGVDRLLSSQNEELAESDVYMSYLPLAHIFDRVVEELFIFHGASIGFWRGDVKLLVEDIGVLKPTIMCAVPRVLDRIFSGLQAKISSGGFLKSTLFNVAYKFKHFRMMRGAKHNEAASICDKVVFSKVKEGLGGNVRVILSGAAPLATHVEEYLRVVTCAHVLQGYGLTETC

SEQ ID NO: 53271 - protein, 156 aa, Sorghum bicolor
  Clone ID: 13317682.pep
HEGGLTSLRELYIGYYNSYSSGIPPEFGNMTDLVRLDAANCGLSGEIPPELGNLENLDTLFLQVNGLTGAIPPELGRLRSLSSLDLSNNGLTGEIPASFAALKNLTLLNLFRNKLRGSIPELVGDLPNLEVLQLWENNFTGGIPRRLGRNGRLQLV

SEQ ID NO: 53272 - protein, 185 aa, Sorghum bicolor
  Clone ID: 13317685.pep
AGTSLTGGSQIRNSQVGGNSSSKLPSIIPLKEPPITLKPSETEQDATEVAIVKELIKSYYDIVRKSIEDAIPKAVMHFLVNHTKRDLHNFLIRKLYRENLLNELMRETDEVLIRRQRIQEMLEILKQAHRTLEEFPIEADNIEKGYNLTEHATGLSKIHGVSGDSTNGIYTSSPNCYPPHQASHM

SEQ ID NO: 53273 - protein, 168 aa, Sorghum bicolor
  Clone ID: 13317686.pep
HEAGVVRTQFASGYPTASYEFRPEKRLRELREDPQSMVKQLLTKCAEALSEERIEEFLTLVQQARGVVSITGEPIQRLGAYLLEGLVARHANSGTNIYRALKCREPESNELLSYMKILYNICPYFKFGYMAANGAIAEALRNEDKIHIIDFQIAQGTQWITLIQALAA

SEQ ID NO: 53274 - protein, 161 aa, Sorghum bicolor
  Clone ID: 13317687.pep
ARGGAHVRSCSTLSSISSGARATTTEQARTPLTVLGKGLAAEASAEELLRRYQLGEELGRGEFGVTRRCTDTSTGEVLACKSISKRKLRSSVDIEDVRREVSIMGSLPEHPNVVRLREAFEDGDTVHLVMEVCEGGELFDRIVSRGHYTERAAANVMRTIM

SEQ ID NO: 53275 - protein, 105 aa, Sorghum bicolor
  Clone ID: 13317689.pep
MDPAAEDGPVAKQVPDVAPRPPERDFAGTPYVPVYVMLPLGVVNGNGEVVDADELVGQLRVLKAAGVDGVMVDCWWGNVEAHRPQEYNWTGYRRLFQMIRELKLK

SEQ ID NO: 53276 - protein, 160 aa, Sorghum bicolor
  Clone ID: 13317693.pep
TRVPLPSFDSPGERMRSRRNDSGANQSDNKRQYELDVDRIMRGEDSRTTLMIKNIPNKYTSKMLLAAIDESHKGTYDFIYLPIDFKNKCNVGYAFINMTNPQHIIPFYQTFNGKKWEKFNSEKVASLAYARIQGKTALIAHFQNSSLMNEDKRCRPILFH

SEQ ID NO: 53277 - protein, 149 aa, Sorghum bicolor
  Clone ID: 13317717.pep
VHHILASLKTVFAKIVDNFLLTVAVPFATAAVIVAATTSRSDEFTTLLHSVSNTDVLSIGLLLGTAAVVAIMRRPRAVYLIDYACFRPPHTNRVPAAAFVEHVQHVSQLTERSKRFLTRLYERSGLGEETCVPLVGHYIDPAKYSKFED

SEQ ID NO: 53278 - protein, 135 aa, Sorghum bicolor
  Clone ID: 13317735.pep
MISLLRRALASSPAATCRRPLLAALLSPPSAPPGPCQAPTPGSPAPPRRALHGSPNPLGFRSTPASWTRPGPGEGVGVDTGAEEGLEIARLWISPRIVEKLAARGITKLFPIQRAVLEPAMQGKDMIGRARTGTG

SEQ ID NO: 53279 - protein, 80 aa, Sorghum bicolor
  Clone ID: 13317741.pep
ARGLNQSLSPVSNWITSAFSTMPGSFVDVGCRGARAVAAGWWSRRRVLAGSEDVHPSLAVLALELARKAGAGAGAMELLP

SEQ ID NO: 53280 - protein, 92 aa, Sorghum bicolor
  Clone ID: 13317744.pep
QRERWEFLSVNLWEYFSVGVNNTDEQSFGRGTHAIVLPCMRAVSYGEQFSIGGGAQAAAAYLECQKQRPMGAPWRRALLPLRQYQASRSPIH

SEQ ID NO: 53281 - protein, 114 aa, Sorghum bicolor
  Clone ID: 13317754.pep
HEEVTGPSHHKDKGLFLRRVNIQSKEEYRQRADREAMQSTVKSKAPTSQPARLSNGYGPKNTVSTQRHAEGRVDSMRKEAFLNTQRVVSRDNERSHSIAKNGSNQASTSKTTLP

SEQ ID NO: 53282 - protein, 173 aa, Sorghum bicolor
  Clone ID: 13317761.pep
RIFIDSSLKHGHDISTFRKERIGGDSLGISYWYEDDEILGHRLYREIRRVEQVKKEPGKRSRGKGGSSAISVVSYQWETVASTFDEFDDVAEKLFSSRNRTEVSLGKKLKIEYLPEIEKIHKKKERLLKKQQREALLLDSYLTSDGLTTGRSLRDRKPVTYTFDDYDRSINEA

SEQ ID NO: 53283 - protein, 77 aa, Sorghum bicolor
  Clone ID: 13317772.pep
QNQPVHGVAEIPTFSDLPLGYEFKLVETMVNAGNWFSIFPFTSDKNDSMELTKWTTITLTILFYKLELTKWATILLL

SEQ ID NO: 53284 - protein, 103 aa, Sorghum bicolor
  Clone ID: 13317787.pep
MALLMEPGAEPLTESEQADLAGIAAIKESAAREFKEQGNQFVRMGRKHYAEAVSCYTKAIAQMEPLSSLDASAAADASVLFANRAHVNLLLGNHRRALDDAEQ

SEQ ID NO: 53285 - protein, 142 aa, Sorghum bicolor
  Clone ID: 13317789.pep
TRAASSWAHRVAHELKKVQSRSSFADEIQKLKRRLKEAHQRVIDAIPVACGGQPSGLPLPSMVASSKPCRVTRNPIGIEKPMEEVQLLLDEVDGEPQQLRVISIVGFGGIGKTTLARAVYDSPQAKEKFQCRAWVAATGSDS

SEQ ID NO: 53286 - protein, 171 aa, Sorghum bicolor
  Clone ID: 13317813.pep
HEDTNEADDANPYVTSFRGIDNKVYYMLDLNNNAQLLNFSGCGNTLNCNHPVVKELVLDSLRHWVTEYHIDGFRFDLASVLCRGPDGSPLDAPPLIKEIAKDSVLSRCKIIAEPWDCGGLYLVGKFPNWDRWAEWNGKYRDDIRRFIKGDPGMKGVFATRVSGSADLYQVN

SEQ ID NO: 53287 - protein, 103 aa, Sorghum bicolor
  Clone ID: 13317828.pep
ERGERRERPPRACAGGGVGGGGAAAADTAGAHRGETGRDRARVPPRAAAIRRGSDGSGRGAPDSDGGARGFEGPGEINLGEFGEDGMETRDEMMGMTSRRALV

SEQ ID NO: 53288 - protein, 104 aa, Sorghum bicolor
  Clone ID: 13317831.pep
ARGLPPSLPDSHRIGAYNCLVYLFLFFSLPRANPRFAQVSRTVLNLNSGPCFGCFHLDLWACRVNSAGSGPPPPAEKIRFVCMRARGCTPFGRFRLQDMLLVRL

SEQ ID NO: 53289 - protein, 163 aa, Sorghum bicolor
  unsure (1)..(163): unsure at all Xaa locations
  Clone ID: 13317833.pep
KSAPKLVEIPFKPARVLLQDFTGVPAVVDLACMRDAMSKLGSDPNKINPLVPVDLVIDHSVQVDVARSANAAQANMELEFHRNKERFGFLKWGSSAFRNMLVVPPGSGIVHQVNLEYLARVVFNNGGILYPDSVVGTDSHTTMIDGLGVAGWGVGGIXAEAAM

SEQ ID NO: 53290 - protein, 90 aa, Sorghum bicolor
  Clone ID: 13317838.pep
ARGAFDPRRWLAPGQLSSRPCPCECPVKSEVITEDIHRIDDKSIIIGKACDKGHRWICSKTISDCVEAIIGAYYVEGGLKAAFAVLKWLQ

SEQ ID NO: 53291 - protein, 92 aa, Sorghum bicolor
  Clone ID: 13317863.pep
QEKGTTSNTMSSCCPFAGATTGGGVCPVKATDQSSAGLCPAAKSDKSITGVCPVTGKGHGSEHKESIDGGEEKAPMILVWCRQSARLATTPT

SEQ ID NO: 53292 - protein, 173 aa, Sorghum bicolor
  Clone ID: 13317868.pep
ARGTTVTEVDPEIRIELIDISEIRLKISLETAPNQRPRGVLGIWSPVLSAVGNAFKIQVHLRKVMHRSRFMRKSSIIPAIMNRIKRDLIHNPLHLIFSVDFLGVTKSTLSSLSKGFAELSTDGQFLQLRSKQVWSRRITGLGDGLVQGTEAFAQGLAFGVSGVLRKPVESARQ

SEQ ID NO: 53293 - protein, 144 aa, Sorghum bicolor
  Clone ID: 13317870.pep
ARGSSSPAQLPFPRRSSTRRPERDALVVCSMSAQAGTGTYSPAVAAGDKRRERKEELRRHLVEDADWPRADGRSFHDCRPAFMQTGPTTAASGSAYAEFGKTKVIVSVFGPRESKKAMMYSDIGRLNCNVSYTTFATPVRGQGA

SEQ ID NO: 53294 - protein, 173 aa, Sorghum bicolor
  Clone ID: 13317879.pep
ARGLRWQAENQAEFEIGVNVPDAEPVPDPLVSGVVDEEHDLERTDARSGGGGSMSDPVPSIYDIVDDDFATIAGIFRRRIPEDNRPQGTSAGSQCPRSTQGRDNGLAAYHARIRLEVERARTLRNSRNLDKRIRELRENWAALRDGSVGFAPHMPGRRRKDMAGSASVPTEHQ

SEQ ID NO: 53295 - protein, 70 aa, Sorghum bicolor
  Clone ID: 13317884.pep
HEAKVMARMASADIMCVDSKAIKEKFTGMIRQQDVRATEIDKVDMYQSYRPGDIVKAMVVSLIRQMMQYK

SEQ ID NO: 53296 - protein, 166 aa, Sorghum bicolor
  Clone ID: 13317890.pep
AEIFQDGQETISTEEIQDNICEANGCLPLEYKVEGQQQRGVRRRCLVFEASGFSNSVVKKGTVENLSVSTCKGKSPVQTQPRGLRGIGLHLNALALTPKGKMACQDPTASALLPSSASEKDVHGRLLSAGENFTHSGGELLEFPVDDCSAGGFPVNDHVSGQSVSP

SEQ ID NO: 53297 - protein, 177 aa, Sorghum bicolor
  Clone ID: 13317896.pep
LKSEGVPVYRCVQHEGEFVLTFPRAYHAGFNCGFNCAEAVNVAPIDWLPVGQNAVEVYREQARKITISHDKLLLGAAREAIRAQWDILFLKRNSADNLRWKSVCGPDSTICKTLKARIEMELAQRQNISSPCQSRKMDTEFDSTDRECALCYYDLHLSASGCPCSPEKYACLVHAKQ

SEQ ID NO: 53298 - protein, 67 aa, Sorghum bicolor
  Clone ID: 13317903.pep
SFGAWKGNCAGSSLHVPNSRCTASSSGCVSVVIKFSDHSRKWTTTTQYSSHQTHRRVDIIGTRNPRA

SEQ ID NO: 53299 - protein, 180 aa, Sorghum bicolor
  Clone ID: 13317909.pep
TRVTGMEPSDEPILRVNCNETALVLGGAASAAIPPYSFFAASGNSVPLQSEIVEHLASIIAPALCPSDILPKIKFSTFLYGPSGCGKRTVVRHVANHLGLHVVECSCHDLMTSSESGAPAALATAFKEAQKYSPCIILLRHFDAIGNASSNEGPQSEQSGIASSIESIIKQYTGQCWVAK

SEQ ID NO: 53300 - protein, 44 aa, Sorghum bicolor
  Clone ID: 13317918.pep
HCKRSGKEKNLNAFFELATACCSPSPSLRPNTRQILKRLEEIAR

SEQ ID NO: 53301 - protein, 61 aa, Sorghum bicolor
  Clone ID: 13317928.pep
FSAVSCVLWLTSCSLLTVLWALLIGLLATLLHASFRTPNLKARLNTFREEFRAVWRNYSEL

SEQ ID NO: 53302 - protein, 53 aa, Sorghum bicolor
  unsure (1)..(53): unsure at all Xaa locations
  Clone ID: 13317941.pep
VVVGNVSSSEAAKVWGDKYFKGNFXRLAMAKAQIDPHDYFRNEQSVPPLVASN

SEQ ID NO: 53303 - protein, 91 aa, Sorghum bicolor
  unsure (1)..(91): unsure at all Xaa locations
  Clone ID: 13318035.pep
CIPECHPAVSYQFVQQQRSVFVVNWIHLIFLLXVLSTYHFQISSCNRVVSCNPNLMQSFRATLIVNFMHKCGQQSRSELKMYSVPFVVLTA

SEQ ID NO: 53304 - protein, 171 aa, Sorghum bicolor
  Clone ID: 13318044.pep
TLMFVNVTRADGEIASKRKLGSGFTITCWSLGTPLSSKSIGWVKEGAMEAGEIWSQYPIFDPHIPCLSPEFPFVSLNEHSIIYALLCEREYAAGRTWVLVIDIKRKKLELVIPYNDVNSSCEDTLVLEDILINWPLLPSMFSMYLNSHASWKTHVLNMAHLAYNASSRHQL

SEQ ID NO: 53305 - protein, 167 aa, Sorghum bicolor
  Clone ID: 13318049.pep
KVLFRPYEDILGIGHSMGFSSILVPGSGEPNFDTFVDNPMETTKQKREKEVHALLDKLPPETIMLNPNMIATVRAPKKKEKKTKKEIEEEMDDAIEAAKNIERKKKTKGRSKPSKRAKKKEEDVFKAKRPFLEQSEEINGRPDKKQRIGEEVELPKALQRFAKKPQS

SEQ ID NO: 53306 - protein, 51 aa, Sorghum bicolor
  Clone ID: 13318056.pep
GSSGRCHGEHSKDGSGRSGRAMPDAAKRLPSVGRSCFSSRNGRGKDSILPM

SEQ ID NO: 53307 - protein, 45 aa, Sorghum bicolor
  Clone ID: 13318062.pep
VPFINFPPIQLCLYKKSKLYSLNKCKEFIVKKKKCKEFRWPCGVV

SEQ ID NO: 53308 - protein, 76 aa, Sorghum bicolor
  Clone ID: 13318071.pep
LRLARKLKKIDGKKNLVNLVALGERYGLSSEGPSHRAMPDVEALCNILPKITLDLKLTCDDLMNEAMRFSDVRKAS

SEQ ID NO: 53309 - protein, 69 aa, Sorghum bicolor
  Clone ID: 13318111.pep
AQYPSRRGLTVSQPSFVLALDLPSLESSSNLKMWSTTTVLTCHVAKGSLLLLFLFFFFGMGLLVAGVGL

SEQ ID NO: 53310 - protein, 84 aa, Sorghum bicolor
  Clone ID: 13318125.pep
VPLLAHKSNLSLLSNDMNKKMHNTLSGSKIAVKFLLNQQDAETVDLEAKNMYGETQHMAVKNSSCRSTNLLFDHGAHVETKANV

SEQ ID NO: 53311 - protein, 84 aa, Sorghum bicolor
  Clone ID: 13318136.pep
ATARAAGAVARVMARRRSRALREMVPGGRGMVDEWTLLGETLDYAVSLKAQVDAMQLLLRTLQQAPQEPCSAEAAVRGIRTTYI

SEQ ID NO: 53312 - protein, 143 aa, Sorghum bicolor
  Clone ID: 13318162.pep
SQRGQSSGMTRNLSSPASRHIQDELSQMPHDMPGQVSFAYNGLPTHHGLALSHPQQAEAVSAGIGLGGVAAGGGGVSLTLGLHQNNRTYIAEPLPAALPLNLPHRFGLEDVSDAYVMGSFGGGQDRHFTKGIGGHHLLHDFVG

SEQ ID NO: 53313 - protein, 83 aa, Sorghum bicolor
  Clone ID: 13318178.pep
SYKDHLQECQTPVLALAGDKDLICPPEAVYETVKLIPKHKVNYRVFGKPQGPHYAHYDLIGGRLATDDVYPCIIEFLSRHDGC

SEQ ID NO: 53314 - protein, 149 aa, Sorghum bicolor
  Clone ID: 13318200.pep
DLADKIVIPTDQPHLQCLGSLGNPDPTDLINVETNRVPFKAENFSLDLWKDAFRSWPNPTKGWKDWFLTVSHSNEVQWGERKLDQCIRLSFAVMERNESLLIAASYFWSDTLNAFVFGHGPASPTLADVLMLTGLDISTADNSHLFDTK

SEQ ID NO: 53315 - protein, 183 aa, Sorghum bicolor
  Clone ID: 13318212.pep
ALSAAAAAAAMDWSSVTAEDLVDALREVDWSTPPRPVSEFFSRFTAPRSYSKWTSRLKCNLYYYRTNYFILIIFLLGMGFLRKPVAILAALATGLSIAFLNDSFAVTFNEKITRSVRQFSPHLAAKMRPPITPVIRGRPSKRRSIHICGRPRWIFVLLFSAVSCVLWLTSCSLLTVLWALLIG

SEQ ID NO: 53316 - protein, 89 aa, Sorghum bicolor
  unsure (1)..(89): unsure at all Xaa locations
  Clone ID: 13318226.pep
SGDRLAFPAGLCPTIGVGGHLSGGGFGMLLRKYGVAADHVVDALLVDARGRVLDRDGMGADVFWAIRGGGGASFGVVLXWQVRLVPVPR

SEQ ID NO: 53317 - protein, 147 aa, Sorghum bicolor
  Clone ID: 13318232.pep
TGASAKTKRTQTSGADAPQPSQAPPKRKGPKSTKTQAKRQKTTPSSPPRPVSPIQVEPSPPRSVPQPQEVPSPPRSVLQPQEVPSPPRSVLQPQEVPSPPQADPTDVSGQTTNPVDLGTSSVVPPEQTITIPPQGKVPITESLPMIL

SEQ ID NO: 53318 - protein, 55 aa, Sorghum bicolor
  Clone ID: 13318234.pep
GAWPAPGGGLHHAPAADPRPAPRAAARREAPASDADGKGSNSARDRGVTQSVRQG

SEQ ID NO: 53319 - protein, 205 aa, Sorghum bicolor
  Clone ID: 13318272.pep
ARGLTDMDGTNLVRMLRESARKAVGERIVPAVDNRKLYYNKGQKEILENSRREITTALLTRYPQLLRKFISDKAKISPLVDMMTLLKLELYSYKRQEKHFKTAIDLIADAFFKHGEKGPLRSCIKAILFCCTECQADLKDYAENKLKNLEDELVLKVRTAIKEVEAGDDEYSLLVNLKRFYELQLSKPVKNDSLFEDMYRILAHL

SEQ ID NO: 53320 - protein, 94 aa, Sorghum bicolor
  Clone ID: 13318281.pep
RALGYDAAVCTSRWEKTPSHPAGEHEYIDALVVESGSGSGSGAGRLVVEVDFRSEFEVARPTKAYRLALQALPPLFVGTPDRLGRIVAVVTEAG

SEQ ID NO: 53321 - protein, 165 aa, Sorghum bicolor
  Clone ID: 13318283.pep
ARGITGNCRFYDASDNLLRLETQIALSGKKKSSLKRITAFEFSPSNPSKLMVTSADSKIKILDGTVVTQNYSGLRTGSCQSLATFTPDGQHIVSASEDSNIYVWNHENQDEPSLKHAKTIWSSERFHSNNAAIAIPWNGQKPRNPVSLASQILSPQGDNFWCMSK

SEQ ID NO: 53322 - protein, 170 aa, Sorghum bicolor
  unsure (1)..(170): unsure at all Xaa locations
  Clone ID: 13318285.pep
GSVELQQARVAEGAAVAEEVMAALERNGVSFVGGGLGKAKKDGSGKQLMGRAALLQLPATVRIDIPPTSPGRAALKVWEELVNVLRKDGADPAAAFVHRKKVQHAEKNIRDAFLALYRGLELLKKFSSLNVKAFTKILKKFVKVSEQQRKTDLFSEKVKRSPFXSSDKVL

SEQ ID NO: 53323 - protein, 166 aa, Sorghum bicolor
  Clone ID: 13318286.pep
MAAAAIHQFAECITCHAWSPDQSMIAFCPNNHEVHIYKFFTDKWEKLHVLSKHDQIVSGIDWSKSSNKIVTVSHDRNSYVWTQEGSDWVPTLVILKLNRAALCVQWSPKENKFAVGSGAKSVCVCYYEQENNWWISKVIRKRHESSVTSLAWHPNNIYLATTSTDG

SEQ ID NO: 53324 - protein, 102 aa, Sorghum bicolor
  unsure (1)..(102): unsure at all Xaa locations
  Clone ID: 13318288.pep
ARGFLPPTTSLPCPHRDLSGTARGEATRTRAPPDPSSPPVAAAAADRPTGRRRGGEDGAXSGXLFVGGISWETDEDRLREYFGRLREVTEAVIMRDRNTGRA

SEQ ID NO: 53325 - protein, 88 aa, Sorghum bicolor
  Clone ID: 13318318.pep
GSQESWYILCTKLLKQFEFSNKEEMKKLGRRMRWHFKRIVDQYGRKRSLCQILYHLKLGQKLPLGAEEFAGRRTKLPFSKKLAKFENT

SEQ ID NO: 53326 - protein, 59 aa, Sorghum bicolor
  Clone ID: 13318349.pep
KSILTSSTINLLQYVQSCCYKWLAIMHVYHSSDICFQLSQAPELHLEIQRQMVSQAALV

SEQ ID NO: 53327 - protein, 167 aa, Sorghum bicolor
  Clone ID: 13318353.pep
ARGQFVGQAVKAVESRLGPSASSRSRLLPRRPKAASPEARSFPKWVMFDTEIYVEDPQSFCEDDPETPSARSRDSNGDDVLVSLRLVAPPGASHLRLHYSREEEAKMLNGTALVAAHLDSVLFRVVPPSSPINPFNSWCCYTDYFVCKAGPSGMSIYGPLPPCYKDA

SEQ ID NO: 53328 - protein, 89 aa, Sorghum bicolor
  Clone ID: 13318356.pep
MSATQSFSPFCHFPPSTPFHPSDDTMRECMSIHIGQAGIQVGNACWELYCLEHGIQADGQMPGDKTGGGGDDAFNTFFSETGAGKHVPR

SEQ ID NO: 53329 - protein, 140 aa, Sorghum bicolor
  unsure (1)..(140): unsure at all Xaa locations
  Clone ID: 13318357.pep
MAPARVDAEKEAQHELEVKVAKYSRGQGADLKALGDKKLKGQLSVKEKLYGQSAKAAAKAEKWLMPNDGGILEPDHLEKTYRFSQRDILTEVDLLSSRKPFDMILPVLGPYNIGYTPNGRYMLVGGRXSHLAMMDMLHMD

SEQ ID NO: 53330 - protein, 84 aa, Sorghum bicolor
  Clone ID: 13318365.pep
SALRSSNSSEAHASHWQHLVICLLHLRSTFPSSCKAQLHRYEHRGTYLSCFHHMATIIWILEQKFMKMPCSSALLELGSLRKIV

SEQ ID NO: 53331 - protein, 116 aa, Sorghum bicolor
  Clone ID: 13318377.pep
SNFPDENPACCLRNLTGQLVRILFLSRLKRRTSDDILCKMCAWNQDTEQLFFDLGEPRLTPGTRCPSQSPRPFLVAATADGFGWTRVLKPGGAVATGNRTRATRDAATARGIDPRA

SEQ ID NO: 53332 - protein, 212 aa, Sorghum bicolor
  Clone ID: 13318395.pep
TRSKANDVVFCGRIIMFLAHFFPLSERSALNIKGVFNTSNVTKYEKDAMDGISVDFNFYKTLWSLQEHFSNPALTNTNPAKWQKFSSNLAVVLSTFEAQPLSDDDGKLNNLNEEEDAAFNIKYLTSSKLMGLELKDPSFRRHILVQCLIFFDYLKAPGKNDKEGPTGSMKEEIKSCEEHVKKLLEIIPPKGKEFLKSIEHILEREKNWVWWK

SEQ ID NO: 53333 - protein, 32 aa, Sorghum bicolor
  Clone ID: 13318398.pep
IQRKTFLWTLLKYTTCYKSSKQQYFRQMDNGY

SEQ ID NO: 53334 - protein, 120 aa, Sorghum bicolor
  Clone ID: 13318405.pep
MSPPSVMGQFGDTTYTKVFVGGLAWETQKETMRKYFEQFGEILEAVVMTDKNTGRSKGYGFGTFRDPDAAMRACVDPAPAIDGRRANCNLACLGVQRSRPPTPQHGGARNFRVMKSFSQQ

SEQ ID NO: 53335 - protein, 158 aa, Sorghum bicolor
  unsure (1)..(158): unsure at all Xaa locations
  Clone ID: 13318416.pep
TRHEITEDAIXKALMSPRYIDMDLVNAYLARRSLDYLIGFGISPLLRTKLPGCQSTGRVQSAALALVCDREAEIXQLKPQEYWTVQTYFKMHFADPPNGTYIPFRIKHLNSKKLDQLSIHSQKEAQAIENRIHSSKFEVLSVKRSKIHKNPPMPYITY

SEQ ID NO: 53336 - protein, 194 aa, Sorghum bicolor
  Clone ID: 13318420.pep
ARGFYLHKFPLLSKSSRLQRLVASSNEEKNDEVDISDIPGGPSAFEICAKFCYGMIVTLNAYNVLAARCAAEYLEMFETIEKGNLIYKIDVFLTSSVFRTWKDSIIVLQSTKSLLPWCENLKVINHCIDSIASKASIDPSEVEWSYTYNRKKLPSENGIDSHWNGVRKQPMVPSDWWVEDLCELEVDLYKRVIM

SEQ ID NO: 53337 - protein, 141 aa, Sorghum bicolor
  Clone ID: 13318435.pep
ARAAGDSGSSSRSSSPTRLLVGEEALGRRALVAVPVVRVPRPRDRAELGVRRRPRSRRHRERAPRREQRLLLEPPVRHHGVGVLTQTIRPAPARGRFDSCARIPILNPNHRLLSSLVIILEESASSEDRRDERGGEVDKMA

SEQ ID NO: 53338 - protein, 89 aa, Sorghum bicolor
  Clone ID: 13318447.pep
LAPGRILLSSCVSHSCSIGTVAKKPIRPVSSSQLHLPFHVFFTTTQQQPSSRRHECKLQEVQARDPQEPATRAQEKRRCCVVVEWHEPP

SEQ ID NO: 53339 - protein, 93 aa, Sorghum bicolor
  Clone ID: 13318454.pep
HEGLLSPLSLPAAAAGHTTLPQCLLRAPPCSVLAAVAGARSTARARRKQPGGGSESCNIGHCAIRHHTASPLPMMDLAASPPEAGVEFTWWIH

SEQ ID NO: 53340 - protein, 143 aa, Sorghum bicolor
  Clone ID: 13389496.pep
MARALAAVWPLVKGCITGGVLGITVADWCASVVTMDGASMHPTFDPQQAERALVEKRCLYRYDFSRGDVVVIRSPRDHRQLIVKRLIALPGDWIQIPEMQEIRQIPQGHCWIEGDNAALSLDSRSYGPVPMGLLQGRVTHIIW

SEQ ID NO: 53341 - protein, 114 aa, Sorghum bicolor
  Clone ID: 13389500.pep
MQEVIVQQEEQPVEIVLDQSRTNSNVLPGCREDLLPSLSWLLRARRRFVLTSERPNKKRKLLRADAGLEQLVLLPSPDGEAGSICDVCCMGESDMMSNRMLHCKNCEISVHQKC

SEQ ID NO: 53342 - protein, 138 aa, Sorghum bicolor
  Clone ID: 13389514.pep
MADDGDAAAKRRRRRSTGMGGMSALPDHLQHEVFSRVGDVKSLFKLAATCRGWLRRFTDRAFLRELCPSPQQGSGLLLGVVVQDKWFNRMDKAMVRARMTTMAALPQQRASSSALAPVFLPALGSPLGPTSRALTSFF

SEQ ID NO: 53343 - protein, 114 aa, Sorghum bicolor
  unsure (1)..(114): unsure at all Xaa locations
  Clone ID: 13389588.pep
MQSGGEMRPVHNSVDTVNAAAVAIVTAESRTQPPAEPRRKWADRLSAYFCFGSQKNGRRMRVNHAALVPEPAPQRTDAPVAEIPNHPPPPVFPFVAPXSSPASFLQSEPTSIVQ

SEQ ID NO: 53344 - protein, 46 aa, Sorghum bicolor
  Clone ID: 13389648.pep
WNGKIQCCIILHFNDNIRIPKTASSKGSHQTFPIIGSFLQQSYSWF

SEQ ID NO: 53345 - protein, 194 aa, Sorghum bicolor
  Clone ID: 13389663.pep
STVDHHGAAHWLCIDDGRLPNARGGGGGDHHLYRLSVDVATASVSLTRLPVRVGGKQLLCVNSDGKLAVASVYPLHVTVWTQPAGAGDDGDGDTTAAAWPRTSFRIAPQQNEDHERWCNSDHGSSSLLALFMGRGVFVLDLDTKVMEKVFILDFNNKTRELAGDAKQYLRCVPYEMDLVEFFTLPAWWHTRATW

SEQ ID NO: 53346 - protein, 100 aa, Sorghum bicolor
  Clone ID: 13389698.pep
LLAPSDIHYFRDIGYRHTTIQHCPANAPARQLPRIPWLEKTTEDEKERIEEDEYWANPDPVKENGVGCRCRCDTDIVDVEGKQGSCFAEWVEVAGGYASP

SEQ ID NO: 53347 - protein, 164 aa, Sorghum bicolor
  Clone ID: 13389709.pep
NIGERRRKHELRVLSRVGANSVEDHELPDGDASEDDASEDDHESSEGGDASEDGFYEDVKRQRTEKLSIKNALYSRTPGIEPPEEETEGDGKRTISYQILKNRGLTRSRNKKKKNPRKNYRDKHKNKLVKRKGQVRDIKKPSGPYGGEMSGINPNVSRSVRFKS

SEQ ID NO: 53348 - protein, 142 aa, Sorghum bicolor
  Clone ID: 13389772.pep
WFFLPDEIRNYLRGPVMEKEIFLACGEGIGLADINPLEAVAGKCTVICISKDERNRQPSPQELEIADYIFYRFFDVGSLTHSDQLPDKIATLTVDVLLNPKDELVVSNPGTNVPPNPNVDEGLVATVPALPSAVKTEDGSQA

SEQ ID NO: 53349 - protein, 59 aa, Sorghum bicolor
  Clone ID: 13389776.pep
MAVGGDDDSMERDFAARLRLAHSPSPASPAAAASSSPTAAGGIAFRAPQEQFTADDFVL

SEQ ID NO: 53350 - protein, 165 aa, Sorghum bicolor
  Clone ID: 13389790.pep
PPTLRPGGRRTPPYPPFGARPPRRDCSGRRPVSAPRSLPRPIVRPHPSAAGMAASGGDAPELAVITNVCNAANAPEENRLAGDSNTISENAQESLSSLPEQESNDASVNTEKKEPGISKCKSVEEIPKTVTIKRCKNIDSKKVSLNNNNNPSFTGSPALKKQPTK

SEQ ID NO: 53351 - protein, 49 aa, Sorghum bicolor
  Clone ID: 13389794.pep
HTHYTLRARQDRRPWPMAMVGVALAAAPSLMMRVRPRVCVCVCVPSPRA

SEQ ID NO: 53352 - protein, 152 aa, Sorghum bicolor
  Clone ID: 13389801.pep
ARGDISPLKVDLRSEAKMAAEEIRRLSSGKKIHPFFASRKMNKCANQDQDVINIENVNGCDSERDPPFYPIHVAYQSEASIPIHWSSWIITDLSSFDTDTASLKKSVSFFEGLVKPLTIETNCKRHSNQLAEPILAECTTSGMPFPITDKQS

SEQ ID NO: 53353 - protein, 93 aa, Sorghum bicolor
  Clone ID: 13389820.pep
MPTHAPCPPPLMRPMASNGMASSPSPFFPPNFLLQMQQTPSDHDPQEQQHHHHHHHHHEHHLPAPPLHPHHNPFLPSSQCPSLQDFRGMAPML

SEQ ID NO: 53354 - protein, 191 aa, Sorghum bicolor
  Clone ID: 13389881.pep
TRIELDPYVHRTGDVWHVSMESVEGYASYGFRSGLFAMFGIDRPLLDPYAKVIGDFVPADSVNEDGLAVPAVRCLASLKNAPSYDWGRDKHPCLPLEKLVVYRANVALFTKDKSSGLADDVAGTFSGMAAKVKHFRHLGVNAVLLEPVFPYHQVKGPYFPYHFFSPMSLYSSECSSVSAIKSMKDMVKTMH

SEQ ID NO: 53355 - protein, 109 aa, Sorghum bicolor
  Clone ID: 13389883.pep
QFCIQSFLPASRGRVSLTFASLRCELRQARNGTMAILKRRSSTDTDTDSTKSSAAAAAAGGEASAVTAASSLSDDMLAEIILRLPVESVARSKCVSKTWCATVADSYLR

SEQ ID NO: 53356 - protein, 85 aa, Sorghum bicolor
  Clone ID: 13389895.pep
CKKGRSFTTSNNPNLCPWVQLMAYACSVPAVHKATNQVHWTRVEIKLKSASILKYSPRQAYSWTLFALTLSKTMHYSTAQSAYIQ

SEQ ID NO: 53357 - protein, 79 aa, Sorghum bicolor
  Clone ID: 13389910.pep
MEGLPEPLLAEIIKRITRTSDLNAISLVSKHLYNAEAEERVTIRVGCGLHPATKALSSLCFRFPNLWKVEINYSGWTSK

SEQ ID NO: 53358 - protein, 147 aa, Sorghum bicolor
  Clone ID: 13389914.pep
MGGGGGGGGKSEKARRSSSARVKLWVARASTVLLWTCVVHLAAYRELWAPSVLTRWPGCLNHPHVVQNPSEEVAVAVADAGQRQAARAVVLPPKRIYKNNGYLMVSCNGGLNQMRAAICDMVTIARYLNVTLIVPELDKASFWADPS

SEQ ID NO: 53359 - protein, 133 aa, Sorghum bicolor
  Clone ID: 13389920.pep
AKVRIPALKSMNQESRRPQRNEQARQSYPYPNQPKGGQHRTPFGSPLHAMPEAPSAGWGCGRLPTGEEWRKETRLRRKGRFMHTWIWIGAWPAGAEGRWGGTARWGTERTRRPWERGRGRGGAPVNRPNIDLV

SEQ ID NO: 53360 - protein, 147 aa, Sorghum bicolor
  Clone ID: 13389940.pep
MDGEEAPLGALNLAEYAPAGARTVDCYRRIRKIGEGTYGEVFEAVDIITGERAALKKIKLDDGKEGFPRQILREIKLLKKLDHENIIRLKEIVVSPGSAHGTGGSDDHIYRGDIYMVFEYMDHDLKKVLHHSAPSQVKVYMGQLLKG

SEQ ID NO: 53361 - protein, 98 aa, Sorghum bicolor
  unsure (1)..(98): unsure at all Xaa locations
  Clone ID: 13389946.pep
GESVVLISKLKKINKLANKKVQLILTDKPQLICVDPSKMVAKGNIIWSDDPSELSVQVSDSSHFRICTPKKVSXFEDAKQRAWQWKKAIEDLQRGQRN

SEQ ID NO: 53362 - protein, 120 aa, Sorghum bicolor
  Clone ID: 13389950.pep
HPDELDEEFDTFPSSRPAEIVRMRYDRLRSVGGRVQTVVGDLATQGERAHALLSWRDPRATAIFIFLSLVVAIVLYVTPFQVLMVIGMLYLLRHPRFRSRMPSVPFNFYRRLPAKSDMLL

SEQ ID NO: 53363 - protein, 125 aa, Sorghum bicolor
  Clone ID: 13389956.pep
MESRSQSRKQASDLEQETCVDDSNLVARAARLFAPKLGQLDDNYEYCVKIIRWLECSGLIEKDFRMKFLTWFSLRSTEQERRVVITFIRTLIDEPSSLAAQLLDSFEEIVTSKRLRTGFCTKLWH

SEQ ID NO: 53364 - protein, 86 aa, Sorghum bicolor
  unsure (1)..(86): unsure at all Xaa locations
  Clone ID: 13389960.pep
XPPPPPYYYYSPPPPATYPGGSGCPPPPGAYIQIGSTPPGKGPLYPQDPGFMPNSAPGRAAAPPPLTVVVVVAALAALACAWAAFL

SEQ ID NO: 53365 - protein, 123 aa, Sorghum bicolor
  Clone ID: 13389981.pep
LNYTTSSLIPLNYNPLLPTMINYSISKYKSHNLADTSRSIRSCTAWLPPSLLHSPRINPNWWFPPLFLLTILLIAIAMQYAIVNHYIIVCDDGDEETMINGSAGGRPTARTAAARRRRTGGCP

SEQ ID NO: 53366 - protein, 110 aa, Sorghum bicolor
  Clone ID: 13390042.pep
IQRQNTSVSTCYASARGRQSDRYIDDGTSHVLTTRFFSPLPNAHTPATSFLVRSYSRSFPADHTYTASFSGCSARNLASLPLPQPHFFPSWTTSPSLTACFSRHWSASAG

SEQ ID NO: 53367 - protein, 64 aa, Sorghum bicolor
  Clone ID: 13390054.pep
FSTLQTFLLVNLIFLISFYLPQFSLIVGMRTYHLVWWTSVSMNWEVESTSTLVLFSCYLSPCLF

SEQ ID NO: 53368 - protein, 137 aa, Sorghum bicolor
  Clone ID: 13390127.pep
MVAMVRKDEEEGPADRVPHLPWMRCPVDIDTFSGCPVTQLPRLDPRLAEALQRMGIESFFPVQEAAWLETIGPGAFERDICINSPTGSGKTLAYALPIVQMLCKRKVRCLRALVVLPTRDLALQVKEVFDAIAPVVG

SEQ ID NO: 53369 - protein, 111 aa, Sorghum bicolor
  Clone ID: 13390136.pep
RPPPPKGRASPFLPTTLNPFHSPPLAVDESRPSTSERPARSRSRRVWEGTRGGREPSLGPAGVPRPHPPSAPPGFTEENLCSVSLGLAVLHHLPGLELVILCQTQTRNQAL

SEQ ID NO: 53370 - protein, 75 aa, Sorghum bicolor
  unsure (1)..(75): unsure at all Xaa locations
  Clone ID: 13390168.pep
GPGWAGPVGACPXRPRGVVGVRSAGGLGWGRHGAWQVGGARSFIVELCTTCGEAEGTATCCSRLRPSPAVAPPQW

SEQ ID NO: 53371 - protein, 159 aa, Sorghum bicolor
  Clone ID: 13390204.pep
TRRAQARAESISKASLGSPRTPRSLLAPPLGSSRRCPICSRGNLLLLLSSDGRRIGAARHHSLVRDRDREGKLPWKALPRLALQVFRLLSGSLSGLRCTAARGWVWVCSGLHVDALRLRSRCRCRRSIRRGCGCCFRLGAGPGLSFHLLWLWVGIGGGE

SEQ ID NO: 53372 - protein, 199 aa, Sorghum bicolor
  Clone ID: 13390206.pep
HEANRTLLECLVFCLLDDHSSEALEEACSLLPKISSKETHPKIAQVLLERHKPDMALLVLKCTGRDSFSATENFEKDGISSLSEAVTVVRVRIECGLLTEAFMYHRSYCSKVKEQRSADMTHSEDAFKSSWIYHVEMMMTEFCTICIERNLVDKMIDLPWDSEEEKHLHKSLFESAHEMPMKPNGSLLVVYYLRRYRYL

SEQ ID NO: 53373 - protein, 136 aa, Sorghum bicolor
  Clone ID: 13390211.pep
ADFLTSLHDLAADRMGFTNRVQAAVAKAHLRAFDAFRALPDPPQYTLELGLLPHIPLPLPNPKAAADADTTPASPSRRGRKRKEQLVKDFDSDEDWDPRKRGATDSDSDVDFDRRRGFRGRGGGGGAGSGAPRGRP

SEQ ID NO: 53374 - protein, 145 aa, Sorghum bicolor
  Clone ID: 13390213.pep
HEDLTPAARRNKKRKLPEKQLPDRVAALLPESALYTQLLEFEARVDAALARKKVDIQEALKTPPSLQRTLRIYVFNTFANQGPRTIPPPKNADPPTWSLKIIGRVLEDGAELDPASVVPKHNPVYPKFSQFFKRGTIALDPSLYP

SEQ ID NO: 53375 - protein, 123 aa, Sorghum bicolor
  unsure (1)..(123): unsure at all Xaa locations
  Clone ID: 13390227.pep
MASRNQFDLLGDVDNDDPAHLLAAAEKKAAAAPKPAPAPAPAPAKLPTRPPPPAQAVREERSYGAPPRDGPGRGGPGRGRGSRGGRTGPRREFGDAGANGFEGGYGGXGGFGDGAVARGENGE

SEQ ID NO: 53376 - protein, 174 aa, Sorghum bicolor
  Clone ID: 13390248.pep
TRDHVFGYNIEVALDNKETWKNRRKPNPIYIKDALPEDAVQQNGRSRDHMNEEQDPSAMVSLGLRNSQEIWSLAENSRVFLEALKLFFEKREKEIGSLIFDKDDQLAVEFVTAAANIRASSFGIPLHSLFEAKGVAGNIVHAVATTNAIIAGLIVIEAIKVLKGDYQDYRMTYC

SEQ ID NO: 53377 - protein, 125 aa, Sorghum bicolor
  Clone ID: 13390253.pep
MSAAETAVSPAPQPPSDPNAAANADAAHSNSFSMADEAQTLTEALLQPQPNHMSPPPSGEEDDGVTASGAPVGGDAAASAAAAAAANATMEERVRGPWSPEEDTVLSNLVEKLGARNWTLIARGI

SEQ ID NO: 53378 - protein, 137 aa, Sorghum bicolor
  unsure (1)..(137): unsure at all Xaa locations
  Clone ID: 13390263.pep
TRQRLSGFHASQCGFCTPGMCMSIFSALVKADKKSDRPDPPAGFSKITCSEAXKAVSGNLCRCTGYRPIVDACKSFASDVDLEDLGLNCFWKKGDEPAQVSKLPGYNSGAICTFPEFLKSEIKSTLKQDNDVPIAVS

SEQ ID NO: 53379 - protein, 181 aa, Sorghum bicolor
  Clone ID: 13390270.pep
TRPLKGVDGELLNHHSSSESEECFMAFARVFSGVLHAGQKVFVLSPLYDPVKGDTVHKHVQEVELQYLYEMLGQGLKPVASVGAGNVVAIQGLGQHILKSATLSSTKNCWPFSSMMFQASPMLKVAIEPSNPADLGALVKGLRLLNRADPFVEYTVSQRGEHVLAAAGEIHLERCIKDLEE

SEQ ID NO: 53380 - protein, 75 aa, Sorghum bicolor
  Clone ID: 13390290.pep
FLRKHEVKTFDKMLKKADNASCSLHSLPEESIETLRPTFSSALRKLEESLESEAAKKSNLGDKMPGASKRKRSNQ

SEQ ID NO: 53381 - protein, 113 aa, Sorghum bicolor
  Clone ID: 13390298.pep
HTVAKELNRVFDLLWESMERKFIGPSPVQEQKTIFTEVQALMDSKSTIGCSNSKPSVIRRPVACSNSIANKPLTDVLSFKVKIVSFVGSDKQISSKGIQKDEVSSQVEYTKRS

SEQ ID NO: 53382 - protein, 38 aa, Sorghum bicolor
  Clone ID: 13390325.pep
IRILAINIHLWLGRIYKPEYYMNQLHFYELAVKLRWCH

SEQ ID NO: 53383 - protein, 162 aa, Sorghum bicolor
  Clone ID: 13390334.pep
LVDVGGSSGACLEMIMRRVPTIKEGINFDLPDVVADAPAIAGVRHVGGDMFKSIPSGDAIFMKWVLTTWTNDECTAILRNCHAALPDGGKLVACEPVVPEETDSSTRTRALLENDIFVMTTYRTQGRERSEEEFHHLGIAAGFTGFRAIYLDPFYAVLEYTK

SEQ ID NO: 53384 - protein, 91 aa, Sorghum bicolor
  Clone ID: 13390369.pep
EEQMPSISSSGYESNKGYLKQPHPDTKYLSQVHCIPSTLDFSEYIDQDWLFSVGHVKQTETLEAIESHQVWTDAQLIDTADVSAMPYVVPF

SEQ ID NO: 53385 - protein, 187 aa, Sorghum bicolor
  Clone ID: 13390372.pep
NMRSTAGGMFPTVGQNVESPFLRGAIDISSRKGESGFKKGTKYADHDPLPMYLNLSSGDTPTKDYQTSLLKTEVNKTTYLQGKDSVVKGEFQFGSRAEKPFILNGTGVGQNGLAKVSGYAGFREDYKVPTKENILSFSKKSSVDGAQASKGVSRWRSDESSEDEEERTNRESAASLVARRRPRFSRR

SEQ ID NO: 53386 - protein, 72 aa, Sorghum bicolor
  Clone ID: 13390376.pep
ANSGTKYRTSRLDACNHRKPKICSLNSVTNVTRSVSHPNSTSVTPIYAPLLQTSWCISSESQDIQCRMQHLK

SEQ ID NO: 53387 - protein, 123 aa, Sorghum bicolor
  unsure (1)..(123): unsure at all Xaa locations
  Clone ID: 13390378.pep
DVLVDVPFPXLQKEMMAFLANTEKHKDIEACDEVISASIKKIHEHRRRRAFFLGFSQSPVEFINALIASQSKDLKLVAGEANRNIEKERRADFYNQPWVEDAVIRYLNRKPANEGSGGGAGGS

SEQ ID NO: 53388 - protein, 96 aa, Sorghum bicolor
  Clone ID: 13390422.pep
STHKVLTPESEVFKFVDPICFSAEVPSKCGHGCCGAHKQPRKNSLLGPEFNEFEDHPPILNTSFASLVSEISSIAWMRSGMQSSDASTLFQSVPPT

SEQ ID NO: 53389 - protein, 67 aa, Sorghum bicolor
  Clone ID: 13390441.pep
LILTAGRDLEITSENQDRYICIYHLQQPADKNAQEQTTPGDLESMVAEADRPNFTTLPAKEHDQEIV

SEQ ID NO: 53390 - protein, 108 aa, Sorghum bicolor
  Clone ID: 13390460.pep
TYNRFEGKNSFGAVIDFTVRSEMRLSIGQVHRNVLALASSRSCFVLGDRLSFRMLSQPRVAGFHQTAWRGSQILEDNSRGGPLTLASLEVQSRVGYGKKEKVARTAVP

SEQ ID NO: 53391 - protein, 156 aa, Sorghum bicolor
  Clone ID: 13390462.pep
TRAPHPENEAKKATLLPPPPLPLPGPPSLPLAALPPSHAHLRRHHRPPSPPLSTQRSSSPPQTLGVSLAYLNLPPLRCNPTPDPGSTRKCPRILVSCAWSLLGCTKFGLFRWVGSSDLFSYSFYIFPVSWLGLCHRFEHLGLGRLTLSRPPPHILI

SEQ ID NO: 53392 - protein, 111 aa, Sorghum bicolor
  Clone ID: 13390464.pep
HSLPPRWRRPRPCQPRTCPSSAAAAAGKSPPSSPSSRHPAMPGTRQRRTGSGLQPPPPTAAHPSPPPPCRATRRGQTLALTANAWKPLGRRRWKKWPLKRTSAPKQLNLVP

SEQ ID NO: 53393 - protein, 184 aa, Sorghum bicolor
  Clone ID: 13390474.pep
MRPFHPPRPNPNQHHRPRPGGDPGPPHLPGTPMHPAFPPPVPNLAAAAANPMAAAAAANPFLALQLLGQAQQLQNLGFLAAAALQQQQQQQQAPFFPGGFPANPNQFAPFAGGPRPAGFNGGGAFRPGGPGFCGPRPPSPMMSPAGNGSNNNNNAGSGGASRPILNVWRKDHNSKAGSGGTPGP

SEQ ID NO: 53394 - protein, 149 aa, Sorghum bicolor
  Clone ID: 13390498.pep
MSGWDEGAVFYSDQAQFPRGGPGGDPAADLTRHSALRKFKEFLRGFTGPTGDFPYRESLVHNRDHVTVAIEDLDAFDAELSDRIRKSPADYLPLFETAAAEVLASLRSKVAGETGEMEEPVTGDVQIFLSSKENCLSMRSVGADYMSKL

SEQ ID NO: 53395 - protein, 98 aa, Sorghum bicolor
  Clone ID: 13390511.pep
HEGPSSSRSPSPLLGLVPTAAEHTHGLAYSEATMAGCLVARTSSSKRQQLSLSILLLVLFQSSCSCCYAATVGYSYSEQEGDRVAFLPGQPRSPPVSQ

SEQ ID NO: 53396 - protein, 111 aa, Sorghum bicolor
  Clone ID: 13390571.pep
TRQKQEIGAQFYESKTEASTEASAEASADIPKPVYSAPAATKPAASKPKASKPKTGGSSSGFTGTGSGVDKKFESGTISCDTFPSEYGAVALDWLELGGWSGIQYVPDFSL

SEQ ID NO: 53397 - protein, 103 aa, Sorghum bicolor
  Clone ID: 13390589.pep
TRYRAPEIILGLPYDHPLDMWSVGCCLYELCTGKALFQGKSNNEMLRLHMELKGSFPKKMLRSGAFTMQHFDRDMRFQDTHDDPVKGKVVRRSSEEDKRPRST

SEQ ID NO: 53398 - protein, 156 aa, Sorghum bicolor
  Clone ID: 13390601.pep
MAPRFWTTLCALTFGSAVLAAPQLAPRATDSLDTWLASEVPFAKEGILDNIGSDGAYAKSSKSGIVIASPSTSNPDYYYTWTRDSALVVKTLVDLFKNGDTDLLTVIEEYISSQAYIQTISNPSGGLSSGGLGEPKFNVDETSYTGSWGRPQRDGP

SEQ ID NO: 53399 - protein, 188 aa, Sorghum bicolor
  Clone ID: 13390612.pep
FGPGFPELEQVEQHLSQNPNLMREIMNMPAMQNLMNNPDLIRNMIMSNPQMREIMDRNPDLAHVLNDPSVLRQTLEAARNPEIMREMMRNTDRAMSNIESSPEGFNMLRRMYETVQEPLLNATTMGGEGNTASNPFSALLGNQGSNQPGQGQPATNAPATGSESTTGTPAPNTNPLPNPWSTNAGSAQ

SEQ ID NO: 53400 - protein, 107 aa, Sorghum bicolor
  Clone ID: 13390632.pep
ARRCFSMGTYQYVLGASELRVALQTGRGGNGASSRFKGRVAGLCPVNADIMEGKRICARSKGESFSVSKIWQWSSVKGKLPAPPDTCSDTGSLPWMKINAAGDKSNM

SEQ ID NO: 53401 - protein, 118 aa, Sorghum bicolor
  unsure (1)..(118): unsure at all Xaa locations
  Clone ID: 13390666.pep
AIIRLSESLAKMRLTSVATPEHVDXAFRLFNVSTVDAARSGINEHLNLSPEIANEIKQAEAQIKRRMGIGSHISERRLIDELNRMGMNESIVRRALLIMHQRDEVEYKRERHVIVRKA

SEQ ID NO: 53402 - protein, 94 aa, Sorghum bicolor
  Clone ID: 13390679.pep
IKSGLRVWLYSGDADGRVPVIGSRYCVEALGLPVKTQWQPWYLNKQVAGRFVEYHGMTMVTIRGAGHLVPLNKPSEGLTLIDTFLQGKQLPAHR

SEQ ID NO: 53403 - protein, 143 aa, Sorghum bicolor
  Clone ID: 13390713.pep
KSKMALAEDPASLERRYIERQKNARIETANRAIGAVALEVDKLADQVTSIEKSIARGNKVAEVQITTLIELLMRHAVKLESIPAAGGDSSSQKNIQAKRVQKCVETLDVLKVSNARLQAVVVTTKWETFDAAATTQTQWELFD

SEQ ID NO: 53404 - protein, 79 aa, Sorghum bicolor
  Clone ID: 13390741.pep
ALRGRLIPGPNGVDHLMLLSMLREILPSPSHRGIKRHVGSSQCKRIRNRWLHTSVPSPYNDSRHSRFVTSPKRSIWSTC

SEQ ID NO: 53405 - protein, 182 aa, Sorghum bicolor
  Clone ID: 13390769.pep
LTWSYAALLTANMRRNSVVPPSWGETSASSVPGQCYATSATGTYSTATNTNWPSTLTGGSSSTTTSVTTTSRTTTTSKTTTTCTTPTSVAVTFNVIATTTYGENIKLAGSIAGLGSWDTSNAIALSADKYTSSNHLWYVTKTLPAGQVIQYKYIRVESDGSTKWESDPNRSYTVPAACATTC

SEQ ID NO: 53406 - protein, 132 aa, Sorghum bicolor
  Clone ID: 13390777.pep
MVELIHPPDPRTLLPPILACLPTAFVSPRPPPALLPLLSPILRQRVQFLTSVSVSPTDSWLRLLSWKSEKGEELQALVDGTNFEPHPVSGEIELPDELPVSYKRIDEETLHAQLSLPEYCLKAIYLWCPPDQ

SEQ ID NO: 53407 - protein, 147 aa, Sorghum bicolor
  Clone ID: 13390842.pep
SWRRGSPGSPPCAAPRRTRGTRPRSSSSSTRRQPPPAPTPPPTPPPRPTTSSPATAPSTTPAAPPPPSRPDPSYRSIQSESAASYLLPAARSMDGWICRWNRMPPAGCVCACLLDGWIRRRRGPVTYHCLAAASLQKLRRRRARSSC

SEQ ID NO: 53408 - protein, 145 aa, Sorghum bicolor
  Clone ID: 13390865.pep
ARGCDRADPPIPCELVRGHLDYTPHAWNVVPVRKGNGWVRMIFDACYPTNIKEETDPEYFCRYVPLSRLQIALDDEGYTPRCSFPSVSSCKEIEVTASSSVYHCKIGAVDAAAKIPYLDTRSASNDEVKLFEYKLLGEVRMLGAL

SEQ ID NO: 53409 - protein, 159 aa, Sorghum bicolor
  Clone ID: 13390876.pep
MKRIIASEITQQVQLCPFHFIPSGLHVPVTAIYNTRYGEIEERQSELRKELHIRLGLPLDRPLLRISNALTFGSMGKRKKSMPRSGSSLLREVHREIPSSGVSGGVMSLIDGSYEYYHYLHDGIDDNGWGCAYRSLQTIVSWYRLQQYSSIDVPSHREI

SEQ ID NO: 53410 - protein, 99 aa, Sorghum bicolor
  Clone ID: 13390949.pep
MIPYGTAAEAEAALGRGLTPAEAAWFRYSAAMPDHWLLWHNTFILFLAHMVVPLPLALLERVAPAFAMRYKLQPRVRLSMAAVARYFGDTIRVFLLVLV

SEQ ID NO: 53411 - protein, 77 aa, Sorghum bicolor
  Clone ID: 13390969.pep
ARGPGALNEPGLGVGFNGADNQVDPSSLNGLVKPDQGILQMSPPQSTVPSQLFPFAQGHGIESFTFDEVYGNGLSIK

SEQ ID NO: 53412 - protein, 133 aa, Sorghum bicolor
  Clone ID: 13390975.pep
MVLISEDSRELLQAHVELWNQTYSFMKSVALAVALDLHIADAIHRRGGAATLSQILGEIGVRPCKLPGLHRIMRVLTVSGTFTIVQPSSETMSSESDGREPVYKLTTASSLLVSSESSATASLSPMLNHVLSP

SEQ ID NO: 53413 - protein, 108 aa, Sorghum bicolor
  Clone ID: 13390990.pep
LQRQVDGSEADSSAQTNGYPPGAANEASLASLNHPRPSSDSTASSDAVAKLELEAESRSACEVGVKQHITSNIKSLFRLAKSTGISRTEFQSLVKTELDLLDMADVDE

SEQ ID NO: 53414 - protein, 79 aa, Sorghum bicolor
  unsure (1)..(79): unsure at all Xaa locations
  Clone ID: 13391040.pep
CHLXHVCNPIPPFSPFHCCHHHLMGGLSYQFRSLVPQGICLLDRCIGFCTCIVLFIFILLFREKLSQSATVVRVLVTFD

SEQ ID NO: 53415 - protein, 89 aa, Sorghum bicolor
  Clone ID: 13391062.pep
ALSYVQKVSEKVSLASDFMYNQMTKDVTATFGYDYMLRQCRLRGKLDTNGVISALLEERLTPGVTFQLSAELDHWKKDYKFGFGMALGE

SEQ ID NO: 53416 - protein, 70 aa, Sorghum bicolor
  Clone ID: 13391109.pep
PQSSLEVDTPNHVTLITAEFIHASTKQTEFIYAANKGTYERVAFVLNNFTRSDLMHQQFIPQRDSGSRAS

SEQ ID NO: 53417 - protein, 95 aa, Sorghum bicolor
  Clone ID: 13391114.pep
SIFEAISAHCGYNFPFDPTKLIPYHGGAEFHDYHHLVGRQSNSNFSSIFTYCDYIYGTDKGYKYYKANVAKVKAKLARNSTEREGRNGFSSTKLD

SEQ ID NO: 53418 - protein, 151 aa, Sorghum bicolor
  unsure (1)..(151): unsure at all Xaa locations
  Clone ID: 13391168.pep
MEKEKEKGSSGPLPAGAAAAVGYMSVEDADALDCGACYHPLKPPIFQCDXGHVVCSSCRDKLVPSGKCHVCGTATSNYHMCHAMERLVDSIRVPCPNAAYGCNTRPAYYDHHGHCKTCPYAPYHCPNKECSFFGSTDALLDHLTGAHGWPS

SEQ ID NO: 53419 - protein, 185 aa, Sorghum bicolor
  unsure (1)..(185): unsure at all Xaa locations
  Clone ID: 13391219.pep
ARGERGVPAMVAAFATRRLLYPSQAFDIIHCSRCRINWTRDDGILLLEVNRLLRAGGYFAWAAQPVYKHEEAQQEAWKEMEDLTTRLCWELVKKEGYIAMWRKPLNNSCYMNRGPAVKPPLCDADDNXDXVWYVSLKACISRLPENAEAPTPVQWPARLMEPPKRLQGVEMDAYSSKNELFKAET

SEQ ID NO: 53420 - protein, 179 aa, Sorghum bicolor
  unsure (1)..(179): unsure at all Xaa locations
  Clone ID: 13391231.pep
HEGGIYVRLFLKDPKFPLRNPKRFLEGLLDQYVSSVAATHYEATATDPELPLLLSAALVSLLRVHPALADHVGYLGYVPKLVAAIAYEGRRETMASGQATSGLQAEPSEHDNSAHSEATVQTPQERVRLTCLRVLHQLASSTTCAEAMAATSAGTPXVVPLLMKAIGWQGGXSILALET

SEQ ID NO: 53421 - protein, 140 aa, Sorghum bicolor
  Clone ID: 13391250.pep
HEGHSGRRRRGEAGPAVAFFLLLQSCSAPERLLGFPSHQLWPQHKQRSGTSQQRRPGSMLAARNPPPPPHDIAARLHHLRDLRRVPLPNRVARIADLHTDEASPVRKLVAEIIGELGSKHMAYLPDMIPCLLHLLNDETP

SEQ ID NO: 53422 - protein, 183 aa, Sorghum bicolor
  unsure (1)..(183): unsure at all Xaa locations
  Clone ID: 13391265.pep
ARGYNLFLQMIDRGIPPDVVTYNTVIDGLCKAQVVDRAKAVFQQMLDKGVKPSNGTYNCLIHGYLSTGKWKEVVRLLEEMSTHDLEPDCFIYALLLDYLCKNGRCTEARNIFDSVIRKGIKPDVTIYGIMLHGYATEGALSEMHXDLMVGNVVSPNHHIFNIMFCAYAEKAMIDEAVCIFDKM

SEQ ID NO: 53423 - protein, 170 aa, Sorghum bicolor
  Clone ID: 13391287.pep
ARGQNAMMAKTGVLGADAESKVAERPRLNLKPRSYATGQSDEIAVKERPSLFGGARPREQVLKERGVDVLASDLEKTSPVGRPKGEFAKVEQKVEALSINPSVERADGFPAGHRGPRSVDKKDYKRDTDRGDAYRPTRWEDNRRVARDMEKPQEQPRSEPETWRKPVEPP

SEQ ID NO: 53424 - protein, 48 aa, Sorghum bicolor
  Clone ID: 13391319.pep
NWFIQKSDGMTRILASNTIALTSHEAVVLCVCLLGPTLLNIAIYNLLP

SEQ ID NO: 53425 - protein, 139 aa, Sorghum bicolor
  Clone ID: 13391373.pep
AGFGGFAAALISRKLDWWVMNVVPISEPNTLPVIFDRGLLGVAHDWCEPFDTYPRTYDLLHASGLFSKEQKRCNISSILLEMDRILRPGGKAYIRDRKEVIQEIKEITNAMGWRGTIRDTAEGAYASRKVLMCDKPMGR

SEQ ID NO: 53426 - protein, 50 aa, Sorghum bicolor
  Clone ID: 13391386.pep
AGLIESSSSRLTYAITAPPPQPSLVRLPSSSPSPPSAPANPSGRHSYQHS

SEQ ID NO: 53427 - protein, 58 aa, Sorghum bicolor
  Clone ID: 13391419.pep
LAAANLLDEECCCRSWMILHFFPTMEKNHRIANSVHILNVVAGSGRSVEQLAGSYQLS

SEQ ID NO: 53428 - protein, 119 aa, Sorghum bicolor
  Clone ID: 13391467.pep
TRLYDGSNDCYFHSGKRGHHKYWGTRMFKYDDVDVLHFLLSNLNWWVTEYRIDGFQFHSLSSMLYTHNGFSTFTGAMEEYCNQYVDKDALIYLILANEMLHQLHPDIITIAEDATFYPG

SEQ ID NO: 53429 - protein, 55 aa, Sorghum bicolor
  Clone ID: 13391479.pep
SFTKNSLIITVELENRSTVSNITVYGNILKIKICYQSRLSRFLTVMTKKEESETI

SEQ ID NO: 53430 - protein, 72 aa, Sorghum bicolor
  Clone ID: 13391501.pep
MALLAPAISGEVGLRLLLAPLSSNVVIRTASCAVGIGLPMYSTFRAIEKKDEKEKERLLLYWAAYGSFSIAK

SEQ ID NO: 53431 - protein, 92 aa, Sorghum bicolor
  Clone ID: 13391508.pep
SPARGKSKMHLSAFALTDSALAPKKSLVFHFLLVFSLPRQYEPRTEPTELAISSAVGDALIGMLGDLLTIGLCIEVMKCQLRHPENRQGIGL

SEQ ID NO: 53432 - protein, 103 aa, Sorghum bicolor
  Clone ID: 13391511.pep
MAASTLSTVKVSNVSLKAAQRDIKEFFSFSGDIVHVEMQSGDELSQVAYITFKDNQGAETAMLLTGATIVYMAVIVTPANDYELPASVLAALEPKDTKPSALQ

SEQ ID NO: 53433 - protein, 121 aa, Sorghum bicolor
  unsure (1)..(121): unsure at all Xaa locations
  Clone ID: 13391549.pep
ANCPPCGEPACSTSTAGTAPSSMPCAMRGTTPRTSQPRPRAPPAASPLPATPRAPSRASSSTTXRSTPASSTGSCPRTSMASSLPAPAPALAPEPLTPQTPWAWPPMPPCSRSPSFIRWIE

SEQ ID NO: 53434 - protein, 134 aa, Sorghum bicolor
  Clone ID: 13391554.pep
HEARSPHSYRPAAGCEASSGGPRGELHRSRPMSVPLVGLARIPIPTSSSLPLPWSSCLLPFPLSSLDPTNYFPNCLFLDPAMAASKNPSWLLSPRLLPLHSPSKKQREAAAPSLHAQVTVPAPPPRDQQQLTWP

SEQ ID NO: 53435 - protein, 98 aa, Sorghum bicolor
  Clone ID: 13391557.pep
ARGKSFSKLLCDAPYLPESSFRLLEDLCMSQDNSQQLKDGDGDRVTQGLGTVWSLILGRPPLRDDCLDIALKCAAHSQDEVRGRAVRLVSKRLYDLPY

SEQ ID NO: 53436 - protein, 102 aa, Sorghum bicolor
  Clone ID: 13391601.pep
CGQQACLNRLPGFQEGHDDMKEAVWQRAQPVWAASQASFDDTTHAGPLPEGIIKLHGVPERRSLNLPWGEERLQPEEKQQREGRRRRRRRERGARGEGLASC

SEQ ID NO: 53437 - protein, 138 aa, Sorghum bicolor
  unsure (1)..(138): unsure at all Xaa locations
  Clone ID: 13391621.pep
QHEPTRARNHAPRRVSPYPHPMAGSDRNNIVIACFALLVSISALQVPSCIIDDERGTSTSTSAGTTTAAAVTASASAPPPLFDDGALMKAAMLALAGMDALVIAAAVIYSRHTHHAAXGAGGGGNWRVSELAFFVLCL

SEQ ID NO: 53438 - protein, 129 aa, Sorghum bicolor
  unsure (1)..(129): unsure at all Xaa locations
  Clone ID: 13391694.pep
AEQSVSTAGSAIMKNRYVLTGAAWVTGAFSKVTSAANDVGAKAKEKIAVEQEHKNAEAGPAQANISEFPAAPRELDSEFTKIHVAETPEEIPVSTVTVPXLLQRRSSARPLHQLMFLQSQKLHRVWYYK

SEQ ID NO: 53439 - protein, 52 aa, Sorghum bicolor
  Clone ID: 13391725.pep
CAAKKHAKSKTNLDGRRERDGLCSNNIRHSASSCRIIMRRAERCTQKGENKT

SEQ ID NO: 53440 - protein, 108 aa, Sorghum bicolor
  Clone ID: 13391791.pep
LCLQLQVGVLQFVLFVQEPTAAARELGASAARALPCVAFVTFFLGITLIYAHVDVGNGGGAAGGAVAGDGPVPAPATATVRLLADMTLGAALACLMSIILALFYIKTK

SEQ ID NO: 53441 - protein, 61 aa, Sorghum bicolor
  Clone ID: 13391823.pep
YANSFLKLVLYNKDSKLLCNGLCKFCISKSCLYDSRINSSRHHRASLVINEDPRKTTERFR

SEQ ID NO: 53442 - protein, 138 aa, Sorghum bicolor
  Clone ID: 13391828.pep
KSEGWVATKGISLSLCADVASIYCHITWDGWRRGGWTPTRIGIQRELMVRGGFGSVDCIYGTTELLVQSYVVPVAVALLDSSASCAGQLDCRGEVGEARRRGRLTVEALDGRGRVACAVSRAVASRRARAAAGGPSRR

SEQ ID NO: 53443 - protein, 164 aa, Sorghum bicolor
  unsure (1)..(164): unsure at all Xaa locations
  Clone ID: 13391831.pep
HEGDEDLKTLRRIIAAVRAAEMRAASASDVCPVAATTTTTPAGKGAKSTFGRDDXQSPSPSPPTPQQQHKVVRAGEQQYPSPDSVLDAISSPRFPCRKRPSPCTDLDVGGKGGCGNGALAPTVGSKIVKPSRTLVFSGGYCKTKSDGDELPLHAVHYPVPLVVG

SEQ ID NO: 53444 - protein, 117 aa, Sorghum bicolor
  Clone ID: 13391849.pep
HEAESSANGSSRNRHHNTLLPPPTTSESLTIPTATNFNVPYPPVEQLNQSTNIAASSTLSDHYSSYSDPHANEFVRNTRMRINPSDYDQSLPSLLPEGSFRCSAYQSTQQQSSFIPV

SEQ ID NO: 53445 - protein, 84 aa, Sorghum bicolor
  Clone ID: 13391866.pep
MSSDPSPHLPSPVAPPGAAEADPQPLPLPQPTEPPEVMHRTRAVDFLGRRTPIVYQNDNGPCPLLAICNVLLLKNVISLNPDEG

SEQ ID NO: 53446 - protein, 163 aa, Sorghum bicolor
  unsure (1)..(163): unsure at all Xaa locations
  Clone ID: 13391911.pep
YLLLLVLAGDGRGEVAAFELEEATIDSIHRAFATGGLTSRGLVELYLRRIASLDPTLHAIIEIDPDGALAAADRADAAARSSSGVLPPLHGVPVLLKDNIAAAGDGGVLNATAGSLAMVGSRPARDAXVVERLRRAGAVLLGTASLSEWCNFRGPGIPAGWSP

SEQ ID NO: 53447 - protein, 148 aa, Sorghum bicolor
  Clone ID: 13391925.pep
MAAAAAATPLDDAKAKNVIRQVEFYFSDSNLPRDGFLRRTVEESENGLVSLALICSFSRMRSHLGLEGDVKPDTVPEETVLAVADVLRRSTALRVSKDGKKVGRSKELLKPDEVIDQVDSRTVAASPLPYNVKLEEVESFFAQCGKVN

SEQ ID NO: 53448 - protein, 158 aa, Sorghum bicolor
  Clone ID: 13391936.pep
TNKLRYLNRACVLRNPGKVDGAACDPWRLCTVQQVEDAKAVIRVLPIWSTGIMPGVVVGQQMFPTLQAKTMERRVGKLDIPAASFGVFAILTLTVWVAVYDRVLVRPLSRLTGHARGLSLRQRMGAGLALFAVAMAVAAHTESVRRAAAIAQGLLDRG

SEQ ID NO: 53449 - protein, 145 aa, Sorghum bicolor
  Clone ID: 13391943.pep
TRAAAKNHKDVLIVVDHNDYPALLEYLKGKQEDQQFRRMLAWKAFQHVASYDSVVSEWFWKQSNKVGEMFPPSFTVPLELKSTLRYGENPHQSAAFYADKSLSRVGAGGIATAIQHHGKEMSYNNYLDADAAWNCVSKFDSPTCV

SEQ ID NO: 53450 - protein, 156 aa, Sorghum bicolor
  Clone ID: 13391949.pep
MTEDRAHKVADEPAAAGRRRPERKKRKWDQPAEDLVSAAMKAAAVAGMPVMNFCALPGAALPGVTAYGAATLPSVVPVPHSLPPHIAPSVLPSAAAAVQKLSQAKLPDEVIAREIVINDADPSVRYKLTKRQTQEEIQRCTNTVIITRGKYHPPNE

SEQ ID NO: 53451 - protein, 57 aa, Sorghum bicolor
  Clone ID: 13391953.pep
FCWIIFSEQTILFCIRDICLTDTLVQLFLTDIQVVVSILVLLFTCIFFECYLKPELN

SEQ ID NO: 53452 - protein, 59 aa, Sorghum bicolor
  Clone ID: 13391965.pep
TRAELASCLLQNLTKVAQETLPASFGLAERVLGLCRDKLKPVLHELLKGTPLDEYSNVA

SEQ ID NO: 53453 - protein, 86 aa, Sorghum bicolor
  Clone ID: 13391978.pep
PPPPPPPPFFSLSGFGLPLLFASAEPDLVLEPCIAAPVCPLPQLLLGLASSRSRPFGASGRAASLSNEQAGKWSAMNAEKFGEASC

SEQ ID NO: 53454 - protein, 60 aa, Sorghum bicolor
  Clone ID: 13391980.pep
MAPTETYARDDDAKLEATRARLSNILTRHEDLKERLSRDSDKLIFERLQKEFEAARAAQT

SEQ ID NO: 53455 - protein, 91 aa, Sorghum bicolor
  Clone ID: 13391993.pep
SRQWSSSQAHQGYTPAESSRQWSTAHQSYTPEPSRQRSSERQGYNVEPSRSWSSGQQGQNPEASRQWNRGKQDPYYNPSDGRRSYDQHRRR

SEQ ID NO: 53456 - protein, 83 aa, Sorghum bicolor
  Clone ID: 13391997.pep
IIYDLVDPNANLIFGAVIDPSLSGQVSITLIATGFKRQDEPEGRASKGGQQGENGRRPSFAEGSMVEIPEFLRRRGPSRFPRV

SEQ ID NO: 53457 - protein, 128 aa, Sorghum bicolor
  Clone ID: 13391999.pep
MGRRVRYEYIIPGPKRARLAASTETIQRLLREVRAGDASQTECAVCLQDYAAEETIRAMPVCAHAFHHHCISEWLSRNAVCPICRRELPLPTHQDQEEQQQQEEEVDDEEDENGVRRSWNWIRVPVSA

SEQ ID NO: 53458 - protein, 111 aa, Sorghum bicolor
  unsure (1)..(111): unsure at all Xaa locations
  Clone ID: 13392003.pep
MRRTRQKQGPKKMTRKSRPAIDQKFRSTISSCTRTRPRARRTAPAAARQPGRPPGRARWHAPARPRPCRARRRPRRPAGPAAAAPTLLPPPRSPPXARXSPAPPPRPPAPT

SEQ ID NO: 53459 - protein, 90 aa, Sorghum bicolor
  Clone ID: 13392065.pep
EVLQIAGTSESTPAPIIDSEKTPTKDHKNESSVPVTTARKRLFEEENVIDKESTGAQDLDAQTAGGDNLMDLTDPPPPAKTKRPKYKAPK

SEQ ID NO: 53460 - protein, 45 aa, Sorghum bicolor
  Clone ID: 13392079.pep
RGSSGGKATDTKNPGGVGAGRREAASDEFMLERFRKREKFRALRR

SEQ ID NO: 53461 - protein, 180 aa, Sorghum bicolor
  Clone ID: 13392086.pep
DNLEIPSMNVINDAMQSGERALMLAEFKLSLNSYLSELATSPVRSLSDIIEFNKKHPIEERMAEFGQDYLLQSEATNGIGPTEEHAILNLNKLCKRGLEKIMQDNQLDAIVAPGASAHSLLAIGGYPAITVPAGYAANGVPFAICFGGLKGSEPKLIEISYSFEQATRVRKPPSMQHSVI

SEQ ID NO: 53462 - protein, 167 aa, Sorghum bicolor
  Clone ID: 13392096.pep
KGNVSEEQSDAVEELKGVSAGETSQSVDKDDKSPSDNAQDKISREDLKEEFTKFGTVRYVDFSIGEDSGFIRFEDSTAADKARAFAAIADEGGLTMKGHIVTLEPVSGQAEKDYWSAIRGGQEKYKDSRNNRGRDWRNNRGGKPFGGGKRGRHFDSRDRASNKAQKV

SEQ ID NO: 53463 - protein, 137 aa, Sorghum bicolor
  Clone ID: 13392114.pep
MLPPPTKNMPPPPPKSMPPPLPPKNMLPPPSKSMPPLPPKFPSDELLSRNENKTFALKELTAPPRPLDAKSVLPSQQRPKEPEEQTKGTPVSDTLLKLIDYGDDDDDDDDDDDTDVTDNIPKGSPTPGSEQKPFWAV

SEQ ID NO: 53464 - protein, 166 aa, Sorghum bicolor
  Clone ID: 13392150.pep
ANRIREVADAETIQWKEKVLDQENELQNIKQENDDLQAKESAASEKIKQLASQLANAKDGTINGNTKEGDNEKGDTEDEDEPVVVVSKMWENSKFADYDSSKEKENDGESQVDLESNKGDAGLDGNGLHSAKESSGKTSPTKQHQQHKKKPLLKRFSGLLKKKGEN

SEQ ID NO: 53465 - protein, 137 aa, Sorghum bicolor
  Clone ID: 13392167.pep
MREEVRSSSAAPPDPPPGRSASPPPTPVASSAGASSPPAQTNVASIDWLGSDQVPKAGSSHIAPPTSQPALSTNANGAAVDCFQSSCRPWERGDLLRRLATFKPSTWASKPKAASSLACARRGWVNIDMDKIECESC

SEQ ID NO: 53466 - protein, 171 aa, Sorghum bicolor
  Clone ID: 13392177.pep
ARGIILPKYDCMQHNQINNLKVLDVVVKSYFEGNMFANKIWTGTVEGLPVYFIEPQHPGKFFWRAQYYGEHDDFKRFSYFSRVALELLYQSGKKVDIIHCHDWQTAFVAPLYWDVYANLGFNSARICFTCHNFEYQGVAPAQDLAYCGLDVDHLDRPDRMRDNSHGRINVV

SEQ ID NO: 53467 - protein, 145 aa, Sorghum bicolor
  Clone ID: 13392187.pep
MKFGKSLSGQIVETLPEWRDKFLSYKDLKKRLKLIGAGNGAAERQPKRARRDDAGEPDASAAAAAMTPEEADFMRLLEAELDKFNSFFVEKEEEYIIRQKELQDRVARAAGRESKEELMRVRKEIVDFHGEMVLLENYSALNYTG

SEQ ID NO: 53468 - protein, 120 aa, Sorghum bicolor
  Clone ID: 13392201.pep
FLKAHRSSSMVVLSVGSPRSMGAGFRNEDSRADPCQSLLCSNRGPFEMNIGNNRLHQIDNLIDTWIYIANSPSDILVFPARRGIKRKIKRNDPTSNECNGFKPGGVKNDKERTTYIKHDK

SEQ ID NO: 53469 - protein, 186 aa, Sorghum bicolor
  Clone ID: 13392213.pep
TRHRPKHHRHKMHAPSPSPFSSAPKALPSPSASAPAISSSGSLHPLAAPPRLLISSSPSISPPHKHSSRNYSLVAAGSAVFVVMAAASVMYCRVKKVGTVRPWATGLSGQLQRAFVTGVPALKRSELEAACEDFSNIVGSTPSCMLYKGTLSSGVEIAVVSSSVTSVKDWSKECESHYRKKSQVYP

SEQ ID NO: 53470 - protein, 132 aa, Sorghum bicolor
  Clone ID: 13392223.pep
HEGPSLVAQSRSPHHRSGGAYPPQSGVSCLPNPNEQLVPVLIPTHPVPSSAPSPAHQQNRITWRGCYVRRRRRLNGMADHLPLQRPAPPLPAHSLCRRRRPRAPLPQPVSHLCVRHHCLCTPCAADDAHVRP

SEQ ID NO: 53471 - protein, 69 aa, Sorghum bicolor
  Clone ID: 13392228.pep
MEGCQLLVGCRIEMEEEAFFDSREELTASPAPSPGPALPWSGSLDSVCQKRERFMRSMGLECCPAPPQA

SEQ ID NO: 53472 - protein, 199 aa, Sorghum bicolor
  Clone ID: 13392239.pep
TRRSSDILTTSDGLAKRARFDMSATSNLPVLGSSDYSDMQADDGSSVGHLSDPAILNNDVSPVEKMIEMIGALLAEGERGAESLGILVSTVEADVMADIVIETMKHLSEASFHLATNNGVQQLNFKYSSGLLAQNLPANSDSSLFTAQSTPTADGVSMSPSEAFVMTSVHDAKRDPRRDPRRLDPRRIVSPSALNSIQG

SEQ ID NO: 53473 - protein, 128 aa, Sorghum bicolor
  Clone ID: 13392256.pep
KLLAHSGIPEDLEVGYVPLSFSGAFPGLYLFTNPARFVRPAFMEIRCPDGGDGGRQEQFPATHEEIHPTAILSVVANLTPWSDHNQSPRNMYQCQMAKQTMGFCGQALKFRTDVKAFHLQTPQTPIVR

SEQ ID NO: 53474 - protein, 201 aa, Sorghum bicolor
  unsure (1)..(201): unsure at all Xaa locations
  Clone ID: 13392266.pep
ARGSSHQHRASSTATAPIRSPSPATEGPARRLSHQHGDRRYPRWTGARLRYSRSLPGRLSGGAQLRSSRSLPGRLSEIMAPLQWPEPMMDYFVDECFKMVQGGRTPANETFFRTLDRSMASKSFGTTFSQMDLTKQFERVKSLWNSYHTILKNLEITKANERRXQTYPEKLHLKTGDIYARKFTLIRKYEIKLNTIFESYY

SEQ ID NO: 53475 - protein, 81 aa, Sorghum bicolor
  unsure (1)..(81): unsure at all Xaa locations
  Clone ID: 13392277.pep
LGVRNLPSMEGIDVFDQKLITFFLQLFVITSGIISSLSIMNMIQSRRQRIHESLCFTTLVSFILWLVDTHPSWCXLKLKCI

SEQ ID NO: 53476 - protein, 93 aa, Sorghum bicolor
  unsure (1)..(93): unsure at all Xaa locations
  Clone ID: 13392307.pep
HEGVXGNFNVASIDIEGENGGARMYMPPLLPPPQCESKLITRADDTEEVVKERLRVYHDLVGSNCLRLPFEILACSFFLISIYLTRILNLCYL

SEQ ID NO: 53477 - protein, 96 aa, Sorghum bicolor
  Clone ID: 13392322.pep
TRAVENSSYFEIPPEMYPKEVGDVSKGMAEADHRIPSTEVKLASEYYFYMETQTALAVPDEDNTLVVYSSSQYPELAQSVIARCLGIPFSSVRVIT

SEQ ID NO: 53478 - protein, 61 aa, Sorghum bicolor
  Clone ID: 13392345.pep
HEGLVSKWRPKDRMKTGCVALVLCLNISVDPPDVIKISPCARTECWIDPFSMAPPKALDTI

SEQ ID NO: 53479 - protein, 137 aa, Sorghum bicolor
  Clone ID: 13392353.pep
MVSREQHTHSYEHLVLDPASLPLGVSWADPAAVEIPPQLLAALGEYLSAARGGGGEEDAEADDEFMMYEFKVRRCARARSHDWTACPYAHPGEAARRRDPRRVAYTGEPCPDFRRRPGAACPRGPACPFAHGTFELW

SEQ ID NO: 53480 - protein, 164 aa, Sorghum bicolor
  Clone ID: 13392375.pep
TRARVLGREESVPEFWDLIQEIKAAGMHVDIDTYLKLSRNFQKRHMVREAVELYELMMDGPFKPSQQDGPIIIRRISLGRSPDLELVNRVVNKFEAVWGVKTKELLDGVHRALTSNGKFDEAAEIVQTMRDQGHQPDNVTYSQLVYGLCKAGKLEDARKVLDEM

SEQ ID NO: 53481 - protein, 98 aa, Sorghum bicolor
  Clone ID: 13392391.pep
MGLGVVAELVRLGVLSSTSDHSSVVSINLFVALLCACIVLGHLLEENRWVNESITALIIGLCTGVVILLTTKGKSSHILVFSEDFFFIYLLPPIIFNA

SEQ ID NO: 53482 - protein, 132 aa, Sorghum bicolor
  Clone ID: 13392407.pep
MGSMAVDTMESVAVVAVPFPAQGHLNQLLHLSLLLASRGLSVHYAAPPPHVRQARARVHGWDPKALGSIEFHDLDVPAYDSPPPDLAAPSPFPNHLMPMFEAFAAAARAPLAALLQRLSATHRRVAVVFDRL

SEQ ID NO: 53483 - protein, 72 aa, Sorghum bicolor
  unsure (1)..(72): unsure at all Xaa locations
  Clone ID: 13392440.pep
CLSLSLFKNENQIKIVCNINLFYFSIKFAINKICRDEECMMEMMNSCSIVIXFEVPSFKFEFSQGLDTLFDN

SEQ ID NO: 53484 - protein, 205 aa, Sorghum bicolor
  Clone ID: 13392446.pep
HEGKTQAWNEKIKRLRLLLTVKESAMDVPTNLDARRRISFFANSLFMSMPDAPKVRQMLPFSVLTPYYKEDVLFSSQALGEQNEDGVSILFYLQKIYPDEWKNFLERVHCESEDQLHETEQSEEQLRLWASYRGQTLTRTVRGMMYYRQALVLQAFLDMARDDDLMEGFRAADLLSESDESQLLTQCKAIADMKFTYVVSCQQYG

SEQ ID NO: 53485 - protein, 161 aa, Sorghum bicolor
  unsure (1)..(161): unsure at all Xaa locations
  Clone ID: 13392454.pep
HEAAVALDAMLNQKRWNNSGDEKLKLYTIYVAVGQKRSTVAQLVKALEENDAMKYSIVVAATASEAAPLQYIAPFTGCAMGEWFRDNGRHAVVTYNDLTKQAVAYRQMSLLLRRPPGREAFPGDVFYLHSRLLERSAKMNDDHGGGSLTALPVIETXGGDV

SEQ ID NO: 53486 - protein, 123 aa, Sorghum bicolor
  unsure (1)..(123): unsure at all Xaa locations
  Clone ID: 13392456.pep
MVWSAGRMAMRGASAALLVLALVAAVARAEDPYHFFEWKVTYGTKTIMGTPXKVILINDMLPGPTINCTSNNNIVINVFNMLDQPLLFTWHGIQQRKNSWQDGMPGTMCPIQPNTNFTYHWQP

SEQ ID NO: 53487 - protein, 176 aa, Sorghum bicolor
  Clone ID: 13392459.pep
HEGNCKPIENWTAPIGSWWLLSEVSSFAPKSVDWKFLSHHWKLLDNVVQDDRGKACSQVEPNSALWAVNRVSLLQTISNVSMELPVKPAAELAQSLLTRIEDFDMNLSEVDAHVKALKTLCKRKAKSANEGEALILKWAQQLIHSAFDILDQYIKEASESARGHSFVTPMTGKRKG

SEQ ID NO: 53488 - protein, 162 aa, Sorghum bicolor
  Clone ID: 13392506.pep
HEGHLPQERGLGFVFLVLGQCPAGATDKTNARLVACWPHSGLSPLTSSPRPPSALPIPLYIARSGHQLPIHISPICVSPLRLRPSTYAVAACQPTMMSTSHAVKQSPACAARWRRRQHGQRSADAPARTATFSARHGRQRRGGRGVAPCSVRAAGSNTIGCL

SEQ ID NO: 53489 - protein, 166 aa, Sorghum bicolor
  Clone ID: 13392516.pep
MAPPAHSAGARLLLRRLLSTVTEAAAETTAPTAPAAASGVAAPTAAATPSASAAAAKPAKKDPKLLYRRLSALGIAGEGSVSRVLNKWVREGGAPRSEELVKHVKELRKYKRHAHALEVMDWMVNARGMNMSITNHAIRLDLIYKVRGLEAAENYFANLPDPAKNH

SEQ ID NO: 53490 - protein, 49 aa, Sorghum bicolor
  Clone ID: 13392528.pep
GRQRSRRRCRLKGRMRRGIRRWRRRRVGRRGPGRRCGRRRRHGRGCGTR

SEQ ID NO: 53491 - protein, 204 aa, Sorghum bicolor
  Clone ID: 13392562.pep
HEEKALPPDVVKAIVDARLSLGLVLPEDKGFPNIHVRRVHRALDSDDVELVRMLLKEGKTNLDDAYALHYAVEHCDSKITTELLDLALADVNHRNPRGYTVLHIAAMRREPKIIVSLLTKGARPSDLTFDHRKAVQISKRLTNHGDYFGPTEDGKPSPKDRLCIEILEQAERRDPHLGEASVSLAIEGDSARGRLLYLENRVAL

SEQ ID NO: 53492 - protein, 141 aa, Sorghum bicolor
  Clone ID: 13392568.pep
VGDRGATVIRGWQVMSYFSDAAALCWFLEPELEREVRRLHRVVGNAVDDGYHLVVGTGATQLYQAAMYALSSSARGDQRQPVPVVSPAPYYSSYPPQTDLLLSDLYRWAGDANKFTGDECIELVCSPNNPDGAIREAVVRS

SEQ ID NO: 53493 - protein, 72 aa, Sorghum bicolor
  Clone ID: 13392570.pep
MGTRGIALVLLAAALLQALLPASAAAEGLVRVALKKQPIDQNGRVSARLSAEERQRLLLRGANALGSGSDDC

SEQ ID NO: 53494 - protein, 83 aa, Sorghum bicolor
  Clone ID: 13392582.pep
KQTPTSHAKDQGVVRQLLKPTAINKSKNEWTKNGFLARERSSKEKEKLSHSKILPSTEKGARGKKPSARKIKERKGILPLSLV

SEQ ID NO: 53495 - protein, 184 aa, Sorghum bicolor
  unsure (1)..(184): unsure at all Xaa locations
  Clone ID: 13392600.pep
HEAAMAAAVRAVGGESALEDSFARDRVSSIANHIRKAQLARRAEQTGIPGTVCILDDEPRSTGRHCGELDLCLCQSQKVTLSIAVMVQPVSGPVCLFGSEFQKKVCWEILVAGSEQGMEAGQVGLRLVTKGERMTTVAKEWNIGASSIADGRWHLVTVTLDADLXEATSFIDGVYDGYQNGLPL

SEQ ID NO: 53496 - protein, 131 aa, Sorghum bicolor
  unsure (1)..(131): unsure at all Xaa locations
  Clone ID: 13392608.pep
GTRLVSLPPSRRPRSRPSAPPPAFSRSPWTRPRPRTQPPPARPPPPPPPPXSAAASAAASASGDVAAMLPDSPPRRGAGHRRAQSEILLGGAALPDDLTFDADLGVVGEACVAGDEDEEDEDEDEEGGGGG

SEQ ID NO: 53497 - protein, 154 aa, Sorghum bicolor
  Clone ID: 13392610.pep
VEAVDNIRAVAAFSLEKQSYAVFGRALVKPYHATMKAIAWGNVWLAAAFSISNLVYALAYWWGSRQIAAHLYTQTEFFIVLPALLFSTQSCGQMFALAPDISKARVASSNIVELLTTRSAEEEMSPGSTANVQPSSRLLDEKLPDVEANEKAAS

SEQ ID NO: 53498 - protein, 175 aa, Sorghum bicolor
  unsure (1)..(175): unsure at all Xaa locations
  Clone ID: 13392612.pep
LQYSVYAASYRVKHIIITSLLLVLGAMSMTWICDTITESGFGHGSSLIICVGILTGYTDTLHKMITQFSGNFSYCWPYVLGVAGIFMILTMGAVLVPEGCRKIKLQYYGFKLASGAGNESTPVTEVEPYIPFNINPTGMQPLLTTSYLLAFPSIMASIFASPFWENLREIXNPKT

SEQ ID NO: 53499 - protein, 123 aa, Sorghum bicolor
  unsure (1)..(123): unsure at all Xaa locations
  Clone ID: 13392624.pep
TRAAPTPAPAACPCPSPLSDSNPTPPSNGPPAPPPLLKGDDSSRAVLTPPPRGPGLLSPSSPPSGSGPIPSPPXPPPPLSSPSRPQPRARAPGSWPRLASPARWTAAGRRCWCGGARARRRDR

SEQ ID NO: 53500 - protein, 207 aa, Sorghum bicolor
  Clone ID: 13392630.pep
TRAGHLSRSNSRNALEGPTPIRSSDSPKPQLQNRSESMNGLRSGSTSPSLVRVQSLGSSMSHTFASAVGSSISRSTTPDPQLIRRTPSPCLPPVGVRMGSSDKKVEAAAVASLNHDGADIAATLSSLSLSGNKMSNVENEVQNHVYQNFGDQADVLFNVPKDHRQFSQQNLTNTNEDSLNAPEYAVFPNGGSNFSNLHASKLASHRN

SEQ ID NO: 53501 - protein, 143 aa, Sorghum bicolor
  Clone ID: 13392648.pep
ARGPRRLPCPPPAAPTPPPPHTAPHLADGAAAPGVVARLMGLESWPATASATAAPPRPQKQRKVEASRPDSGATNDSAAVVLVLPTTRSRRPPAPAPTARSHHGADLPARSPRRTRLVHAAAAKLLDPGARAKLALAYACSSP

SEQ ID NO: 53502 - protein, 179 aa, Sorghum bicolor
  Clone ID: 13392654.pep
ARGFPRAWTVYDGEPDPDLKISCRQISPFIPHDYKDSSLPTSVFVYTLVNTGRDRAKVSLLMTWANSIGGFSHNSGGHYNEPFIAEDGVSGVLLHHKTAKDNPPVTFAVAACETQNVNVTVLPVFGLSGENHVSAKEMWNTMQQNGHFDRENFSAGSSMPSSPGQKLCAAVSASTWVEP

SEQ ID NO: 53503 - protein, 180 aa, Sorghum bicolor
  Clone ID: 13392675.pep
ARGRFCPPLFVLALARGGGGAHSAIRRLKPWGRRARGFSRARRVPSGLAVVEGPPERGSVATRRRSSSRHRRLCEMDIVCEVCGVVGYRKLLVRCVNCENAARHLYCLDPVIYDASSFEWLCDDCPQKHNEVPKSLERNCDHSHKVPQWKGSRNVIDEHNMLFEEGFNKAGVRMFSHPEN

SEQ ID NO: 53504 - protein, 148 aa, Sorghum bicolor
  Clone ID: 13392685.pep
MPRQLGQKVFTRSGSGAEQMTAAMQATQMQGQEREQEDRISELPDHILMNILDRFEEEPRNAVRTCVLSKRWRHIPGLLSIIVLDVAYYEANSDYTDDEVAQANVSLVEATKSILAHKSQHTINYLSIKFYLRDESIDIIRSVDNAMA

SEQ ID NO: 53505 - protein, 178 aa, Sorghum bicolor
  Clone ID: 13392686.pep
TRCTSTHPRARARSLVRQLDDRRRRRPTPGAEVFVSTFSRSSPATSTHQVWIMGKFMHDNRLLSPSEVNRRQYSLAAVAVGLGLGVAGLCKALHSGLSIPWVSPRNLFLGSGRVYYVGGLRNLGNNCFLNVILQALASCGGFISFLDNLLATDGLLPEEKAVRMPLLLALSSLLEDLS

SEQ ID NO: 53506 - protein, 189 aa, Sorghum bicolor
  Clone ID: 13392727.pep
ARGDDSVLRTGEDFNSSSTGAAGEAAAGGVEVVAEAVPFIKLSEVGAEAEKTEPETERAVTVDTDAATGEGAAVAEETAVAEAVSCDTEAPVDCTGDRELFNLLMRAAIERFPDLHFYRFGRPVAVPGSPMECDLAWRFRPAADAIGTGRTTYYKDYRRFTLTRDINTCTLVVDTVGEYHSGVGAKRNG

SEQ ID NO: 53507 - protein, 159 aa, Sorghum bicolor
  Clone ID: 13392728.pep
TLLRSQPMPSVAAAGAMAVAAAAAGFTAAEWEAVTGSVALEAVTGSAVVEAVTWSAAADLGLKVLAAGAASMVAATVKEWGTSNAAGPMAAKLAVAARAAGAGPVAREWEAAPRKTLVVRKPGFRLPTACPMCLTVLLYLRMADVPFDLEVDTCNPNAE

SEQ ID NO: 53508 - protein, 170 aa, Sorghum bicolor
  Clone ID: 13392756.pep
HEANTRTPAYIGEITLTDLNFGKLPPYLHRMRVLPPDLNESWAFEVDFEYSSGILLHIETRLEVQAPELEKDILKTNTKDDSNGDVSSDFLDSIEQYGNQFRPSEASDSAAEVNDEADTLRKSKSTGWASRWKSIVNSIADQVSQVPLSLTIKMSSLRGTLRIHLKPPPS

SEQ ID NO: 53509 - protein, 177 aa, Sorghum bicolor
  Clone ID: 13392760.pep
MPALLPFRRRSSPIPLLLLLSLFASSPLFFSPSPAATAVGDCPLDFSWANFTLAAAACSDPSQRATCCRYINAFVAISIARYANATGRLGVPPAFAEICLSSVSETFKLRGIPTDADVFCGLGPKIRVSYQCAGRDTVLEMMQSPNFNDVIGSCRGPLSLDITCKTCLNYGIVYLHR

SEQ ID NO: 53510 - protein, 38 aa, Sorghum bicolor
  Clone ID: 13392830.pep
IKMSQFTHLYISTITCITGYLLALASRSRMRFCTDSSC

SEQ ID NO: 53511 - protein, 158 aa, Sorghum bicolor
  Clone ID: 13392854.pep
EIGNTGRRKPPPPALQRSDLRAATEQLRALAPTSPNSSRFTTSTQSSGPLPSIYRMALESRSHKRNSSNNTNCWSFNQDTRSAVDSEDRVPSLPSPSPMLRNILRPSPKPEPSPPHVYRMIQRPPSAHHCDTRVHENGVVLPMLPRSIFAVNDLVVSK

SEQ ID NO: 53512 - protein, 73 aa, Sorghum bicolor
  unsure (1)..(73): unsure at all Xaa locations
  Clone ID: 13392876.pep
CNNDKYCNDTXTVKDLNIPNVLALVAMPIIVSHKDLVRSKGFLASFWRIAKSFLVSLIPAQPADCLRLHGVEN

SEQ ID NO: 53513 - protein, 74 aa, Sorghum bicolor
  Clone ID: 13392905.pep
ESNNQKKAKHEMLGLPTVRPPKNFACQACKASKGMETVAMPYVFRYLAAELAAMNIKLELRLSNKSGLLPSQES

SEQ ID NO: 53514 - protein, 82 aa, Sorghum bicolor
  Clone ID: 13392917.pep
TQVCLREFATSRSAICEEPKLLSSRLLSDRRRCEFFKWYDDKAFPQYITNLLGDLRDKVNFGGLLEPVFKQDYLNRCSCRTT

SEQ ID NO: 53515 - protein, 154 aa, Sorghum bicolor
  Clone ID: 13392927.pep
FVFFIKKTHTQWQELCISIKRGIKVCFYNNARPEANTCLHATCETEPTTCFFYITAAIEAHTLKLNKERGPSLSAGLINQAQQIHPQPPLLRPAGSFHHFLQPPHGNGMQPLFQLPFQCRDLLHPTNSFPVKTKLNPSLDSKRIYPSKLPALSN

SEQ ID NO: 53516 - protein, 151 aa, Sorghum bicolor
  Clone ID: 13392963.pep
DIPSALVSFPEFSSARSYPEIDPVLESPLLENFQENSVVKSYTEVLLVPLTTPDFSMPYNVITFTCTVLALYFGSLLNALRRRIGEEERELKKTATRRGLIPQLLAKLRGQKVDPTESGSSSESSGSKKLLFKVVFVAVAAVLFHYFSNNS

SEQ ID NO: 53517 - protein, 93 aa, Sorghum bicolor
  Clone ID: 13393002.pep
MKLFRMAIERRLLTEMASTSWARPPALGNWAGAGMPTSPAPTPTPSPAPSAPPSPRRRRPTTARRWRRPTSGPPPLETPAATPRAAQGWTWAR

SEQ ID NO: 53518 - protein, 129 aa, Sorghum bicolor
  Clone ID: 13393021.pep
SRCFDLNPLEKGSTGDSVSPASTSARIDGLDDYVEGLSLLHLACRVADLGMVELLLQYGANVNSTDSRGRTPLHHSIMKGRHVYAKLLLSRGADSQAVDRDGRTALKYAIDSGTIEDEEILVLLEDPSR

SEQ ID NO: 53519 - protein, 75 aa, Sorghum bicolor
  Clone ID: 13393031.pep
QRMGYQRRPIKQDEEESQNEDLMDVATPQIAGKENQFPPKDDKSKSNKEPENEAKASTPGAMDSEVLGEMKNVAI

SEQ ID NO: 53520 - protein, 158 aa, Sorghum bicolor
  Clone ID: 13393055.pep
DIYADASGESRHAKFLSEFTEETRGIGLLITGWAPQLEILAHGATAAFMSHCGWNSTMESLSHGKPVLAWPMHSDQPWDSELLCKYLKAGLLVRPWEKHADIIPAQAIQKVIEEAMLSDSGMAVRQRAKELGEAVRASVADGGNSRKDLDDFIGYITR

SEQ ID NO: 53521 - protein, 134 aa, Sorghum bicolor
  Clone ID: 13393061.pep
MSFKNFANGPVAFIGQSQGRLCYINTRRHLSSKISVWILEDYSAGQWMFKYNVSTSQLCGKVDLMFERDYSLIAIHPECNVIFVVWKCGNLLMSYDMDHGKVCVICSLTEPMYDAFLPYFPYVPFFSDSLADQN

SEQ ID NO: 53522 - protein, 65 aa, Sorghum bicolor
  Clone ID: 13393086.pep
QFPRVLVNVCFCRGLSENNQKEVHTSDLHREKTPSVTQEYSRRLRKIAPQSWGPPVIGQGWALKP

SEQ ID NO: 53523 - protein, 94 aa, Sorghum bicolor
  Clone ID: 13393091.pep
LAFMPSGWGLLLIAQTMRSAISHMGLWGSVKALARGYEIIMGLLLFTPIAFLAWFPFVSEFQTRMLFNQAFSRGLQISRILGGHKKDRAARNKE

SEQ ID NO: 53524 - protein, 150 aa, Sorghum bicolor
  unsure (1)..(150): unsure at all Xaa locations
  Clone ID: 13393100.pep
IRPAINVGLSVSRVGSAXQVKAMKQVAGSLKLFLAQYREVAAFAQFGSDLDASTRQTLARGERLTELLKQKQYSPMSVSEMVPLIFAGVNGFLDNIPVGKVLQWEADLLSHLKTNHPEIPEAIEKEGQVSKELEAKLKDVVGGFSASFNA

SEQ ID NO: 53525 - protein, 98 aa, Sorghum bicolor
  Clone ID: 13393108.pep
IVSTQTAEAARTDSRTPGRREPGPALPRMDFTLGTLIECSGGVGAFRFTSFSTDLTVALADASPAAAGDLPVPLGPASASACSAALPFPLPASYFCMS

SEQ ID NO: 53526 - protein, 143 aa, Sorghum bicolor
  Clone ID: 13393156.pep
LANQLTNILRDVGEDARRGRIYLPQDELEMAGLSDADILDGRVTDEWRSFMRGQITRARAFFRQAEEGATELNQESRWPVWASLLLYRQILDEIEANDYNNFTRRAYVPKTKKLMALPKAYLRSLVPPSSSQAERQRHHSSLT

SEQ ID NO: 53527 - protein, 79 aa, Sorghum bicolor
  Clone ID: 13393168.pep
HVQQPYACTTKRKNLDFRFHHFHGLTRHKPRHTSRQLWTTVLKAIISSTNGCSVHRDLSTLHFSRACTDHCQDINLMAH

SEQ ID NO: 53528 - protein, 119 aa, Sorghum bicolor
  Clone ID: 13393180.pep
SCVAIDASESWLACGTSSGISVWSLLSNECIFNLDCHAPVQDLLFDKNQILAVGAEPVLSRLTINGTVLSQIKCAPQSAFSVSMHSSGIAAVAGYGGLVDVISEVGSHLCTFGSRGLDK

SEQ ID NO: 53529 - protein, 121 aa, Sorghum bicolor
  Clone ID: 13393216.pep
LGSNANLPTEIQRTVDLNDTPFIMKEEHLARMRALAKTVELGKRFFPRCSKVLDKIMDDETELASLGRDTSTEKKRRFHDLQDLVHKAFSEDKEENDRSAARSSSSSSTTSIGIGAVRPRR

SEQ ID NO: 53530 - protein, 78 aa, Sorghum bicolor
  Clone ID: 13393223.pep
ETSGYCNFAKQNLTACPAFAWLRCEKEGVEDCAKLLAGHKIVARGGEQFGGDARCVRINMLDRDNVFNLLVQRLSAIN

SEQ ID NO: 53531 - protein, 58 aa, Sorghum bicolor
  Clone ID: 13393247.pep
VTTYLQTLEQRFSPCALRSYQRTMNPAFSPSLQHKKHCLLSVLQQATELMYFACSKID

SEQ ID NO: 53532 - protein, 104 aa, Sorghum bicolor
  Clone ID: 13393255.pep
QLKVATGQVNANIGKMGNFSMSSFGGNPQSYQRSHIQSLLAAQQLQQLQIHSQHQQQQTHLQQQHQLLQEAHPFPVDLKMRGFAMSSHAQNAGASDSHAVKSEP

SEQ ID NO: 53533 - protein, 142 aa, Sorghum bicolor
  Clone ID: 13393257.pep
NHEPSQAEIETACKMANIHDVITSLPQGYDTMCSHDGKQFSGGQRQRLSIARALVRKPRMLLLDESTSALDVESEKRIQEALATLAGRTTVVAIAHRLNTIHRADCIFLIEDGVCVERGTHTELIQRSETYRTSVIHQSLET

SEQ ID NO: 53534 - protein, 153 aa, Sorghum bicolor
  Clone ID: 13393272.pep
ETEGKKKMLASTKRRSLALLAEVKFLRRKYQSFLKGGSQQKHYKLKKQARYMPSPLGSNKATALGDHGARTKVPSTSKNSNLHLNQDSVPNDVVNDHQGQQGHPEVEKFDEVGVDEDMMTPDVKLSVCRDTGNSPASEGKRTVPWQDRLALKA

SEQ ID NO: 53535 - protein, 100 aa, Sorghum bicolor
  Clone ID: 13393331.pep
SNETPKQLPIIISAKRTGNVARFMNHSCSPNVFWQPVLYDHGDEGHPHIAFFAMKHIPPMTELTYDYGQSQGNVQLGSNSGCRKSKNCLCRSHKCRGSFG

SEQ ID NO: 53536 - protein, 191 aa, Sorghum bicolor
  unsure (1)..(191): unsure at all Xaa locations
  Clone ID: 13393342.pep
LRNVTIVNLDLNFXSRKIWIQPEATRPLAPLLRNLQMLRLRFIHEKCDLSWTMFILEAAPLLKEINIQVWDHVCNANEEDMSREELQMQQEFFKIESDHLSWEAHDFKHYNLSKLTIEGFQVEEKLKSYIRQVLKTAVNLELVALRKRRLCGKCRIRPSSMAYPQNEEQKDLIWTQISDQISSNARIRFFP

SEQ ID NO: 53537 - protein, 117 aa, Sorghum bicolor
  Clone ID: 13393386.pep
LDRDTSPDSILASLNDKVGAGRYLYIATNEPDKSFFDPLKEKYKTHFLDDFKYLWDENSEWFTETKELSNGKPVEFDGYMRIAVDTEVFLRGKRHVETFNELTRDCKDGVNTCPASS

SEQ ID NO: 53538 - protein, 109 aa, Sorghum bicolor
  Clone ID: 13393423.pep
CMESLPSPRGPTSTTPIHRHNSKKKKNEIYTCNQGARKESTLACQYHKQLSKECKTLMPCLLKQSLQNQTDVHSSGSTSPQLPTDFASTSIQITLLLCFSFLRFLPHAS

SEQ ID NO: 53539 - protein, 155 aa, Sorghum bicolor
  Clone ID: 13393468.pep
EHTVVLMSELSPARMELFGDSIDAWVQIACPRLSIDWGEGFKKPVLTTFEFDVALGYVPGWWEKGSRECGGECGSGCCSGSGTCGNCNCSGGDFGGDYPMDYYSQDGGDWNSCYMKKKPSTGERKLRVRIASNGVQAEKRGNQDSCGVEINTLVR

SEQ ID NO: 53540 - protein, 75 aa, Sorghum bicolor
  unsure (1)..(75): unsure at all Xaa locations
  Clone ID: 13393474.pep
DCFWEYRTHRPQEHSGPDIITXKSYTMYRWRHSFFASKYINKHVNQIPRSNNRRNQLLHVHQEFRIYIRMQHEFL

SEQ ID NO: 53541 - protein, 120 aa, Sorghum bicolor
  unsure (1)..(120): unsure at all Xaa locations
  Clone ID: 13393499.pep
IEARSVXEAIARMSVVDPQASLPADKHPERRLKSTFKAXEEAELPKLKEEKXPGLTLHQYKDMIWKLXKKSPDNPLTRLLTNFAILLNHLCIKDQPPNSPNCVAPFSWSGCATNLESEDV

SEQ ID NO: 53542 - protein, 106 aa, Sorghum bicolor
  unsure (1)..(106): unsure at all Xaa locations
  Clone ID: 13393535.pep
QPGCSPSTWLSISASARRASPGARAQRLPPSRLDRDAPLRPDVALAPSSRGHQLPHGRRAPPPLGLGGGPPRPVRQDHRRHPTPEPAHRRXYRVPAISDVQALCAX

SEQ ID NO: 53543 - protein, 49 aa, Sorghum bicolor
  unsure (1)..(49): unsure at all Xaa locations
  Clone ID: 13393542.pep
TRRQKHALYLAFHLTRDGFNGXNIVFPIVPKGEERVRLFLHAHNTKXEV

SEQ ID NO: 53544 - protein, 73 aa, Sorghum bicolor
  Clone ID: 13393555.pep
AEVRGWLRARKEDDASKLASAWYHVTYHPDRRGEKRFWSFPWVACDTLLAIKAARRCRKRVEDAAAPMDCDAS

SEQ ID NO: 53545 - protein, 42 aa, Sorghum bicolor
  Clone ID: 13393572.pep
ISFRSFNRRGDTNGSHQFQPYILIHKIVRCQLSVQLTYRRPR

SEQ ID NO: 53546 - protein, 156 aa, Sorghum bicolor
  unsure (1)..(156): unsure at all Xaa locations
  Clone ID: 13393590.pep
ITGSSPFAGFAXGSETSGGVENVLAEHLNFFSSGFGIHIKTNTGRGGFIRNVTVSDVTLDNVRYGLRIVGDVGNHPDERYNRSALPIVDALTIKNVQGQNIKEAGLIKGIANSAFSRICLSNVKLTGGAPVQPXEVQAVSGGALDXQPSPCTELLP

SEQ ID NO: 53547 - protein, 70 aa, Sorghum bicolor
  unsure (1)..(70): unsure at all Xaa locations
  Clone ID: 13393592.pep
QRIVSGSYDMSVKVYDARTGEXSIDLPGWTTSWMLSVKSDYRRIVATSQDSRAVIMDFGYGLDGIELLEE

SEQ ID NO: 53548 - protein, 47 aa, Sorghum bicolor
  unsure (1)..(47): unsure at all Xaa locations
  Clone ID: 13393608.pep
IKNTGSVESDYTAMAXVNTTAGPSPHPIKWLIGFDRLGDLKPRASQT

SEQ ID NO: 53549 - protein, 64 aa, Sorghum bicolor
  Clone ID: 13393618.pep
EGTADLQSKLIEILDRNSRLVAAQLEAQNQNCELDREQRKDQANSLVLVLGRLADALGRIADKL

SEQ ID NO: 53550 - protein, 61 aa, Sorghum bicolor
  unsure (1)..(61): unsure at all Xaa locations
  Clone ID: 13393624.pep
LIFKNLHHLLNSLRPHQARATLIHMLESQIQLRKQAIEDXKQRREEAQKLLGESLHILXGS

SEQ ID NO: 53551 - protein, 49 aa, Sorghum bicolor
  Clone ID: 13393627.pep
LTLLCCMPWAAVGDFTKYIISIHPISPALLPPRTSTAECPALPPSEPFG

SEQ ID NO: 53552 - protein, 55 aa, Sorghum bicolor
  unsure (1)..(55): unsure at all Xaa locations
  Clone ID: 13393643.pep
NNAVSSSFLLXDDSSIPFSVDDISKSXTEIEVTDVDMPPLIRENSGFTFLHQRKD

SEQ ID NO: 53553 - protein, 104 aa, Sorghum bicolor
  unsure (1)..(104): unsure at all Xaa locations
  Clone ID: 13393682.pep
NTKGKGFTGXMKRHGFGGQDRSHGVSLTHRSLGSAGPGQGGGSRVYPGKKMAGNMGNEQNTVQNLKILKVDAENGXXVVVTGAVSGPKGCXVRIQDAIKKPWPR

SEQ ID NO: 53554 - protein, 63 aa, Sorghum bicolor
  unsure (1)..(63): unsure at all Xaa locations
  Clone ID: 13393684.pep
GVTPSWKPYLTPLAHPNCRPATKRENNQKHSAYRCIIPTHLISLARSLXLVEFAYPYRVPPDP

SEQ ID NO: 53555 - protein, 99 aa, Sorghum bicolor
  Clone ID: 13393729.pep
LVQVCLLIPSGRQENLRSSSFSFSSSLTLHTQCAIHRYQKKPIQCLGGCSCSCRRFNIRKISKSNRHSTTATHFRTSNPGSLDKLHLVRPLCMCPPNLQ

SEQ ID NO: 53556 - protein, 93 aa, Sorghum bicolor
  Clone ID: 13393757.pep
TDWRALDKFVASQLSPAAECGGSLEAAAAAASTAAAGNVGSQLDHVEDDDDMAALLFLNSDGREEAERWTGLLGPAGGDGDFGLCVFEKSGRR

SEQ ID NO: 53557 - protein, 94 aa, Sorghum bicolor
  Clone ID: 13393772.pep
RDAAAMKAVVGEEALSSEDKLSLEFLDKFERTFISQSAYESRSIFESLDIAWNLLRVYPKELLNRIPKRVRTSSHPPWSKVPNKDTRDGTQAPQ

SEQ ID NO: 53558 - protein, 67 aa, Sorghum bicolor
  Clone ID: 13393776.pep
LKNGKTGRSWSKANGKQRQQRRQQRDPVLRNVYEPFLRSKRYKLATSLGLRLIRCRCRFCGHRLFAV

SEQ ID NO: 53559 - protein, 47 aa, Sorghum bicolor
  Clone ID: 13393791.pep
NSDLRVGHFLQVLGRSREHDWTVKLEGSEKVLFFKELWDLHHAAFSK

SEQ ID NO: 53560 - protein, 96 aa, Sorghum bicolor
  Clone ID: 13393832.pep
IKPTSLPRERVCSSKDSHNQDSDNEEQRAGSYVARTIISPPRSQEEGRKLQSSYQCATSTADSCAKSYLKSAANISASRHGIKGKTGRKEKESPRL

SEQ ID NO: 53561 - protein, 85 aa, Sorghum bicolor
  unsure (1)..(85): unsure at all Xaa locations
  Clone ID: 13393833.pep
NPLHIDPEFSKVGGFKTPILHGLASLGVSGKHVFGKFGXLKNLKVRFAGVVLPGQTXDEMWKEGNTVIFQTTVVTPASRPYGRWC

SEQ ID NO: 53562 - protein, 79 aa, Sorghum bicolor
  Clone ID: 13393884.pep
QFRQNLSHTPTWLAEDQGRISKCQCRNKEKGTYGSWTQKGLIQAIVMAMRARRRSFCTRLVCIEHRYQHENLDGVCHWT

SEQ ID NO: 53563 - protein, 47 aa, Sorghum bicolor
  Clone ID: 13393888.pep
YGRKGPGRAGPRYCTKGFWKATWGRKWASLGSAVMEGRLPGKQGISL

SEQ ID NO: 53564 - protein, 61 aa, Sorghum bicolor
  Clone ID: 13393890.pep
MSPDSLVGSLGLAPPIFFSILLGTVLFEMPRNRAVSAIRSLPASQLSLWNPSHVPRNGWWG

SEQ ID NO: 53565 - protein, 70 aa, Sorghum bicolor
  unsure (1)..(70): unsure at all Xaa locations
  Clone ID: 13393893.pep
XQLLFLNSITVSRVNAEHCGLEHDHQSDAPVTGLNENTQASMLEAGSEASGFVRGEALFVLSFFLFGFLV

SEQ ID NO: 53566 - protein, 53 aa, Sorghum bicolor
  unsure (1)..(53): unsure at all Xaa locations
  Clone ID: 13393903.pep
XVAETTLLLNKLQELSMAKLRPDFSSNHLPSHAISSVRLALASNLARAILGDP

SEQ ID NO: 53567 - protein, 66 aa, Sorghum bicolor
  Clone ID: 13393909.pep
YNVKLEESSLLDQYPRNHQVLTDPYAVHKQGWDALKTAYLDKQNIRMDLDRFRATLREAMSRLPSP

SEQ ID NO: 53568 - protein, 100 aa, Sorghum bicolor
  unsure (1)..(100): unsure at all Xaa locations
  Clone ID: 13393910.pep
GRVPAVLLHDVSCVLVNEDKCFCVHGPCFACTGVPAWLATRPVHFGDYSGKXIVVXRELGDRQTSGTVVSHEGDVLSGTGKKKNRMFGFVAKRCLLVKRH

SEQ ID NO: 53569 - protein, 127 aa, Sorghum bicolor
  unsure (1)..(127): unsure at all Xaa locations
  Clone ID: 13393912.pep
DDDEDSDESEEEEEEEDEPLAAIVTAAKKRRARKLSDEFDRIAVSNXGEKEKAGAATPARTSPKRKAAAPAAAPARVSPKRKASASAAGATARASPKMEELPHPLRRPHRRLGQGGPSPRNKHMSAV

SEQ ID NO: 53570 - protein, 98 aa, Sorghum bicolor
  Clone ID: 13393929.pep
VPAESQQPGRRPWRGGAGGRHGHAREGDHVRSELPVRPGRGDHVRHGPRRGRCCPEVIRNSGSAAQACTMRKIDWQGQIAVFEPSCHACMQWISGSCV

SEQ ID NO: 53571 - protein, 77 aa, Sorghum bicolor
  unsure (1)..(77): unsure at all Xaa locations
  Clone ID: 13393940.pep
GSLAPISVPSFDIMRGRSVTGSLFGGIKPKDDIPVLAHKYLDKELELDDFITHQXGFQEINRAFXLLTQGKCIRCII

SEQ ID NO: 53572 - protein, 114 aa, Sorghum bicolor
  Clone ID: 13393954.pep
MPKKMGVNSKAEAARERRSAAEADRRDRQERAKEEQYWAEAEGPKSRAARRREEDAEKRAEAAARKAENRRLAEAEAAAVAASASAPSKAAARKASRVAAPPPKVTEAELARLG

SEQ ID NO: 53573 - protein, 40 aa, Sorghum bicolor
  unsure (1)..(40): unsure at all Xaa locations
  Clone ID: 13393966.pep
YECGLANIRDTNKHNQXGWVPLRLLPLVSAQQNQEALIVI

SEQ ID NO: 53574 - protein, 53 aa, Sorghum bicolor
  Clone ID: 13393974.pep
LGSKLLLSIGNLWCTNMNPICGNDPIPWGRSATSIFVYCITSCFAYLCASSFG

SEQ ID NO: 53575 - protein, 48 aa, Sorghum bicolor
  unsure (1)..(48): unsure at all Xaa locations
  Clone ID: 13393975.pep
DFDIDLAWRMHKASDGQRRRVQICMGLLRXQVLLLDEITVDLDVLADQ

SEQ ID NO: 53576 - protein, 85 aa, Sorghum bicolor
  Clone ID: 13393979.pep
CSAAQRAQHEEQFCLFRNIEEELDLNRKAGLHFPIHLPSHVSDFSTCDVLGMSHTGALREEFMKELEANPNFAMGAGGSRLLDGT

SEQ ID NO: 53577 - protein, 57 aa, Sorghum bicolor
  unsure (1)..(57): unsure at all Xaa locations
  Clone ID: 13393986.pep
XSGSALGATXDGTGAILLQLTYAPRIYTAISGSTVKSRLQMTAFMXARRMPICMGRA

SEQ ID NO: 53578 - protein, 61 aa, Sorghum bicolor
  Clone ID: 13393987.pep
STAPTLVSPPSKAVVYDEHGPPEQVLRTVDVPPVEVGDRDVCVRMLAAPINPSDINRVEGV

SEQ ID NO: 53579 - protein, 113 aa, Sorghum bicolor
  unsure (1)..(113): unsure at all Xaa locations
  Clone ID: 13393988.pep
PLRHSGGVGPGLLGPGEAGDAASCTGPDRGTRSALRGGSLSWWTXVLAHGAAWSPSSGRLLIAGTGSRSTNSRDSPPSFLATAAPFSATTGSDSLGVAWLWFVSCSCMLLPRA

SEQ ID NO: 53580 - protein, 120 aa, Sorghum bicolor
  unsure (1)..(120): unsure at all Xaa locations
  Clone ID: 13393993.pep
HEAPPIRAQIAXAAPNSNDAASASGTGPAGEEDISIEALARRVQEHMTLNSNPAARRHKFWETQPVGQFRDAADTSLPDGPIEPPTPLSEVRADPYPLPAAFEWLTCDLDDDALLADLYS

SEQ ID NO: 53581 - protein, 98 aa, Sorghum bicolor
  Clone ID: 13394000.pep
HEAHNNAFSFGTAVLDSSPGLPVDSPRTADCVPRPPCTDGTLAKGLCKAARRQSAKQAVSIAPLQPGLKVDATLSSEHSCPSKSIDGEKGRQVGSSRI

SEQ ID NO: 53582 - protein, 125 aa, Sorghum bicolor
  unsure (1)..(125): unsure at all Xaa locations
  Clone ID: 13394013.pep
RETACSFHPRETSSACRTESGSRYERTCAMISDGRYVQDQCAPRITRSRNDLNGLVGRSQSHSPSPDTSWRPGIWHCRVPPVSFHSXPRPPPGLQSLRPCPGGQXGXFVAMAGIXRRNGSSRDXX

SEQ ID NO: 53583 - protein, 69 aa, Sorghum bicolor
  Clone ID: 13394021.pep
MNVVDWAFPDCSNGPLKDTIVCDKSARPHDRAAALVSMFTFEELVNSTGNLIPAIPRLGLPPYQVWSEG

SEQ ID NO: 53584 - protein, 70 aa, Sorghum bicolor
  Clone ID: 13394025.pep
MSTAGDPAGAAAAAAAAAAAATPSGRAPRLPRWTRQEILVLIEGKRMVEGRGGRGGRGRVAAAAAAASGS

SEQ ID NO: 53585 - protein, 96 aa, Sorghum bicolor
  unsure (1)..(96): unsure at all Xaa locations
  Clone ID: 13394026.pep
SNSANIEIFRLDFQSDSPDLPLLASAPAPDRFNRLSWSRPGAVEGDSFALGLLAGGLSDGSVAVWNPLSMISSEGKAEDAMVARLEKXTGPVCGLE

SEQ ID NO: 53586 - protein, 102 aa, Sorghum bicolor
  unsure (1)..(102): unsure at all Xaa locations
  Clone ID: 13394028.pep
GILLKFLYNRKMEEVEDTMMMWPLPSSKRRNQNNSSTQHWATGRGIGDGARGASSSLAPGPVAGSAPRSCAGAERXSGGAVSGXRRATPERGTSGWRHCPSC

SEQ ID NO: 53587 - protein, 62 aa, Sorghum bicolor
  Clone ID: 13394030.pep
KWTNIGKGWRPRWFAIRGAILTYSKIPRCSSSAAHYGQDRPVVGLVHLKISSFRESKSDDRR

SEQ ID NO: 53588 - protein, 140 aa, Sorghum bicolor
  unsure (1)..(140): unsure at all Xaa locations
  Clone ID: 13394039.pep
ARGLQETLHDMQLQVEESKAMVVKEREAARKAIEEAPPVIKETPVLVEDTEKXNSLTAEVEQLRALLLTERQATEAAKREHAESERRNEELXKKFESAEKKIEQLQDTVQRLEEKATNMESENKVLRXQAVAISPTAKSL

SEQ ID NO: 53589 - protein, 33 aa, Sorghum bicolor
  Clone ID: 13394047.pep
LKFVKLPNTDFWGSDQQHRLSVSLQTCKNICIQ

SEQ ID NO: 53590 - protein, 76 aa, Sorghum bicolor
  Clone ID: 13394061.pep
MPVRTFGIKSVTTPKPSRFNVGPDLPILKSTPAAALERKAYTLPLRSGAVAIKKGMTGIYDAQTGTRIPCTVLQLD

SEQ ID NO: 53591 - protein, 77 aa, Sorghum bicolor
  unsure (1)..(77): unsure at all Xaa locations
  Clone ID: 13394062.pep
GYRKDSHDGWWLTSAHLFXVTVIVGSDQRLFAAHEDVLSHSPYFAELLXXQFFESANRRIDLPTEEPEIFSCILEYL

SEQ ID NO: 53592 - protein, 139 aa, Sorghum bicolor
  unsure (1)..(139): unsure at all Xaa locations
  Clone ID: 13394096.pep
TRAVTATIVXVLLFXGSDXWKQSKSAMNAVKMDVHAKLMQRYRQVPQWWFLMLLLGSVVVSLLMSFVWKEEVQLPWWGMLFAFALAFVXTLPXGVIQATTNQQPGYDIIAQFMIGYALPGKPXANLLFXIYGRISTVHA

SEQ ID NO: 53593 - protein, 56 aa, Sorghum bicolor
  unsure (1)..(56): unsure at all Xaa locations
  Clone ID: 13394105.pep
MDSMESCVPPGFRFHPTDEELVGYYLRKKVASQKIDLDVIRDIDLYRIEPWDLQEX

SEQ ID NO: 53594 - protein, 114 aa, Sorghum bicolor
  unsure (1)..(114): unsure at all Xaa locations
  Clone ID: 13394110.pep
DPEGLRQRWQSRFGAILLLVLLVVAVAVVDVDVKGWGLLGVPADPVGGEALAGAEDPGGGVGLVLGLRRLGRLGHEDAXEQAGPGGRHGLPLPRLLVLLASVVTPRLRLVGPGX

SEQ ID NO: 53595 - protein, 97 aa, Sorghum bicolor
  Clone ID: 13394113.pep
MASEFVDPRMTSIKPRIRINTIGGINGPLVVLDNVKFPRYNEIVSLTLADGTERSGQVLEARGNRAVVQVFEGTSGVDVKKTQSRVTGHSLKLGVSE

SEQ ID NO: 53596 - protein, 113 aa, Sorghum bicolor
  unsure (1)..(113): unsure at all Xaa locations
  Clone ID: 13394115.pep
QIRELGKWAQRENAYGASSGSXGPKIAGDEVCPSGPTCRVIAWSTSIVVDPPWMTAVSPSRASFCFCPSKPLXAGALSSTAAIVLQGWSFLVHLTWFLQXAXXGSTXRFSASC

SEQ ID NO: 53597 - protein, 61 aa, Sorghum bicolor
  unsure (1)..(61): unsure at all Xaa locations
  Clone ID: 13394117.pep
FRKPTKQQMGXRLMEIAKKEGXQAQENAMEELAERVHGDIRMALNXXLQYMSLSQSVVKYD

SEQ ID NO: 53598 - protein, 80 aa, Sorghum bicolor
  Clone ID: 13394122.pep
MTSTVTTPSRPLAAGTRPRRSWPAVLSLSKGSSGPRRRRPPSTSCAALASPDKQRTANKLPVSSRKQQQQEEEEEVRATE

SEQ ID NO: 53599 - protein, 51 aa, Sorghum bicolor
  unsure (1)..(51): unsure at all Xaa locations
  Clone ID: 13394132.pep
PLPIPFSSRRGHLRSGRRYREAEPAAAADFLRPRXRQAWSVTRTXGPPPXX

SEQ ID NO: 53600 - protein, 62 aa, Sorghum bicolor
  Clone ID: 13394134.pep
EEEKVALPASCLLSANRVASATLSATSPPNRVAASFASAAARAGGSAGGLCLLLRPISQHGI

SEQ ID NO: 53601 - protein, 51 aa, Sorghum bicolor
  unsure (1)..(51): unsure at all Xaa locations
  Clone ID: 13394141.pep
NSYCLQFILQHVRNKNRFYFYGMCCPDQRSSAKSTASENRAFHSESXSFCH

SEQ ID NO: 53602 - protein, 122 aa, Sorghum bicolor
  unsure (1)..(122): unsure at all Xaa locations
  Clone ID: 13394144.pep
AHIRHVYXRYDRLXESDLVSEARTTVEEPTLAKLVEWRGDDENGKTVLEDVFREVIVISDDDDDSDSDEGENIPPRFNRDHSVEYVSGRARAVELPTGPTAYADPNSQRSLRELSEDEAPPG

SEQ ID NO: 53603 - protein, 35 aa, Sorghum bicolor
  Clone ID: 13394147.pep
MLPPTRREFKDIYVVFELMESDLHQVIKANDNLTP

SEQ ID NO: 53604 - protein, 36 aa, Sorghum bicolor
  Clone ID: 13394151.pep
VLGGVRGVDEGSHQRNHPVGLQVSRTSGGITVAVIR

SEQ ID NO: 53605 - protein, 64 aa, Sorghum bicolor
  unsure (1)..(64): unsure at all Xaa locations
  Clone ID: 13394152.pep
DLCGQSQXVNCTSQGPEQYGGSDRNGINSQPTDLRXHPYRTFLLGAEQADSFTLNPSENPLSDF

SEQ ID NO: 53606 - protein, 61 aa, Sorghum bicolor
  unsure (1)..(61): unsure at all Xaa locations
  Clone ID: 13394156.pep
XQAHSPKLLSRVCCRHCDKDVTLDRRCVCGEKYAEACGGHXVFHDHMASYGTGTPLFLATS

SEQ ID NO: 53607 - protein, 77 aa, Sorghum bicolor
  Clone ID: 13394170.pep
VFFIFLSFSFVAFSSRLSVLFWGKASYTYTWDYMAWQLPQVKKQLEKPGDTRDTKNGKRLAQEYCSRRIILAWLLRC

SEQ ID NO: 53608 - protein, 81 aa, Sorghum bicolor
  Clone ID: 13394209.pep
LKDEMKVNLQYFDGRPMSGTVPQRVTCTVVEAQPNTKGLTAQPQYKRVLLDNGLSVLAPPFIEAGEKIVISTADDSYMTRA

SEQ ID NO: 53609 - protein, 34 aa, Sorghum bicolor
  Clone ID: 13394216.pep
YLIQRHLQIYIAGDDSICSSKTKYSPFFNTSLSP

SEQ ID NO: 53610 - protein, 67 aa, Sorghum bicolor
  Clone ID: 13394234.pep
EDVYRLKGVISVNESTGRFMFQGVHCMLEGCPAKPWEPDEKRINKLVFICRNLDEAALRKAFNGCLL

SEQ ID NO: 53611 - protein, 48 aa, Sorghum bicolor
  Clone ID: 13394253.pep
LPVVHKILQDSWRSNAVVEEMFGRMALQITDYPGSGPNDRHTPKAPGP

SEQ ID NO: 53612 - protein, 63 aa, Sorghum bicolor
  Clone ID: 13394291.pep
PTDLNLASASALRQTQLSPLVGSHSFVQILHGLGTKKFLGCMDGRTDKKQFPSSSKTKKKKHH

SEQ ID NO: 53613 - protein, 53 aa, Sorghum bicolor
  Clone ID: 13394306.pep
RTSSMDVRYAHALNLISRKGYSEAQLKECLEEYASLNVWQIHPSTFDIHFIDA

SEQ ID NO: 53614 - protein, 143 aa, Sorghum bicolor
  Clone ID: 13394308.pep
QSDEEEENEDGENKNGESAESSEPKAKAKSEDDDDLVVGGYELYMAGDGHDEEDAAIYRSADADEDDGILLTTAAGWNRLSIVLRDQGTLKFVKYVSAAAKGDRWDITGEMGVEYDDNDDDEDEEKEEEDEEGDDDEEGDDEE

SEQ ID NO: 53615 - protein, 92 aa, Sorghum bicolor
  Clone ID: 13394324.pep
RHGAEQALVREQAPGGWPDHALLPRRPDAVVQAGALHAPRRLHRRRFRYHIMITLAIAIDQRQFLSGPSWNYYYSICHRRPRQLIINDFIYS

SEQ ID NO: 53616 - protein, 139 aa, Sorghum bicolor
  Clone ID: 13394327.pep
HDDPHMEIPKEGQDVCREFLRECIPEFGNRPWTHTRICWYTDTPTGDWVIDYHPKYKGLFVATGGSGHGYKFVPKIGERIVDVMKRQPRDDLGTEFQKKWSWPKQKYHFDHIWTNDWRGGRKGMIVEEEQRRGEKTCKL

SEQ ID NO: 53617 - protein, 38 aa, Sorghum bicolor
  Clone ID: 13394334.pep
SRCGTGFARCVCISTFHALVSSIAIDMCILLIKFCVSW

SEQ ID NO: 53618 - protein, 81 aa, Sorghum bicolor
  Clone ID: 13394339.pep
YRLPISSTIAAGLAHLYNDSGRKAGILAHHASPVFSSTPIVSLSLYVRVPPLKMLIDFAALDINHPQPQPQPPFIRSSSVA

SEQ ID NO: 53619 - protein, 61 aa, Sorghum bicolor
  Clone ID: 13394361.pep
GRRGRKPSRGRGRGAKKATPEAKPSGRGRGRPKKTESPAQKAGTSGSRGGKRGGKRGRPRK

SEQ ID NO: 53620 - protein, 116 aa, Sorghum bicolor
  Clone ID: 13394371.pep
DNCVQSAPIDTRRALYKNIVLSGGSTMFKDFHKRLQNDIKKIVDERVAATNARHRVEVRPIEVNVVAHPIQSYAVWFGGSVAASNPEFFEFCHTKEEYEEHGASICRTSPVFKGMY

SEQ ID NO: 53621 - protein, 109 aa, Sorghum bicolor
  Clone ID: 13394393.pep
ESKKGEKKNTDAEAHEAGDNNKKSKDSKQLKMFKVALADFVKEALKPTWKDGQMSREVHKTIVKKVVDKVTSTVENTPPTKEKIDIYMTYSKEKLNKLVQAYVGKYAKA

SEQ ID NO: 53622 - protein, 83 aa, Sorghum bicolor
  Clone ID: 13394416.pep
NSVYKMEQNVVIRDIQKPYIPQINFRPVSICIMKHVGQPVDQELVCRDVQMYILFHYFPAADSSLRYEKHRITSKSGQRLLWS

SEQ ID NO: 53623 - protein, 64 aa, Sorghum bicolor
  Clone ID: 13394423.pep
VAGTPEAEIVRQKQAAVTLAKTVERLCGEMYKCIQDELLTLLVEPMTIAAYRPDGPDRARELAA

SEQ ID NO: 53624 - protein, 47 aa, Sorghum bicolor
  Clone ID: 13394437.pep
TSAHSVVRIILVVCFHDFIILMFCCSRFRNGTICLFYWLRNPNSFGL

SEQ ID NO: 53625 - protein, 174 aa, Sorghum bicolor
  unsure (1)..(174): unsure at all Xaa locations
  Clone ID: 13468681.pep
TRGGRGRLEELCHEELGLPILVQVVTTASQVGHKEEWLEWLLFKVCVEEQKFESLFYALCSTNDVEHTDSGEYNAKHVFLLGTLSRCLNSHPKEVTVSDGFAHDVFNLHKHAAETVNFTHRGTSPLPTGSPAIDVLGYTLQLLRDICAWESTSSDTQRPVDSLLQTGXVQRLLR

SEQ ID NO: 53626 - protein, 43 aa, Sorghum bicolor
  Clone ID: 13468683.pep
AVICNPRFNCCPSKASVYSWCISHLQQDGARPIKMAPKALHDV

SEQ ID NO: 53627 - protein, 77 aa, Sorghum bicolor
  unsure (1)..(77): unsure at all Xaa locations
  Clone ID: 13468686.pep
RPRRPRRRRHIPVLLTLSQPRSSYKTPQPRXTPPWREQLTLRGIAVAAALGALLCVVIHRLNLTVGVIPALNVASGL

SEQ ID NO: 53628 - protein, 53 aa, Sorghum bicolor
  Clone ID: 13468687.pep
PIGIVMLKAILVCLNFFFCRPEALGLVVGIVYLVIAIIFQQFHYAPDSIVCRD

SEQ ID NO: 53629 - protein, 113 aa, Sorghum bicolor
  Clone ID: 13468691.pep
PRRRGARRAVSRERERIRFEPLLRRVTTDGGLWVVRVSIGRPRVSAACRARGQEQLASPTHRHVRGSQHIFPPRSAATECWSSTSSSAATAGARCSLKIKIKSLSCCFFFLRA

SEQ ID NO: 53630 - protein, 122 aa, Sorghum bicolor
  Clone ID: 13468698.pep
ARGPSAHKLDRQHQDCNMQIVCMTEPSNIFHVLRRQMHRQFRKPLVIFFSKSLLRHPIARSDIEAFTGDSHFKWIIPDPAHKTEAIEAPEKIDRVIMCSGQVYAALVKHREANGIRNTAITR

SEQ ID NO: 53631 - protein, 161 aa, Sorghum bicolor
  Clone ID: 13468702.pep
SLTDHSQSFQRLKELVDGWHASIVPSGRLITAVDFDELSPPYHMDMQTPSPSTGIMLLYKNCLLLLSKAPDSRMTARGLLADLDHAASTTTDAPGTFSTTEIRVARVFDIHSVRCMQSTCGRILFLAPASAKSGVANDNATDLLALELSGMYEARANRLIE

SEQ ID NO: 53632 - protein, 39 aa, Sorghum bicolor
  unsure (1)..(39): unsure at all Xaa locations
  Clone ID: 13468709.pep
FFFFFFFFFFFXXPNVLVKRWHWHLKYDIHLCVDNLCTI

SEQ ID NO: 53633 - protein, 95 aa, Sorghum bicolor
  Clone ID: 13468723.pep
PSLNCKQVTSQETSLAASCRRVYAHAHDYHINSISNNSDGETFISADDLRINLWNLEISNQSFNIIDVKPTNMEDLTEVITSAEFPPYSLHTLAY

SEQ ID NO: 53634 - protein, 168 aa, Sorghum bicolor
  Clone ID: 13468730.pep
HEAYMSQASTVSLAPSVVCKEQNNNGNKMLNTSSLETDTSGPFSEPIKSGNVSLQKETQMRNEVLCTLNNSVSPEGHKGSLNFPVPSGQSFSSNFATRSLSTSGESMKTAYGLAVFEGSRESSRSGNCISSVGVHHNIPPIMVDQGNNMNPSMESSNNSHRLMASNTN

SEQ ID NO: 53635 - protein, 127 aa, Sorghum bicolor
  Clone ID: 13468737.pep
TRHIVMELCAGGELFDRIIQRGHYSERKAADLTRIIVGVVEACHSLGVMHRDLKPENFLLANKDDDMSLKAIDFGLSVFFKPGQIFTDVVGSPYYVAPEVLRKRYGPEADVWTAGVILYILLSGVPA

SEQ ID NO: 53636 - protein, 153 aa, Sorghum bicolor
  Clone ID: 13468753.pep
ARGYCTLRTGQEVKEVPFANHVACTIEMVSTEELYEVAVVDEIQMMADPVRGFAWTRAVLGLKADEIHLCGDPSVLKLVRKICADTGDDLVVHQYERFKPLVVEAKTLLGDLKNIRSGDCVVAFSRKEIFEVKLAIEKFTKHKCCVIYGALPP

SEQ ID NO: 53637 - protein, 177 aa, Sorghum bicolor
  Clone ID: 13468755.pep
STEQSTSTNKRQSSMPVPMSKGSSGEKRSISGPSLVNSEPSRRSVSPVSSIIPEENDKGPSTRIVDAKPDGEFKQTAQDAVENCDNEDAAYPLTLALLFDILILSIAYIQRFSSELFGNEYPQVILQSVVKMLEQDIVQAAVYLISLGFMMIIIGRAAGYVVIVGSWVVWMAKPFLV

SEQ ID NO: 53638 - protein, 151 aa, Sorghum bicolor
  unsure (1)..(151): unsure at all Xaa locations
  Clone ID: 13468765.pep
MNNVFPTLEAFILFLQTIATVGLDKKLYILDSGSRRPTQTIPHEAPFSSLAYNDDGTILAAGTNSGRVVFYDVRGKPKPLTILRAYNTSEAVTGLCWQRSKPVVVNENSSSEVALLGGTSEESVLMPDPLPSATPXSLGSGVASTSLRSSL

SEQ ID NO: 53639 - protein, 110 aa, Sorghum bicolor
  Clone ID: 13468782.pep
HEARLFAPPGGTGAVSHALAPPHPATPRATPPAFHGSASPPRMTRAKISEIRSPPGAPDFATPSTAIATVRAASTAAFCSMSAQSPYQRASSRSEPGHCLGGRGFLAVPF

SEQ ID NO: 53640 - protein, 113 aa, Sorghum bicolor
  unsure (1)..(113): unsure at all Xaa locations
  Clone ID: 13468783.pep
MTSAVLAGRNEVHHAHPHHHRHWGGARVPLMPKPSSNPNPRRHHRPGPNPIPTGSPPPRAVPAVAAEPLPSSSGHVKFRPSXMTPAEASLLRARLTGELGRVRAFLSRIDSWQ

SEQ ID NO: 53641 - protein, 50 aa, Sorghum bicolor
  Clone ID: 13468787.pep
KQMQHDQRLQNLSVRIALQATFWQKRGLLGGPVTSDAAELFVIIGNCPSC

SEQ ID NO: 53642 - protein, 141 aa, Sorghum bicolor
  Clone ID: 13468791.pep
MGSTAAASVLPVSAGTGQNLVLILDYGSQYTHLITRRVRQLGVLSLCVSGTAPLASLEGLRPRAVILSGGPHSVHAPGAPAFPEGFLDFAAAAGAHVLGVCYGMQLLVQSLGGAVVPGERQEYGKMDVQVTAASSALYGEA

SEQ ID NO: 53643 - protein, 134 aa, Sorghum bicolor
  Clone ID: 13468822.pep
ISDPTRERSIKLSEDEILSRVAQLVSTDTEICTDGKPLPCHHKRPPENDLSKYLSATLEEDEEGVDMPQAADAVTIVSQPPLKKPRTLGAGSSGESVQQKGIEVVAHFCSELAQQRESGNSVPIAQPLSDDEDT

SEQ ID NO: 53644 - protein, 44 aa, Sorghum bicolor
  Clone ID: 13468826.pep
TTKLVGEHDSRVHKMAIEPGSPYIFYSCGEDGLVQHFDLRSVSA

SEQ ID NO: 53645 - protein, 68 aa, Sorghum bicolor
  Clone ID: 13468830.pep
MGEEVAAAAAVVLEPPRPKSPPRYPDLCGRRRLQLELQILNREIDFLKDELQSLEGVPPVSRSCKEVN

SEQ ID NO: 53646 - protein, 75 aa, Sorghum bicolor
  Clone ID: 13468845.pep
LLLQQCVIDEDNPYLREWGLLAVKNLLEENEENQKEVSELEMQEPVITPEIANIGLKVEIDKETGRPKLVNTSDT

SEQ ID NO: 53647 - protein, 95 aa, Sorghum bicolor
  Clone ID: 13468850.pep
FSETLLLFFLPQVLNFLCSVPQLFHFVPCPRHRLPRFDPETGLLTGTKDGNLVNIFLRLFGKCSEKVLCIRLLIFQALCCVFCFWLRYMLTGWYK

SEQ ID NO: 53648 - protein, 77 aa, Sorghum bicolor
  Clone ID: 13468854.pep
WDFAQSLWDPYELVAVSRRLESGVVIADHAAAASAAPQDGGDARGAAEKRRRESGRSLRNLFLRSTSKRFGFDEPSS

SEQ ID NO: 53649 - protein, 66 aa, Sorghum bicolor
  Clone ID: 13468861.pep
GAWSYVQPRIETMLNSTEHHNRRHVLYAGRAPSASVATGLKAVHLKEEQEFLEDAFSIHQDRLKGE

SEQ ID NO: 53650 - protein, 123 aa, Sorghum bicolor
  Clone ID: 13468865.pep
GRLSWERHISDSGSVFFYLFGFYSCLFSFLFCHLHLSFGKHMHIMHALLHSLESIGRIFFSLHFCSWEQVKLSSSLVYPWTFISSFYFSFHLFYCIPFRLSCRIGEDFYILAFITFISKTKPI

SEQ ID NO: 53651 - protein, 85 aa, Sorghum bicolor
  Clone ID: 13468872.pep
LQHLSWSVAELPSTDFPLHIRAPVSTSHRAACGCTRVESMETICRLCPVAALNVQHHSINFDIVQHEVRFRPVQIAAKALQCMHH

SEQ ID NO: 53652 - protein, 118 aa, Sorghum bicolor
  Clone ID: 13468888.pep
HLLQMPKCCQTRTLSLNLNEPMGERQACPRKKINQNQSCFPGMIESFPLGLWTALYDTEKNCIQLAQDTPSPATPGFNPPGAKRVFLTGSNHQKNCRSVHFACLCIVHVQAIGCSTRN

SEQ ID NO: 53653 - protein, 168 aa, Sorghum bicolor
  Clone ID: 13585048.pep
ECVRQLRLAREEQEDKIREIVSKSLVPQSENPELQNHIAELKKRLEVTRLEASSSMLLQHDLQERLQAVERENLDLKAKLQATEKENTDLKAKLLVQSKDLKILMLERDLSNQAAETASKQHLESVKKIARVEAECRRLQHLTRKTTLINNSRSTQNNCCMESLTDSQ

SEQ ID NO: 53654 - protein, 186 aa, Sorghum bicolor
  unsure (1)..(186): unsure at all Xaa locations
  Clone ID: 13585056.pep
ARGQIHTSQPSSPNPKSANRCRQPAGEECEDEGDLELYEQLRVEAFHRTWSKIQSTIDEVLRAINLKLFDQVLQWAKESFTSVRAITEPHRTEVQQPYPLLTDVICRRIPTAFVLTKNAEFVDDITTFHDLAGHMKSNGCHVVKLSAAELSAKHGVGGCFXSLLRQLLSDVPVVADVSALASWYCE

SEQ ID NO: 53655 - protein, 174 aa, Sorghum bicolor
  Clone ID: 13585057.pep
MDSASSLNLKFMQELESSPEFACLQPLFGWLHSYFRTCPDFLKPCIFYLSIFPRGHRIRRRRLVRRWIAEGYARDTDKISADERGEHFFCRLLDLSIIMQKTYSVTTTFGGRRMTLCQVNSFVREYIISRQMEENLVFELGGSCTLTSQRTGRHLIILKSWDRDRIVFESIDFS

SEQ ID NO: 53656 - protein, 145 aa, Sorghum bicolor
  Clone ID: 13585061.pep
ANSPVHTASPYDSPHLPMPNGSISTNFVRNTGDVSPRIPGLPGYDRMPNPWTPPNGNIPYRVVGHDVPSAMENTSAFAPRSNPTAAQYVQPFIAPESIQHQPGGPLIHPERAYPEPMPASYADSKVAVSALPLTDQLSRLDANTM

SEQ ID NO: 53657 - protein, 112 aa, Sorghum bicolor
  Clone ID: 13585062.pep
MADTEVFDGAVGIDLGTTYSCVANYEGTNVEIIANDQGSYTTPSFVSFTDKERLIGDAAKNQAAMNPANTIFDIKRLIGRRYDDPIVKKDVESWPFKVIDQGGNPVVQVEYL

SEQ ID NO: 53658 - protein, 124 aa, Sorghum bicolor
  Clone ID: 13585065.pep
ARGALAAHAEEQRHLLKTYQITARKLESDLRARDAEADRARSSLTAELRAERALEARLHPGRTLASLDELHLSGLNPTHFLTALRHTVKSIRSFARSMLNSMQSAGWDLGAAAAAVHPGVPLHR

SEQ ID NO: 53659 - protein, 157 aa, Sorghum bicolor
  Clone ID: 13585068.pep
HEARRPASSAGPATTKRGGLLLGRYELGRLLGHGTFAKVYHARHADTGETVAIKVLDKEKALRNGLVPHIKREIAILRRVRHPNIVRLFEVMATKSKIYFVMEFVRGGELFARVAKGRLKEDTARRYFQQLISAVGFCHARGVFHRDLKPENLLVDQ

SEQ ID NO: 53660 - protein, 89 aa, Sorghum bicolor
  Clone ID: 13585077.pep
MSCGRVPMECGHDCVVPRPQEHQAPLKCESPTLSSEEFLQFKRKATTIVEEYFSTDDVAATANELRELRVPCYHYYFVKKLVSVAMDRH

SEQ ID NO: 53661 - protein, 90 aa, Sorghum bicolor
  Clone ID: 13585092.pep
EGLPFSKMTGAILLSAGQVFLLVLFAFAASVGNFPSFILGFLKISICVTRFAPWSMYINQIWIGISYVIFPHGAILVWSLIEIFCYLFQA

SEQ ID NO: 53662 - protein, 83 aa, Sorghum bicolor
  Clone ID: 13585100.pep
MILRTPPQRKRRAGSSAGDDADLALVKSVGGASATGRSPVSDRRLVLYDRPTALVPADAPGEPFDDMVCTYHCRQMVKSEFMV

SEQ ID NO: 53663 - protein, 51 aa, Sorghum bicolor
  Clone ID: 13585103.pep
IVFNLDTRQVKWAAELDLSTDTVHFRAHVFSSPTVVDLDGDGYLDILIGTA

SEQ ID NO: 53664 - protein, 136 aa, Sorghum bicolor
  unsure (1)..(136): unsure at all Xaa locations
  Clone ID: 13585106.pep
RIGLLNDPRRLNVALTHARYGIVILGNPKVLSKQPLWNSLLTHYKEHECLVEGPLNNLKQSMVQFQKPKXIYNDRRLFLGGGQGVMHGAGASSQAADKRSGRGKGQSFVPYGPPNGVHKPGVHPAGYAVPRMPFPP

SEQ ID NO: 53665 - protein, 117 aa, Sorghum bicolor
  Clone ID: 13585111.pep
SSSWQGEPSLLSREAMDPSRAWALACRRRRCWSRWQFVGMRRIRSSSPMADDASLYLAGDARRKGREIRLSVSSCRFSLHRSLFCPAPRPPRCLDRILSFLIFVRLSNSKPARAPRE

SEQ ID NO: 53666 - protein, 127 aa, Sorghum bicolor
  Clone ID: 13585114.pep
NAACARSLHVVYLVRVARAVTPQPSQPCFDINYSLFVAVTTAGCLLSLLPGRYEKNAKRTNYCCCCCFPSSSGTAFVLIPQGYVERQHAIYSPPHLNPHLTPLLLAPSGSILAQDDRRYKLLDHPGQ

SEQ ID NO: 53667 - protein, 159 aa, Sorghum bicolor
  Clone ID: 13585118.pep
QLHAIYMTTSSHDPDKWAHLVREYASQSLLREAALVYARNVPRRTHHQPLLPILLRAAATASPAEPGLGKSLHAEALKSAFARDLLVGTTIVSMYCKCGALADARRAFDEMPDRNVISYNALLAGYAAAGDMDGALALFGGMRSWTYVTWATLIRGFAK

SEQ ID NO: 53668 - protein, 171 aa, Sorghum bicolor
  unsure (1)..(171): unsure at all Xaa locations
  Clone ID: 13585119.pep
TRLILAPTNYTSEGRADIRRSNSMELFTVTNVTRGSNRXYREITMRRIEHLKHHYKRHDQYTILVRGIPTCPDHGTYGCYVDHFFSKHYQTYQSYQIVHDIGNIEALQKLASSIQKRIQRKRETRKCNLLGRIWSKFTSEATNIHNHEKKLKNLQETIRLLQCNLLKQKEV

SEQ ID NO: 53669 - protein, 38 aa, Sorghum bicolor
  Clone ID: 13585121.pep
ARGPSAVDQFRKQFAHLEENSGNGPVIPMERKHTSLPR

SEQ ID NO: 53670 - protein, 143 aa, Sorghum bicolor
  Clone ID: 13585136.pep
TRYLRANKMFVDYNETQTERVYSSYLELDLADVEPCVSGPKRPHDRVALKDMKADWRACLRNKVGFKGFGIPKEQQDKLVKFTFHGQPAEIRHGSIVIAAITSCTNTSNPSVMLGAGLVAKKACELGLEVNPWIKTSLAPGSG

SEQ ID NO: 53671 - protein, 168 aa, Sorghum bicolor
  Clone ID: 13585139.pep
HEEYPSLPSTNQNLKQSVSMVPPTELDKGLQPAQDSVQVMNHGHSAADSKLPYGTDWSPQDDPTSANQSSLPETSGDPSLYEASFQSSTLVTDVVNSHENLHLDEDSTFAMRPVPASEIHLEPSDGISEYNDGMLNNSSSYQPQNYSYTEQEVEDSSADLSAAAAAAN

SEQ ID NO: 53672 - protein, 135 aa, Sorghum bicolor
  Clone ID: 13585140.pep
MQHRSPEAASASASPTAAAAAAMAPGVGGVEPAVTLDQVPRWSDPDQRISPLSPTAAGSETPPSSFLSFSDPLTGDDAAAGAGGRGASRFPVDHEINSKIYLWRGHPWSLEVDAVVNSTNENLDEAHSSPGLHAA

SEQ ID NO: 53673 - protein, 99 aa, Sorghum bicolor
  Clone ID: 13585145.pep
FDLYPSNMHYSAALAAVVAVAPIVSGHGTGVPNIVGLNPRDLKARDLLSRVGARFTGVNELLEPKNDVKTQIIRRQDDRQCGTGIGNCPAGQCCSSAGY

SEQ ID NO: 53674 - protein, 163 aa, Sorghum bicolor
  Clone ID: 13585147.pep
ARGILVPKTYIWPVEKDQYLAPSPTSLVKDAHAIGLEVYASGFANDIVLSYNYSYDPSAEYLQFIDNPDFSVDGVLTDFPVTASGAVACMAHSKGNPLPPPGKSRPLIITHNGASGMFAGSTDLAYQEAIKDAADIIDCTVQMSKDGTAFCMHSADISSSTTA

SEQ ID NO: 53675 - protein, 209 aa, Sorghum bicolor
  Clone ID: 13585152.pep
ARGFLGIHGDELGIHTGWKSLDDLYKYHLNRLTWLVVPGELTVVTGVPNSGKSEWIDALLCNINTQCGWKFVLCSMENKVKEHARKLLEKRIGKPFFYARYGGDAQRMTPDDFEAGKEWLNETFHLIRCEDDSLPSINWVLDLAKAAVLRHGVRGLVIDPYNELDHQRPSNQTETEYVSQILTKVKRFAQHHSCHVWFVAHPRQLHNWN

SEQ ID NO: 53676 - protein, 169 aa, Sorghum bicolor
  Clone ID: 13585160.pep
HEARFGFSLGDAAITEAYVDPSETALLGPVVFRPSNHCMWSTMVLIRNNLSGVEMLPLRAYGGRQSIVLLEESEPAWKLEFSLGSNIQNQSTMTKQEVPSSLCSQQLTKEIHVKNSGDLPLQVTKVKVSGADCGVDGFTVENCKGFSLAPSESIRMLISFQADFSSAMV

SEQ ID NO: 53677 - protein, 178 aa, Sorghum bicolor
  Clone ID: 13585165.pep
ARGHGQTQHSLSNVSAITAASSIRDCPPMTVTYRLQGLDGEATEPMIKELDEEREESQDPEIEFAIAGAVRECGGLEIILSMIQSLRDDEFRSNQEELASVLNLLKYCCKIRENRCALLRLGALGLLLETARRAFSADAMEPAEGILLIVESLTMEANESDISIAQSVFTTSIEATGA

SEQ ID NO: 53678 - protein, 150 aa, Sorghum bicolor
  unsure (1)..(150): unsure at all Xaa locations
  Clone ID: 13585172.pep
PNVDLAKGDRARDRGVGVHLVVEPAMLVDVGRSSCGSSXMIEGRGSLTWRGARCRCGVVSDGDLYLSHATASPTATSMYPTQWARALGPATGERRQRARAVRAARAEVLGGGGGTSGRGEPPTSRRGRWAWPPASAGSGVGREEEARAAI

SEQ ID NO: 53679 - protein, 55 aa, Sorghum bicolor
  Clone ID: 13585187.pep
HEASSPLLGAIHPPPPSGVKRGRGLPRNSVLVPVRSSFSQLLKSIAPPPPAGVKR

SEQ ID NO: 53680 - protein, 176 aa, Sorghum bicolor
  Clone ID: 13585202.pep
NANSTGPLQPGRYYSPEEIGKKRCSTIWEEAPSKAKQKSPDTTPDGSFLGCKEMGPGEKNPDEILFFSTTTERPKVVDISSPISRKPRAKTKPTGRRVPGDMDDNIMAYREWRSLSDKADSKNNPKEDDIFLNTATVSRAPITASGKTRYKRSSSSQLPQSNPRTTGDSARTSQEP

SEQ ID NO: 53681 - protein, 69 aa, Sorghum bicolor
  Clone ID: 13585207.pep
NCWPCKHSRTIRTNNISAEIFTQPQNRNTGLSLQQRLMVRLKPSTQLAECLRRQALAAPDPSRGSRSLL

SEQ ID NO: 53682 - protein, 123 aa, Sorghum bicolor
  Clone ID: 13585209.pep
PYIVLERIGSVAYKLELPPHSEIHPVFHISQLKPFVPDYTPVYSELPSVTDLQTSNAVPEMILQRRLVRKGNSAIPQVFVKWTGLSPASATWEDYNVIKNRFPKAPAWGQAETSAGGDVAIQG

SEQ ID NO: 53683 - protein, 68 aa, Sorghum bicolor
  Clone ID: 13585229.pep
SGQHITDHIWPSTQHCPHIATTYHPFCSTNYGSTHQVLILNSQLPFSQLSSTRQKYSHKHTALETFYT

SEQ ID NO: 53684 - protein, 78 aa, Sorghum bicolor
  Clone ID: 13585268.pep
PRLGNTDLVAKSSAYRTCLQLHHKVINLLVQALTASRWVRITDVAVPPISCWCYCFICQLSREDTQSLSNNLNTVRGR

SEQ ID NO: 53685 - protein, 147 aa, Sorghum bicolor
  Clone ID: 13585275.pep
SGCNPCGSCKQCCSCPTDCCNCKPSCGCFSAQCCSCAACCSSCLSCFSCFGCFKSFKCSNLFGCCSCKQCFKCQSSCCKGAPSCCKCQSSCCEGEDGSSCCRRSCCSVPKPACPGCSCGCVWSCKKCTDGCRCSGCRNPCCATGCLC

SEQ ID NO: 53686 - protein, 136 aa, Sorghum bicolor
  Clone ID: 13585279.pep
KLDAYGVEAGVEHYGCLVDLLGRAGKLKEAYEIVKNMPEEPNEVIWGSLLGACRVHGDAEMSRLVTDEIHRLHSVHASSNDAEYIMLSNIMAASKRWEQAEQIRRKMARHGVEKTPACSSLELGIPEYQVCAGSRQ

SEQ ID NO: 53687 - protein, 147 aa, Sorghum bicolor
  Clone ID: 13585280.pep
VAPLLLPILLIYFLLGYAVYINQMEDVYEITYDTCGQYWPNIHHYIFLSVTLMQITMIGLFGLKSKPGASFATIPLLVLNILFNEYCKVRFLPNFSHRPVQVAKQSDELDEADGMTEGDVNDAICAYWPPWMRPTSLESSSVQPLNI

SEQ ID NO: 53688 - protein, 83 aa, Sorghum bicolor
  Clone ID: 13585286.pep
SSRKDQSFGGAITCIVDGTEMNRAQLVCRNCNIPHFIVPSHFQPYQNFIVYRQQENLLFLTTNYHQFGFLQCPLLQSNLRGKH

SEQ ID NO: 53689 - protein, 102 aa, Sorghum bicolor
  Clone ID: 13585302.pep
LGFMKRLQQILGRKHQKNLHTIYILHPTLGLRTAVMAMQLFVDGEVWKKVVYVDRLVQLFRYVPREQLTIPDFVFQHDLEVNGGKGIIVDPRTKHVYQRPSG

SEQ ID NO: 53690 - protein, 63 aa, Sorghum bicolor
  Clone ID: 13585307.pep
SKSIASLKPISTLKVSTDATCGGKYGFTCAGSTFGNCCSCAGWCGSTTAYCGTGCQPGFGKCT

SEQ ID NO: 53691 - protein, 70 aa, Sorghum bicolor
  Clone ID: 13585313.pep
HLEGFFCSHFSTPDEEPTMSLMCPSREFRCSFDTCKAIYRPCAEHFRLGTVSVNLFCNRSRAAVLCSWNN

SEQ ID NO: 53692 - protein, 137 aa, Sorghum bicolor
  unsure (1)..(137): unsure at all Xaa locations
  Clone ID: 13585330.pep
MSRTASMRLPGATSQNQELDSFKGSXLYKLRPSKFRAAIEAAFLTERDFXQKMDGVCSLRKSVNKQSDPNSFQEEANSNNEQECQSDSQVVRKLALSCDSCDNRLPSKVPKKRKQGMSRCSALRKDVLALQRKSWPQ

SEQ ID NO: 53693 - protein, 56 aa, Sorghum bicolor
  Clone ID: 13585340.pep
LLNSYSVFVLLHILRYTSTLQSTEILEAFQASSLGRGYPWPFSVAGNLSHHSSVSP

SEQ ID NO: 53694 - protein, 105 aa, Sorghum bicolor
  Clone ID: 13585368.pep
NQAITCDHYSADFRQGYTGNGTLTSVLTRLGELEEKIQTLEAKPPQVPFEKEELLRTSVYRVDVLEAELISMKKVLYETLIRQDELLAYIDQQQTAKFCRRKFCF

SEQ ID NO: 53695 - protein, 78 aa, Sorghum bicolor
  Clone ID: 13585371.pep
FTKRFESRQQLESYISRVEEIVSDPSMSMKLKRGNKERIESALSDAMAQLEVEDSSPEDLKKKELALKRLITKAMATR

SEQ ID NO: 53696 - protein, 119 aa, Sorghum bicolor
  Clone ID: 13585374.pep
RLEQRGIVSAGPGFPESSWFADFAEMARRVWLLHCLFFAFDGVAEEDGASIFQVRTGARFSEVYMESVSDGRAGDDAGAAAAAEDRVVGFTVLPGFRVGRTLIQCRVYLSKPSKPVRRP

SEQ ID NO: 53697 - protein, 73 aa, Sorghum bicolor
  Clone ID: 13585376.pep
LCFISIVGSCFSFLTLSYTIFLMAYTLPMLYEKYEDQVDVVGEKALIEIKKQYKVIDAKFISKIPMLSEKKQH

SEQ ID NO: 53698 - protein, 109 aa, Sorghum bicolor
  Clone ID: 13585386.pep
CRCIKDLGMPFFHHEVVKKALVAIIEKRGKDERLWGLLSECYGRGLITPNQMTKGFDRVADCVDDLALDVPDAAKQLGCCIDRAKKEGWLDPSFSMTRPGQPVANGVCS

SEQ ID NO: 53699 - protein, 136 aa, Sorghum bicolor
  Clone ID: 13585418.pep
LLLSKRMGFAEIWLDQTEPGLKSGLTQHDWADQTNSCLLVLPPCFLSSSRVFNNARWHGHYLPRFPFRFPCSKPCLSSSSSPARPELAFLLKKTPDINSHEATSLVAIIAATSSLSSSLSSRSSNKPTLPSPMEKD

SEQ ID NO: 53700 - protein, 45 aa, Sorghum bicolor
  Clone ID: 13585422.pep
FSLDSDILMEGYRGVLAIRRYIEPRVPSTVKLQVLELCSCHAAVH

SEQ ID NO: 53701 - protein, 121 aa, Sorghum bicolor
  Clone ID: 13585425.pep
LCQLICTELFLCPDEQRNAQDDMTYFRPSFLVYMTWPLLLIFSVCMIWVFCFCLLSVDFYFSSFFFFFFSVILRLCVCLRLLLSFLSVWCLFSSGFFGPGISRYTCMIRDGMFAMFCYAFS

SEQ ID NO: 53702 - protein, 82 aa, Sorghum bicolor
  Clone ID: 13585431.pep
TSSTFTDFIFQAAVPKFIELRLDPASGNTVPANGNGSVTQGLNVTNNQQGQKPLAMRIRMSYKVNGKDRLEQGQVSNFPSGL

SEQ ID NO: 53703 - protein, 86 aa, Sorghum bicolor
  Clone ID: 13585435.pep
AFSSKLINLRWEGPSKLSIFLEAMSLERIQLPVHVTEADYFFNSGVQEKGLVKWTTRPDYLCHAWESAGLEVGISYLCCCCLYGLP

SEQ ID NO: 53704 - protein, 113 aa, Sorghum bicolor
  Clone ID: 13585449.pep
GILCSCCSKTLSISDFKAHAMISLPRSSLNLCLQSGKSFTLCQIEAWNAEYMDRRSNACRRKVEAADGNDDPCGFCGDGGELLCCDICPSTYHQSCLSVKELPDDSWYCHNCI

SEQ ID NO: 53705 - protein, 83 aa, Sorghum bicolor
  Clone ID: 13585477.pep
LRQLAAKYASNTKDGSKLQALSNPAKSCASFHHDELNKSICQVAVPVHSVFVAKHEDKFSLRNIFILLFKHKEPNATLTKQEI

SEQ ID NO: 53706 - protein, 90 aa, Sorghum bicolor
  Clone ID: 13585479.pep
DQERPRDQKIEELKETVRATEDAKAHALKELELIKENNMNEIKRFNKERRQDLVEMLKGFVSDQATYSDHFASIWTKVAEETKGYAKSSS

SEQ ID NO: 53707 - protein, 55 aa, Sorghum bicolor
  Clone ID: 13585492.pep
DRQQLSPGDALICSISPWPVPTACLVDSTTDFFRSIHEGLHWNLRKSQSFDGPRD

SEQ ID NO: 53708 - protein, 105 aa, Sorghum bicolor
  Clone ID: 13585497.pep
RKLMTLRKTSSTSREEVEKLQMENRSLREKEEKSSSETKKLQREIAKLNESMKKLKSETEEHERKASVAEAHVNALQKQSEELLLEYDRLLEDNQILQTQLLSRA

SEQ ID NO: 53709 - protein, 103 aa, Sorghum bicolor
  Clone ID: 13585504.pep
FSVTHSWTWEAPQEIDHVLFKVDCAAGDKEHASKGCSCRRPAPPEEREEEKAEERERESQVSKVFKPPAVSTNLPLFLLLYMCMPCEVHSRGTTDYKEFEFLK

SEQ ID NO: 53710 - protein, 52 aa, Sorghum bicolor
  Clone ID: 13585511.pep
YLLNIQCLLVQNLSVVSVQMLISVLNDTKYLNYCYYYYRQCLVCAPIYGPAT

SEQ ID NO: 53711 - protein, 133 aa, Sorghum bicolor
  Clone ID: 13585514.pep
MMKLKDSKYVEWRSVFLLTVLTNPLHKLYGKVNKFLQKAPFWEVEKIATYWIDKILLHEPELDDGYFEEISWLLDLFVKGLRTGTDMEVYRRANVFERVLSFYESPSALFSAKRRILHLLYRSTQVGGSTTLV

SEQ ID NO: 53712 - protein, 56 aa, Sorghum bicolor
  Clone ID: 13585519.pep
ESIDTIYTVQNCHLSKPQAEKLSLLPNVITPLHLHVNRAKGHAEYDRRFISNGLVQ

SEQ ID NO: 53713 - protein, 139 aa, Sorghum bicolor
  Clone ID: 13585531.pep
SFIGRAGPKNKGRISRFLANKCSIASRIDNFSEEPSTKFGEVLKKQVEERLDFYATGAAPTKNEVAMKSAMDSVLADMDIDDGSDEEMGDAVAESKKEDKKEKKEKKEKKEKKEKKEKSEKSEKKDKGEKEEKKKKRKH

SEQ ID NO: 53714 - protein, 126 aa, Sorghum bicolor
  Clone ID: 13585549.pep
ENYKPDEWSLWRVDFKYNEELRMTFMAANQIGGFFNRLEASRKYMFGAAAVYGVNYDCVIRGVMLIRGQESHPAIEVAPDWESYALTKLDHTKEEDRKFVGDMWAWDVPLVIEGKELPWVDGHELK

SEQ ID NO: 53715 - protein, 78 aa, Sorghum bicolor
  Clone ID: 13585552.pep
FEIHDFDTQKLGHQWLANKGYEAVWGVGRHILGSQLFDYWWDTTGNMIEHYADGDLVSEETPVGYGPAGDESLAVWGP

SEQ ID NO: 53716 - protein, 179 aa, Sorghum bicolor
  Clone ID: 13585591.pep
TRGSPVVLPYTVFILVACVSVAFSLYLAVTPLRSGSHEAESHEWSVHSQRELLNTPQEREDVKVDNVTYEEDQRSDVGPSPRDAPDSHPELAMDYIDTSDTAVESDHDSQQSTAYASTAPETCPSPSFTREESKSVVAVNWPEPLEKVPTSTVIEESTVESVVSRITTERDVLVETDVF

SEQ ID NO: 53717 - protein, 162 aa, Sorghum bicolor
  Clone ID: 13585592.pep
AKRLDRGGRKKRETERERPRRERERQRGETKRQRHREGAEERERERGESREGGGVLARFEFPPTLPPWCPTRRSQAASSPSSVAPPAGPGRPRSPPCCSRRRPRSASTSPTRRASSATRWTSSSARTSSRSRRPSPSRRLPRLRPSLPPRPLCRSSSLSISI

SEQ ID NO: 53718 - protein, 108 aa, Sorghum bicolor
  Clone ID: 13585596.pep
MAASRALLPSPQASPAARVAVAPSSLTTLAARTGAARLRVVRCAVLSSPAAPVAESSKPPAHRISRSGSDGALRPKPAVLVAEKLSEAGLAVLREFADVECAYGMSPA

SEQ ID NO: 53719 - protein, 88 aa, Sorghum bicolor
  Clone ID: 13585615.pep
MGLGEAARRLLAAVDWEREAYPAYGDFLALPAFVLFFPTVRFLLDRFAFEWVARRLIHGNGHQRANNETEEARKKIRKFKESAWKCVY

SEQ ID NO: 53720 - protein, 94 aa, Sorghum bicolor
  Clone ID: 13585618.pep
PHCQHPVNNTVANTRPSPQSRTEIQEKILPFPNPPSRRVLQSPGAAAVSCAPAASDDRMRREFPESGGGEGGWGLGALLLQERDGTVGSLLPLH

SEQ ID NO: 53721 - protein, 177 aa, Sorghum bicolor
  Clone ID: 13585631.pep
PNPNRRAPAVAMMATEPSSPVSPVEDLDTLPLESSSSSVGVAATTDPLLRPPPPPSSTSSPTAGENHGVFLDEEDEDGVEDFTPPPAPHTAAAATKSREASPGFAEITVSEPRKHAEPATGAVGVIPGSANYVSYLIATRVPDGGEFRVRRRFRDVVALADRLAETHRGLFVPARPD

SEQ ID NO: 53722 - protein, 186 aa, Sorghum bicolor
  Clone ID: 13585632.pep
TRLQQYSQFPDFNNYLVFILARGEGKSIEVRQAAGLLLKNNLRTTFSSMPPPFQHYVKSELLPCIGATNRAIRSTVGTVISVLFQIVRVAGWIELFQALHKCLDSNDLDHMEGAMDAIYKICEDVPEELDVDVPGLSERPINVFMPRILQFFQSPHPTLRKLSLGCVNQYIVVMPSALYMSMDQYI

SEQ ID NO: 53723 - protein, 178 aa, Sorghum bicolor
  Clone ID: 13585648.pep
GRKASFKLSWGCNGDKNGQHKHDFVSFEKGDITTAERSNKQILLKWESPPQTVLFITKPNSNSVRVLCAEMVRWLRESKNINIFVEPRVRKELLTEDSYYNFVQTWDNDEEIKMLHTKVDLIVTLGGDGTVLWAASLFKGPVPPVVAFALGSLGFMTPFPSEQYRELLDNVLNGPFSI

SEQ ID NO: 53724 - protein, 124 aa, Sorghum bicolor
  Clone ID: 13585653.pep
GAAPPRPPRTTRGRAGESYRPTGRRRSSLTQSATILQPDLGGPEKKKRRRDFSETAGLASFLSLAPNWNGMAVWHRSGGLRRRKKIRNLVGREIGDDGQEMKSPPFLGLRKGEPSAIRRPGPRA

SEQ ID NO: 53725 - protein, 113 aa, Sorghum bicolor
  Clone ID: 13585672.pep
DVRDITHVLNYDYPNNSEDYIHRIGRTGRAGASGTAITFFTTDNSKQARDLINILTEAKQQIDPRLAEMVRYGGGGGYGGGRWGGRGGGRGRGRGGGSFTASNAAPLGNHRRW

SEQ ID NO: 53726 - protein, 78 aa, Sorghum bicolor
  Clone ID: 13585693.pep
RDQSQKDTGRKMWRSVNELMLVRWDKSKAAGISNLILLKFSEADAHESTTLERIQEEEPEFYSMVSRVLKRAEMEFAL

SEQ ID NO: 53727 - protein, 118 aa, Sorghum bicolor
  Clone ID: 13585697.pep
LEKQQPAFALKVQTVPLTCNNPKGQNSFQISLEISYTGSRPASNMVIADVKMLSGFIPLKPTVKKLERLEHVSRTEVTTNNVLLYLDQVTNQTLSFSFIIQQDIPVKNLQPAIVKVYE

SEQ ID NO: 53728 - protein, 121 aa, Sorghum bicolor
  Clone ID: 13585709.pep
WDMKTVDGSEQFFPADLVLLSMGFLGPEDRLLGDEIERDARKNVKTPPGHYVSNIPGVFAAGDCRRGQSLIVWGINEGRQCAREVDAFLVGTGSRLPVTGGIVRRPAIDAVPQSTENILAA

SEQ ID NO: 53729 - protein, 54 aa, Sorghum bicolor
  Clone ID: 13585716.pep
ANNAAHGPPRLAPPPSTSVGRGRGRNQGQSALSRASRPPHSNSSSGQQPILDLL

SEQ ID NO: 53730 - protein, 174 aa, Sorghum bicolor
  Clone ID: 13585740.pep
ARGLDRPSHQIPWTEFCSLLLERFARNQHGTLIRQMFHISQTTTVVDYVDRFSTLIDQLKAYTKNPDMHTYITRFVDGLRTDIRSVVALQCPNDLDTAYSLALLQEEVSALVTKNEYPRVGNTPGFKTNFRHAHPLPRPPQADKPAEPPAAQAVTTPTTTDKLSELRQYRRAQG

SEQ ID NO: 53731 - protein, 165 aa, Sorghum bicolor
  Clone ID: 13585743.pep
ARGFLRELPKSLTYPDIARLLCSPEGRERLDISGNASFALYYFLSYVAMEQDMRSNTTVMLLERLNEFAEQPWQKQLALHQLGCVMLQRGEFEEAQEWFEAAVAEGHVYSLAGEARAKYKRGHKYAAYKLMNSVVGDYDEPAGWMYQERSLYCVGKEKLADLQAA

SEQ ID NO: 53732 - protein, 159 aa, Sorghum bicolor
  Clone ID: 13585750.pep
TRSVYSYGSTVVDSLSNDQRSVLAFAHFLYHSFKMEHIESFWLSKLCCAMPIVDRYGNVVNKTENIIVPAKGSKWVGLLGTYPWRNQGYIELSADYKSVGHFAGNYTSEDQLLEFLKIHLHASDVPLIRPPNVRFHTVSSPLNVDNTFLLLEWIRNIRS

SEQ ID NO: 53733 - protein, 175 aa, Sorghum bicolor
  Clone ID: 13585754.pep
TRLRRNAQRYVLANLKFQQASAKSDILEQHKIIRAFFEHVRKDSWDIVLDIVKSAERDIAQDASLSRNAKTKFFSRWNLERLVTLYGYDRESDNPNPKGVSITNEVHKLLMKICTKFDHGVLLPETGWYPNGSDPESLPTEDDACIELGLDSALHVDKYKESVPVRNGSLSYLIQ

SEQ ID NO: 53734 - protein, 160 aa, Sorghum bicolor
  Clone ID: 13585758.pep
TRGGLEKSITAGSDGASRKRSLSDFLPSIPSLRGLQASEPRKRRKKSESVQNILPLQAHSSNLQSRVSLTYGDVLAERNNCVPATIYASVLLHVIRHCSLCIKHAQLTAQMDSLAIPYVEEVGLRTPSSNLWLRLPFAQDDSWKHICLRLGKAGSMSWDV

SEQ ID NO: 53735 - protein, 98 aa, Sorghum bicolor
  unsure (1)..(98): unsure at all Xaa locations
  Clone ID: 13585764.pep
XIPSRPPPPSPPPPPPQAAAAGAAARRMPGVNCDPRRRRRWLRGCLLGFGWLVAGRRENLLPLGIGLVEISRRLLQIAAWASTSTSIAEPEPRAGASC

SEQ ID NO: 53736 - protein, 89 aa, Sorghum bicolor
  Clone ID: 13585771.pep
MADVLLFEGPMGYSLFKVNHKGDSVGNRLKEVQEGVDDLAKFGKMVELASFMPFENNKQALSEINDVSEGVASETLISFLELNLPKPNK

SEQ ID NO: 53737 - protein, 168 aa, Sorghum bicolor
  Clone ID: 13585790.pep
MSFGKLYGAAENGRTIAVLVAAKSNDLDLELVRTEPNSTAAFNQSAEYAKINPLGKIPAFEGANGFVLSEVIALAIYVTSQNEKTTLLGKTKQDYASILRWLSFANSEILPRFGAWYRPLLGLDGYNKKNVEEAAKGALKNTAVLESYLSSNTYLVGERITLADFFTA

SEQ ID NO: 53738 - protein, 91 aa, Sorghum bicolor
  Clone ID: 13585794.pep
EMAIEATHGSEVQDTVAIGPEQEALQAWRERCNINTDAQIRLVKLSHMRYQHPDLDEITVFLQDFGMEIVKKTDDQIWYRGYGTDPYVYYA

SEQ ID NO: 53739 - protein, 168 aa, Sorghum bicolor
  Clone ID: 13585799.pep
TRAPPAPQQLQLQIQWSSQLSSLAAPAGLCLLSALAAALLVLTLYVLCVVASFAVFCAREFARRDPERPPLMGTMFRQLKNFDRLFDEHVKYALAHRTCRLVYAGHSELFTADPAVVEHVLKTSFSKYSKGAYNIEIMKDLFGDGIFAIDGDKWRHQRKLASHEFSTK

SEQ ID NO: 53740 - protein, 168 aa, Sorghum bicolor
  Clone ID: 13585801.pep
HEAERGPGVSSQPGHVIHRREPSGKLYNYAAASKGAKVLDFNKEAKGASNILDKDKDKYLRNPCSAEGKFVIIELSEETLVDTIAIANFEHYSSNPKEFELLSSLTYPTENWETLGRFTAANAKVSQNFTFLEPKWARYLKLNLVSHYGSEFYCTLSMLEVYGMDAVK

SEQ ID NO: 53741 - protein, 146 aa, Sorghum bicolor
  Clone ID: 13585821.pep
HEGKLVLVQVANPARGRGKDVAEVQTETYAMVGRINEVYGEPGYEPVVLIDEPLQFYERVAYYVIAEVCLVTAVRDGMNLIPYEYIVSRQGNEKLDGMLRQGKPEEKKSMLVVSEFIGCSPSLSGAIRVNPWNIEAVADAMETALV

SEQ ID NO: 53742 - protein, 139 aa, Sorghum bicolor
  Clone ID: 13585825.pep
LKEVFHSQWHPKRPDYCCYLNMICEHLTMDNFVKAPVYESITFTKLRNKWFKLFTVGAYPDSCYQSEESKNFVRTVITAKELKKFLLAVAVSWPMLPSAVCLPSNDFLYQLLKCLKDQIIISQYLAIMLTQYWPFKPSC

SEQ ID NO: 53743 - protein, 175 aa, Sorghum bicolor
  Clone ID: 13585831.pep
ARGEIFHCTEQLVYGDIVWAKLGKRQPMWPGVLIDPTQQVAADAMPPQPRRVAVLCVMLFGWCTEFSDEKKYVWVRQGLIFPFSDYMDRFQGQTELSSCKPADFRRAVEEAFLADQGFSEVVIDCSTKGQPVVCHSFPDDLHEVTGSNELEYQPQIKRCRRALQCESCGNCFPNK

SEQ ID NO: 53744 - protein, 87 aa, Sorghum bicolor
  Clone ID: 13585832.pep
ARGLMADLAAHAPPGSLGRLRLIHLPDRALQVTFSLAAADLRSNSSGSGVLGAQMRGLPLPPHDVWRPGTVILAEEDLLVVLSTLCG

SEQ ID NO: 53745 - protein, 125 aa, Sorghum bicolor
  Clone ID: 13585837.pep
VRGPAPLVQPHEQSVGVGGGDVERDDAVACIGDLDERPGEQLAAGGVAPDPHHDRPGQRRGRRRGGRRGRRGPRLALEQPLPARAVGDEQPHGTAAAAAAVGRSMLPRPGGSALARSLLGLGPRA

SEQ ID NO: 53746 - protein, 145 aa, Sorghum bicolor
  Clone ID: 13585838.pep
HEAAIAVHPEDERYKHLHGRYAVHPFNGRKLKIICDAELVDPTFGTGAVKITPAHDPNDFEVGKRHNLEFINIFTDDGKINSNGGAQFDGMPRFAARVAVIEALKEKGLYKDTKKNEMSLGVCSRTNDVVEPMIKPQWFVNCSSM

SEQ ID NO: 53747 - protein, 53 aa, Sorghum bicolor
  Clone ID: 13585845.pep
TIIYHQTDRLNVQYWCQIYIFLKKKIAICPFLHKYNINRYIISVHFKKISNSL

SEQ ID NO: 53748 - protein, 174 aa, Sorghum bicolor
  Clone ID: 13585849.pep
HEGGEWLNNLRFGVFGLGNRQYEHFNKVGKVVDQLLAEQGGKRIVPVGLGDDDQCIEDDFNAWKELLWPELDKLLRQEDDSSTAPTPYTVAIPEYRVVFVKPEDAMHINKSFTLSNGHAVYDIQHPCRANVAVRRELHTPASDRSCIHLEFDITGTGLKYETGDHVGVYAENCI

SEQ ID NO: 53749 - protein, 156 aa, Sorghum bicolor
  Clone ID: 13585851.pep
MAGGPKKPVNIFRLGNLGDPKEVFNWKLWFAVVSFALMGAARGVDEGLISGAFDSADFQRYINYDSYSTVEQTNIKANVSAMVQIGSVGGALFAFVVCDRIGRIWATRQLCLLWILGIAIFMGNSGKLGAVYAGRFVAGLGVGQTVVVGPVYLAEI

SEQ ID NO: 53750 - protein, 165 aa, Sorghum bicolor
  Clone ID: 13585864.pep
ARGCQLLCHSGHCPPCLETIFTDLTCACGRTSLPPPLPCGTPTPSCSHQCSVPQPCGHPASHSCHFGDCPPCVVPVMRECIGGHVMLRNIPCGSKDIRCNQPCGKNRQCGVHACNRPCHPPPCDQPPANGDASSSSGGKASCGQVCGAARRECKHTCTAPCHPSS

SEQ ID NO: 53751 - protein, 167 aa, Sorghum bicolor
  unsure (1)..(167): unsure at all Xaa locations
  Clone ID: 13585867.pep
TRGIACMSWALVFWYAGVFIRNGQTDGGKAFTAIFSAIVGGLSLGQSFSNLGAFSKGKIAGYKLLEVIRQRPTIVQDTADGRCLDEVHGNIEFKEVAFSYPSRPDVMIFRDFSLFFPAGKTAAVVGGSGSGKSTVVALIERXYDPNQGQVLLDNVDIKTLQLKWLRE

SEQ ID NO: 53752 - protein, 120 aa, Sorghum bicolor
  Clone ID: 13585874.pep
MAGQPRERGSRSSRKGRSARAVPAPAPPPASDPDPAAGEDAAPWLRATADELEERLLKRLDEAYAAALARLADLGHGEEASLEAVLHSGHCYGKLNDPVSNIVANARAYLDPNHATASGG

SEQ ID NO: 53753 - protein, 115 aa, Sorghum bicolor
  Clone ID: 13585876.pep
ARGQGNPSLSRRRRRRQLRLVVRGFSFLLPLPPALAAPPAGDGYDKPEAPLSTTQVPFPLSLRKVSVLPSGVWSAVQIHPVGPGSISPFVGSTNSGVQLNPKSVPNCHSGPARFL

SEQ ID NO: 53754 - protein, 137 aa, Sorghum bicolor
  Clone ID: 13585879.pep
MLRRALLSSASPALHGRARIRALLPQWSSYASVASSSAPPPEQPPPPPPPPSPPRGPSRSGGGGPTVSSLNPAEVAKFASIAETWWDSSGPFKPLHVMNPTRLSFIRSTLCRHFRRDPNSSKPLEGLKVIDVGCGGG

SEQ ID NO: 53755 - protein, 56 aa, Sorghum bicolor
  Clone ID: 13585883.pep
VKKQPPKSKVFFVLTLAKLRFAQVYKKVHQHPQHQICFIKSAMIVHLFGTVGAKPL

SEQ ID NO: 53756 - protein, 161 aa, Sorghum bicolor
  Clone ID: 13585885.pep
HEEKIKFICSFGGAFLPRPSDGELRYVGGERHLVRIDRDVSWRELICKTTKLIRQDHTIKYHLPGEQLNMLISITSDDDLRNMVDECIVLEASRERLTMYLFSTNEDEHGVHFLVKRSSSEAEKEAQFIALVNGLTAPIVASRMHSLGSTSASDLDQMILG

SEQ ID NO: 53757 - protein, 173 aa, Sorghum bicolor
  Clone ID: 13585888.pep
ARGEALATTLASSRDSSGEEEKSKCPHSIVLSGDEFRERGRTVELPCGLTLGSYITVAATPHQAHPERDPKITMLREGEEPIMVSQFMMELQGLKTVDGEDPPRILHFNPRLRGDWSGKPVIEQNTCYRMQWGTPLRCEGWRSRADEETVDGLVKCEKWIRDDEGPSEESKTS

SEQ ID NO: 53758 - protein, 135 aa, Sorghum bicolor
  Clone ID: 13585906.pep
MSYGGGYRGDSYRGGYSNGGGSNGYSGGYGGGGGGYGGGYGGGYGGRGGGGAAAAGGDRMSNLGSSLKRQDWDYSALPKFEKSFYKEHPDVANRSQQEVDEFRKASEMSVHGRGVPRPVETFDEASFPQYVLSEV

SEQ ID NO: 53759 - protein, 160 aa, Sorghum bicolor
  Clone ID: 13585927.pep
MGERAKEWLLAAGAGVAVGALSAAVMNHLSRSKRREGYARNLLESNRMTTGNAQSTRHLGAVGSLDLLSDEVVSEQLTRNIQFFGIDSQKKVTKSYVVVIGLGGVGSHAASMLLRSGVGRLLLVDFDQVSLSSLNRHAVATRDDVGTSKALCLKKHFSMI

SEQ ID NO: 53760 - protein, 181 aa, Sorghum bicolor
  Clone ID: 13585930.pep
TRVEQRCQVEKPEHFQPTAVVRIPSLRSRSIGKGEKVVVAPEIEAATSKIIQEEERESGQVSWRVYKLYMTEAWGWWGVVGMLTFAVVWQGSEMASDYWLSYETSGSIPFNPSLFIGVYAAIATFSMVLQVIKTLLETVLGLQTAQIFFKKMFDSILHAPMSFFDTTPSGRILSRASSDQT

SEQ ID NO: 53761 - protein, 154 aa, Sorghum bicolor
  Clone ID: 13585932.pep
TRGSVSVQSWANASSNDAAKTSSTNIESDTFDVWQDFAKFGHLQEKMSSLGGEPSSVSPEPAKENDSLDLWLTSNFKESKSIDVVGRTNASSDGWQDFASFDQAQRSNEIPVEGHHVKDPSGAETMDLWASSHANEKNLEQISGNNDLFDDWQD

SEQ ID NO: 53762 - protein, 71 aa, Sorghum bicolor
  Clone ID: 13585940.pep
LKSHLYKLLLLFFTENKVSTLQKEIFFSRALCILRTTYFFFFCCVRSAGRCPLLCDAAGWTWLRRPHVCWL

SEQ ID NO: 53763 - protein, 142 aa, Sorghum bicolor
  Clone ID: 13585941.pep
TRETSIASSISYLDNGVVYVGSRFGDSQLVKLNLQADASGSFVEILERYVNLGPIVDFCVVDLDRQGQGQVVTCSGAFKDGSLRVVRNGIGINEQASVELQGIKGLWSLKSSFNDPYDMYLVVSFISETRFLAMNMEDELEE

SEQ ID NO: 53764 - protein, 163 aa, Sorghum bicolor
  Clone ID: 13585942.pep
HEDRNPISRTRDWGEITSRLSEDELKYQSARCMDCGVPFCQSDTGCPISNIIPKWNELVFQNQWQDALNRLLMTNNFPEFTGRVCPAPCEGACVLGINEDPVGIKSIECAIIDRGFEMGWMVPRPPKTRTGRTVAIIGSGPAGLAAADQLNHAGHSVTVYERA

SEQ ID NO: 53765 - protein, 106 aa, Sorghum bicolor
  Clone ID: 13585950.pep
ARGDLVPSLDKEGILGTLETIRRCTAVDHTAPTLMCTLGVANAIYKQCGVEFAAEYVIPLIFPLLTAHQLNVQQFAKYMLFVKDITSKIEEKRGVTVTDNGNTEVK

SEQ ID NO: 53766 - protein, 100 aa, Sorghum bicolor
  Clone ID: 13585961.pep
HEARLHQEGDKMDERSGGSPLRALILTPTRELAKQVCDHLKDAAKFLGIHVVPIVGGLSMEKQERLLKNKPEIVVGTPGRLWEHMSMNNQHLVELHSLAF

SEQ ID NO: 53767 - protein, 183 aa, Sorghum bicolor
  Clone ID: 13585969.pep
HEARRLMLLSLACCCSISPGGRIFAAADTDPNDLNVLNTLFTSLNSPGQLTGWQANGGDPCGQSWKGITCSGSGVTKIILPNLSLTGTLAYNMNNLGSLVELDMSQNNLGSGAQIPYNLPNMKLEKLNLAGNQFGGNLPYSISTMPNLKYLNLNHNQLQGNISDVFSSLYSLSELDLSFNSLS

SEQ ID NO: 53768 - protein, 121 aa, Sorghum bicolor
  Clone ID: 13586006.pep
VTSNSRMGYAFSRDGAVPFSHVWYKVNKQEVPLNVVWLSVSVAFAMALTSLGSQVAFQAMLSVATVGPYIAYGLPIVFRVTTARRSFVPGPFHLGRYGLAVGWVAVAWVATVTVLFSLPVA

SEQ ID NO: 53769 - protein, 110 aa, Sorghum bicolor
  Clone ID: 13586009.pep
AAMRPVNLGPEVIAAAAAEKPRRKNVRISSDPQTVAARLRRERVSERLRVLQKLVPGGSKMDTASMLDEAASYLKFLKSQVQALETLGTTNDTSTSNSTATASRSQQYNY

SEQ ID NO: 53770 - protein, 162 aa, Sorghum bicolor
  unsure (1)..(162): unsure at all Xaa locations
  Clone ID: 13586020.pep
TELAGRILNIHGISHGTDGWTYQWGSTFSCKQAYSAIQGIMTKQVQFTWLWKNSCRGKHKFFXFFWLLLESINTRNLLKRKHFTLPSYNCVVCQGNVEETVEHLFFGCPYRSXCWPLMNVKWPQNVXFWIVLALAKPXFGSLIFLELVIVAAWCIWNHEKPV

SEQ ID NO: 53771 - protein, 40 aa, Sorghum bicolor
  Clone ID: 13586036.pep
GFGPSPSLFDLEVPAIMPVVKELCGLDNVERYLQSLPSSE

SEQ ID NO: 53772 - protein, 108 aa, Sorghum bicolor
  Clone ID: 13586068.pep
KLYERRIGKNNLKMIAPLAMAAAAAAGASPRKAAPEVLSPSVLDFPSLALGSPVTPLLSDPFNRSPPSAGEEDEAAERAAIARKGFFLHPSPRAAAEPPRLLPLFPVT

SEQ ID NO: 53773 - protein, 108 aa, Sorghum bicolor
  Clone ID: 13586081.pep
YLSLTDVRAFCREEVADCFNSFGASHSCCMPYPEFLNFAGWCESHRQIFCCQILIIASNVNSGSTSWTNTVDGAFPGKRLMLEERFRGSVVHFFEAATNSFVLQKELS

SEQ ID NO: 53774 - protein, 119 aa, Sorghum bicolor
  Clone ID: 13586126.pep
ILNDLKNALGRYYFNNFADGTKQDAMDLLQGHYMTSVSRDMAVPTKAGLLDSYASFRLAFALVMGALMFMMMSLRQARNDVRHLLLSLLWAGLCIGITQFVKANGRTFTNRPRFHKSRH

SEQ ID NO: 53775 - protein, 68 aa, Sorghum bicolor
  Clone ID: 13586130.pep
STQLDMTLEMMSDAIDETLDKDEAEEETEELTNQVLDEIGVDVASQLSSAPKGRIGATNKKVDNSHAR

SEQ ID NO: 53776 - protein, 103 aa, Sorghum bicolor
  Clone ID: 13586133.pep
FPNEPVPMMLAQMIGIIGPIDMEMLELGQETQKYFTDDYDLFTKNEETDQLEYLIPEKSSLRRHLQCPDSEFVDFLSYLLQINPRKRPTADEALQHPWLSFAY

SEQ ID NO: 53777 - protein, 138 aa, Sorghum bicolor
  Clone ID: 13586141.pep
NRTHLKYNWSMCSDILNYSNTDGNINILPTLQRIVEHKIPLWVFSGDQDSVVPLLGSRTLVRELAHNMGLQVTVPYSTWFRRGQVGGWVTQYGNFLTFATVRGASHMVPFAQPDRALRLFQSIVLGQRLPNTTSPPIE

SEQ ID NO: 53778 - protein, 214 aa, Sorghum bicolor
  Clone ID: 13586166.pep
LGSMIVVTSRSQKVASIMGTLPHHELACLSDGDSWELFSKKAFSKGVQKQEELITIGKLIVSKCKGLPLALKTMGGLMSSKHQIKEWEAIAEDDRVGKDEVLSILKLSYMHLSSEMKQCFAFCAVFPKDYEMDKDKLIQLWMANNFIHADGTTDFVQKGEFIFSELVWRSFIQDVDVKIFDEYHFAAPAHKKIGCKMHDLMHDLAQETTDECVV

SEQ ID NO: 53779 - protein, 154 aa, Sorghum bicolor
  Clone ID: 13586168.pep
SRLPHMLVRGLPASSEGMFSTLDLVSGDKLEFVLIIAPVKESYEIARATLKIADELKLSAKVCVMWPRGSTGAEVEESRSELAPWTNYIDVEEVPRVSGSSWWEMCRISRKNVLLVRPDEHIAWRTESDRVRDAESEIRRVFSHVLCLNRCKNL

SEQ ID NO: 53780 - protein, 82 aa, Sorghum bicolor
  Clone ID: 13586169.pep
RSRRMDWLVSTTTWVTRSPISLRVLKRIYKCQQVTVENLVFRLCYGIDNVTVGISNASKDMFVHLAPGEYLYNGSSAFWAGN

SEQ ID NO: 53781 - protein, 177 aa, Sorghum bicolor
  Clone ID: 13586171.pep
SSDVTHVIANTDERGACARTLKVLMAILAGKWVLNVNWLKDCIEARKPIPEEPYEISCDVHGSVNGPRSGRLRAMQQAPNLFAGLTFYFSGHFMPGYKANLEDLIAAGGGSILEKTQLSCASLILYSMEPPQGNSPNTLETINKRIAEAQELAATVGCKAIPHTWLLDSIASCNLSV

SEQ ID NO: 53782 - protein, 140 aa, Sorghum bicolor
  Clone ID: 13586173.pep
MTTNHAEKLDPALLRPGRVDMTVTFGYTSKADIEELFSAIYSTLEGDCGSKKQRQQQYQKRKEELADGNGAAVVAHEKKKAEVDAHRVARLAAEFSARVPGGEFTAAEIQGYLLNYKHAPADAIEGAGKWAEGVLKKRKA

SEQ ID NO: 53783 - protein, 108 aa, Sorghum bicolor
  Clone ID: 13586175.pep
RDFIHVMDLAQGHVAALAAAKANPARDSFRAYNLGTGRGMTVAEVISSFEKASNQTVPAVLAPRRAGDVGACVAATQRAETELGWSTAKGVDECARDTWNALNMPAEC

SEQ ID NO: 53784 - protein, 80 aa, Sorghum bicolor
  Clone ID: 13586180.pep
VTYPVINRILSWHLGSTYPQQALTKLKISCELIPSKAQSKQEFMEQIVSWPNLSRILSGEALLPKPSFISSMYPTLPTVH

SEQ ID NO: 53785 - protein, 141 aa, Sorghum bicolor
  Clone ID: 13586185.pep
KYCEGYTMVGPTYRLGGFGFAFPIGSPMVHDVSQAFMTPAVQEEMARIERKWFGNPGACGSSSDGINSSRLGFSNFSGLFLISGLTSGLALLISLSILVYQKRDELSAEASRTRSMSLQRLHMWLERLRTWYQAQGVTHHQ

SEQ ID NO: 53786 - protein, 109 aa, Sorghum bicolor
  Clone ID: 13586220.pep
TLVQFEERVVVGNVIEEVVSIGKSREYGLVVVGKGRLPSPMVAQLAVRPAEHPELGPIGDALASSGHGVTSSVLVVQQHDMSNADEVPVSVVVDGRAQDGEFAKDMAEP

SEQ ID NO: 53787 - protein, 119 aa, Sorghum bicolor
  Clone ID: 13586221.pep
AKKAAAKETGARGLRSIMEDILTEAMFEIPDAIERKEKVIAVLVHEESVGPLHHRGYGAKLFRDDGALELYVYHNNIKVPGLIQSNPRRRRIFRLCLLVALSADKALDLPNITCFSSHI

SEQ ID NO: 53788 - protein, 80 aa, Sorghum bicolor
  Clone ID: 13586247.pep
QWLQRRKDTTEVIRYMKIQLQRRRVTTNLQHRDWLVHLLDTKLLSMDKQLATPQHLLYLTLPLSYSPIRRCPTVSQLAII

SEQ ID NO: 53789 - protein, 165 aa, Sorghum bicolor
  Clone ID: 13586288.pep
MWTPRPSRRIVSPAPATLLLRLLLLAGAANAAPPLVGVSPQDEAYFATQVIACRDGSGSFPRSRLNDGYCDCADGTDEPGTSACPEGKFYCRNIGDTPRLLFSSFVNDKICDCCDGSDEYESGIHCQNTCRNIKYIAEAADGGSDLSVTHLDANTNEFMGKHAIA

SEQ ID NO: 53790 - protein, 115 aa, Sorghum bicolor
  Clone ID: 13586299.pep
MEVAAAKQLLPMARGVPNSPSSSTSSSSPSSAACASPSPRQQSQAPVPPSPKPVPRIIDTTPFPTTFVQADTANFKQVVQRLTGSDTPPTPAAAQQKPAKSSHGHYHHHHHHHHG

SEQ ID NO: 53791 - protein, 141 aa, Sorghum bicolor
  Clone ID: 13586309.pep
MAFAVHSATAFPAPQKSASSSMPSSRMTVLSTSKHTASAFRNVSIAPSEGRVLARTAEGPSLETSSAAASRLRLLQSLAQRNSGLVKRTATCGGRADDSRGSAGELLGPVRKLIMPAIPCAPAPGDSKAKGGTNARRRCLV

SEQ ID NO: 53792 - protein, 191 aa, Sorghum bicolor
  Clone ID: 13586311.pep
TRVARVDDNAAGQVSVDDDDDDDEDLAHITSENVRAAIRKSKEVLARHKVIMKQIAEKKKLLSTILDSSIHNEQEPLSGQSDGSLSNLNANAEVTEIGYGSSQQSEFDTTYGESIYNQNEYYESSKHDGTDFSENYQYNSFPRAARSVYELEADNGMKQDYGVQLSQVSEHEQSVNEGTNDDASGGVDVMN

SEQ ID NO: 53793 - protein, 167 aa, Sorghum bicolor
  Clone ID: 13586321.pep
IRYQNQIEPGPGGGELEDHRIQTGVGPHRRRTPRKNLSSLGSPSPLCIRSCSQKSERACRNCDKNPALCLCRMLTSPLGKKRTSRKERQKRGGYKSRANAAPAPPSGGKYPKKFNSVGGWGGCRKQRGMSNQFPRTMNLDAVAINNSSAQEQCALLLLLLCCVSASC

SEQ ID NO: 53794 - protein, 191 aa, Sorghum bicolor
  unsure (1)..(191): unsure at all Xaa locations
  Clone ID: 13586322.pep
HEASLRSRLVERFGKKSCLNVTIDEGTEELALGKVAAGHGKQSMYVGHQLQEAEQNIMTTTPEGTMELENDGAEKTGGLSNSSSGPSMGNCDPEDNISSLKELCMPLAMDTLIFPSSAPLNAARQIKRALPXICKDPSDYKNDYLTSDAASEVTESVQDMMHDLVGENMKILPTTQKDNNMVHSVIDPFWP

SEQ ID NO: 53795 - protein, 106 aa, Sorghum bicolor
  Clone ID: 13586344.pep
HEADLTLPLPQRDMISLAVPLPLPLPPSSAPSSTSSSGSLAAPSSLGAPTPPTSAGSAPANPPPLCELERVRRIGSGAGGTVWMVRHRPTGRAYALKVLYGNHDDA

SEQ ID NO: 53796 - protein, 89 aa, Sorghum bicolor
  Clone ID: 13586352.pep
MSPNKPSHASGRDAVFWSQGMNAYLIDRLLYHQDNGNRGESKFSSVAYDSIINGVGDKFGVTIDRNNIKNRLKYIKESFHECRNLLGED

SEQ ID NO: 53797 - protein, 72 aa, Sorghum bicolor
  Clone ID: 13586356.pep
MNIFKKKVDPKEALRTSKREMAVATRGVEREIGSLQMEEKKLVAEIKKTAKTGNEAATKILARQLVRLRQQI

SEQ ID NO: 53798 - protein, 160 aa, Sorghum bicolor
  Clone ID: 13586359.pep
TRLLSLRFQVHPNGDATAYITAPRPCATRLSERQRPRPRAPTNHAPSRRRMAAQGLDQVMAFLTDHGFAGTASALRDDVLARTAAGDESHAAALDPHLPPLRMPASAVGAGAGAGTPAPASPDSSSGSASSSAFVSMRSTPSGLLNPYGLWSPRHSQSDA

SEQ ID NO: 53799 - protein, 186 aa, Sorghum bicolor
  Clone ID: 13586361.pep
ARGNYAHLNKGDVATETKTDSEGSFFAGPLYDDIVYKVEASKDGYHLKQTGPYTFSCQKLGQISVRIYGENSELLPSVLLSLSGEEGYRNNSISSSGGTFTFDNLFPGSFYLRPLLKEYKFNPSAVAIDLNSGESREAEFRATRVAYSAMGSVTLLTGHPKEGVFVEARSESTGFYEEATTDAFGR

SEQ ID NO: 53800 - protein, 134 aa, Sorghum bicolor
  Clone ID: 13586367.pep
MAAVSWRAVVLAVAAVGWLLVGGGSGGAWAFPAEDLVTRLPGQPPITFRQFAGYVDVDFKAGRSLFYYFAEAQQDAAAKPLTLWLNGGPGCSSIGGGAFTELGPFYPRGDGRGLRLNKRSWNKASNLLFVESPA

SEQ ID NO: 53801 - protein, 106 aa, Sorghum bicolor
  Clone ID: 13586377.pep
MAAPLSSWPWTSLGDYKYALLGPLAWKVVQEWREQGQGALPLVLGSWWLHLLLLFVVRGLTYQFWFTYGNMLFFTRRRRVVADSVDFRQIDAEWDWDNFLVLQTLI

SEQ ID NO: 53802 - protein, 140 aa, Sorghum bicolor
  unsure (1)..(140): unsure at all Xaa locations
  Clone ID: 13586383.pep
RRRTLVVSTAAAAADLFRNHDLAFSSRPHNALAHKQTYGSRYISFTPYGDHWRRAKKVAVVHLLSQRRVDAFAPVRQAXAAALVARTRRAAEAGEAVQLKELLYGYTNSVVTRAAAGTAGTTAERLRQLLAHTATLVAGF

SEQ ID NO: 53803 - protein, 126 aa, Sorghum bicolor
  Clone ID: 13586394.pep
MPSITGGGRGGLFSVHQGALWWLRRCHSPLFSSLAGGGGRGDAPHLPVLIVGAGPVGLVLSFLLTKFGIKCTVIEKNVEFTRHPRAHFINNRTMEIFRKLDGLAGDIERSQPPVDLWRKFVYCTSL

SEQ ID NO: 53804 - protein, 115 aa, Sorghum bicolor
  Clone ID: 13586397.pep
HEARPAPLCRALPPQAAQHRVLRRPRCRRHWRGSPYTARPPARRNQPGVNMLHHSNSRNQRNRGSRIKTLLRATLLLGVIFWLLYQVKHSFDKKNEYLDDAEDQLAHNDRSVFHG

SEQ ID NO: 53805 - protein, 175 aa, Sorghum bicolor
  Clone ID: 13586398.pep
MAEFLNDNTNGSGPGPSFDTQLLETFIPGYGLASRILATYFHLDLSSYIPALIASGIVLAVTKYLYHWLYSLFTDHFISTAEIRLDDEIYTYLMFWMARQSFTTRTTNFIAGTKLSGRNWYYSDDESDSEAEDEEEDGESFDDYWSRTINRDKYKKLRFTPSQGTHYFRFNGQYI

SEQ ID NO: 53806 - protein, 142 aa, Sorghum bicolor
  Clone ID: 13586400.pep
MPHSIRSVASTASLSDESSAPTSPSSSQLIDDSYVLANDVLPADDGKHYVMVLGGLGYIGSHTTLELLKDGYNVIVVDDLSNCFEEVLNPIRILAEDYCREQGLIMPTLRFHKMDYRSAEMRELFPRYAAARSAITGVIHAA

SEQ ID NO: 53807 - protein, 117 aa, Sorghum bicolor
  Clone ID: 13586402.pep
MGRGRNRKPRNFATFRLCPRPGVADASDRVFVRVDDNPYSVPGFADDEGHSSSTAVGADGGEPAASSSASVDDDGAPLPEHVRREILELGLPDDGYDYLTHLRELRPSLSSTGGGGS

SEQ ID NO: 53808 - protein, 156 aa, Sorghum bicolor
  unsure (1)..(156): unsure at all Xaa locations
  Clone ID: 13586404.pep
GVGILVGFTREGAHPGGPHRRIHCELPGPADHRTGRAQAKSKPTXGARLWLRWAMKPPQAMLCRKGSAEGEGDWPVRTTADRGGLRTMVWARTTTSSEGXSPSWCSIGGGDTVGRKRMRQRRSDEWKMGNGEIDGVGRGGNCVSGRWIVSVIVGLV

SEQ ID NO: 53809 - protein, 168 aa, Sorghum bicolor
  Clone ID: 13586407.pep
TRPFAASHLRAAVSSLAASLTAIPGPDPDPVPALHEHSFPTLLAVSPLASLELLSLLRSRPRLGLAVFSFRRALSPVPSLGEFALAISLASRARDHDAAAALFADGTATHSPNQGLYNALMAAYMHNGLLDSCIETFHALERDPRCGPPNVDSYNILIALYGRSLLVD

SEQ ID NO: 53810 - protein, 35 aa, Sorghum bicolor
  Clone ID: 13586410.pep
HEGAVQAMHEVVLSNKAKYSSNENAQQSGSATVEA

SEQ ID NO: 53811 - protein, 144 aa, Sorghum bicolor
  Clone ID: 13586424.pep
TRPLYPASLFQNETDGEGMSFVLYFRLSDGYSKELPPSFIESIRRLVDDHVEKIKSFPMETTIPFRERLKILGRVANLEDLPLSAAERKLMHAYNEKPVLSRPQHEFYLGDNYFEIDIDMHRFSYISRKGFETFLDRLKACVLD

SEQ ID NO: 53812 - protein, 115 aa, Sorghum bicolor
  Clone ID: 13586426.pep
MPEQSRSGAPMEWTTVQHLDLRHSGGRRGASARPMQPHAAAFRSSQAIVAVAMGTHVVEFDALTGSKIASIDLGARVVRMAYSPTTSHVVIAILEDATIRSCDFATEQTLVLHSP

SEQ ID NO: 53813 - protein, 125 aa, Sorghum bicolor
  Clone ID: 13586428.pep
VLLQRAAVLTLLHIHDGPASGSLAESNQINQALTRGSSLTGATGNGVLGEAILDQSDEHVSSALNHRKGNLVLEHDGRNGSVVSYRGVVSEEDRDSNPGHARKDSAESIGSDLSSLRGSELSVPG

SEQ ID NO: 53814 - protein, 131 aa, Sorghum bicolor
  Clone ID: 13586439.pep
MELRVLACIHGGQDVPAVINLIETIRGHTQPRRLVKLYILRMVELTERTSSILMARAARRNGLPFLRPRRAGEPHDQVDVAFDTYAQLGHVHVRAMTAVSALHTMHDDVAAVAEDKRVSLVVLPFHKRQTG

SEQ ID NO: 53815 - protein, 151 aa, Sorghum bicolor
  Clone ID: 13586441.pep
TRIWYKILSFNDIDTEIPNDKTRFPEVYVKAMLGNQVLRTRVLASRTLNPMWNEDLMFVAAEPFEEHLILSVEDRVAPGKDEVIGRTIISLQHVPRRLDHRLLTSQWYPLEKHVIIDGEQKKETKFSSRIHLRICLEGGYHVLDESTHYSS

SEQ ID NO: 53816 - protein, 150 aa, Sorghum bicolor
  Clone ID: 13586445.pep
MESTSGEDAPKRNPLPAALVSNLQSVLAARRPPGAEVSTEASAPEAEASDVPAGDGAPARPIVLLTCAGGIRSAGLAALVDALVASGRCDVHVCAPESDKPACGHSITIRETITATSVDFTGAKAFEISGTPVDCVSLALSGRLFPWSSP

SEQ ID NO: 53817 - protein, 146 aa, Sorghum bicolor
  Clone ID: 13586463.pep
ARRLPLRLHRRGPLHFLRLFPRVFHLRAPLPLSLSLTPAAAGLLAVASSPADAARTLHRLLAMSVSRSLPLRAVFRVWRELALPDDFEDSVVEGHPHLFRLAPNPDEPNTHILHLVADPATEEFTPAVEKTRPDRYAFKLQFPPGF

SEQ ID NO: 53818 - protein, 138 aa, Sorghum bicolor
  Clone ID: 13586470.pep
MAGVPPPPRQLEVRRFAAARAGELRSLYAAVSSRLDDAGGRQQPRSARRRTTGHLPNKRRRRGPGEVGTEDDGGLPPRKQSRRVRRRRELAGNPAEGFSVAGDGARRLRTHLWYAKRFSMERRWGFILPVGTQGSGRG

SEQ ID NO: 53819 - protein, 135 aa, Sorghum bicolor
  Clone ID: 13586482.pep
ARGRSALNTAHVGMYLVSVRFGTPALPYNLVLDTANDLTWINCRLRRRKGKHYGRQSSKTMSVGGDDDVVAALAKKEARKNWYRPAKSSSWRRIRCSEQQCAHLPYNTCQSPSKLESCSYYQKTQDGTVTIGIYG

SEQ ID NO: 53820 - protein, 184 aa, Sorghum bicolor
  Clone ID: 13586498.pep
TRVRLWDVERKSCIGIGKGHLGAVGSVAFSKKTKNFFVSGSSDRTIKVWTWDDALGDAEDEVSLKAKAVVAAHDKDINSLAISPNDGLVCSGSEDRTACIWKLPNLVSSIVLKGHKRGIWSVEFSPIEQCVMTSSGDRTIKIWSVADGSCLKTFEGHTSSVLRASFLSRGTQIVSCGSDGLVKL

SEQ ID NO: 53821 - protein, 100 aa, Sorghum bicolor
  Clone ID: 13586511.pep
GLILPPSLRAPLVLASQSPHPRPATAMASPHPLSWADAPPFYYHGTTPQPAPDSSSDGAGPRSLWIGGLLHWMDEDYLYACFTTSPELLSDVIRRSKQTG

SEQ ID NO: 53822 - protein, 162 aa, Sorghum bicolor
  Clone ID: 13586515.pep
HEGTKVRSEETKAKLSHRILLIENIYIIMVQLLVLPSSSLILLLVLLMMAPSSSCAQEQEQEQQQLKQQMQEHQQQHTMLQGWIKEQVAKDAAAGCTCGKKDAALSAAEANRVVLHVEPADDSSTSDPAIYLNSIGEAIAKIPDGNTKRYIISIQPGAVYRE

SEQ ID NO: 53823 - protein, 114 aa, Sorghum bicolor
  unsure (1)..(114): unsure at all Xaa locations
  Clone ID: 13586516.pep
LHYSQSLHLLAKAVALPNSSCPESCGDVKIVYPFGIGALCAMEGFDLECNKTEDGSANVTFFGSMPLLNISLLHGEIXVKHHISSMCYNLSSRSISYREGGMKLDTXPFTFSEL

SEQ ID NO: 53824 - protein, 85 aa, Sorghum bicolor
  Clone ID: 13586529.pep
HEGHPRLEDLHTSFNCIFLLSCITLQAFQFIILHSSYSTQDKNKLQILLFLGLLSLIHRLRLTYISLGHNLILLSDAHVYQAYIY

SEQ ID NO: 53825 - protein, 120 aa, Sorghum bicolor
  Clone ID: 13586530.pep
HEGKPSFRNKKMHYTPQRTQRSTFKRRKLFDRHSVLASEFGAANGKGSTQVTGRDSHAEANNGTNSMPFQKSCVSNDCHVKLTIKSFKVPELLGEIPQSATVGSLKRTDLEAVTAILGGG

SEQ ID NO: 53826 - protein, 174 aa, Sorghum bicolor
  Clone ID: 13586544.pep
TRAQSVFEAGLKRFMHEPGYILEYADFLCRLNDDRNVRALFERALSLLPPEESTEVWRRFAQFEQIYGDLSSMLKVEQRRKEALSRTSEDVLSASENTLHDIVSRYSYMDLWPCSSKELDYLARQEWLSKNIFKKVDKSAMLNSSSMLDKGAAGFSASARLLPQSAKVVRPETS

SEQ ID NO: 53827 - protein, 124 aa, Sorghum bicolor
  Clone ID: 13586559.pep
IEDDDAVFEEKMKGVSLLEADGFDVEHLRSRLETLLRIKKARAKLQGTIKDMEQKFSHEETERRTQMGVLNMTVRQLELQACLFRCMMHSAISQELSDASEISRLKAEVSKLEHRFSSTTASPW

SEQ ID NO: 53828 - protein, 83 aa, Sorghum bicolor
  unsure (1)..(83): unsure at all Xaa locations
  Clone ID: 13586575.pep
KYKDQDNRVEMAIKVALWCIQEDFYQRPSMSKVVQMLEGVCDVPQPPISXHIGYRLYTNAFKSSSEEGTSSGMSDYNSDALPS

SEQ ID NO: 53829 - protein, 105 aa, Sorghum bicolor
  Clone ID: 13586588.pep
RFIYIYTLASFMRPCASYISRTIHSPHHLHLSELLTQENRAPVTMGVRYAGVVTVSSELAMAECHCRCLILAAVADAGSQLDADQASWIASQQEICRIQRRLGSA

SEQ ID NO: 53830 - protein, 133 aa, Sorghum bicolor
  Clone ID: 13586608.pep
QKIDIWSLGCILAELYTGEVLFPNESVPIILARMIGTIGPIDMEMLVSGRETQKYFTDDYDLFHKNEETDQLEYLIPEKSSLRRHLQCPDKKFVDFLSYLLQINPRKRPTASEALQHRWLSFKYSSTANQTRS

SEQ ID NO: 53831 - protein, 160 aa, Sorghum bicolor
  unsure (1)..(160): unsure at all Xaa locations
  Clone ID: 13586621.pep
MLMSALREEDDKVITDSDGVLALYQASYLAFPGPGETVLDQARALAIGKRAAGRRDDDDDSDCTRLPLPLPLHWTAPRLQAMWSLKGKGDDHNHNKKVAVVDPAILQLAQVDFNLVQALHRRELAEVTRWWKESGLXVGDYSFARDRVVECLFCAACIAP

SEQ ID NO: 53832 - protein, 65 aa, Sorghum bicolor
  Clone ID: 13586638.pep
GNNIDSGSGVYMRTHIVHGKPLFFDKEHGKPQVIDMVTLILLSGTMLLCCLKSQMNPSLCSGTCT

SEQ ID NO: 53833 - protein, 55 aa, Sorghum bicolor
  Clone ID: 13586660.pep
PQGATGAKSLLSWNCQGVGGSLVSPKMSPLARLINSRNAQLKVFLVVYGFYLGIK

SEQ ID NO: 53834 - protein, 50 aa, Sorghum bicolor
  Clone ID: 13586663.pep
AADVPSNAKETPQNTQPVKVTDDQYKRGDDALAAARARALARKKAKEQQL

SEQ ID NO: 53835 - protein, 101 aa, Sorghum bicolor
  Clone ID: 13586708.pep
TYEPVTQGSQEQQSLGMEDHQQVDDIPWDDALISVGLINLLDEPMTEEAVIGGSQDQESLAPEVLQVGDNAWGDYLRSAGMVNLLDEPIAQEAAIWQCSDG

SEQ ID NO: 53836 - protein, 95 aa, Sorghum bicolor
  Clone ID: 13586731.pep
LLSPVALLHVAAFALGYWLSRLSTFGESTSRTIAIECGMQSSALGFLLAQKHFTNPLVAVPSAVSVVCMALGGSALAVYWRNKGLPTDDKDDFKE

SEQ ID NO: 53837 - protein, 42 aa, Sorghum bicolor
  Clone ID: 13586763.pep
LGMFPSIGYTLVEENGALKLGWKDLCLLTASAWRPIHMPPCR

SEQ ID NO: 53838 - protein, 129 aa, Sorghum bicolor
  unsure (1)..(129): unsure at all Xaa locations
  Clone ID: 13586766.pep
TVXSDVYSFGVVMLELLTGRKPLDSSRERSEQSLVRWATPQLHDIDALARMVDPALNGMYPAKSLSRFADIIALCVQPEPEFRPPMSEVVQQLVRLMQRASIVRRQSGEELGFSYRAPEREGDLRDLSF

SEQ ID NO: 53839 - protein, 65 aa, Sorghum bicolor
  Clone ID: 13586771.pep
SLGGGHYTAYVYHEGKKGWYDFDDRHVGPITEDSIKTSAAYVLFYRRIQEDSLDTGTHIDSDIPT

SEQ ID NO: 53840 - protein, 92 aa, Sorghum bicolor
  Clone ID: 13586773.pep
TEYLTEENGYPLDVDRLTEVTEGPFKGHLCAEPSIDRLRDLMRHVVDDRDEARNKGKKAREDMIERFSPEVVARIVAEKIQQVLTHTQLTND

SEQ ID NO: 53841 - protein, 100 aa, Sorghum bicolor
  Clone ID: 13586774.pep
EVDHVDFLKPVDVGDSLRFKSCVLYTQLDNPEQPLVNVEVVAHVTRPELRKSEVSNTFHFTFTVCSDMLKNGLKIRNVVPSTEEEARRILERMEAEGLCN

SEQ ID NO: 53842 - protein, 63 aa, Sorghum bicolor
  Clone ID: 13586780.pep
YKAGIHLLLQSAVISVLNSIIKRRRSASILIITFTICSHLYSNFFESKLAKGIFPKARFIKLI

SEQ ID NO: 53843 - protein, 165 aa, Sorghum bicolor
  Clone ID: 13586781.pep
HEGLLEKPVSKGLQSTSQKRRASVVLAMASCNDSVDIASLAPCIDNDSISYESGSHLMEKVNKDVVSEPFWPDLVSNENDPNKHKASTCPEKVVKQQGTLLSFKPHLPTKRKKSSYPEKVVKQQGTVLSFESHLTLPSRPSVTGFGNLNYGPKLYLSDQLERSSS

SEQ ID NO: 53844 - protein, 78 aa, Sorghum bicolor
  Clone ID: 13586797.pep
ARGLHHAITTAPPPLLCSPSLRPVAPNHFIGGHRPPSPRCFQALSLSGTQLNCQMLVKEVEKPVRSFIRNCFHSRWRE

SEQ ID NO: 53845 - protein, 142 aa, Sorghum bicolor
  Clone ID: 13586814.pep
MASGEQGKGETVLVTGASGFIGSTLVRGLLGRGYNVRAGVLNPDDRAETDHLLDLAAGAGDGRLSFFRCDLLDGAALLDAARGCSGIFHLASPCTVDPVKDPQNQLMVPAVEGTRNVVRAAKDAGGVRRVVVTSSISAMVPS

SEQ ID NO: 53846 - protein, 154 aa, Sorghum bicolor
  Clone ID: 13586815.pep
METSTSKLVDHDADNNESNNLLERISQLQDSISTVESQLSMASLRRDCLGRDSVGRLYWVTGRPSKRPRLVADGSMLIPKDRDISMVTSHSQSTFDKGWNSASLVMYESDEEIKSLVDWLRDIDPREKDLKDSILHWQKSLYHQASPITDPPVS

SEQ ID NO: 53847 - protein, 174 aa, Sorghum bicolor
  unsure (1)..(174): unsure at all Xaa locations
  Clone ID: 13586816.pep
HEGDEYYDQDEYEEEGSGAGDEYVEEEEPTEGQKEILELRERLKEQIRRKAKAAAACTAGRSSSSQIPQARDKFGSFFGPSKPVISRRVIEERKSLKELHSTIAREPRPSGVHKDIPSSSNKVQSKGNGHQHKQKIVNQQLQFXVKRKVEALKDNRDYSFLLSDDADLSSPSPK

SEQ ID NO: 53848 - protein, 121 aa, Sorghum bicolor
  Clone ID: 13586832.pep
GAWAGDRAAAAAAAAARGAQPQRRKLGVIESRRRHGWVRADVPRAPGSSSRSLSLHRLRLLSFEAKRGRSSQSGWPAQARSGSYNDAGTLTTHRGEAAARDPTAAAPGGRRTTTLLECASV

SEQ ID NO: 53849 - protein, 131 aa, Sorghum bicolor
  Clone ID: 13586842.pep
GGYNMHNLVDHFHQRGLYRSIFLSIMEGEESLSRYSPEIVAKTSSAETIALLPLIVLMHGTEDYSIPSSARLVHILFIDVCLGEGQKSSKPRVLVDMISLCLSCCSVEMKLYDGPNTLALEFDKSNFPTDA

SEQ ID NO: 53850 - protein, 48 aa, Sorghum bicolor
  Clone ID: 13586846.pep
LPTLHYAAAGFRNSSVTAERCRRPEPASPNQFLNQSDTAICEAGQVLT

SEQ ID NO: 53851 - protein, 136 aa, Sorghum bicolor
  Clone ID: 13586848.pep
MAAAPAGAPAITASSSFLASPPFALKASTTSHRRPAGRVSVNIRCVSSPPAVDTSYKTNVPRNANMAKLQAGYLFPEIARRRAAHLLKYPDAKIISLGIGDTTEPIPNVITNAMAERALALSTIDGYSGYGAEQGE

SEQ ID NO: 53852 - protein, 71 aa, Sorghum bicolor
  Clone ID: 13586856.pep
LKFLMYHRLPQDAIPPEKKGDIFLSFIRQGPDQTKQATVEERTHHREDEHKATNIEPRLPSPESESMFNPA

SEQ ID NO: 53853 - protein, 76 aa, Sorghum bicolor
  Clone ID: 13586858.pep
ARGLLTVSSRPVAMVSSVFSLLVLAHEHCSHLGLFHCSVKYSSKLLRSYMFARCHCLFCWVEIGGCVVLGVYFCTS

SEQ ID NO: 53854 - protein, 174 aa, Sorghum bicolor
  Clone ID: 13586865.pep
TRAAFAPAPAPALAAGEMGYTHCGCDGGGGAGGFWSLDNIFKWQKVSDLLIAAAYFSIPLEILYFVAGLRHLLPFRWVLVQFGAFIVLCGLTHLLAAFTYEPHPFMVVLLLTAAKFLTALVSFLTAITLLTLIPQLLRVKVRESLLWIKARELDREVVLMKRQEEASWHVRMLT

SEQ ID NO: 53855 - protein, 94 aa, Sorghum bicolor
  Clone ID: 13586877.pep
MTVVKVEEVAKADENPALVGGLDDEAETGYVSPDDDEDDETDSDGDYEIPSGGDGVPELRKGPWTPDEDKRLKTYVEAHGEGNWNKVQRNAGLN

SEQ ID NO: 53856 - protein, 148 aa, Sorghum bicolor
  Clone ID: 13586879.pep
ARGGAVADSPAITPSNSERYTLDSSVMDSETRSGSFRHEPAAADDLAAAAAGLQRPCRSFGETTFRTISGASVSANASSARTGNLTVSLLAGDVQEPAAAFESTGSFAAVPLQPVPRGSGPLNTFLSGPLERGFAYGPLDKGSGFMSG

SEQ ID NO: 53857 - protein, 66 aa, Sorghum bicolor
  Clone ID: 13586884.pep
LIQNESASSRSSEGPVRSRSLLSRCAQATEKSVDALYSRSMIHLQGNYCSPVSLFLAASVRLFCPT

SEQ ID NO: 53858 - protein, 133 aa, Sorghum bicolor
  Clone ID: 13586905.pep
SFPPRQAVSPPIFVLCRDWLAMTESLPADEVCKSLKDVMQLLRDSFEHQDEQNKPRSESQECGMLENNSEPEAAKSGSGSVASAEGLQSRLTAVLDRLTKFSEASLKCYEELKQNYEMACDDYKRVGPNAPHA

SEQ ID NO: 53859 - protein, 72 aa, Sorghum bicolor
  Clone ID: 13586919.pep
RVVSSESKTDPQKKTIKKKELRHNQRISWWRALHVPTLIQGAKLRLKLEEEKKKIYTLIRGNSAMYRSVKAR

SEQ ID NO: 53860 - protein, 152 aa, Sorghum bicolor
  unsure (1)..(152): unsure at all Xaa locations
  Clone ID: 13586935.pep
ISMVYIAAFLSTEPKMGVVDGYEPPEAKAGASRGAIAMIYISGVGWALGWNSMQYLLTAELFPLRIRALATSMAMTLHFVNQYGNSRAVPNMLLPTPDGITPLGTFWFFAAVTIVGGIWVLFTVPETAGRSLESMDRLFXLPWYKIGLYGNR

SEQ ID NO: 53861 - protein, 65 aa, Sorghum bicolor
  Clone ID: 13586947.pep
METPNRWNVLESDAAASSVPGNEWRRAVPCTDASYSAIPNAGNAGPSVTKLQPDVDVDDWEEACE

SEQ ID NO: 53862 - protein, 92 aa, Sorghum bicolor
  Clone ID: 13586957.pep
NRSAARAPKQQPIQRPQPASNRSLPPPAQKPSRRRDCVVCKKEEACVILLQCAHQVLCVGCNKLHEDKGISRCPCCSAEVEERIRVFGASSN

SEQ ID NO: 53863 - protein, 85 aa, Sorghum bicolor
  Clone ID: 13586958.pep
GTFQQLTEGWIYGLGCSVSTVLNLLEAAEGGCSPVLQKGRCRHRWCRLLRAGALGGGSRTPQQLKGQRDAEGKGAVPQGRVGRSG

SEQ ID NO: 53864 - protein, 92 aa, Sorghum bicolor
  Clone ID: 13586963.pep
SMRAYATAIVAAEYILRWLPRGTHEWSKLVTPEELVLMLQRASVSVEEMAGFVYNPLSGEWSLSDDIGVNYIAFGVKKSEASSTNGREAGLS

SEQ ID NO: 53865 - protein, 68 aa, Sorghum bicolor
  Clone ID: 13586968.pep
TNSADHEACNPKGSKPVAKVRSSITGMNEIKEKLASVIQGGSRITETTFVCINVFAMATLLDLVTTNQ

SEQ ID NO: 53866 - protein, 93 aa, Sorghum bicolor
  Clone ID: 13586973.pep
FMTATTANHAKSNRYLTKLSTRPIYKSSPQAGLILLTELHLYVEKRSAPHAQSGKGLQAAVHSPCFHFQLKHRLVSYTKRNPLNGHSLVISRA

SEQ ID NO: 53867 - protein, 174 aa, Sorghum bicolor
  unsure (1)..(174): unsure at all Xaa locations
  Clone ID: 13784249.pep
MSRVGSPCMSASEARSVGSRRSTLGHGTEDTRLRSNDVVGSNFSGCGISYCWSGASKYRELYSDSDGPDQPLLSTDGTEAAFQGNVPYTETPRCLSQKFRPRSFSELIGLNVVAQSLLYSSCKGKVAPMYLFHGPRGTGKTSTARIFAAALNCVSLEEXRPCGFCKECVILFSG

SEQ ID NO: 53868 - protein, 157 aa, Sorghum bicolor
  Clone ID: 13784250.pep
PEASSRADGGARSRSRAEGPGDGGHGAGGGRRHAAEPRSRRQSRDADRWWCSEARGTDGEGEGEGLRVDEWRETSTQPRRCVVVEGNREAEWGRRKSMGAPGEPHVRRGPGGLVPGALVDQVAVAPSSQLRRRRATLLACNCKGFDLLRSHGLLLFP

SEQ ID NO: 53869 - protein, 153 aa, Sorghum bicolor
  Clone ID: 13784279.pep
NYLSVMLNESSTSGGDVLIYIALAVVGIDWQPCHRACIASVCRPSGAGAGAARSASGIPRRGRQFLICSLPLRGDRPAPWILGGCIVRLVAMVVRSLACFIEAIGPVPVAVTLLLWFVPRCWWRWHAWALPKQEGHVGTCVEHAHRSRFSTLL

SEQ ID NO: 53870 - protein, 124 aa, Sorghum bicolor
  Clone ID: 13784281.pep
YTLDNSIVTRLSAGFSEIEELRFGLSQLSTETVYAALRCPKLKVLHILHRNPVKAGTKLMLQDSILKLLNEGLASTLRYIIFDDDPVYEILMKPYRRVQARSLVGYVANTILLGEKMFSWMGNA

SEQ ID NO: 53871 - protein, 131 aa, Sorghum bicolor
  Clone ID: 13784289.pep
CFYYLISTPTVGRRCFCSSMSRTKKSSFASPCRLGEIETLFNLAANFSTVHTQEKEQYMSPRFDHWNTVFNFLFSILSRQSWRQGRGTDLHLRCNSRIISWVSTATFQLFGMFSLVSSSPYCVLFTNTPFT

SEQ ID NO: 53872 - protein, 224 aa, Sorghum bicolor
  Clone ID: 13784295.pep
EAAAMLIRFGIARCSAKPEHVQFHDLIRLYARKRGGTRTAQAVVQSVYLQGSIKHSSEHLWASCFMVFGFGSDPLLVELRPSELMFFVKQIVMPLAIHTFITYSRCNAALDLLRLCTDALERAAESMLVHAGKWRETSFSCFRQAHSEAQYTYIWQELALLKASVLETRAKLMLRGGQYDIGDDLIRKAIFIRTSICGEHHPDTVSARETLSKLTRLLTTVQLS

SEQ ID NO: 53873 - protein, 129 aa, Sorghum bicolor
  Clone ID: 13784303.pep
SCLSKTPSTRGQPKRTVRFLDSDDGGEAAAPAPGLERRRVQVGVAELEQMLLHRMEMDSDEEDDEEDEESSDASSDLFDLENFAAVAPDAGAAAAAYRDELPVYETTRVVLGHRAIGHGYAHGRSTRVV

SEQ ID NO: 53874 - protein, 133 aa, Sorghum bicolor
  Clone ID: 13784314.pep
RLRRRLSEELIVKRMVAAAPAPAGTGNGAIAANVPAPAGQTEPSRASHLHTLHAWTGMLNDELENDDRKVATWYEENKKAIQTRIESLKTKSVATDVASLLIGNKEGGLKGVQQVLSMLPVEEKEAVLKYLSS

SEQ ID NO: 53875 - protein, 161 aa, Sorghum bicolor
  Clone ID: 13784326.pep
MHAMAVKHGGKFIDTFLKAFSFLETHFEQHNGTIVKMLRILQKATRIIQSICSDAKGNKRTMITSKVPPAKRSMERFLFQVKALLHNCSAEKEFQMGNLKHKDLQGHVVSSQAYGSVDEEDEEQMETDSDAPADEENNNDNAMDEDAVGGSNETPMEEEEE

SEQ ID NO: 53876 - protein, 105 aa, Sorghum bicolor
  Clone ID: 13784345.pep
EIDRLHPKGFNKEGRLRACHNSCCFYISKKMWSQKRLEPIYMMTRQDKTIYHFNLQLHKLTSRQKGCNLTDSSVPNQHVAEQPVICGRPHATVTRIPMCRVTSHP

SEQ ID NO: 53877 - protein, 84 aa, Sorghum bicolor
  Clone ID: 13784353.pep
ASGLSATTLSCPADVIKTRMMNQGKEGKAIYRSSYDCLVKTVRHEGAMALWKGFLPTWARLGPWQFVFWVSYEKLRQASGISSF

SEQ ID NO: 53878 - protein, 34 aa, Sorghum bicolor
  Clone ID: 13784362.pep
PKLRAFVSRVNDDVKQSLPSHAIIELCLISTLFS

SEQ ID NO: 53879 - protein, 80 aa, Sorghum bicolor
  Clone ID: 13784385.pep
NLLRRSPVGQWISTFCTASCFDQYSVLVCYSTYSRALCMVDLWHIFFEKGKGSIASQTCYKHVTEIRILLPQSLFFVAHA

SEQ ID NO: 53880 - protein, 40 aa, Sorghum bicolor
  Clone ID: 13784387.pep
EKIERLTPLHEPRFQHWHFHIWGRRGGALCCTCRFINCLA

SEQ ID NO: 53881 - protein, 84 aa, Sorghum bicolor
  Clone ID: 13784393.pep
TSREDVDFFFHLEMHLRQEHPPLCGRDHMAYRSAYFPVKDVIDGDLCEQYPSLPADMQRKIADELDRTPGEILKKLEDIRNKII

SEQ ID NO: 53882 - protein, 166 aa, Sorghum bicolor
  Clone ID: 13784399.pep
LLLLLSMGDSANFHTVLEGLVEEASSKGAHVEDDAYIKYPVELERNLMEGSYDKVWRETKSERVPSEDFGLFSNVLIGTIRSEIADCSEKAYPSLPISNAKNLLFLESEGAVIEFAQQRGWILRDGRIFFPVEPEASGRSEKDILMASGTVIENALGYARELETIV

SEQ ID NO: 53883 - protein, 105 aa, Sorghum bicolor
  Clone ID: 13784428.pep
MAGQAGNPVNHPISPHVIGGAFVQQYYKILHEQPDQVHKFYQDSSILGRPDSNGTMVYVSTMSDINEKIMAMDVRNCLTEIETADAQLSHKDGVLIVVTGSLTSE

SEQ ID NO: 53884 - protein, 137 aa, Sorghum bicolor
  Clone ID: 13784431.pep
TRVGKHDGDVTDLSISQWMSTRLASGSKDGTVKIWDDRKQVPLSIFKPHDGQAVYSVAFLTAPERPNHINLITAGPLNREVKIWASTNEDGWLLPSDSETWKCTQTLELVSSLEPRVEEAFFNQVAVLPQASLILLA

SEQ ID NO: 53885 - protein, 168 aa, Sorghum bicolor
  Clone ID: 13784457.pep
VERLLDRLTLERKPDAIVADTFLTWGVTAGAARGIPVCSLWTQPATFFLALWHLDRWPPVDEEGLSCKSLDQYFPFPALSSVKCSDIKIFRSMVLPMKRLAEVFSNVRKAQCVLFTSFYELETGAINGTRQVVPCPIYTVGPSIPYLSLKGDSAKLHHENYFDWLDCQ

SEQ ID NO: 53886 - protein, 119 aa, Sorghum bicolor
  Clone ID: 13784461.pep
HEARATESISNRGAMDSPTHGDKTHDGHSWGPSFDHGMDNDSLWNFGHKDGENGDSDLFFGPQGLPPIRTGGSSSGSSFVKEQKPFFDSVPGTPMEKPFFDSIPGTPVQKSVFDSIPGT

SEQ ID NO: 53887 - protein, 187 aa, Sorghum bicolor
  Clone ID: 13784470.pep
WFESSSEEKEWRADEAEEEEDGTAAVAVPVVVVVDGMKREGWCCCCSKGGLIKLFMLHHPWPWPASPISRTRAADDLWTTPLSIFSLPPSDPSISLSLSHTHTQTKCNKHLLAVLSLSLSLALAFDVHSSIDRHHLCFDRKLFYLLRSTSRQRWEKAYGPFGEGKMEGNLKCSGTGYTTGRLQEPRA

SEQ ID NO: 53888 - protein, 124 aa, Sorghum bicolor
  Clone ID: 13784475.pep
MAAPPLVLVFAAIAALAILVLVVFAFRRWWRRRGQRQRQRRPLQTAEAAPTPVAVQDEDIDRPLLSGNWGDHSRQSNSFLGSSVGEPSKIQTNRSNTSPRSHAISDTGRIYPGECCATQRRNSG

SEQ ID NO: 53889 - protein, 177 aa, Sorghum bicolor
  unsure (1)..(177): unsure at all Xaa locations
  Clone ID: 13784478.pep
TRNTLTFALAALDCGFDNPVFAAIELEYAESDRDPTGQAANQAQKLLTFYELDLGLNHVSRKVSEPIDNGANLLVTVPGGGDGPSGVLVCCDNFVLYRNQGHPEIRAVIPRRADLPAERGVLIVAAATHKQKXELRIKYFDTIPVTSAVCVLRSGFLFAASEFGDHALYQFRDIGRD

SEQ ID NO: 53890 - protein, 160 aa, Sorghum bicolor
  Clone ID: 13784485.pep
HEGALLSNHAKTFKDKYFPSEPVSSDIAVTDDLLKLRALCAKLNTTADTIKTKAKGKSKAVVGNNFDVLCNVEEQLDGIIAEMLSELNKGDGVSTFEFIGSGVVSALLTYLSCGTFGREKVSEANIPNLRHQAVRRYKAFISLALPNDKNGNKNPYDIPS

SEQ ID NO: 53891 - protein, 92 aa, Sorghum bicolor
  Clone ID: 13784501.pep
APVTSLSSSSPPIASSPSTLWPTTCSHALTAAAGASGPEMTSTASSPTGGWSTWRSREGRSAAARLEGQSKRSVVVGRLVEGEGVEEEEASC

SEQ ID NO: 53892 - protein, 127 aa, Sorghum bicolor
  Clone ID: 13784516.pep
LRDLPFVQHPRPCPRSPPSPALRQRLGENLARRGEMAGRARDPRPFLPARTMMREARGVAPLPPVLRDGGIVAAANGNGTLLCAAPLSLLPCLLELLYPGGAPIDLAFVKETRRRRARIRRGLVASC

SEQ ID NO: 53893 - protein, 161 aa, Sorghum bicolor
  unsure (1)..(161): unsure at all Xaa locations
  Clone ID: 13784524.pep
TRAHADAGGGRGGTLAKVSLSSVSAAMAEASTYPLDAVKTRLQLHRSPGGAGGRSAVRVAAELVRDGGVYRGFSPAVLRHLMYTPLRIVGYEHLRSTLASEGREVGLFEKALAGGLSGVAAQCXVVASPADLMKVRMQADSRMLSQGIQPRYTGIPDAFTK

SEQ ID NO: 53894 - protein, 164 aa, Sorghum bicolor
  Clone ID: 13784532.pep
MSAPPVRTLADLDGDVLAHCAGYLGARDVASLSMCCRPLRAAAYCDAVWYRLFRDQWPFEKVPCDALGIRELYIHRHTDIHQMKFGDPVSVLYYLDSAETTPSHLMLDRNSIWFCQGPAAKKLNINWPETEMTENHRNHSARITCLRLFSLIDTPLFRSDTQKN

SEQ ID NO: 53895 - protein, 127 aa, Sorghum bicolor
  Clone ID: 13784545.pep
KKLTDNETTEAASIHCCPVSNFSAYVSPEAAAQSATTTTWGSGVTSVAFDPTRGGSVITVVIVEGQYMSPYDPDEGPSITGWRVQCWESSRQPVVLHPIFGSPTSLGGQPPMQTVWSTRVNKSIPPT

SEQ ID NO: 53896 - protein, 124 aa, Sorghum bicolor
  Clone ID: 13784549.pep
MDRLVAFSRRRRRWILLAAAGAAAAVGAYKIYHHPAVAERRRRLVRLAAAIAAFADAAASSADAAALVASDLADFVRSDADEVPRSVKQLAKLAASPEVSATVSTLSEAVTSGMLRGAGSGPGS

SEQ ID NO: 53897 - protein, 164 aa, Sorghum bicolor
  Clone ID: 13784560.pep
HEADEELVSYYLRRRVLGRRLRVDAIAEVDLYRLEPWDLPSLSRIRSRDAQWYFFARLDRKVAGAGAGGRGGPGNRTNRATPRGYWKTTGKDREVHHRGKPVGMKKTLVFHAGRAPKGERTNWVMHEYRLLDADGPQDLHVVCRIFQKHGSGPQNGAQYGAPYM

SEQ ID NO: 53898 - protein, 139 aa, Sorghum bicolor
  Clone ID: 13784564.pep
NEKNPGAPPRQNPSCERDRVQALALGAAAAGATGLLRAETAAPPRHRLRSTYDASPLRRRGTGSSHQSQGGASVQLLCRAGVVAALLVNTSRAPLTNRGGGGGACDGSHGGCGARCAPLSDSLSLVASCCRHWDWRMLY

SEQ ID NO: 53899 - protein, 153 aa, Sorghum bicolor
  Clone ID: 13784568.pep
ARGENLVNKRIVVAVDSWDVLSRYPSGHYVRTIGDIGDKETETEVVLIENDINTRPFSTQVLACLPPLPWTLSPEDLANPNRQDLRQVRVFSVDPPGCRDIDDALHCTLLPNGNFEVGVHIADVTNFVHPGTPLDEEAAQRGTSVYLVGQRID

SEQ ID NO: 53900 - protein, 152 aa, Sorghum bicolor
  unsure (1)..(152): unsure at all Xaa locations
  Clone ID: 13784570.pep
ARGSSEGPGFPASSRPHSNPKSQLLIEHLLLLPGSSTTRPFGTKFIFCRCSFLAGSSSAPWSRRARLAVLVVGLHRDGSRDPSGFVISVPLLCCFKLVDRRGRRLGNAEKCACKAAGKSFAQTRFDLCSSRYCWLLMSMGFMLILFFFSVIX

SEQ ID NO: 53901 - protein, 153 aa, Sorghum bicolor
  Clone ID: 13784573.pep
MNMDFTGDADGFALDFIGDLMFGVDGGSVPVASPVVVSDDLTFPVLLPPHQPEFQPVSFLPQQQQHQGYIDVGAAPTAASVVGEAPAAFRAQEPARPVMIKFGSEPSSPVATTMRQPLTISVPPSSYAWAAAPAVEDFRKYRGVRQRPWGKYA

SEQ ID NO: 53902 - protein, 47 aa, Sorghum bicolor
  Clone ID: 13784575.pep
LSSRRAAAYSSLVLCHGALLTALRRREHGASGDDSRRRVVAYETPRI

SEQ ID NO: 53903 - protein, 164 aa, Sorghum bicolor
  Clone ID: 13784576.pep
HEAQEEVNKVMDAAKVAQKAWARTPLWKRAELLHKAAAILKEHKAPIAECLVKEIAKPAKDAVSEVVRSGDLISYTAEEGVRILGEGKLLVSDSFPGNERNKYCLSSKIPLGVVLAIPPFNYPVNLAVSKIGPALIAGNSLVLKPPTQGAVAALHMVHCFHLAG

SEQ ID NO: 53904 - protein, 71 aa, Sorghum bicolor
  Clone ID: 13784583.pep
MALAMPPHGPEEDADAHLFAGVRFVLHGFDQVSASQYRLEIKRCGGVHVGSWDGDCTHVIVSNTLYDDPVC

SEQ ID NO: 53905 - protein, 146 aa, Sorghum bicolor
  Clone ID: 13784587.pep
TRATLPPVDEQVISMKLVTPAKGTIELSREKDPELFYLARCGLGGLGVVAEVTLQCVERHQLVEHTFVSNADEVKKNHKKWLSENKHIKYLWIPYTDTVVVVQCNPPSKWRTPKLGSKYGNDEALQHVRDLYRESLKKYRTEAESN

SEQ ID NO: 53906 - protein, 110 aa, Sorghum bicolor
  Clone ID: 13784588.pep
MCLITDLMRCRCSSVAATQLMTPERRRAIWAIYVWCRRTDELVDGPNASHISAVALDRWESRLEDIFAGRPYDMLDAALSDTVANFPVDIQPFRDMIEGMRMDLKRSRYR

SEQ ID NO: 53907 - protein, 158 aa, Sorghum bicolor
  Clone ID: 13784592.pep
TRLPLRPAAHRVVAVVGPHADATVAMIGNYAGKPCRYTTPLQGVAAYAARVVHQAGCADVACQGKNQPIAAAVDAARQADATVVVAGLDQKVEAEGLDRTSLLLPGRQAELISAVAKAAKGPVILVLMSGGPIDIAFAQNDPRIDGILWVGYPGQAGG

SEQ ID NO: 53908 - protein, 130 aa, Sorghum bicolor
  Clone ID: 13784595.pep
MGCTASKVEQEDTVRRCKERRRHMKDAVAARQLLASAHADYLRSLRVTAAALSRFAQGHPSLAVSHHTAPVLLSAAAPPPAPSAAHALPTPAPSTATSSSLPPPTPLAQHPHPHPPSQPQPQPAAAMAVP

SEQ ID NO: 53909 - protein, 169 aa, Sorghum bicolor
  Clone ID: 13784602.pep
TRASRCPAAAQAHRSRLGLASRERPSAAAPERKEEPPPPRSARRQRSRDPVHSRLPHRRSRRSLPSGSGPAVPSARPPSRGPEPPTADGSRPALKQRRSGSGHGPEARKERHVVVQGRSPEPSIPAGAELLRGAPRLRRGGRRVRVPPHRAPRPGPQRRRRGGGAPRLG

SEQ ID NO: 53910 - protein, 151 aa, Sorghum bicolor
  Clone ID: 13784610.pep
CGGGGISSVRDLYRKDREEWTDGAISSLLDAYTDRFEQLNRGHLRGRDWEDVASVVTDGKGKTTGGKSVEQCKNKIDNLKKRYKVECQRLTSSGGGAVSHWPWFKKMEQIVGDSMSPASSKPLAAAEDVKPRQQQQQHGSKRYPLSSTGPP

SEQ ID NO: 53911 - protein, 189 aa, Sorghum bicolor
  Clone ID: 13784617.pep
TRRNAGFLSPFGYSTPTVTAAVDAICSMEWYWLLASKSQVCVEGKYPTRIWRWKGYLVQYTFLGNEGPAVLLVHGFGAFLEHFRDNIDKIADMGHRVWAITLVGFGKSEKPNANYSELFWSELLRDFIVDIVREPVHLLGNSIGGYICAIAAGLWPSLAKSLVLLNSAGSVIPNYSFVPLSEERRTSSW

SEQ ID NO: 53912 - protein, 133 aa, Sorghum bicolor
  Clone ID: 13784624.pep
TRADSSKCMATGCLVDLNGACPADLRVMATSTTSGAGGGAVACRSACEAFGTPQYCCSGAYGNPNTCRPSTYSQFFKNACPRAYSYAYDDSTSTFTCATGITYAITFCPSTTSCAARHRLIGCLCLSEKVSSR

SEQ ID NO: 53913 - protein, 165 aa, Sorghum bicolor
  Clone ID: 13784628.pep
TRVTGQLSDTRSRFLGLRPPKLFPCVVSHRQAMLCLSSRPWLGYIHQGHFLLTPLSCDTLESASSFSSDQCSEGVVAVAGDALRIFTIERLGETFNETAIPLRYTPRKFVILPKKKYIAVIESDKGAFSAEEREAAKKECLEASGAAENGNANNGDPMENGDGQE

SEQ ID NO: 53914 - protein, 135 aa, Sorghum bicolor
  Clone ID: 13784634.pep
MSDLQSLVSELHGALERKQLDAANDLLSRAKRALLLQNALIPTSSTSPQLVVLARQVLELGALASIRQTDAQLFTRYYQQLQPFYDIERHAGLPGQSSSEVDFSTSQRSKVTGLYLLLLLSMGDSANFHTVLEGL

SEQ ID NO: 53915 - protein, 104 aa, Sorghum bicolor
  Clone ID: 13784638.pep
LQRAGFASPTPIQAQSWPIAMQSQDVVAIAKTGSGKTLGYLLPGFMHIKRLQNSTRNGPTVLVLAPTRELATQILDEAVKFGRSSRISCTCLYGGAPKGPQLRD

SEQ ID NO: 53916 - protein, 134 aa, Sorghum bicolor
  Clone ID: 13784642.pep
LHCAGSPSPLSSAALVGRGDAVALSYSLISHIPSPSPPSTAPAGCRAGLPTGELSTGARHLFDAMPPRRVGAAAARGEDHIGALPDDLLLHVLSFLPAHDAVRTCVLSRRWRPVWKSLRVLRFTKHQSWGSATK

SEQ ID NO: 53917 - protein, 173 aa, Sorghum bicolor
  Clone ID: 13784661.pep
MALALRFRRVLAAASTSAPLLRPSASVARPSPLAAPASSPVAPLPRAPWRLLPGGAAAGFRSTAAAAARGGADYGADDSKISPDEILFEGCDYNHWLITMEFPDPKPSREEMIETFLQTLAKVVGSYEEAKKRMYAFSTTTYVGFQAVMTEEMSEKFKGLPGVVFILPDSYLY

SEQ ID NO: 53918 - protein, 171 aa, Sorghum bicolor
  Clone ID: 13784667.pep
TRQELMRFAPTILLVGLVYVAGKKMKGGISIGGPGGGARGIFNIGKAQVTKMDKNSKNKVFFKDVAGCDEAKQEIMEFVHFLKNPKKYEDLGAKIPKGALLVGPPGTGKTLLAKATAGESDVPFLSISGSDFMEMFVGVGPSRVRNLFQEARQCAPSIVFIDEIDAIGRAR

SEQ ID NO: 53919 - protein, 125 aa, Sorghum bicolor
  Clone ID: 13784669.pep
HEATMAAARCVEPLVGLLVSEANPAQLSVVRALDRLLDDEQLAELVAAHGAVIPLVGLLYGKNYMLHEAVARALVKLGKDRPACKLEMVKAGVIESILDILHDAPDFLCIALSEMLRILTNNATI

SEQ ID NO: 53920 - protein, 155 aa, Sorghum bicolor
  Clone ID: 13784673.pep
HEDRRLEILMARRRSRKNIKFEIDNNLTDVDSNGAGRSLDDLSRFRALVPPIAVPRRNPFDLPYDSEEAVIPGSAPSILHARKNPFDLPLEQLNDSVVVPAPDSLNSGESAMSPRRDMIFRRHESFNFGRMDAIQEKHFSRLKPYFVPETVEWNA

SEQ ID NO: 53921 - protein, 171 aa, Sorghum bicolor
  Clone ID: 13784676.pep
HEAAALWETLLAASAADGTGGSSTTVVSICVFTAVLCLCLVAGHLLEENKWVNESITALIIGCIVGAIIFLLTEGKHSHILRFDEQLFFIYVLPPIIFNAGFQVKKKQFFHNFMTIMSFGVFGVFISGAIVSAGCYWLFPKVGFGKLDAVDYLALGAIFSSTDTVCTLQVI

SEQ ID NO: 53922 - protein, 125 aa, Sorghum bicolor
  Clone ID: 14007792.pep
LLFSCATKLLFAKERMYRAILQNLRTKKLIYTVGTLFGIAQVGQFTHIADHSSYLGGGQPSCYGATPYIHTNNSVCTIMQLGSKKDHGLAVTLAAIALASPACRLSFSVAKNKLAQIFYGLPREK

SEQ ID NO: 53923 - protein, 95 aa, Sorghum bicolor
  Clone ID: 14088969.pep
AATLSLFPRSCVANIIQRRTRSCLDPHSIQLLPHRRRKESYRRQPRDDRPAISPVLAAAAFAQHISYGPVMYENLLLSQTAEPQSYRCLSASKLG

SEQ ID NO: 53924 - protein, 73 aa, Sorghum bicolor
  Clone ID: 14088981.pep
LPFGSGRRSCPGTALGLYALELAVAQLAHGFNWSLPDGMKPSELDMSDVFGLTAPRATRLYAVPTPRLNCPLY

SEQ ID NO: 53925 - protein, 144 aa, Sorghum bicolor
  Clone ID: 14089006.pep
ADNVRYGPQLRGKKLTEAEVKNLLSLADLDPALCSKPASELSVGQAQRVALARTLANDPEVLLLDEPTSALDPISTQNIEEAIVRLKKTRGLTTVIVSHSVKQIQRIADLVCLVVAGEIVEVLAPSELSDAKHPMARRFLELSS

SEQ ID NO: 53926 - protein, 121 aa, Sorghum bicolor
  Clone ID: 14089035.pep
RGASKRGRGRGTSSMKQTTLTFSQWRSTTVIRSEDVSSEEEADANEVVENSEEESAQQVGRKRAAPRGRGRGRGSTAKRGRKTDIASIQSMMSKDDDDSEDEPPKKAPPRVTRNYGAVRRR

SEQ ID NO: 53927 - protein, 127 aa, Sorghum bicolor
  Clone ID: 14089120.pep
PPDMPLDGGRGGLPAAAGAGAGGMNPTHRQKMEEMLQLFDKSRKELSKLLDIYEQRLGEEDFLAGTKFTLADLSHLPNADRLAADPRSARLIRSRRNVSKWWDTISRRDSWVRVKELQRPPSAEAPF

SEQ ID NO: 53928 - protein, 94 aa, Sorghum bicolor
  Clone ID: 14089132.pep
RKRSRGDSSSNERSSVLSSGGVTPKNAPQSHLNADDMEPGLQREERTKNGGQNRRIRTSMVEMDARTAGPSRGPGPTDRISDPGKATNGSSAVP

SEQ ID NO: 53929 - protein, 71 aa, Sorghum bicolor
  Clone ID: 14089142.pep
ARGPASDSRLRAHYLALIIRSRKTFKRSGTMQMEMEKGDTQFFFDLFVAMCNHIDDISEEIGHVQSPNITK

SEQ ID NO: 53930 - protein, 176 aa, Sorghum bicolor
  Clone ID: 14089151.pep
HEVDIDLEDQKVQRIPADEFVPKKLTLQLDLEKPSLGDEKSPSERRQPQPQPQQLQQQKPSKAEIKHEKSAMPAVTPPMPIPVGGWLGNFPPFGYLSPVPGLSAAGLHHPMDVKPGSSSGLQHAALLPPPTRSKRCATHCYVAQFIQHQQRVAKMNSFWPPAAAAAAAAAANRSGP

SEQ ID NO: 53931 - protein, 118 aa, Sorghum bicolor
  Clone ID: 14089152.pep
NQRVGGWCVRMARGSARRRRFRGWSSMRGNGALALVEGMELVIALSACCDCTARPTSANLFLTTAISMAGACERHGQCELGRQRWCSDRARAQAAATSIRVSAGHGGGKPAALALDAS

SEQ ID NO: 53932 - protein, 140 aa, Sorghum bicolor
  Clone ID: 14089154.pep
MAAVAKIAMEWLQDPLSCVFLVTLAVVLLQLRRRGKAPLPPGPKPLPIVGNMAMMDQLTHRGLAALADKYGGLLHLRLGRLHAFAVSTPEYAREVLQTHDGVFSNRPATIAIAYLTYDRADMAFAHYGPFWRQMRKLCVM

SEQ ID NO: 53933 - protein, 130 aa, Sorghum bicolor
  Clone ID: 14089175.pep
QLRTPPPPPPPPIMGSASSDDLREHLLDVDGGAAAAAAEPKIRVRGLRRRAESADAATGEEILRGVHLDVPRGVVMGVIGPSGSGKSTLLRALNRLWEPAPGAVLLDGADICAIDVLTLRRKVGMLFQTP

SEQ ID NO: 53934 - protein, 158 aa, Sorghum bicolor
  Clone ID: 14089195.pep
MQVRCDFCGAAPAAVLCWADEAALCSACDRRVHRANKLVHKHRRIPLVQPASGNVSDADADAAAPLCDVCKERRGLVFCVEDRAILCPDCDDPIHSANDLTAKHTRFLLVGAKLSAELVDQAPASPDDDDDDDDACGRDTRAAAEPDAVPALGAQGSC

SEQ ID NO: 53935 - protein, 126 aa, Sorghum bicolor
  Clone ID: 14089202.pep
MSESAQPRGGEVDSNTLRILVATDCHLGYMERDEIRRFDSFQAFEEICALADQNKVDLILLGGDLFHENKPSRSTLVKTIEILRRYCLNDQPIKFQVVSDQTVNFPNRFGKVNYEDPNFNVGLPVF

SEQ ID NO: 53936 - protein, 73 aa, Sorghum bicolor
  Clone ID: 14089207.pep
RTCSGNVRRFTCTGTIFRHMPYEMTILTSASLVRCLGDEAKFVNKLKIKVCLPNGKLAVGKLWKYDCNYNIAI

SEQ ID NO: 53937 - protein, 71 aa, Sorghum bicolor
  unsure (1)..(71): unsure at all Xaa locations
  Clone ID: 14089216.pep
FGTRKSLRLQRDVGGDGGGASTAAEPCGGGVRAVAGWLXLLFQILLRIIRSTPSSWAQLLSFVGLRHPLLP

SEQ ID NO: 53938 - protein, 174 aa, Sorghum bicolor
  Clone ID: 14089241.pep
ARGGYLVCPDELLRVTSIDVAMVVLKENLILPLFRDEYILLHENYQLYVLPKVLESKRMAKSGRTKQKEADLEYNVAKQVERMLTEVHEQALVSCDAMHRERRILLKQEIGRMVLFFTDQPSLLAPNIQMVFSALALSQCEVIWYFQHVGVAASKSTRVKTVDIDATDPTIGFL

SEQ ID NO: 53939 - protein, 180 aa, Sorghum bicolor
  Clone ID: 14089248.pep
ARGYTWLEHSAVNDDEETWTDNNLPVACGNFTLGNTEESQDPLMFSHIVSWAKGRKRGSYVIYPNKGEVWALYKGWSMQWVSDADNHRSYEYEVVEVLSNFTMEAGVTVIPLVKVKGFVSLFAPAKDKSSFVISSSELLRFSHSIPFFRTVGNEKVGVPCGFLELDTVSLPSNLDVAFPP

SEQ ID NO: 53940 - protein, 51 aa, Sorghum bicolor
  Clone ID: 14089280.pep
QRRVLLHRFAPPVPVSRLLGAYRRPPSAESGAVKVEGSGDGRLEVSGWPRA

SEQ ID NO: 53941 - protein, 203 aa, Sorghum bicolor
  Clone ID: 14089286.pep
LSSSTLSAVAGASSSMLSSFRTTGLASLGGSGLVASSSTSASFLVDSSGASSPPRATTSSPSASLLVDSSGASSPPRATTSSPSASLLVDSSGASSPPRATTSSLSSFSSPNSPLASGATLSCGSATSSLGGETSTSFSSLNSPPSPLPEPTSSPFSISGSSFSAATGASASSATLSTTSTSSAAPLSSSSSCCSSFCNSPSC

SEQ ID NO: 53942 - protein, 71 aa, Sorghum bicolor
  Clone ID: 14089299.pep
ARGKTSHSPWPCLWRSRRTSWRSPRCSGSTTPATSSSPRRRRRPRSGTSGGCRTSLMAWRQPTSVSTTGEN

SEQ ID NO: 53943 - protein, 116 aa, Sorghum bicolor
  Clone ID: 14089302.pep
ARGSALHGFYVPTAPILVPIPGHGLEPPVLPNDRFAGAAARAAAAAQNEQMELARLEMAKLEHDLLKKTEARVPQDSESGIEINLHDSSEVLSTDLNVVRIDPVSYLPAEVMSHVL

SEQ ID NO: 53944 - protein, 155 aa, Sorghum bicolor
  Clone ID: 14089307.pep
HEAFFEHIVIIVVLVLFAGLMSGLTLGLMSLSLVDLEVLAKSGTEQDRKHAAKILPVVKNQHLLLCTLLICNAAAMEALPIFLDSLVTAWGAILISVTLILLFGEILPQSICSHYGLAIGASVAPLVRVLVWICFPVAYPISKLLDYVLGHGQTA

SEQ ID NO: 53945 - protein, 112 aa, Sorghum bicolor
  Clone ID: 14089309.pep
MASTHALKKNYRCDRSLQQFYTGGPFAVGLAPGGDGEGEGGAQAEAFLACACGGEVRVVSAADASAIGEPVDGDSEAITALALSPDSRLIFAAGHSRLIRVWDLASRTCIRS

SEQ ID NO: 53946 - protein, 129 aa, Sorghum bicolor
  Clone ID: 14089310.pep
ARGSGHQPVSAPTTLPSVNLSEPSSSDWQEHTAAEGKKYYYNKKTRQSSWEKPVELMTPLERADASTEWKEFTTPEGRKYYFNKVTKQSKWTIPDELKVARELAKNASNQQPDLESRIAASALVGSAAS

SEQ ID NO: 53947 - protein, 105 aa, Sorghum bicolor
  Clone ID: 14089319.pep
RIGPDQDEDGQGAPEAYEDEVDEEDEGYYDEEEDDLGEGFEEEYEGRAAPPMEEGGGGGGQVSRGEDGVTGEEGLPEGEAKGEGEEKEQEPFAVPTSGAFYMHDD

SEQ ID NO: 53948 - protein, 92 aa, Sorghum bicolor
  Clone ID: 14089324.pep
MQVPAGFLGKLWSFVSFVPFFILLLLLGSIKAVLIGPVTASIVFFGNSAVIIGLWPAHFIWTYYCVLKTERIGLELKILIGILLPLPLLLLP

SEQ ID NO: 53949 - protein, 116 aa, Sorghum bicolor
  Clone ID: 14089352.pep
TRRKRTKQFSGGWRMRIALARALFIEPDLLLLDEPTNHLDLHAVLWLETYLLKWPKTFIVVSHAREFLNTVVTDILHLHGRKLHAYKGDYDTFERTREEHLKNQQKAFETNEKARQ

SEQ ID NO: 53950 - protein, 108 aa, Sorghum bicolor
  Clone ID: 14089354.pep
RSAVEDRRRAGAVARSHDPPPSSSDRRAWDFKALTVSRRLCHHRRPPSPEPCSTPTGISERRMKNQWLRKSQILYEVAHGDEDGTATTGDEDSGKQISTLISAPVGQC

SEQ ID NO: 53951 - protein, 148 aa, Sorghum bicolor
  Clone ID: 14089358.pep
MAAVGVGAADERWASLCNCVVNFLLEERYHLTALELMQELQEDGRSAHALRLRAFFSDPALFPPDLVARASSAPPGADPQILLQEKIAAEEKLALVEYDLRLAKEDLSQFKLDLQKQKESSPDDSNGLLLGASIREGSTSQQDKWDTK

SEQ ID NO: 53952 - protein, 56 aa, Sorghum bicolor
  Clone ID: 14089360.pep
MPDLPCDGDGVCMVCRAASPPEVDLLRCSTCATPWHSPCLSKPPALADAASWSCPD

SEQ ID NO: 53953 - protein, 191 aa, Sorghum bicolor
  Clone ID: 14089367.pep
DIIQWPPNLPVQSNLRVPIEQPVSNEKFTVQLPNAGAQVPAGPLLQHPKEMPNHLVSAPPNGSSKFPLQVTVGIDPVEVTHEPAYTDSLFSNQDPWKAVGNASLVPPRPSKLTKEPVVLGGQYTDGHMADMNTHAAVLFEEDPSFKDIHTVKLNKGFGEDNIKQQLQAVAEGVAASVLQPPFPEKPAAFSG

SEQ ID NO: 53954 - protein, 127 aa, Sorghum bicolor
  Clone ID: 14089370.pep
ARGRSDIKFDKDNHSTVPANINWKDNKEHRSKRYFEQPADTVDWRLPRPSLQSIDEAPKGLISVEERNSKDANESAGDNKAEPKSEDRFRDKDRKKKDEKHRDFGAREGDRNDRRTGVQLGSSGVER

SEQ ID NO: 53955 - protein, 83 aa, Sorghum bicolor
  unsure (1)..(83): unsure at all Xaa locations
  Clone ID: 14188345.pep
SSSSPSTSGSKSMSSSNSSSSSSNSGSKSISSSSSSCXACEIASXAGDSLTFTSGSKSMSSSCASSNSGSKSLSSSPSSCFRL

SEQ ID NO: 53956 - protein, 172 aa, Sorghum bicolor
  unsure (1)..(172): unsure at all Xaa locations
  Clone ID: 14188348.pep
MKNPDFAADKALAKDFLSNFAGPHGEPKYLNILQDVANRKIRAVQIELDDMFHYKDIDEEFLQRVTENTRRYIGVFAEAMDEIMPEPTEAYTVDEDRDILMTQRVXDEGADGGADGTDPLQRMPPEIKRFFEVYIKTFSKATPLTIRQVKASNIGQLVKISGIVTRCSDVKP

SEQ ID NO: 53957 - protein, 71 aa, Sorghum bicolor
  unsure (1)..(71): unsure at all Xaa locations
  Clone ID: 14188349.pep
SASFGPQQEWASMESPLQPPHVSFSCASFPPCPRTPPLMDMPAVPPDSSSRAPXPDSLQPPPPSPPRLGFR

SEQ ID NO: 53958 - protein, 192 aa, Sorghum bicolor
  Clone ID: 14188350.pep
MKRKTGRESQGANGQPDSKKRALSNEEAATRFRDGLFDSAELQKYTTDYAKSKPYLHGVIHPVFNDSLLRSVRDEIQEHLHFTEKETDIYKIFQSGDLANLDGLDDASLSRLPSVLKLRDAMYSQRFREYLSGVTGSGKLSGRKTDMAINVYNEGCHLLCHDDVIGSRRLSYILYLTDPDTPWQAEWGGALR

SEQ ID NO: 53959 - protein, 136 aa, Sorghum bicolor
  Clone ID: 14188357.pep
PDPERRHHHAFPLHGGRAACCSPAGGGDRHDTIQRRRRWRRRLKLRGPAGAGHGREDGREEAGVAWAAGSEQRVVVWVAEWRAGEVAEGGGRGAQVPGLCSLPLLASRSFAALSVSSSPPRLCSGTQGRQSNGASC

SEQ ID NO: 53960 - protein, 130 aa, Sorghum bicolor
  Clone ID: 14188368.pep
MAEALPLPLLLIAVATTAVAAYCAPATPAAAAALRTSSYSHFFAFGDSLTDTGNFIHYSTAPGPVAHSPYGETFFHRPTGRWSDGRLIVDFIVERLGYPRWSPYLDGKSKEDFQHGANFAVASGTALSRR

SEQ ID NO: 53961 - protein, 80 aa, Sorghum bicolor
  Clone ID: 14188371.pep
MSEPIPSSILIIGAGVFSLGTAYALAQREEYKNTKITVLDRSGFPAPDAASVDSSRIIRADYADYYYSALCMESLKEWRG

SEQ ID NO: 53962 - protein, 128 aa, Sorghum bicolor
  Clone ID: 14188383.pep
MSDSTVGQTKQFGKGQRTVPAQKAQKWYPVDDESQPKKVRKTLRPTKVRESLQPGTILILLAGRFRGKRVILLKHLDQGVLLVTGPFKINGVPLRRVNSRYVIATSKRIDISGVDQSALEKVSASDYF

SEQ ID NO: 53963 - protein, 111 aa, Sorghum bicolor
  Clone ID: 14188400.pep
LIERFSQTNRCDVTTTPPPGIPSGTNNGNHQRKASPVFQIRETKEATTSRRARCFSVGHFVLLDQSSILVEILDRSCCFAYADNARQLQVCSLFAATPKQSPAGGARLPRA

SEQ ID NO: 53964 - protein, 134 aa, Sorghum bicolor
  Clone ID: 14188401.pep
MSASAEPEKDAAAAAAAEGDEKTEAKGTGSGWELLYCGGTSFDAMGRKVVGGAQGNLVSPTRLRPLVGVDIRFVASGCTACHCVALHAEGKCYTWGRNEKGQLGHGDTLLRNLPTVVSQLSKYKIIKASVGRNH

SEQ ID NO: 53965 - protein, 178 aa, Sorghum bicolor
  Clone ID: 14188411.pep
ARGSLSVEEHQTDVLQSPEGTFSCGFHSIYESAFTFSIWYTNSVNKTVVWTANRDRPVHARGAVVTLRKDGTMVLTDYDGAVVWQTEGDLVGVQYARLLDTGNLVMANSSGMVVWQSFDSPTDTLLPTQHITSTTTLVSTTHLHVPGPYIFHFTDSSILSLIYDDARVHEIYWPNPDN

SEQ ID NO: 53966 - protein, 200 aa, Sorghum bicolor
  Clone ID: 14188436.pep
ERFPADPRERYGYQSKEFMDTREPNDYLRSRQSRDRYDDGPWERSEPRRDYRYPAPCINFAKGKCIRGASCLFAHGDSASHGRWRDEARESAHDRVGPDSSYGNRTEHRRVNKNPCKFFAEGRCRRGENCPYLHEEAPQSQIGVSAPDEDLNHSDGHAARGNYSNWGEQNNAVHATSQILSRDDRENPISQSIGRNDSRN

SEQ ID NO: 53967 - protein, 195 aa, Sorghum bicolor
  Clone ID: 14188447.pep
MSYHADTELRNSKIEVAEHKAPDEADMTTPSNGEALRSEVSAGITIDENVEIDKPASTSSAQNSQDRDLAAVPPKVESDNDEDMDVEMEVDEDNVEEQAHCSPVPKKEHPPSEQLNSSNLSSFEDPTSPEDSSFPPPPPEDEWIPPPPPENEPVPEAPPEEPAASYVQVDTIPQPYIAQANVGYTISGMEYYGTV

SEQ ID NO: 53968 - protein, 135 aa, Sorghum bicolor
  unsure (1)..(135): unsure at all Xaa locations
  Clone ID: 14188460.pep
HEAEPCVTHGTTVLAPPREPRRNMAAALLPETAPRLLTPETLRTAAKQSQGIHLVPLSLRRAIKRYLRDQDKAHMNRKVLLLSASFDRAKGTGAELAAAATRGALLDDPNAPSGAEQRAXARWKVRSAYGDIGLR

SEQ ID NO: 53969 - protein, 136 aa, Sorghum bicolor
  Clone ID: 14188462.pep
MAMVSGAKRRRGLEEEQEEDEDRISRLPDGVLGDIVTLLPTNDGARTQVLSSRWRHIWRSAPLNIDLDIDPDYPLGAHNVTEGVISRILSAHQGPCRRFSIPEHYLLYRDLRVTSLDGWLESPALDRLQELEFHYG

SEQ ID NO: 53970 - protein, 162 aa, Sorghum bicolor
  Clone ID: 14188465.pep
ARGDRFHEPPFVAPQIHRRSFGSRFRRTFPVKVRRAFPANSGILCENRHRCEHHGQLSPSTPAARCQSSLHPMASPTHLTAMCSWPPFSRAAAADVAAQPSCGRRPCPRAVRPVVGPTTAARWDRRAAATASLLSGRAPPFPSRCTAAAASHLQLGQRRSRT

SEQ ID NO: 53971 - protein, 162 aa, Sorghum bicolor
  Clone ID: 14188470.pep
MDHLVSKETSFCCSPSSSSPVFSDAGAEPCPSSTASSDEWFRCARRATVEWIFETRAYFGFSHRTAYLAVSYMDRFCLRRCMDSSVMPWAARLLAVACVSLAAKMEEYRAPALSEFRADDDYDFCSVSIRRMELLVLSTLGWRMGDVTPLDYLPCLSSRLHR

SEQ ID NO: 53972 - protein, 147 aa, Sorghum bicolor
  Clone ID: 14188471.pep
TRRIDGIYDSLDKGRECMLRNAGIVLQENNSMVAAGSTTPWRTVTCKVCFEEFSMAAVSTMDCGHCFCNDCWTGHFHAAVESGKKQIRCMEVKCSAFCDENLVLFLLGQKYPDMAKRFNRFLLESYIEDNASVKWCPSTPNCGHAIR

SEQ ID NO: 53973 - protein, 166 aa, Sorghum bicolor
  Clone ID: 14188473.pep
TREKSRGQLQNAKRKHAGFRSPICEVANSPSSNDEADAPANEFTTAKRMMGMDVVHKSVRSGLQGASVSPQCDNNHSTRNYGVRPSWNSRRGPRGSFIPPIRNNGGSGTTISRVTGKNDESMEVSTRKCIDMLCGPDGELPEKLRNLESRLIEHVSNEIMDRDPNV

SEQ ID NO: 53974 - protein, 146 aa, Sorghum bicolor
  Clone ID: 14188488.pep
TRAASALHLRLLPSPPASVKLQQRQLRSLSPRIQRQGGLSRRFSKVVSYYGLTTPPYKLDALEPYMSKRTVELHWGKHHQDYVDGLNKQLATSPLYGYTLEDLIKEAYNNGNPLPEYNNAAQVWNHHFFWESMQPEGGGVPVGGVL

SEQ ID NO: 53975 - protein, 139 aa, Sorghum bicolor
  Clone ID: 14188489.pep
ARGLFSTLVKLELSALRYYVINALKSGRQDKVIEFFGENGNYLLQKRGDWLAWFAIPYIKNPSLDPQFRVYFSKEWLDTLVLSFRNFLSGIFNDTRTPALMRISSEKNTIKSLKNDIKQLNNKLAELQASLEAKEDEIS

SEQ ID NO: 53976 - protein, 111 aa, Sorghum bicolor
  Clone ID: 14188492.pep
TRGHGHAWNNPPNWPSPVSNGFVPIQHGGAPGFHPPVHQFPGPPMFNLRPQMKLNQPGVSYPMHDAVDRFSTHMRPFGWPNHLDEACPPHMQVWNGGSGVFPGEPYMYGRQ

SEQ ID NO: 53977 - protein, 110 aa, Sorghum bicolor
  Clone ID: 14188533.pep
GVSMAATDEDRGSLSPFLSSPNRPPSDSPRLSSTASISSRSCPGLCSGGGASPFPIPHSKSLEKPSIVSASLSQGASVNEKRTGRKEEGGGRHWRGEALPLLLTAASRRL

SEQ ID NO: 53978 - protein, 88 aa, Sorghum bicolor
  unsure (1)..(88): unsure at all Xaa locations
  Clone ID: 14188540.pep
TRLRRRRERNAQSSQDRPYGVRRMAXMGGSGGPGDDAAEGAGAGFEWDADSQLYYRASTAFYHDPVAGWYYSSRDGQYYIYQNGNYMP

SEQ ID NO: 53979 - protein, 95 aa, Sorghum bicolor
  Clone ID: 14327978.pep
FDGMQSVLSGVVRGCGRQKAGAYINLAAYYLAGVPSAFVFAFVCRLGGMGLWLGIMCGLVVQMLLLLSITLCTNWNNEALKAKDRVFSSALPPLD

SEQ ID NO: 53980 - protein, 132 aa, Sorghum bicolor
  Clone ID: 14328105.pep
EVHWPFDPRLASTEMAIVPWTQLLLSSELTCSTVLSTSFPVVIDRVGDILLPEIFLMARFILPHRHVLWLLVSMLLRLGIRDVRQGSQGKAPYGQDSQTVDSTGSACFRGDRSRKYGGSRSFGGVVHVQPLL

SEQ ID NO: 53981 - protein, 155 aa, Sorghum bicolor
  Clone ID: 14328119.pep
YQWRKYGQKVTKDNPCPRAYYRCSFAPSCPVKKKVQRSADDSTVLVATYEGEHNHGQPPQHDGGRAARSTATAQAQVASEAAVRPVAAPLPLQHPHQQQKQKQKQEAATTVPSSEVARKNLAEHMAVTLTRDPGFKAALVSALSGRILELSPTRD

SEQ ID NO: 53982 - protein, 178 aa, Sorghum bicolor
  Clone ID: 14328219.pep
GKEASAQPLAVAGPHGTEDEAPRKKARLGWGQGLAKYEKQKVQGPVDPAEAVADGSPADGEQKTASLAPAPTPTPVPSVAPVPPAAPVPDPVPAPAPPAPPAAPVLLSAPVGCSSPVTAPPYCSSAPEDKSCEMMPNTVTNSTKDVLEADDKTFNNEFSIKLDQLGDDPVSSLANMPR

SEQ ID NO: 53983 - protein, 155 aa, Sorghum bicolor
  Clone ID: 14328233.pep
MRNPAAPGAVTESAELVLPLLPPQDLAAVASACRALRAAVTGVTARRAADAARGLEPLPIPFRNCVDSKPYAYFLYTPFSLTRLAPGASAPSAQPWGAAWVRPPGPTWPRPNLDGFPSSVCGCACAAAECGGTQCACSDADADAAGPGFEAGMGS

SEQ ID NO: 53984 - protein, 122 aa, Sorghum bicolor
  Clone ID: 14328234.pep
ESLKGRPENDEKYSCSETGYRLPLKCVEAQNATKEGNKTKQRKILDDASTSGGTKSASGGPKHYITYRSCVPLVGEEKLSVLGFEVVMAGMLLVSGPFVYYRKRRTNLMQGAARIPTSDPRF

SEQ ID NO: 53985 - protein, 164 aa, Sorghum bicolor
  Clone ID: 14328245.pep
ARGAICSPALDNATSASPSSLGHPGGGHPLPAAVGGNTVLSDLTSSNNNGCFLPRKRARVGDVSGAGAGLIMDLQGQRALLPPVPVPVPVLAGDVQRRLLCSAAASTTTSGRPTASVAPVSQSQGLLSHLYHHGVEIDALVRIENERLRAGLREARRRHVRTVV

SEQ ID NO: 53986 - protein, 53 aa, Sorghum bicolor
  Clone ID: 14328246.pep
VAGLDALGVVMYTCVVWVVNCQMDLSVNYFTIIHYIFIWGSIAVWYLFLLDNG

SEQ ID NO: 53987 - protein, 194 aa, Sorghum bicolor
  Clone ID: 14328278.pep
CSYLTRERRKLANIKERYFRQHGGLLLLEQISTGQGTTFTIFTEAELMEATDQFDDKNVLGRGGHGTVYKGTLKNGILVAIKRCISMTDEQRRKEFGKEMLILSQVNHKNIVKLLGCCLEVEVPMLVYEFIPNGTLFHFIHGVSGCCDAPFSTRLQIAHESALALDYLHSCASPPILHGDVKSSNILLDDKYSA

SEQ ID NO: 53988 - protein, 84 aa, Sorghum bicolor
  Clone ID: 14328317.pep
YNLGTGRGTSVLEMVAAFKKASGKEIPTKLCPRRPGDATEVYASTEKAGRELGWRAQYGIEEMCRDQWNWAKKNPYGYCGSAEK

SEQ ID NO: 53989 - protein, 108 aa, Sorghum bicolor
  Clone ID: 14328370.pep
SFCCIPCSCRTSTDQNTIVGDDRSAIRTGPRLTRSPVGNILLPTSHASHRVAADTKSHASTNHDVSRATLRPFLLHWSELLLLKPAPLLVGASSARASAWACATVWRC

SEQ ID NO: 53990 - protein, 125 aa, Sorghum bicolor
  Clone ID: 14328389.pep
QRIEEAGGFVMWAGTWRVGGVLAVSRAFGDKLLKQYVVADPEIKEEVVDSSLEFLILASDGLWDVVTNEEAVAMAKPILDSEQAAKTLLAEASQRGSADNITCVVVRFLEQQNGLAGRATNDQAS

SEQ ID NO: 53991 - protein, 154 aa, Sorghum bicolor
  Clone ID: 14328422.pep
VASEYRDTVARRYFTVTGTQPDEATLDALAESGEGERFLQRAIAEQGRGQVLGVVAEIQERHGAVAELERSLLELQQVFNDMAVLVAAQGEQLDDIEGNVGRARSFVDRGREQLQVARKHQKSTRKWTCIAILILLVIILVIVLPIVLQNTKKN

SEQ ID NO: 53992 - protein, 97 aa, Sorghum bicolor
  unsure (1)..(97): unsure at all Xaa locations
  Clone ID: 14328446.pep
ARGPQSVGKIERQVTGAPPPLSTIGYSVDVFDGNEVPPPEKKECNYRNGKWVSDNRRPLYSGFGCKQWLSESWSCRLTQRTDFAYEKFRWQPEACXM

SEQ ID NO: 53993 - protein, 41 aa, Sorghum bicolor
  Clone ID: 14328543.pep
CWCGGSGVVGAVGGRHPLLSRPDVGRDMRKRQQCGGSDPRA

SEQ ID NO: 53994 - protein, 108 aa, Sorghum bicolor
  Clone ID: 14328547.pep
TRIDSIPSASLDAIKEWLDTTDLKYYESRLNLNWRPILKTIIDDPQKFIDDGGWEFLNMEASDSETEDTEESDQGYVPSDAEPESESEDDDSDSESLVESDDDDEESD

SEQ ID NO: 53995 - protein, 118 aa, Sorghum bicolor
  Clone ID: 14328573.pep
TRQSVVALSTTEAEYMAICEACKELIWLKGLYAELSGVESCISLHCDSQSAIYLTKDQMFHKRTKHIDIKYHFVRDVIEEGKLKVCKISTHDNPADMMTKPISVAKFELCSSLVGLIE

SEQ ID NO: 53996 - protein, 115 aa, Sorghum bicolor
  Clone ID: 14328595.pep
AAALSLFCSAQISNMPPSLAPPPPPAADHKAWPRQQRHAEKKKKAAGSPAPRRASFHGRGTSEQEEQQRQQRDHHLLRQRPRTHPDLLLLAGVRERGFRRAGVGHATTTPAMLLS

SEQ ID NO: 53997 - protein, 55 aa, Sorghum bicolor
  Clone ID: 14328647.pep
PPPDTAASPSGPMYKLCIPSESSRQSQKHAKLSPIVRSISLPLRPAPDGYSRPRA

SEQ ID NO: 53998 - protein, 76 aa, Sorghum bicolor
  Clone ID: 14328649.pep
QIKRISIISESSIEDMTESNSSSIALPLSHLLLFLFCRAVPSRTLLHVDSAGAALRHNATSSLTCTDTDTATLSHI

SEQ ID NO: 53999 - protein, 164 aa, Sorghum bicolor
  Clone ID: 14328659.pep
TRLGFVRGDQYAIALALIEDGEVILGVLGCPNYPMKKEWLNYHQKYYRLMSKVAPPPLGSWNKGCVMYAQKGCGQAWMQPLVHDFGKLNWHHPREIQVSSISDPISATFCEPVEKANSSHSFTAGLAQSVGLRNQPLRVYSMVKYAAIARGDAEIFMKFARAGY

SEQ ID NO: 54000 - protein, 42 aa, Sorghum bicolor
  unsure (1)..(42): unsure at all Xaa locations
  Clone ID: 14328678.pep
MMSCSCGSSCNCGSSCKCGKKYPDLXEKSTAAHATVVLGVTP

SEQ ID NO: 54001 - protein, 150 aa, Sorghum bicolor
  unsure (1)..(150): unsure at all Xaa locations
  Clone ID: 14328688.pep
MYEEKIFLKRYKLEQDLLLKTYHEMLREASESERPELRQKLDDLLFNEERPYDRIRLGLPGWKSRFFREYFGAETSNEIGKLQNDMAQKYLEGLCWVLQCYFADVPSWSWYYPFYVAPFVSDLXGLSRVDISFTVDKPLRPFDQLMAVLP

SEQ ID NO: 54002 - protein, 48 aa, Sorghum bicolor
  Clone ID: 14328689.pep
ARGRELEAELRKMAPPNGRTVLIFRAPCCCPKGRMEVWGAKKVRRIKK

SEQ ID NO: 54003 - protein, 185 aa, Sorghum bicolor
  Clone ID: 14328692.pep
ARGSNGSLDKYLYCQESKGTLNWAQRLGIIKGIASGLLYLHEEWEKVVVHRDIKASNVLLDSGMNGRLGDFGLAMLYDHSANPQTSHVVGTIGYLAPELGRTSKATTLTDVFAFGVFVLEVICGQKPIMQDSDDNQIMLVDWVVEHWNKTSLVDTVDAKLQGDYNADEACMGLKVGLLCSHPFPE

SEQ ID NO: 54004 - protein, 109 aa, Sorghum bicolor
  Clone ID: 14328713.pep
IRGSNNGSMKNNPNAHHVDFLGQESFDHFSRTSLFCEGTTSGDLGNVGSPTRQLKYQSTSLDPEITERPPEQPVGVMENTLKAKLLQARLEGRHARLKAAGGSSTSRRK

SEQ ID NO: 54005 - protein, 158 aa, Sorghum bicolor
  Clone ID: 14328722.pep
WSAVAGAAHQIPQKLANLWRWLQAAAPVALPYVLAVAAVVLVATLVWFCWPVLLEASVGVGKALVIGACFFVQGLLHVGRAVLSVFVFLLPCLNCAVVTMKAPGAAGIRISRAAFEAAPALFFQILRSAPTIVAATVFCTKTVALLVAFPVAALFGAR

SEQ ID NO: 54006 - protein, 141 aa, Sorghum bicolor
  Clone ID: 14328737.pep
FSVLQVEGKQYLSEWGCGICQAKCNSVSQFENHCSSRGHQQKVEALRKGGQIASSSGSKTAKCASSEETEIHRATYFCKLCYLHCNSKNTLAEHRKGKKHTEKVEQRMSLSFCEICNLQCNSEKMLAHHRTGKGHLSKLNN

SEQ ID NO: 54007 - protein, 100 aa, Sorghum bicolor
  Clone ID: 14328743.pep
LPGSKRKCPHFKSNEEDVELSDSFTRSVHLTPIKRLKESHDARYGVGESHKVIHFSSSSSDYHEETHLHNSRGCLQNSPCNVEDALSKGFEGCISMKCPF

SEQ ID NO: 54008 - protein, 123 aa, Sorghum bicolor
  Clone ID: 14328762.pep
PEKVKASNGSFLKHSDVDSSKAPVVELLGEFMCANSSRGRSIKRLNQNAGDATVQELLEHLGKDEDVEKMQVHSSIIQSPSVQGAKKEQEKSVRLEKTDATPTPLTPTPLRRSSRLRSKVTSP

SEQ ID NO: 54009 - protein, 168 aa, Sorghum bicolor
  Clone ID: 14328772.pep
AGFALQVGKALAKDGTFVECHLFNPPSVSLGTGLRKIQEKASSVLKRYISRSSSSSSSNVSPGEELQAASQVEVGEEELNNEVKRWVPNLYINSSDYICCFYADRSGVATVTTEKHSGVHSKLYVIAKGPSKFLEAHGLQQWWSDDSELHLAVHDSKLMYRHLKSLYV

SEQ ID NO: 54010 - protein, 143 aa, Sorghum bicolor
  Clone ID: 14328773.pep
IAKAIQRSRARIAAAQQQSQRIEQSPQSVNVTTPAQAEQDAPHIAEASHAVASGSGSTERETVANPATVLADDNLNVSSSPAESSLNTPSKPMDPALADIVEKKLSSSIEKIEKLVRKNMKRTPKAARASRRATQRRNLMSMR

SEQ ID NO: 54011 - protein, 129 aa, Sorghum bicolor
  Clone ID: 14364980.pep
MRPALATPAAIRSASSIAHLSRRQTCSFATRCLASHTTATSAQLLSPRRTAANNNTAIAAPARLYTQLGNYRMASSTAFSKIKVKNPVVELDGDEMTRIIWQSIKDKFIYPYLDIDLKYYDLGLEYRDK

SEQ ID NO: 54012 - protein, 91 aa, Sorghum bicolor
  Clone ID: 14364992.pep
YSFAVCCSVLLVVLLLLTMDAGTYSISSEKSHKAAKAAAAPRPPLQEAGSQPYMPSLSTGSRNPSAKCYGDRFIPDRSAMDMDVAQYLLTG

SEQ ID NO: 54013 - protein, 87 aa, Sorghum bicolor
  Clone ID: 14364997.pep
SYCNQNIPRVYADVYLPFEDQTLMLRCRGKSWEVRCVIKKDKKRVKRLMKGWKQFARDNKLRLGDLCLFELLENTKYTMNVHVIRAK

SEQ ID NO: 54014 - protein, 105 aa, Sorghum bicolor
  Clone ID: 14365012.pep
SGSRDDRQKREQQREEKELAKIAQLADAHRKQQQQQHQEKQEKSETEVVAPKNMAAPRNQDQRGTLKFGFSKMAPSKVQVGNASKKPKVATKVSSVFGNESDEDS

SEQ ID NO: 54015 - protein, 89 aa, Sorghum bicolor
  unsure (1)..(89): unsure at all Xaa locations
  Clone ID: 14365022.pep
XGQVTLYYQEFPPSLKNTATGMVAMIVALGFYLSTALIGIVRRATAWLPDNMNASRLENLYWLLAGLVSFNFGYYMLCARLYKYQNVGK

SEQ ID NO: 54016 - protein, 72 aa, Sorghum bicolor
  Clone ID: 14365024.pep
QRCSVTPKKTTCNMWNNSLTPITATCCKQLTLILVRHEIIPFPILEHVFIPGHIPPYILPESPKRVDHPNNN

SEQ ID NO: 54017 - protein, 85 aa, Sorghum bicolor
  Clone ID: 14365026.pep
KTFFALSNWRFSRKIAPASTQDTSYVTTLKLTTSLTVRIPGATKQKDRRQISYSIVIIYARSSKGDRCLKILYFHQSVRGLQQIC

SEQ ID NO: 54018 - protein, 69 aa, Sorghum bicolor
  Clone ID: 14365032.pep
VILILTLVILCFQRMCALTKMSEYRKKYTTTEMAAAIGICEDMKYNLAQCRYISQIHESFAQHCINCSL

SEQ ID NO: 54019 - protein, 73 aa, Sorghum bicolor
  Clone ID: 14365040.pep
RSRYDCSLAFMNSNEMSMTQSCKLYSMYLNRKIEKKLPHIDTMNRSLGSLPHLQRKRELHLRLIISLATRVSR

SEQ ID NO: 54020 - protein, 136 aa, Sorghum bicolor
  Clone ID: 14365046.pep
IHAVVIQQAEEQKQKKRSESAFKEFEKKAEELRSLESKYGSYIGAEGYREMSRKSPVADKRAKVEALRSRADEEKSKYEKSIGVTRAMTLNNLQTGFPNVFQAMTGFASVCMEAFESVYNFKRSSDRILDVKRLLT

SEQ ID NO: 54021 - protein, 80 aa, Sorghum bicolor
  Clone ID: 14365056.pep
FFLVQRRAGLAVYIENKRNVKEAACKPSAQYWTAHAVLHLWSEQRLQVTSCEVLMLVYVCIYVYGCRLNLLVTILSIDKL

SEQ ID NO: 54022 - protein, 159 aa, Sorghum bicolor
  Clone ID: 14365080.pep
ARGLQGMLMEVNLGEGRDKMFWALEQSRKYTSGSLYRAITFGGVRDQRLMNVWKCNIPLKVKIFIWMAAHDRIQSGVQLKKKQWSGPEECAACDNLETTDHILFQCPLAVYLWSFLRVSLNWSASPTNCTDFLMEFAEDCRGAKRKVTLFICAGALWTI

SEQ ID NO: 54023 - protein, 75 aa, Sorghum bicolor
  Clone ID: 14365094.pep
MESRRQWGKAHQEAVGGGGGGGHRVDLDEEDDLEEFRLPMSHRPTENLDTEGLEQASVHTQLTASNVGFRLLQKM

SEQ ID NO: 54024 - protein, 69 aa, Sorghum bicolor
  Clone ID: 14365095.pep
MKMGADPSTQDAMVEAALKAKHAAERKFHACNIKGARRSAIKAHNLCPSLEGISQMISTLDVHVASESK

SEQ ID NO: 54025 - protein, 165 aa, Sorghum bicolor
  Clone ID: 14365101.pep
HEAAFYPTSMHEVQLQKALRSFGSMVKGPAVRVFLKKLEDECRAIWESGRQQCDAVSLTGRPCKHRRHGDFSSSDAMKQHSSGYVFLHACACGRSRRLRDDPFDFETANVSFNCFQNCDDLLPTLALPRGSDAGSFSVSSWRLVRLGGARYYKPTKGLLQSGFSS

SEQ ID NO: 54026 - protein, 180 aa, Sorghum bicolor
  Clone ID: 14365102.pep
METNVPEEKRTSASRQGLHVDHESLQQPQSDHRRKGGWITFPFLGAAMMGLGVAMSGVLSNLVVYLIKEYNVPSVDAAQISNIVAGCLSLAPVAGAVVADAFFGCYPIVAISMAFSVLSSVVFTLTASLRGLRPAPCHLGAGSPCEPASAGQMAALYAGVFLMCVSAAGSRFNQATMGAD

SEQ ID NO: 54027 - protein, 124 aa, Sorghum bicolor
  Clone ID: 14365111.pep
NVKKNLGKFTPEARFSFVRVEQQQYVTGGNESDALDKDDDGESQPGKEEGVLVGLPLPQLLLRGPLPNDAPDRGHCLLLLLEDGRASCRPAADYGRRRLQHLGVLDLAAALPSPSQARRTEPSC

SEQ ID NO: 54028 - protein, 149 aa, Sorghum bicolor
  Clone ID: 14365119.pep
HEGPGRRRQPAGLLPLQHPQTYRHTSSPRCLPISRPGAIPSAPVSASASSPTRTTTATTWSSSSTPPPPSTNSTGSSSTPPPTAGGSSGGSTCHRPAACATPSPRPACSPTTAASGGSPSPMACSSATPARPDSSVPSCASSRSRTTAR

SEQ ID NO: 54029 - protein, 171 aa, Sorghum bicolor
  Clone ID: 14365125.pep
TRLEAVSRCKARRRYTKHLVQARRDMAAAHALYLRALRATGASLLHFASAESDHPHPHSSAAHHHHGPPPSPPPPATPPPPPPPPPPPPPLSPSPTTRSWTTNSSSISASTILPPPPPPPMPSSWDFWDPFAPSSSRSATEDADWDDAATTVVDAPIAAAAPPVVTAAAAV

SEQ ID NO: 54030 - protein, 185 aa, Sorghum bicolor
  Clone ID: 14365137.pep
TRGNPAVKTTTGGWRSAILLLANYGLATCAFFGVGVNLVVFLRRVLHQGNAEAANNISKWTGTVYIFSLIGAFLSDSYWGRYVTCAIFQIIYVTGLVILSLASWFLLVKPSGCGGVKVHCDEPSAPGVALFYLSTYMIAFGNGGYQPSIATFGSDQFDETDPKEGRSKVAFFSYFYLALNVGSLF

SEQ ID NO: 54031 - protein, 78 aa, Sorghum bicolor
  Clone ID: 14365139.pep
MARRALEPAAVLLVLAALAAVAAGGDITHQDDDAPKIPGCSNDFVLVKVRTWINQKDKIEFVGVGARFGPNIESKEKQ

SEQ ID NO: 54032 - protein, 156 aa, Sorghum bicolor
  Clone ID: 14365147.pep
TRLLLASFSAAPTAAAARPSSTPKKPAAAFPAAVAPLHLQALKRHQRASSSIRAGGELFVAAAADGTANGTAAKKPFTVHYFAQELDHFTFTPNASMVFRQKYLLNDTFWRRPSAGDGDGAGPLFVYTGNEGDIEWFATNTGFMFDIAPKFGALLV

SEQ ID NO: 54033 - protein, 208 aa, Sorghum bicolor
  unsure (1)..(208): unsure at all Xaa locations
  Clone ID: 14365161.pep
SESGCVEAAKMGYISPKLYELMRVFLSFSDSDNVRCLIFVDRKISARVIERTMKKIGRLSCFRVSFLTGGSSSVDALTPKMQKDTLDSFRSGXDVAEEGIHIPDCSCVIRFDLPRTTRSYVQSRGRARQRDSQYILMIEKGNVKQSDLISRIMRSKTSMTEIASNREPEDSHRNFFPIEEINEYHISTTGAKITTDSSISVLNQYCDK

SEQ ID NO: 54034 - protein, 154 aa, Sorghum bicolor
  Clone ID: 14365220.pep
MVGNEEVRGWGSGDVSHQLDQHDQAFCKDDEMLDDDDTDFGSSLGPIVSWDRMAAECEDRKMLMGDSPKCDKWMLKDDVGDFDAKSILNCGDDDGVEDSKVIKPLMHDDTMVTDPSLVGIHVEGFYTGPKWYDSPGLDSSVDGGDSSFRHGGIV

SEQ ID NO: 54035 - protein, 185 aa, Sorghum bicolor
  unsure (1)..(185): unsure at all Xaa locations
  Clone ID: 14365277.pep
ARGKDTALAFSGQKLIQVEEPDAQVDLVLNSAGPALVGELFTVPVTIESKGHAVHSGELKINLVDARGGGLLLSPREAEDSESHHVELLGVSTASEDKESKEEADSIRKIQYSFGVISVPTLSVGDSWSCKLEIKWHRAKSVMLYVSLGYSLXSSEEEALHRLNVHRSLQIEGQIPLLISHQFLR

SEQ ID NO: 54036 - protein, 172 aa, Sorghum bicolor
  Clone ID: 14365298.pep
TRVDCPPNMQLMAEAGILEALTKYLSLSPQDATEEATTELLGILFSSPEIRHHESALGVVNQLVAVLRLGGRNSRYSAAKALESLFFADHVRNSESARQAIQPLVEILSTGMEREQHAAISALVRLLSDNPSRALAVADVEMNAVDVMCRILSSDCSVELKGDAAELCCVLF

SEQ ID NO: 54037 - protein, 168 aa, Sorghum bicolor
  Clone ID: 14365299.pep
HEAESFIRVCVAACPVCKAAPAGQPDSVISSPGRGKRRRRFEYTETLDVPARDVPRRLQQLAAKHKVVLCIRQKYIRYKPFMAEVKDYACHRAGVPTSNSGNASSSASNSEGKKARVLKREPYQSKRCGCGFRIRAIVPIANYNEKDKTFVYLEEGTAVFKLFAVHSG

SEQ ID NO: 54038 - protein, 146 aa, Sorghum bicolor
  Clone ID: 14365300.pep
ARGRGTTTMEVRADGVAVITISNPPVNALSLDVIASLQRNYTEALSRNDIKAIVLTGAKGRFCGGFDISAFGKKPKNEKPGSMSIDFLTDIVEDAHKPSVAAIDGIALGGGLELAMVCHARISTPSAQLGLPELQLGIIPGLGGTQ

SEQ ID NO: 54039 - protein, 152 aa, Sorghum bicolor
  Clone ID: 14365311.pep
MACSSSRLAEASLLLLVVILLAAVGACASAEAEMSAKTIAAVATRRKLDDVVTTTSSSGSSSPSSSPSPAAGGGAEKKESKDDNGNKEKEKEKPKGGATSTKKPPPPLPAKCVTSKDCHLKRLVCAKKCTMAAHKKCAAKCSHSCNALPICT

SEQ ID NO: 54040 - protein, 105 aa, Sorghum bicolor
  Clone ID: 14365335.pep
AVVNGQLFRGVLFAPGPGVTAPRPTVHHQILTSSAVPPQQQRPLLAHAIPVHTRPVPQATGFVLPDCAPHARQGFPAKPAKSEPERGSSDLHDVVLTLGGPGGGK

SEQ ID NO: 54041 - protein, 151 aa, Sorghum bicolor
  unsure (1)..(151): unsure at all Xaa locations
  Clone ID: 14365344.pep
GFVVALRARDNSGYHVARQRVVGGGGWILDVVSTTTNRDPAAQFLVTFKNKVRLXAYSHRSFLQFSCLLRFYAHVGTDKTCTFQDTMGLRSFVAGGKLLQINRKMEFVFASHSFDVWESWMLDGSLLEGSKLINCRNPSVCTFLIVILLRS

SEQ ID NO: 54042 - protein, 51 aa, Sorghum bicolor
  Clone ID: 14365350.pep
ILRAKRLAAAREAPYAKSRTQFTRDVQMTKHQRTHESVRSSNNESSPHLLS

SEQ ID NO: 54043 - protein, 53 aa, Sorghum bicolor
  Clone ID: 14365357.pep
DFHHLPARLVCLSRVFLCMLCVWLFSCTLSIFLTIFIYSKHHGSMIPLLSWMP

SEQ ID NO: 54044 - protein, 119 aa, Sorghum bicolor
  Clone ID: 14365372.pep
QAVAIIQPKHAAKANVRWCAYTWSWHWWPGAATTVSAATAVSAAAAAAAEACCSRRCICSSLKFRTRMMMDQTGPVFPKSIPSPCKVTCTGVRAVEDVRMIVLFILNFELIVASSVSGR

SEQ ID NO: 54045 - protein, 72 aa, Sorghum bicolor
  Clone ID: 14365398.pep
LGESMMNEMDLHVGFTILCCVDLVPHVEVNKCYMLSFFIFFGVLLDDVNVQCLVDFVLFFPPAVNKTNANCA

SEQ ID NO: 54046 - protein, 53 aa, Sorghum bicolor
  Clone ID: 14365400.pep
GEKKKSRQKPIIHFLGGNFRAIHSFKEFGGCASSFLGRIIVAIHSGTRRGIQT

SEQ ID NO: 54047 - protein, 156 aa, Sorghum bicolor
  Clone ID: 14365413.pep
MTPYVQLVSEVILPAVRISGTNSWEAREPEPMLHFLELWDNKKLLPPVLLQSILEHVIMPKLSAAVDSWDPRRESVPIHVWVHPWLPMLRERIETLCHSIRYKLSTVLHVWQAHDASAYAVLSPWKDVFDSASWEDLIVRYIIPKLRLALQDFQIN

SEQ ID NO: 54048 - protein, 201 aa, Sorghum bicolor
  Clone ID: 14365421.pep
HEATMTWSTPEVKAPPAPRDSHSAVAVGSRLFVFGGDCGDRYHGEVDVLDVDTMTWSRFPVKGASPGVRAGHAAMSVGSKVYIIGGVGDKQYYSDVWVLDVTNRSWSQLEVCGQQPQGRFSHTAVVMNTDIAVYGGCGEDERPLNELLILQLGSEHPNGRYNISMCKVLSNHWSQEKRKFLRSETKDASVSNGKMVQKPRE

SEQ ID NO: 54049 - protein, 152 aa, Sorghum bicolor
  Clone ID: 14365422.pep
TRPHQADLALAKVDATEETDLAQRYDVQGFPTILFFIDGVPKDYNGARTKDAIVDWINKKLGPAVQNVTSVDEAERILTGDDKAVLAFLDTLSGAHSDELAAASRLEDSINFYQTLTPDVAKLFHIDAATKRPSIVLLKKEEEKLTFYDGEF

SEQ ID NO: 54050 - protein, 173 aa, Sorghum bicolor
  Clone ID: 14365427.pep
MDAGEMEDVRAAAAAEEVISSRGGSVLGKKTILKSDHFPGCQNKRLTPQIDGAPNYRQAGSLRVHGVAMPTMEGIANVLNHIGAHKKGKQTRILWHSLREEPVIYINGRPFVLRDVERPFSNLEYTGINRERVEQMEFRLKEDILQEASRYGNKILVTDELPSGQMVDQWESV

SEQ ID NO: 54051 - protein, 155 aa, Sorghum bicolor
  Clone ID: 14365430.pep
ARGLLLCLGSADRAADAAVAADLGLRLVHVDANRAEEVADTVMALILGLLRRTHLLSRHASSAPAAVAAGWLGSVQPMCRGMRRCRGLVLGIIGRSAAARCLATRSLAFRMSVLYFDPRYVVSGKTKRPSIVFPSAARRMDTLNDLLAASDLVSL

SEQ ID NO: 54052 - protein, 112 aa, Sorghum bicolor
  Clone ID: 14365431.pep
ARGTLLKNLGSVAKSLEPKELCKLLEAYQSLQNGSNAGTSGTANVAEEAAGPSNSKLPFVNGSHCGQASSSVVPVQSKATMVVTPEPASCKLKDFDLNDTCNDMEGFEDGQE

SEQ ID NO: 54053 - protein, 152 aa, Sorghum bicolor
  Clone ID: 14365436.pep
MDVTPNKNYSVWLHFAEIDNGVTAEEQRVFDVLINGDTAFKDVDIIRMTGERFTALVLNKTVAVSGTTLKVILQPVKGTRAIINAIEVFEIIPAEKKTLPQEVSALRTLKGSLGLPLRLGWNGDPCVPQQHPWSGVDCQFDNTKGNWIIDGL

SEQ ID NO: 54054 - protein, 99 aa, Sorghum bicolor
  Clone ID: 14365442.pep
ARGDDPSQPAPGHPHPLLHGRPCLRAAPAALPAPPQLYLIASATKCSAVSDHPRLALLQSPDLARPRMDKPALASGRTVLRLTMVANPHVPASSPGIQV

SEQ ID NO: 54055 - protein, 153 aa, Sorghum bicolor
  Clone ID: 14365443.pep
TRPQHPSGPDKLLPQHMMNPGHKHGFSENNRPPLQQPYGLFHSGTIPRPFGENQIQMPMSQPGGIRPGDGIRPHVVGALPGHHGAVLPPFDLERLGQPHLLGMLNSNDFGGERFNTSGGAAYPGRHDNIKDDRKHFPAPAPLDGQGLQRDPRH

SEQ ID NO: 54056 - protein, 62 aa, Sorghum bicolor
  Clone ID: 14365447.pep
MWRLKIAKGGPWLKSGNSHIGRETWEFDQDFGSKEEREAVDSAREEFKKNRFQMRHSSDILA

SEQ ID NO: 54057 - protein, 134 aa, Sorghum bicolor
  Clone ID: 14365453.pep
MARLFATESVGFRARALYGVYAVTVSVGICLVLYCRAAGVLRRSAAAGEAGSQAWLWLGMLAAELWFGLCWVVAQSVRWRPVRRRAFRDRLAARHGDKVPCVDIFVCTADPRSEPPILVVSAVLSVMAYSYPAD

SEQ ID NO: 54058 - protein, 210 aa, Sorghum bicolor
  Clone ID: 14365456.pep
ARGLNQAPDISLEGLTPVGPMASPAASQMSNMANPTKVIKISTRGRKNKGLKMPAGHSGPGGPWSSFEDQALVVLVHDMGENWELVSDALNSIIQLKCIYRRPNECKERHKLLMDKSCDGADSADDSGSSQHYSSALPGIPKGSARQLFQRLQGPFEEETLKTHFEKIIFLGQKLHQTRRKGEIQELRQINPLHTSHFALSQACPGNLSG

SEQ ID NO: 54059 - protein, 97 aa, Sorghum bicolor
  Clone ID: 14365463.pep
ERPTSSFHRRATPRISLSSSSPLPFIRVAQTGDPTSVICFIGSFGFVSDPALIQPVRGWIQLLGYLGGGCSARSSLFPGNISGVRRCPCHGIRQYQI

SEQ ID NO: 54060 - protein, 135 aa, Sorghum bicolor
  Clone ID: 14365468.pep
MVELTPRGNGCCPRVLSVSLLLLLLAALLPSTHVSSAAAAAAITRGDFPEGFVFGAGASAYQVEGAWAEDGKKPSIWDTYTHSGYSIDHATGDVAADQYHHYKEDVKLMHDMGLDAYRFSIAWSRLIPDGRGAVN

SEQ ID NO: 54061 - protein, 130 aa, Sorghum bicolor
  unsure (1)..(130): unsure at all Xaa locations
  Clone ID: 14365469.pep
MADEPRTTAAATPSSRMPDFKQSVKLKYVKLGYHHLISHGAYLLLAPLPGLVAAHLSTFTLRDLADLWQSLQYNLVSVLVCTTXLVVVATAYALTRPRPVYLVDFACYKPDDERKCSRARFMNCTESLGT

SEQ ID NO: 54062 - protein, 92 aa, Sorghum bicolor
  Clone ID: 14365470.pep
MALARILLLLLVTVASLLPPIASQQAAATKCEYRKHSGHRYRHPVGVRKIVVDASGAGDFVSIQQAVDSVPEGNTMRVIMQINAGTYIEKVV

SEQ ID NO: 54063 - protein, 189 aa, Sorghum bicolor
  Clone ID: 14365480.pep
TRLPLALTWVPTSNSITNGFCVQKNIGVDSQPGKAVLRIHETACYVNDAKMQGFLHACAERHLEKGQGIAGRALKSNLPFFSPDIREYSIEDYPLAHHARKFGLHAAVAIRLRSTYTGNDDYILEFFLPVNCKGCGEQQMLLNNLSSTMQRICKSLRTVSETEIENVRATAPMCEKTNGSCLPTGNSES

SEQ ID NO: 54064 - protein, 180 aa, Sorghum bicolor
  Clone ID: 14365484.pep
SRRIYFSKKDGDDGGSDTSEAGESAAVAAPKWPYYARRVSHDEGFLLGLMREGGVDYRSAPRPAGRLLVDMLSTLLTLWVSLVPMMWFIQRQMSGGGSADKRRKPRKQMVGFDDVQGVDEAKEELVEIVSCLHGSLNYKKLGAKLPRGVLLVGPPGTGKTLLARAVAGEAGIPFFSVSAS

SEQ ID NO: 54065 - protein, 71 aa, Sorghum bicolor
  unsure (1)..(71): unsure at all Xaa locations
  Clone ID: 14365490.pep
QSSMASRAITRRRKYLFDHVKTLNLSSSSSTFQHGRIGSEAEPRIALRFLEQSSGDSRSEKEQYSVNLTXR

SEQ ID NO: 54066 - protein, 72 aa, Sorghum bicolor
  unsure (1)..(72): unsure at all Xaa locations
  Clone ID: 14365517.pep
TNVEARRGTLQSDQELLSTPGAPTAXIVGRFAGSQKEFFKSFTRSMINMGNIQVLTGSQGEIRNNCRVVNGS

SEQ ID NO: 54067 - protein, 91 aa, Sorghum bicolor
  Clone ID: 14365536.pep
MDQLLKAFRSSRMASQEPHQLYPPGRIMHMVELPEPEELSTGEQCHQNEVVAIYETPRSMYGKIRLARTMIRDHYMPRYIETMEMLIDKLA

SEQ ID NO: 54068 - protein, 76 aa, Sorghum bicolor
  Clone ID: 14365553.pep
PIFEHPQTYPYGGISCPPLVKIQNETTQHRRLMRVSSKTISPQLSTQFHRKYKSEGKKNSIAVAATTFTAPAPNPK

SEQ ID NO: 54069 - protein, 67 aa, Sorghum bicolor
  unsure (1)..(67): unsure at all Xaa locations
  Clone ID: 14365560.pep
MQKINKEKKKXXRGLGGREQDGWTWSTGKSKTSWLLLLFGSFSDHWTNLGKTTCVMLLNTQVRNVRC

SEQ ID NO: 54070 - protein, 73 aa, Sorghum bicolor
  Clone ID: 14365569.pep
VCDRPEQDQPCRVPLCSHFTAKMQTEKADKTWRLLVKKVTRARAMAGLANRQVPEVVAMSWAKYSTSSKWARN

SEQ ID NO: 54071 - protein, 123 aa, Sorghum bicolor
  Clone ID: 14365570.pep
IGLVRKIMQSIGFMGPCVSLLCLRFAQTPSVAAVLMTTALSLSSFCQAGYFCNIQDIAPKYAGSLHGLTNGIGTVAAIVSTIGTGYFVQWLGSFQAFLTLTAALYFSATVFYNIYATGDLIFD

SEQ ID NO: 54072 - protein, 144 aa, Sorghum bicolor
  Clone ID: 14365575.pep
GFCTDEVPMMHPDEIMVPVLGDQRLHTPPLPTFSPATAAAAAAAVSTTPTTTTSSSAAASAASSSSLISRDEDAALFPLIDMDFPEIVFRMGLDDMVASWDDSLAQPPLSPSLPVYEDSAYQLQRSGVAFDQEPGNKIQLFSSY

SEQ ID NO: 54073 - protein, 94 aa, Sorghum bicolor
  Clone ID: 14365594.pep
EICTSSDVLSEQIEFEIICVLLSSVNAPLCTAISSTASAPPGTKECLVSLLSAFRPFSCFYAFCPFSCFLMPTKDLIHLDEIPMILPASLSLTQ

SEQ ID NO: 54074 - protein, 208 aa, Sorghum bicolor
  Clone ID: 14365599.pep
ARGLLEELFRAIELWLRIAKEQVPLVDPTLDPVLLVPGIAGSILEAVDEEGNKERVWVRILAAEHEFREKLWSKFDASTGKTVSVNEKTRITVPEDRYGLYAIDTLDPDLIIGDDTVYYYHDMIVEMIKWGYQEGKTLFGFGYDFRQSNRLSETLDRFSKKLESVYTSSGGKKINLITHSMGGLLVKCFISLHSDVFEKYVKRWIAIA

SEQ ID NO: 54075 - protein, 65 aa, Sorghum bicolor
  Clone ID: 14365613.pep
RASYEEGGNGQRVWLLLMEMVPMEREPKGIDVCDNASVLAELNAPKQPALTVTSLGRWVWWGGLV

SEQ ID NO: 54076 - protein, 40 aa, Sorghum bicolor
  Clone ID: 14365622.pep
IMDTNGVVHQTVSHDLESVSAILKWLNYVPPYDGGPLPIM

SEQ ID NO: 54077 - protein, 182 aa, Sorghum bicolor
  Clone ID: 14365628.pep
TRHSGIGLKILWLDLLDESSCFPYIDGWLKVAVTPGIEELNLRLPEKHNFPCSVLSAGVGNSIRSLLLASCAFRPTAELGPFRSLTILRLCSVCITGDELECLLSNSLALKHLHLTECNEIISLKIPSVLQQLSLLLVDGCFPMQIIENKAPSISSFTLSRVLPKLELGKALQMMKYLQLNF

SEQ ID NO: 54078 - protein, 172 aa, Sorghum bicolor
  Clone ID: 14365629.pep
HEVLGGSQHPYPRRCRTGRHPTEKDPNSESRLFLLNLNIYVPRDERFGHLKMSDFLGYSLKAIVEAVLPTLGTFVDDTPKEFDSFEDILGLYELGPEAPNNPLVAEVRKRIPSEFLRSILPNGSHDHPLKMPLPNIIKSDVLKKAPEFKFGWRTDEEFARETLAGVNPVIIK

SEQ ID NO: 54079 - protein, 86 aa, Sorghum bicolor
  unsure (1)..(86): unsure at all Xaa locations
  Clone ID: 14365647.pep
SVGAATNKPFHQGGLHXRDALIEHPDRAPACKYVYQQHQHVIVFFFXGGWVQWGLELLCFIETESSTKYTTQIKACVKCEWYMQLK

SEQ ID NO: 54080 - protein, 197 aa, Sorghum bicolor
  Clone ID: 14365655.pep
ARGLAALLGVSVLYDSAHIAATLRRHGGGPTTYAKLSSSDDGATAVSGVAREEAAAAAVEALAPPARAAESAPVDGADWADPPPHERQEEVAAKPGATAGSSLQDAPLIEEVVQGGGGGHGDGAAQEQSPGTCDLYKGRWVYDESRAPVYKESDCSFLTEQVTCTRNGRRDDDYQKWRWQPDGCDLPRFDAKLLLEK

SEQ ID NO: 54081 - protein, 151 aa, Sorghum bicolor
  Clone ID: 14365656.pep
ARGTIAVLGVPSDAVLAFLHLLYSSDAAALARSRRLVAPGAEDLVAAHGPQLLALAHAYRVGWLKRAAEAAVSARWLTADRAVDMLKLARLCDAPRLYARCARLAAKDFAAVEASDGWRFARRHDPALELELLQLLEDADTRRARWARARA

SEQ ID NO: 54082 - protein, 93 aa, Sorghum bicolor
  Clone ID: 14365657.pep
MCSASFDGVRPAAGAGAAVASAVQPVPAAFPERVKVVALVAAIMLLCNADRVVMSVAVVPLAAQYGWSSSFVGIVQSSYLWGYVFSSMVGGAL

SEQ ID NO: 54083 - protein, 118 aa, Sorghum bicolor
  unsure (1)..(118): unsure at all Xaa locations
  Clone ID: 14365662.pep
HEGTAEEDQKLVSFILGNGQCCWRAVPKLAGLLRCGKSCRLRWTNYLRPXAXKRGLLSDAEEKLVIDLHAQLGNRWSKIASHLPGRTDNEIKNHWXNTHIKKKLKKMGIDPLTHKPLC

SEQ ID NO: 54084 - protein, 207 aa, Sorghum bicolor
  Clone ID: 14365664.pep
TRHIRAAVALHRPQTWDTACVLSQLQEDLTSSSKSAVRKWDVTAGAKPFTRAAYPIPPPPPRVDKLPAPPELKPQPGRVLTADDRWAALRATRKAQGLCYKCGAKWSRDHKCPAAVQLHVLEEMLELFSVEDSSSPTDWTPDDEPAQLAMLLSAAAVSGVTAPRTMSFEGMLGDTPLRILLDSGSTHTFLSASVAAQSPALSPLPVP

SEQ ID NO: 54085 - protein, 129 aa, Sorghum bicolor
  Clone ID: 14365741.pep
SAVVGDLLANPLGFGARRLRAATGHGDEYARSLLDYLETADLAALPRGGLAGTDLRVISWLGMPSYDADFGWGEPALLAPALMYYPGFVYLLNCPGNGKGGGVAVAVALEPERMERFKELFFEELAALE

SEQ ID NO: 54086 - protein, 57 aa, Sorghum bicolor
  Clone ID: 14365789.pep
MTFCSQTVQDRLFKAGYLESKAFHQRWGETFQIKRLSMLADVLGGGEMAMACERIDG

SEQ ID NO: 54087 - protein, 97 aa, Sorghum bicolor
  Clone ID: 14365844.pep
TPGINLRWFLDVAGKKNSKAYIVNGVAMFITWLMVRIVLFIYLFYHILTNYDQVKQMDTFAWVLISVAPPILFTMNVIWFSKIVKGLKKTLAKRHAE

SEQ ID NO: 54088 - protein, 64 aa, Sorghum bicolor
  Clone ID: 14365888.pep
TTQRIIVLKQMHLQFCLVCSVSLKWLASHLSGFKAAMSSNAQTMGTWFRMSELVLQNLVPDISG

SEQ ID NO: 54089 - protein, 36 aa, Sorghum bicolor
  Clone ID: 14365891.pep
KIFGCVTKQGLNITRVLTSYTKASAKPLLEGLLHAT

SEQ ID NO: 54090 - protein, 97 aa, Sorghum bicolor
  Clone ID: 14365902.pep
KCHQIVPLERFDASWCRLQNVQKLLLYLLSLTPSEYKSSSPCSSAFLTEIFLVAIILPFSFIICFSCGIIFSITFASCFPLRVISLLTKRIARISFT

SEQ ID NO: 54091 - protein, 68 aa, Sorghum bicolor
  Clone ID: 14365916.pep
SSQLRWTWVIHPCWRPCFTDLTCSIVICMYRKKIHLLPTACIQSKECNKKIELECYRENVLRKQMDES

SEQ ID NO: 54092 - protein, 113 aa, Sorghum bicolor
  Clone ID: 14365924.pep
VNSKDPKADKAKHAAEAGDDPKKRASDQAGKNTPDASNSTYKKVEMFVKEQIRPLCKSGVITVDQYKWAVVKTTDKVMSFHRDAKNANFLIKEGDKVKKLALQYVEASQQKIS

SEQ ID NO: 54093 - protein, 99 aa, Sorghum bicolor
  Clone ID: 14365925.pep
PQAVVVQIVPWGKMDWMATNFYGQPARGMNLRYLEYYVSEKESSLAQRYPRDHLVFKDPMAIHGQGWNALADIFMAQDVKLNIRRFRPTLLQVLDLLQV

SEQ ID NO: 54094 - protein, 61 aa, Sorghum bicolor
  Clone ID: 14365936.pep
QMNSRDNFQELNVLTNAGSVSHSSITQKIIFYPSTPLNKMPPTCQGDTTGSIGLLSSMSNC

SEQ ID NO: 54095 - protein, 48 aa, Sorghum bicolor
  Clone ID: 14365937.pep
MALYYMQALLLPTDIHGACSVLMTPFCFLASFSVQLRSAVDGSRGKLQ

SEQ ID NO: 54096 - protein, 108 aa, Sorghum bicolor
  Clone ID: 14365939.pep
STKAISVLHCGHTIHLECLYEMRAHQQFSCPVCLRSACNMSDIWQKLDQEVAASPMPAIYQKKMIWILCNDCGMTANVQFHILAHKCPGCSSYNTRQTRGDPAACSRV

SEQ ID NO: 54097 - protein, 102 aa, Sorghum bicolor
  Clone ID: 14365947.pep
ELTKMQKPYRYLVVATDYQRNTDYNSCNCNMTNSNTTLLFNVKQLTANFCLNRYCETAYITLPVFSCSQNMASFQMLGSCLFVQPFFCSKKPIHLRQPSSFN

SEQ ID NO: 54098 - protein, 170 aa, Sorghum bicolor
  Clone ID: 14365971.pep
ARGLRLRYPGDSSHPTWQSVGHVIKLTAQEEVALELRASQGVPTELNVGFSVDFVWKSTSFDRMQGAMKTFAVDETSVSGYIYHHLLGHEVEHQIIRNTLPRRFGAPGLPELNASQVLAVKSVLQKPVSLIQGPPGTGKTVTSAAIVYHMAKQGQGQVLVCAPSNVAVDQ

SEQ ID NO: 54099 - protein, 137 aa, Sorghum bicolor
  Clone ID: 14365977.pep
HEAAIFVKPNKKDVTAIADILTKFGEVTGLKTNFGKSSVIPIRCQGVDLDEVLCAFPARRAHFPTKYLGLPLSNTRLRRIDFQPLVDKAVSKLTVWNGKNINYAGRSTLVKAVLTSQSEYCLTSLRAPKSTLEEIDN

SEQ ID NO: 54100 - protein, 164 aa, Sorghum bicolor
  unsure (1)..(164): unsure at all Xaa locations
  Clone ID: 14366063.pep
ARGLDVIASALSNFIEMGKDVLAKELAEMFTPEEMPLFGSNSALDWANFNAQAFSDESLSFDEECSRTSSVDCGLHESPITNTASSISKITLPQSVPHVLGVGQLLESALHVAGQVAGASVSTSPLPYGTMTSQCEALGLXTRKKLSSWLVNGHESTPDNPMPS

SEQ ID NO: 54101 - protein, 138 aa, Sorghum bicolor
  Clone ID: 14366076.pep
TRRFRRAARLVRSPTKAECPLPDLGLVPPLGGWPNEHRAMATAGEPPPRSTSRSRRWWQSYSQPDPGSSIRGARRRWRLHCWLTVQPSRVLKSSPATHSPMLRAPHLLSSKDPAAKALHTCRPKLALLLIWKKAGTSL

SEQ ID NO: 54102 - protein, 141 aa, Sorghum bicolor
  unsure (1)..(141): unsure at all Xaa locations
  Clone ID: 14366091.pep
MRVIVDAAAPGLDHHRGSDLLCVVRALLKKIRRRVLVGDRXLVGAVDWTDRRGMIEDVFERRSEVADPPVANVDRLVVLFSLDQPKPEPATLTRFLVEAESTGIPFVLVFNKVELVGEQTIAYWRDRLKSWGYDPLFLSVD

SEQ ID NO: 54103 - protein, 167 aa, Sorghum bicolor
  Clone ID: 14366176.pep
TSLKKEKAEKLIREIENKCNEKISQNKHDSERYLICLKEEHGTMVARIQQDNEQKESTLRAYHKEELQRIQSQAENELRESLSLLRKEHELQIKALRMHHEEECQRMQGELELQKSKEEKQRALLQLQWKVMGESQQVDQEVNSKKEYSVSSIKRRDPYGRKEHDVQ

SEQ ID NO: 54104 - protein, 166 aa, Sorghum bicolor
  Clone ID: 14366179.pep
ARGLDVVKKFPSKVQLEEVPRQNSWPTQFQENGPTYDNIGLFFFARDVQSYENHYSKLVENMLKNDLVLRGSVGTVELLIFPSNILSKNFQRWNMFYFLWGLFRVSKKDSSNLGPNLVKSTNFAPSLEASHEVCLDGEISLNQPLCRRALDDHLDSDTKASSTISN

SEQ ID NO: 54105 - protein, 38 aa, Sorghum bicolor
  Clone ID: 14366182.pep
HEAPLRQNDTTASALSSKIYEDRMKITVQRDVSEEALM

SEQ ID NO: 54106 - protein, 189 aa, Sorghum bicolor
  Clone ID: 14366189.pep
ARGIAGLYEAWKHHGKLPWRRLVLPAARLALAFRISPYLRMQMEATRDGILGNNGTRAVYAPGGDILRAGDMCRNRRLAQTLRAVAEHGPGVFYGGAVGARLVRDVREAGGILTVEDLKRYQVKVRQPLTENVMGLEVVTMPPPSAGGAGMMLVLNILDQFGIPAGFAGSLGIHRLIESLRHYMAVKMN

SEQ ID NO: 54107 - protein, 80 aa, Sorghum bicolor
  Clone ID: 14366194.pep
MDKIQSDCPYPGCFFCVMKEANPSKRRASVLKFFRELPSQDDDGQVLPISGLWNTAMAHPNDPEFINLGIFECMAALIWK

SEQ ID NO: 54108 - protein, 164 aa, Sorghum bicolor
  Clone ID: 14366199.pep
TRLFSILYNKRFNVFHFPVSEEEVPDYRSIIHKPMDMATVLQRVDSGQYLTRAAFMKDIDLIVSNAKTYNGDDYNGSRIVSRACELRDVVQGMLSQMDPCLVSFCDKIALQGGPQQVVDDEDSSILQAAPVAQLVSGTRISARLRNVLPEVNLSQSYEVLKRQK

SEQ ID NO: 54109 - protein, 189 aa, Sorghum bicolor
  Clone ID: 14366202.pep
HEGYSGAGARQQQQTEAVADRVHRYRRVLMVLLSPVLLISFVLLLMPRAPASASGGGLLAVGGRRWGPRAVEDGLNKYAVIFDAGSSGSRVHVYCFDENLDLVPIGKEIELFKQKKPGLSAAKGPQEAAESLISLLEEAEKVVPAELRGQTPVRVGATAGLRALGTERSEEILQAVRELLRDKSSFKSQ

SEQ ID NO: 54110 - protein, 165 aa, Sorghum bicolor
  Clone ID: 14366208.pep
ARGWISNFLRMNQLKDEICSSWFAPVGSASDYPILAKWVIYGELVCSGSCAGPSDEISPLYSLWATFVGLYIANFVVERSTGWALTHPSTDLEDEKLKRHMKPDFLDMVPWYSGTSADLFKTAFDLMVSVTLFVGRFDMRMMQAAMKGPTDNTSNDDLLYDYFNE

SEQ ID NO: 54111 - protein, 209 aa, Sorghum bicolor
  Clone ID: 14366216.pep
HEDSWLCPRCKFNEVEHEADVILKQNFSEECMIGSDRTATNASFSGRVSVSVADEGETALVVSMVGVHSETRSGISETSLGLKTAHETFNCSSYPSHSKDALVADASSLRNTDIFSTSQNKPSETNVVHPLYPEPTETSLQFSPIREPATTIFSSEQGNMSTERLEVPKLVSSCPVVDNGKEAKSTGEENSVEQSNNELSPVTNLHNLS

SEQ ID NO: 54112 - protein, 154 aa, Sorghum bicolor
  unsure (1)..(154): unsure at all Xaa locations
  Clone ID: 14366218.pep
AMAFLVQHGKSRAVGARKPRHVARIPTKLELRHRQLAARLLPACLLAPVLCICAARLFSVVLPSQLSPGNGVYLAEGNHVISDDAEAAGALSSLQQGSVDDRHRLQEPSAQVPARLXADPVRGSPKLDIEVESSNSKHITDLDNKSGMKGLAIS

SEQ ID NO: 54113 - protein, 174 aa, Sorghum bicolor
  Clone ID: 14366225.pep
MDEAPGLLLQEEGGGRDHEPLLLPLPQDAGLYTGDGSVDVKGCPALKGTTGNWKACFFILGNECCERLAYYGIAKNLVTYLKVKLHLGNLEAARHVTTWQGTCYLTPLVGAILADSHWGKYWTIAVFSSVYFIGLAILTLSASVPALQPPSCLRTVCPEASLLQYGVFFVGLYM

SEQ ID NO: 54114 - protein, 173 aa, Sorghum bicolor
  Clone ID: 14366230.pep
TRVVTGVIIASGGEPSFHLFGFIMCIGATAARALKTVLQGILLSSEGEKLNSMNLLLYMAPIAVIFLLPATIFMEDNVVGITIQLAKKDFTIVWLLLFNSCLAYFVNLTNFLVTKHTSALTLQVLGNAKGAVAVVVSIMIFRNPVSITGMLGYTLTVIGVILYSESKKRSNKP

SEQ ID NO: 54115 - protein, 199 aa, Sorghum bicolor
  Clone ID: 14366231.pep
MAREMEKPRKATSSPNKSSTNHTGPKSPVRNGGGSPPHKKNTTEPRGRKNEQQNVRKGGHQDSLSHDESKRRSSSTAQTSPKSQRSPRHEQPLSYNRLHTEERAIRRAGYNYQVASKINTQEIIRRFEEKLAQLMEEREIKLMRKEMVPKAQLMPVFDKPFHPQRSTRPLTVPKEPSFLRLRCCIGGEFHRHFCYNGAN

SEQ ID NO: 54116 - protein, 154 aa, Sorghum bicolor
  Clone ID: 14366233.pep
HEGHYSAARPCLLSCTHTARHGKRASSRRPAGRARAALPPLLRRCAHAGTPPYGSARARRSRSTETALFSCCRRVPLPRRLFERWTAALLSFSAPRLLPVGVYPPPVISLSFLCSRLPCPSVGATVSHVWSAATPGEVLKLTHRRCMHSTTTKG

SEQ ID NO: 54117 - protein, 166 aa, Sorghum bicolor
  Clone ID: 14366240.pep
ARGKGFPLNYINQGISGYKNLSPSCKLRVLNFLCDETLSTDKLRNWIDMQNDIAAEPMNAAREKARAAKEMEKELKERLKDNVDKTMLSPNEAAAFSSEENKYLLSQIKEAQEAKRAAINGMATMEKQGGLWTKPLMVEKGVAYWKLDGYCENSAILLQEYGDDEL

SEQ ID NO: 54118 - protein, 127 aa, Sorghum bicolor
  Clone ID: 14366264.pep
VSRDSREVKLWRLTNSNGDLKVKQEKDLTSAAGKLAECQKTIANLGRQLKSLTDLDGVAPDPEKLESRDTHLDFRDGGDDLLSADVADGLYEVGLPKRNGSCLSPLRSNQSSGGLPSLSSYLSKTKR

SEQ ID NO: 54119 - protein, 63 aa, Sorghum bicolor
  Clone ID: 14366267.pep
PYPYIKLSACSPLLPPKDISGGFGISFKLSNGSFEVCSRSTTSAEGSFTEGFVRSATSTKGSL

SEQ ID NO: 54120 - protein, 111 aa, Sorghum bicolor
  Clone ID: 14366276.pep
LPSMSTKRGCHALTVLGESLYAMGGYNGDKMVSSVEIFDPRLNAWRMGDPMSTPRGYAAAVTLDGSAYLIGGLKSNVQILDTVEVYNASSGWSALGFSSLGKRTFASAVAM

SEQ ID NO: 54121 - protein, 83 aa, Sorghum bicolor
  unsure (1)..(83): unsure at all Xaa locations
  Clone ID: 14366281.pep
WYRTRYVNDKALLAIYIAGTSTGYSDLQYFEELXSXYTTEKGGHLCDPNAGCVFKASRVSTLTFAVSHFLQALKCDDWFDAVQ

SEQ ID NO: 54122 - protein, 122 aa, Sorghum bicolor
  Clone ID: 14366289.pep
LGMTVLAWGNSVGDLVADVALAKAGQPTIAIAGCFAGPMFNMLVGLGTALVVQTARVYPRAFVLEFHVGIVVAFVFLLLSLMGTLLVVTWARFRVPRFWGYCLMGIYILFTIVSIAIASSSG

SEQ ID NO: 54123 - protein, 163 aa, Sorghum bicolor
  Clone ID: 14366291.pep
TKYVRTPVISTTLLSLHYMVSIEHGYTCIHVVFRHSVQLSSLTVVELSSPWRRRARPPMRAPRQGRAAVPPRWAWTTSSGFWEMAMTLAVRQLVSAPCQTSRQTRSQRPSSPSAAGVGAPAWSAPTIPRASSMAACACFCPVSLVLERLLSGRPASSQMSCQP

SEQ ID NO: 54124 - protein, 115 aa, Sorghum bicolor
  Clone ID: 14366315.pep
CPPPPQRSYWRCSWWHDRSGPPFLLPLICFPSTSHPSPSSSIPFPWAGRGQQSRVGRAYWLPRLQHLGFASLNCFVRGKLSCTVCNVTSQLQVVRWQDNQAGRLFGSATTIREPA

SEQ ID NO: 54125 - protein, 101 aa, Sorghum bicolor
  Clone ID: 14366316.pep
NFAPMVVDSKCASANSEHQRPFVLPSIQERRGGSLGIRWRLAVGIFFILCILFSRTLLASDGLVTWLPRQFLVVDGIYLCACNTTIYVSPTNMFWNHLCPP

SEQ ID NO: 54126 - protein, 107 aa, Sorghum bicolor
  Clone ID: 14366349.pep
LNQKIHVLESKIAFLLNETSYPLSALVGYPAYLSFTIERTKARFLMYNWLREKGLVPPNLALSTLLACSEKRFLKYLVLKHEKGPEVWEKLKKEVVADKNMHCTADD

SEQ ID NO: 54127 - protein, 70 aa, Sorghum bicolor
  Clone ID: 14366366.pep
FHSDGPNAGDQEPFPVGSNVRSRPGRSRILSWEQNHQDIASDHTKGGTPPSRGGGTLGYIATDTDHMAVA

SEQ ID NO: 54128 - protein, 60 aa, Sorghum bicolor
  Clone ID: 14366394.pep
LEKGKQKLYSSSLKLLLEEDVRHLIEAVTAEEKKQQKKKRREKAPPSVLLDPPFSPIGRV

SEQ ID NO: 54129 - protein, 104 aa, Sorghum bicolor
  Clone ID: 14366420.pep
DSALQFVSLNTSSSANRTHPKIRGGFTCIYSAGWIGGVGVWCVFLVSNWNGKGNSVIVLGILSFFSFSGPRSFSCCKVFLSCHRDLSGGLAVQLFCIIVLSTSM

SEQ ID NO: 54130 - protein, 142 aa, Sorghum bicolor
  Clone ID: 14366428.pep
GAERVEDVMLPRSPEQMRRLLQLAYHRPRRFTPGFVLRDFVQYLYSDKVEEKKELIKGITLGNKDKFQLTPLPQDEVLVLWGEHDQIFPVEKAFEVARKLGANARLEVLKDTGHMPQEEDPKRFNEAILNFLLPAPKSSLQS

SEQ ID NO: 54131 - protein, 127 aa, Sorghum bicolor
  Clone ID: 14366433.pep
TGLAPAQAPHLTRIATLYSLVKWQITCHCPQPKKKQKNSSLECMPGHVTLCLASYDTTHAHAWLFYILNSQLNIPENRSSTIIVILHTTVVLHTTNVWANIRFFFSRTRFIIRFHRILVANLFLFSF

SEQ ID NO: 54132 - protein, 79 aa, Sorghum bicolor
  Clone ID: 14366442.pep
DQSREIKIFPPNFKIFLCYIQKWKKSPPCSASKHANEAEQAALCFASLLLLPLLCFSLRFQPQPTPLLLRGNGPGAATI

SEQ ID NO: 54133 - protein, 143 aa, Sorghum bicolor
  Clone ID: 14366454.pep
MIKDLESSGPFSGPSHGWEPGIGLPEDLADLFEAIAGAIYVDSGNDKEAVWRAMRRLLVPLATPETILLDPVSELKELCEHKNYPEPWYSPTRDDAAGVTRVVAKVKAAGREYSDTGEGPNQDVAEVFAAKALLKKLKAAARG

SEQ ID NO: 54134 - protein, 121 aa, Sorghum bicolor
  Clone ID: 14366488.pep
GRGRGRRQRKDFQKDILPGLASLPKHEVSEDLRALGRSKPTTPAKRGRNKQQPRGRRRARSVAVAMEVEEAKVSPPPQASPSLLPADLDADALGITRWGRTTRRCRRPRCPPVNNASLRVA

SEQ ID NO: 54135 - protein, 77 aa, Sorghum bicolor
  Clone ID: 14366492.pep
SPTQNLNYHNLYRCIHFYIHHRGCESNHLRSECRQYNLGFKIQSNGLPQLPSSCRFAVSIWPWINFIALQWYAVPPP

SEQ ID NO: 54136 - protein, 84 aa, Sorghum bicolor
  Clone ID: 14366495.pep
VTDYTSTCTRTKHNYFPTKNVPRSAVQSGTDQMIGLQPCEHVWDGKLIVQGVLDLVTPRNPSLLLTVRIRLQATKTQIRHKWFI

SEQ ID NO: 54137 - protein, 76 aa, Sorghum bicolor
  Clone ID: 14366539.pep
RTGVLFPPEEDQTLSSNTSGFKCLELVPSPEADSVSRSPESVHIVNLFPADQACISSPRRHTKSKRENTYTLAVPM

SEQ ID NO: 54138 - protein, 110 aa, Sorghum bicolor
  Clone ID: 14366543.pep
SSDSRPTYRGEAPTLNHLTRLMSSASKKTSQHIHNVVYNRCRCQMVQRSACHSPNRSYHHFLVLAANRPPSLLCPNLHMRHSIALIYLNHHFLVLAAFRPPSLLCPNLHM

SEQ ID NO: 54139 - protein, 91 aa, Sorghum bicolor
  Clone ID: 14366563.pep
VSFFETSTTLVVFLFFLGEFLSAFAWEAQFLPGYGLDPCGRDRGGSFPTSELAMGWQSIPSFDEPISPARPAGLVSRAPAAGGGYVATAVQ

SEQ ID NO: 54140 - protein, 158 aa, Sorghum bicolor
  Clone ID: 14366576.pep
TRGWEQAEAEVASLKQLLETASQKNTSLEGQVSHLDDALKECVRQLRQAREEQEKKIRDIVAKKSKELESEKSELQHHIAELSKQLEATKLEATTVRVQRDLQEKLQIVEKENKDLKVELLALSKDLKILARERDLSNQAAETASKLHLESVKKITRS

SEQ ID NO: 54141 - protein, 165 aa, Sorghum bicolor
  Clone ID: 14366579.pep
ARGEALLTSTKGTSSLKPAVCTSSNLGAENINDSFSCSLSPGKTGKMPTKDGSADQFLGTSGDANLVGAIMSSQDIDTTPSNSLSNEMLDSKVEINEQNDDLSTEKVAFVAITEPLDVPSRTDTIEESIDDASCVNRQSNGPNLDTMNCGPLDPPKPPTLFEPVD

SEQ ID NO: 54142 - protein, 209 aa, Sorghum bicolor
  Clone ID: 14366588.pep
HEADLSRRAEALEKKQKGSDQDILFLREVVKDSGRKVQQLEYLVDELQFRFDSSLPLLGSTRKPSIFLIGGYNGVTWLPSLDSFSPEKDTLMGLAPMSVARSYASAAALDGHIFAFGGGGGNSSWYNTVECYSSRNNEWIECPSLNQKKGSLAGISLNSKIYAIGGGDGNETFSEVEMFDPYLGKWICGPSMLISRFALAVAELNGTIY

SEQ ID NO: 54143 - protein, 130 aa, Sorghum bicolor
  Clone ID: 14366592.pep
MAAIKKTKVVLAQPAVGAPASRPPFFSRAPGPVRGAGDEAAYRASLRYRALLQDYQELIKETQAKKKRLHMERLRKQRLLAEVKFLRKRYKSMSENPSQTIVCRLRNPAMSSASWTAASAGDAQHQSVHG

SEQ ID NO: 54144 - protein, 201 aa, Sorghum bicolor
  Clone ID: 14366593.pep
HEGCPSPAVARSAHAFLEKLGLRDHDHTVHSLITMYSCLGDHLTARRVFDGIPHRDVVSWNSIMKAYERAACRDAGNLVLGKWVEEWVRSAGMEVDSLIGSALVGMYEKCGEMEEARRVFDGISNKDVVAWNAMITGYAQNGMSNEAIALFHSMREAGLRPDKITLVGVLSSCAAVGALELGVELDGYALHRSLYSNVYVG

SEQ ID NO: 54145 - protein, 148 aa, Sorghum bicolor
  Clone ID: 14366601.pep
AASARFTPAVSRLAARLRLSPSMAAVTLLALGNGAPDAFASAAALGGPRGMPRAGLAAILSAGAFVSAFVVGAVALIAAPFAVPPASFARDVFFYLVAASGLFYVYLSAEIFLWQAVGLVLFYAFFVGLVFYMDLGSAGGKAVSAAAA

SEQ ID NO: 54146 - protein, 164 aa, Sorghum bicolor
  unsure (1)..(164): unsure at all Xaa locations
  Clone ID: 14366603.pep
MKGVDDAFLGVGDKPGLDIWCIVGSSLVPVAKPQHGKFYTGSTYIILNTTELKSGARRHNVHYWVGEEAKEDDCLMASDKAVELDAALGSSTVQYRETQGEESDKFLSYFKPCVIPVQGCFFSHLXGSGDRSNATTMFRCQGEHIARVTQIPFTRSSLDHKSVF

SEQ ID NO: 54147 - protein, 138 aa, Sorghum bicolor
  Clone ID: 14366618.pep
TYLPQAVRFPAPLWCSASPLAGDHQTPPQTPTHLLPRPGFLPQPHPRHHPAPPPRRAARPPHPRPPPPHHNRPHPPQWLPSRRIPPPRRLRRSRPPDPPAARRCRSRSPWITPAGGRSGTLVGGDGGVGEMGSVSALV

SEQ ID NO: 54148 - protein, 116 aa, Sorghum bicolor
  Clone ID: 14366627.pep
MGLRDSSVLLAALSLALAYCSVSVVAYDPLDPRGNITIKWDVISWTPDGYVAMVTMSNYQMYRHIMSPGWTVGWSWAKKEVIWSIVGAQATEQGDCSKFKGGIPHCCKRTPAVVDL

SEQ ID NO: 54149 - protein, 148 aa, Sorghum bicolor
  Clone ID: 14366628.pep
ARGLAALARAAGWTVQPDGTTFRSSNQPLLPPPPPQLHGVFQVASVETPALINTLSSYVIGTPLDSQASALQTDDSLSPSSLDSVVADRSIKTENYGNSSSVSSLNCMDNDQLMRSAVLFPGDYTKTPYIPVYASLPMGIINSHCQLV

SEQ ID NO: 54150 - protein, 170 aa, Sorghum bicolor
  unsure (1)..(170): unsure at all Xaa locations
  Clone ID: 14366641.pep
MGMGAVAATTREDEEAKKMEAGEDTVGQKLDAGALFVLQSKGSWLHCGYHLTTSIVAPALLSLPFAFASLGWAAGIICLVIGAVVTFYSYNLISLVLEHHARQGRRQLRFRDMATDILGPGWGKYYIGPIQFMVCFGAVIGCTLLAGQSMKAIYLLAXPGGTIKLYVFVA

SEQ ID NO: 54151 - protein, 119 aa, Sorghum bicolor
  Clone ID: 14366660.pep
GCRSWSRRRWRPWSSTPKLSPFLPSCQRFQLGFSMILRSALRAGRGLRRVPLVHLIVEHGEPSRAPPRCATDTRDVEEPSAVLNWWGVSPIGHRYQLRAYSAAAAHVRGEKPLDCANEV

SEQ ID NO: 54152 - protein, 188 aa, Sorghum bicolor
  Clone ID: 14366664.pep
ARGLPSGPSADPLMLNSCKTMEGRCQFSSEDNISSGRCQLVKEDLINATVDASDISESFDSCPYYLSEHTKCALMSSAYVHLHCKNYFKFTKDISSLSQRVLLSGPTGTDIYQEYLVKALAKYFGARLLTVDSSMLFGGQTSKESESYKKGDRVRYIGSLQSTGIILDGQSPPDFGSQGEIFLPFEEN

SEQ ID NO: 54153 - protein, 121 aa, Sorghum bicolor
  Clone ID: 14366671.pep
MGGCHAKPLTHDADGSPPHAAPATPPPGNATPATPATGKKHWAVSPFFPFSTPSPSPAHHLFGGTAASPRKSPAPAGSAPTTPARRLLRLPFPPPSPAKHIRAALARRHGPSRPSIPEEGG

SEQ ID NO: 54154 - protein, 129 aa, Sorghum bicolor
  Clone ID: 14366681.pep
CLSSSFFADGTSRTGGCGAAPAGNSCSFTSTTCSSFFSNTTSRISSRAVSESNSSGVTSIACTLLSTNPTSRTSSEGATSATRCCCFTSTASVSKGSTCATPITSTPCPCLPGPASRTSTGARADSALV

SEQ ID NO: 54155 - protein, 109 aa, Sorghum bicolor
  Clone ID: 14366682.pep
MKNAEAPSTSTATANSLRFPTQGNFNVAAIVSIAFCFLHRIISGRMQSLMNLFPSMSSGITSLPFACISDPTKRPMPLKLDLTLPPLPNFGWSFSRLYYLFNSQLDRDI

SEQ ID NO: 54156 - protein, 166 aa, Sorghum bicolor
  Clone ID: 14366693.pep
TRTTVAGILEYEDPTSPPPHAAFNKNLPALKPTLPQINDTSFVANYTAKLRSLATAEYPAAVPQEVDRRFFFTVGLGTHPCAVNGTCQGPTNSSRFAASVNNVSFVLPTTALLQSHFAGKSKGVYSSNFPAAPLVPFNYTGTPPNNTNVANGTKLVVLPYGASVEL

SEQ ID NO: 54157 - protein, 164 aa, Sorghum bicolor
  Clone ID: 14366704.pep
ARGTGSKKNSMSRKSLLGDFSRTEQASNCQPNGQAQRVKSALSPAHLQAVLRLDSKNGVQVFEFCVEGPEESISARNWKTGDELNSIYTFHSGGKRSSAAGRISKDGGLNLPPIVGQVQVSSYLCSEVGKDGTVNNSVVTEFVSYDIAHARRIVEEKTQCTETP

SEQ ID NO: 54158 - protein, 145 aa, Sorghum bicolor
  Clone ID: 14366711.pep
ARGFVNDVEVGDMLLVDGGMMSFLVKSKTEDSVKCEVIDGGELKSRRHLNVRGKSATLPSITDKDWDDIKFGVDNQVDYYAVSFVKDAQVVHELKDYLRSCNADIHVIVKIESADSIPNLHSIITASDGAMVARGDLGAELPIDE

SEQ ID NO: 54159 - protein, 159 aa, Sorghum bicolor
  Clone ID: 14366713.pep
ARGWSCGHFSRPLLTVSDDNEETNARREEKERIALDYITKCQRSSCKMTSQIASWDTRFELGTKAALLLPFSPIVVAADESEQIRVWNYDDALPVNSFQNHKLSDRGLSKLLLINELDESLLLAASSDGNVRIWKNFAQKGGQKLVTAFSSIQGHPSCW

SEQ ID NO: 54160 - protein, 110 aa, Sorghum bicolor
  Clone ID: 14366715.pep
AAVARRAAPWRRGPSPRTAARPKRLTLLARPRRSCRHRRSAPRAYPRRRRRRCRRISPPPPHRRGRVPRRSRGRRRSRGGGARPRRSRRAPRRARRRGAPRRGRGETEEP

SEQ ID NO: 54161 - protein, 159 aa, Sorghum bicolor
  Clone ID: 14366723.pep
TREMSSIKVDDVSSKIAKNVGSAVEATNKLPSSGRNVEFRYNRKNPKRRRFLEASQEKLTICSSLDSTCGPDSASTSNSTYIDDHQERGRPISGETIMSVDIDERLASLSNMVAVLCEQQLFLPLLRAFEMFLPSCSLLSFIRSLQAFSQMRLSEASAH

SEQ ID NO: 54162 - protein, 115 aa, Sorghum bicolor
  Clone ID: 14366726.pep
TRLPRQKGPTSSHVNGSRGELHSAEWGTNPEQMEIDSLLNSFGVSTDSFSQTCGMFEQSDNLMKVVLLHALVILPHICKLDHQSQLYLMDLLILNSINLLLRHVAFMLQHLSGKM

SEQ ID NO: 54163 - protein, 177 aa, Sorghum bicolor
  Clone ID: 14366731.pep
ARGAISATLAAVKARQVNGEMEQLSDKEQSPDSTSTTKHSSLIKPDSTLSNNMAVAPGVRLHHRAVVVAAETGGALGGMVRQLSIDQFENEGRRVSYGTPENATAARKLLDRQMSINSVPKKVIASLLKPRGWKPPVRRQFFLDCNEIADLCDSAERIFSSEPSVLRLRAPVKIFGD

SEQ ID NO: 54164 - protein, 27 aa, Sorghum bicolor
  Clone ID: 14366736.pep
IRLLVQAGTSDSDIYRPSRLYCESWLY

SEQ ID NO: 54165 - protein, 123 aa, Sorghum bicolor
  Clone ID: 14366741.pep
MPTLGIAPLLDAYFRRRFAAAGLVEATVPLDGGATTVHCWRFPPGPGAAADGEGDARPVLVLLHGFGPPATWQWRRQVGPLSRRVRLIVPDLLFFGGSSTTSSVAPGAGRVSEAQQAEAVAKL

SEQ ID NO: 54166 - protein, 128 aa, Sorghum bicolor
  Clone ID: 14366745.pep
ASSEASTSRQRCQPQCSVISAHEQIVGAGEAPSRSRSPMDGDHMRQATAAAAAVVTVTQAARAQDSPARRLIAWLRLLFRAFVHRYAKLASWDAAGRPVFVILAVFFLHRSLRRRYLSWKESSGLRLM

SEQ ID NO: 54167 - protein, 107 aa, Sorghum bicolor
  Clone ID: 14366746.pep
HEAHRQLACYWGLHRHFVISLIMEELSLVWKIIDWFDDWALRLATLASLFLTSILMLSAETRRHNKYPFAMLLLWAVYQVQPKVTEYALTHLSINSSTCCTSTSAHE

SEQ ID NO: 54168 - protein, 104 aa, Sorghum bicolor
  Clone ID: 14366747.pep
LVLFVLLGRKQQFVAHLHTACLLFLAKSRHRQEKRGEGATRATHQIDRSITAAPARRGQPPATNERAKGRLICSLSLSLSLSLSALLVAPNQSINFNHKVKLEF

SEQ ID NO: 54169 - protein, 163 aa, Sorghum bicolor
  Clone ID: 14366748.pep
ARGTCALEQARVLRELLFGVAASHGLVGGHMDAATGEIRFVLSESGGTDSVEGSVVTWEDEPGRLLWEKGCLLRCQLPLKLPLYLRPDVNSGIEERFSSLIESTIAKLRDPHVSYLVEGPITSSESHHSIILRGDDLSFDSHTHGNSRKNNCTTSIVSCSEFF

SEQ ID NO: 54170 - protein, 116 aa, Sorghum bicolor
  Clone ID: 14366755.pep
TPATCTRCCSSATTATWCVGGGGGGSKLLEVEAPRRHGVMVGRFERPGSQAAKPRRRWLRGDLSALVVLPSDAIDGNVLVPSCLLVLGTQQLGLLQNLRCFHHLLLSQFLICGQDT

SEQ ID NO: 54171 - protein, 158 aa, Sorghum bicolor
  Clone ID: 14366756.pep
MLFSQLCLRIPSTNAMHVRGLQSLGQLFGYTSKNIDSHLETLASHQSVGNKNLCRSETLQDIGMDQSGQSTSFCEASMAALLLRGLAIAPMQLVARVPTSLFFWPLIQLEGAASDDIALGIAVGSTGRGNLPGATSDIRAALLLLLIGKCTADQEALK

SEQ ID NO: 54172 - protein, 188 aa, Sorghum bicolor
  Clone ID: 14366767.pep
MDGSASPSAAAVETDTQGGEAPSKAKRGNAEEKYQHGQPVYFPEELVDNWVSFSRHGLYYCYSINISLQGSCNTAADPTNIILAVKCDMGPDFFWHSFNSGGIGITIKYLCKIHLNQEQVIFARRFQTTVLSLLINSDHLEVSDAIKYFHELQVDVGVVYLLLPTVYGKIDWCGIKFSTSSVYDDVTD

SEQ ID NO: 54173 - protein, 212 aa, Sorghum bicolor
  Clone ID: 14366782.pep
NRITMVGVLFACSHAGLVEDGWYYFRSMKKLFGIQPEREHHNCMVDLLGRAGKLDEAVEFIRDMNLEPDAVIWRTLLGACRMHKSGNLAAYAAREILKLEPDDQGARVLLSNTYADLRQWTDAEKSWKAMRDRGMKKEPGRSWIELEKHVHVFIAGDLSHPCSDTIVQELNRLIGRISALGYVPQTEFVLQDLAIEQKEDLLKYHSEKMAIA

SEQ ID NO: 54174 - protein, 72 aa, Sorghum bicolor
  Clone ID: 14366802.pep
ARGDSSSAYDKTDKLAFIAQFLGRYTYRGFSLGLQNPSATVVSSARRIPRHRRFASQNLVTSRCIFLCCKRC

SEQ ID NO: 54175 - protein, 88 aa, Sorghum bicolor
  unsure (1)..(88): unsure at all Xaa locations
  Clone ID: 14366806.pep
MARIQPVVDERMDPFLGRLTRPTTIDQSWCTAPSGLSLFNGPFNEFKDAIVPSSGLLSHNCCSDVANNFEEFATAVSRLHQHLDANVX

SEQ ID NO: 54176 - protein, 128 aa, Sorghum bicolor
  Clone ID: 14366809.pep
FGTRLSSPSPFVLLPSDISPNHAVADRTLFLPPAPSFFSPATISTATISPVSLADRASLPAFAVGALPRHTSRLGTTRPGRPPPPLSWPSPPLAPATRVASTASPSSSKSRARAINVAHTATALARGI

SEQ ID NO: 54177 - protein, 201 aa, Sorghum bicolor
  Clone ID: 14366829.pep
FGWSNTYVFTKAMGEVVLGQQLRAGVGAGAGDGGRDIPVVVMRPSIITSVRDDPVPGWMQGTRTIDSIIIGYAKQNLSCFLADLGLVMDVIPGDMVVNAMMAAVVAHSGERGAPQVVYHVTSSLRNPATYDVLYQSGRRHFYENPRVGKDGRVIPTREMYFFNTIARFHLYMILTYKIPLEILHLVNLLLCGLFSRLYNDP

SEQ ID NO: 54178 - protein, 169 aa, Sorghum bicolor
  Clone ID: 14366838.pep
TRLLSSKHGIGSRRRFLLRAAPSLPPTPGPAARVALPAAAAAPPFRAISCRWSALLCSSSICPLYPLSLLRVCGRRRRPRATPLLRASLCRWSARLCSPSICPLCPLPLLRVCSCATGNPTCLGYKVTTARHRPHPRQRCPTPSEALAGDSSGAHQAAVPPVTAWTTSR

SEQ ID NO: 54179 - protein, 75 aa, Sorghum bicolor
  Clone ID: 14366851.pep
ARGLFIALRGGVVLLLSSTCLPALPSAACLPAADGWPANPPAFAEAQRRVYSSSSVRGFRKCSEFHSAAETSGRV

SEQ ID NO: 54180 - protein, 189 aa, Sorghum bicolor
  Clone ID: 14366854.pep
TRARFGTVEALSPSRNAVNNSQGSSPKISVHLFLHSSGMIAARFPYNQLLVDAFRRTPKASWNAKERVWMFPPSSLAIVEDFPRSVSGLAVEVHKLDPLVQRALDAALRSKDLRGLYDRIPPNLESQLMPFQREGIGFVLQHGGRALIADEMGLGKTVQAIAVASCLRDAWPVLVISPSSLRLHWATAI

SEQ ID NO: 54181 - protein, 205 aa, Sorghum bicolor
  Clone ID: 14366859.pep
ARGTRRAYMNVVRLIGTIVVCPAHYLEALEEGDELYFICFSLVIKLTFDPSRVTLVNSQQDLMVWDLGNMVPPSIDTLKMIPTLEDWDHFQDGPGAFAVTKYNSKFPTNYINTLTMIERIRANTQNPTGCYSMMGSQHTITTGLRYQMFSLDGFCGGLILRASTNMVRKVVGIHVAGRQNHAMGYAECLIAEDLRAAVARLALDP

SEQ ID NO: 54182 - protein, 183 aa, Sorghum bicolor
  unsure (1)..(183): unsure at all Xaa locations
  Clone ID: 14366862.pep
ARGYAVLGLDSAVPASREPDVVHSQYRRLSFLLNRSHPDRPCSLAFADAARLVADAWAFLSDPLRKASLDSDLDAAAAATXQLQPPKPLPPPQXRVPTAPHPEKQHQQQLSPPPPPALQPPQTVSGTPPKRGRPLRAAKTPATPPVPQPPQTVSATPPAQQPPQTMSSTQPPKRGRPPRAAQT

SEQ ID NO: 54183 - protein, 72 aa, Sorghum bicolor
  Clone ID: 14366864.pep
HEAALEQGFQLEWNISRRSERCTQCERSNGRCAYSRDGEFVACLCTNGRVSDHECTKGKPFRSCTTLSPFFG

SEQ ID NO: 54184 - protein, 156 aa, Sorghum bicolor
  Clone ID: 14366868.pep
HEGCFEMPANTDGSEDLLQSHEEMFENADLWSNYSHVDTSECHMELSGGEQMIDHTEASPYEFFSNDLQNQSRTSNLDNEHFPRDASNHANVEEVAGPPYEDLSNGLYLRQQTLYSGQTQFQVENNTEGMETQMNTYFSGGISTEHSDLMLGSTGQ

SEQ ID NO: 54185 - protein, 141 aa, Sorghum bicolor
  Clone ID: 14366872.pep
TRQETALNHVKTAGLLGDGFGATPEMSKRNLIWVVSKIQLLVEQYPSWGDMVQVDTWVAAAGKNGMRRDWHVRDYNSGRTILRATSVWVMMNKNTRRLSKMPDEVRAEIGPYFNGRSAITDEQSEKLAKPGSTSDGDTMRQ

SEQ ID NO: 54186 - protein, 170 aa, Sorghum bicolor
  Clone ID: 14366883.pep
ARGDFGPSPQNTIRRKLSNKYEWSILDAPETEGWNAEYCSEEHGPTNCITGAKNIVTDTESNDLSNTPPSRRRKVEDKQHYLNVNSYQQSDETESYNFLSRTIDLNFHMRVMHADRSLFLIADNGLTFEYLNSNGIWLWLRHEHVTAMKGTLGSYNGSLYLVDVHGNLHI

SEQ ID NO: 54187 - protein, 188 aa, Sorghum bicolor
  Clone ID: 14366886.pep
HEADKQDKPAPSVLSSSPAVTSTPQLSFPAFSTPSYQPSPLGITPPQPATTSPPKPTIQTPQPPTLPPVPPAPPQPPRDLIGDFTKWYVLGDEGMLGDFQAFMLDNILQGVYRKFVKDKERKRQKEEEEQALAKATEFRRYTLSVRYFYRWRDTARELRLSQLRRSGREQMRVYYEAQRAAQVKAQKA

SEQ ID NO: 54188 - protein, 167 aa, Sorghum bicolor
  Clone ID: 14366887.pep
NMVFILALCLLSQIVVALQPLPPIASANDSSNNGLGFSVSKHGTKIYIEHAFAEKKDFEGLTLIPPNAGEFAETFRADLSTLLGTQWTLERVDQLPSTGVVLGPFRGNADHLTYENGIATEEGYELDVTNGSVYIGGTGARGMYWGTRTVLQELLINNGSLPYGSIG

SEQ ID NO: 54189 - protein, 96 aa, Sorghum bicolor
  Clone ID: 14366891.pep
MKKWGNSGQAADSFYQVRPDCSQNVPNTKFKIKAGKTLSVRKWHAAFTRDGCLDIASVLSRIQRGGVHPAIRGEVWEFLLGCFDPGSTFDERDQIR

SEQ ID NO: 54190 - protein, 182 aa, Sorghum bicolor
  unsure (1)..(182): unsure at all Xaa locations
  Clone ID: 14366894.pep
TRLASGFSFGSAKTMPEAAGAVAAAAVADRLHGSKEDRKLAIVLVGLPARGKTFTAVKLTRYLRWLGHETRHFNVGKYRRLKHGANQPADFFRDDNPEGIEARNEVAALAMEDMIDWMNGGGQVGIFDATNSTRKRRYMLMKMAEGNCKIIFLETICNDPNIIERNIRLKIQXSPDYADQPD

SEQ ID NO: 54191 - protein, 175 aa, Sorghum bicolor
  Clone ID: 14366897.pep
MEASIQTLKAQEVPILERGQPEYDKAIATSNLLFRFSRPEFVARPETPAHVQAVIREAKAKKLKVTIKCNGHSYAGHSTAQEGISLDLRSMKKVALDMNTKTVTFDAGCQWGHVYGTLIDGGHDGFIVNGGRCPTVGVGGFILGSGLSPFTRSFGMGSDTLVEATLVTADGDLVT

SEQ ID NO: 54192 - protein, 94 aa, Sorghum bicolor
  Clone ID: 14366899.pep
MATRNVNVSKQESDLQINIRKATSIEETAPKRKHVRAAIVYTWDHKSSASFWQGMKVQPIMADEIQTFKALITVHKVLQEGHPTVIKEAQNNIN

SEQ ID NO: 54193 - protein, 178 aa, Sorghum bicolor
  Clone ID: 14366903.pep
TRNRYATLLSQFNNSIKKGSTKEVFLASHAIGLLAITLGAGSSSREIMEESHPQLCRILQAWSDASKMISALDCLAIITFVGATDLAETELSLKAMWDVIHPKSGSNVGTVRKPKPPVLAAALSAWTFLLTTIGSWRINTDSWKEPIAFLSTLLEADDRAVRMAAGEALALCFELNLL

SEQ ID NO: 54194 - protein, 187 aa, Sorghum bicolor
  Clone ID: 14366908.pep
PDGNGNYEFSAARQGTITGLLSIGCLIGALIAGNLCDTIGRRMTISASAFWTCVGTVIEVASQHAWYQHAIGRLVTGVGIGSLSVAVPMYQSESAPAIIRGIIVSCYQLMVTLGIWCAEMVNWGTNHYDGSASWRIPNGLNFLWALLLGVGILFLPESPRFAYRKGKEDEARNNIARLAGLEPNSPS

SEQ ID NO: 54195 - protein, 170 aa, Sorghum bicolor
  Clone ID: 14366910.pep
TRMNSLLIVLVALCLHCINAATYRVVVGWQTANDAMGPQWYSLWFYPPSLTIAYGDSVTWVSPTLELHNVVFTNGTRQSETMPNGVNLTAIAGVVGNTTHFVSYADTYSSGFRANNAPAYTLTFIPNTGSGTFQYYCSIHPGMDGTITVLPQGQAAPLTPAAVNQAVDNQ

SEQ ID NO: 54196 - protein, 165 aa, Sorghum bicolor
  Clone ID: 14366918.pep
MKLSNPGTVPVYTISGASSARPLPDWLARRRKRSLKDDAEYQNRVELLQDFEFEEASNCIRVSEDGDWIMSTGTYKPQIHVHNLPQLSLSFARHTNSLNHSFELLSTDYSKSLHLQTDRRLEFHTPMGCHYEVRLPRYGRALVYDRQSTEALVPAVGLDSDGKGE

SEQ ID NO: 54197 - protein, 181 aa, Sorghum bicolor
  Clone ID: 14366919.pep
HEATSKTRKSALRHVLLLCLLLPCISQPLPAPSPSPTAAAPPAATLHLSPFNDRLDAAYVALQAWKHAIIEDPKNLTADWCGPFVCNYTGVFCTAALDDPHILTVAGIDLNHGRIAGFLPDHIGLLADVALIHLNSNRFHGTLPPSMQHMRLLYELDISNNLFSGGFPSFLTSLPSLKYLD

SEQ ID NO: 54198 - protein, 184 aa, Sorghum bicolor
  Clone ID: 14366927.pep
MADHAKPDDHVASAKLSVESHPESRAAAAFAMDSQHRQAVEKSMKRKLDTRCALFVLIYIMNYLDRNNMAAARLKGLQEDLNLSYNQYATCLSILYVGYILMQVPSNMFINRIQRPSLYISAAMLLWGLISTLSGSVHNFAGMVCIRFFLGFVEAAFLPGALLILSKWYTRRELTKRNAILFCG

SEQ ID NO: 54199 - protein, 71 aa, Sorghum bicolor
  Clone ID: 14366929.pep
MKSDMSSLKKSDKKAALDFAAWSFNVTTSVGIIMVNKALMATHGFSFATTLTGLHFATTTLMTIVFRWLGL

SEQ ID NO: 54200 - protein, 194 aa, Sorghum bicolor
  Clone ID: 14366931.pep
TRYTDIAKEVFDRLLEKGNPEVVADPPAFLELLYRHFERLPLSYAIDVNVEKAEDVLLHRTILNECADPEKRPIFHVRFLHCASTSADSHDNTEGLPTSENGNCGGSQASTLRESEPREFEPCEGMEDLSLTRKKVVEDDFEASSERKGVEILHIHEIIFSTIDKPKLLAQLSALSEVGLNREAHVFSQLMAVW

SEQ ID NO: 54201 - protein, 132 aa, Sorghum bicolor
  Clone ID: 14366933.pep
MQYSTAILVAAFAATNVLAHGVVTEVQGANGMNLPGLSLIDGTPRDCATPRCGSEADTAIIRERELGTSKASALGRTQGGGPIDAAKMMAIFTDGANANSTAAKEAREIHEANMAARALVTRQNGGGSKTPK

SEQ ID NO: 54202 - protein, 167 aa, Sorghum bicolor
  Clone ID: 14366935.pep
HEGGPLSLLLSSDAILQFVNMFKLLRRVSSGIWSRNRPAPDSEPSTDAPLVGSKRRRDADDDANTVMQVDDLGQRKRARSKEPDSDVPDTPTGSQFITPSYVVSDAADAARDASPFPISRSQSATDSVREQTEAVKNVTLTDKEAVVEEPTATKEEAIPAPEETTPS

SEQ ID NO: 54203 - protein, 166 aa, Sorghum bicolor
  Clone ID: 14366936.pep
TRQEYQAQGDSRLPHWHHHGSSSHLPTSREQDEDNLDPYLQQEETPQVPPKDSQYQPNLPRPKQFVAQPHQEPYVRPPLGRVSTEGSYSTQGGVDHYSPEQQQHQSQGLQQSQSQQVNHGHQQSFQSYQPAPPHSQAQGNFSGFNTQNSSSSLLQGIQLHGHNASV

SEQ ID NO: 54204 - protein, 145 aa, Sorghum bicolor
  Clone ID: 14366941.pep
GFAGSEFRWAAIDFATGESCSRVRCAAAAADHRGEVLQPAHPLKSPLLASASQFPVPPSPPRLQSAVYACSDLSMAASRQVNGVLGGIDTDEYEWSRQPATNHHLILGCRDPRLGGGYLLRVVSKEKHHLIMLKVQRGRMLCLCY

SEQ ID NO: 54205 - protein, 151 aa, Sorghum bicolor
  Clone ID: 14366947.pep
TRKTSKSKKSSEKKKSHRHADSSVPVFNLEDIEEGIEGSQFDDEKSLIMSQMSLEKRFGQSSVFVASTLMEYGGVPQSATPESLLKEAIHVISCGYEDKTDWGTEIGWIYGSVTEDILTGFKMHARGWRSIYCMPKRPAVKGSAPINLSDR

SEQ ID NO: 54206 - protein, 72 aa, Sorghum bicolor
  Clone ID: 14366951.pep
MMATGAATRGNKVRVRVRPEEVVEAANLAVSGQPFEVVYYPRASTPEFCVKAGAVRAAMRTQWCAGMRIKMA

SEQ ID NO: 54207 - protein, 189 aa, Sorghum bicolor
  Clone ID: 14366956.pep
MFTHTLVWLCYLSLLATPLPALGHSMYNKHERRAHVRKSDSARADKTSSHIIPISTSPHKATTTHSSSASKHHSVPATSIASSSANPSSPSSSSFISSSVTSSSPSSNTSTSSPSLSSASSTATSAVSVPSSTESSEELQTLLERRNEFTISAVPDLNSITKWLSTLSSAGTWPDVNYATGCDAQRANW

SEQ ID NO: 54208 - protein, 133 aa, Sorghum bicolor
  Clone ID: 14366959.pep
MLRAAAAAAAILPVRFAAAPTVAAAEELRSPLLRVIGTLRGGRGSVLLGRRVRFCSNSSASDSEAAAAEAKAEDATAAEGEADSKASSAIVSTNTNLDDCLSVIALPLPHRPLFPGFYMPMYVKDQKLLQALI

SEQ ID NO: 54209 - protein, 124 aa, Sorghum bicolor
  Clone ID: 14366966.pep
MFGDFLLFVGLSYTLYIQHSSTHVSMIGPFAFLQTISHAQSMETLNTTGEAAGLPSAPASQFAILDFLFPGFSTFSSIVHAYLGIDLNLYIPLLLVISGIMFAWNYITEYSWSIIGQHLMSAGR

SEQ ID NO: 54210 - protein, 163 aa, Sorghum bicolor
  Clone ID: 14366974.pep
ARGSLEAKGLKHVYYPDSNGYKTRTESYFSVSSQLEPYCIVQPESAKDVSTIIKTLTSDTKCNFAIRSGGHTVWAANNINDGVTIDMGLMNKTTYVKNTKVAQIQAGSIWRDVYGALEPYGATAAGGRTSTVGVAGFLTGGGNTFYTARRGFGCDQVVNFEVV

SEQ ID NO: 54211 - protein, 143 aa, Sorghum bicolor
  Clone ID: 14366980.pep
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRYDQKTIEELRKTSQKPVSPEE

SEQ ID NO: 54212 - protein, 143 aa, Sorghum bicolor
  Clone ID: 14366986.pep
PIHTLSVDTCPVQSFSRTNCLLTNNTNHHLSLKMKSAAIASTLFASLALAAPLDKRVYATKTNIVLQTVYVTTTIWDNGAPAAPSSSAAGLFFENQSASSASTPAAAPVASSTSAAVEIPAQTPTPASSTPEPSSSSAVPPPP

SEQ ID NO: 54213 - protein, 173 aa, Sorghum bicolor
  Clone ID: 14366987.pep
WPWDPPLDDAGLLRAWTVGKCIRAAAAKQGWALHRVLVSPFLRCRQTAARAVAALCAVPDDDALLAVGDPDNVPLDTSRIKVSIEYGLSEMMNTQAMGVIVSKLASSINKWFPDLPELEADFPAGTIDHSAEPIYPEVPKWEESVMEARSRYASIIKALADKYPHENLLLVTH

SEQ ID NO: 54214 - protein, 109 aa, Sorghum bicolor
  Clone ID: 14366988.pep
APAAARRAPPRGDEDPLPPPARRRPAPPHLPPPPPDGGPRRRWGRRRGSGRGGRRGGTRRRGTGSTPERRGYKAGEGVRRCRGAGGQATRGSGPRRRRARRGRGRPRRA

SEQ ID NO: 54215 - protein, 144 aa, Sorghum bicolor
  Clone ID: 14366989.pep
HEASFQLPKDLMKLDIRCYPKGELKLERHEKLEKLYLRGGDMQRFSANKSASIKTLRLRYLKKFTMEWQDICSELKNIEYVEIVLNNQDAMRGKDKSELVTKDAEDKEVKRIYKDVMKIPDFTLDGHGVWTKDQKEEDNKQKWL

SEQ ID NO: 54216 - protein, 139 aa, Sorghum bicolor
  Clone ID: 14366991.pep
MFKRSFRSQDPNRVDKTARLKRSGSHRDHTKMSKLQRSLNEQDAIPQKPAPAPAAPAPSPIVTLTVGQDGRLFAAHEDVLRQSPFFEAALRGSCFEAQSKRISIPDEEPEVFSAVLEYLYKGDYYPRLLHNKQRNSWEL

SEQ ID NO: 54217 - protein, 58 aa, Sorghum bicolor
  Clone ID: 14366993.pep
KIFQFRPMRNKHLSFIRNHVVRSYHRLPCSQLFHCYFKHHQNTKLVLSQTNKLASTLV

SEQ ID NO: 54218 - protein, 175 aa, Sorghum bicolor
  Clone ID: 14366996.pep
HEGTSFTQDELAKLWVLRGQVYDFTDFVKHHPAGSKAILLGRGRDCTVLFESYHTILPSDALLEKYRVSAPNAKLEPSRSAKLFSFEDGGFYHTLKQRTREYFKKNNLSTKATTLDVLFFVVTILSIYYCTWAAFVQGSLIAAVLHGIGRALCIIQPTHATSHYAMFKSVWLNQW

SEQ ID NO: 54219 - protein, 78 aa, Sorghum bicolor
  Clone ID: 14366997.pep
QSFPHFHLLCGRCFHSLKHLPRLLYLDIASSIPSPLVSVQSPTTHNSVNETASSLQNTNTNDERVKSLLSHIFKMGFT

SEQ ID NO: 54220 - protein, 124 aa, Sorghum bicolor
  Clone ID: 14367001.pep
TRQQSTQILNQLFNTLFRDNHFLPTFNMKFTASILTVLALATGALATPPAPRPPAPPAPPAPKNNNNNNQQNHCGNGQSLYCCTCAGNNADVECVSFTNGGLGGVCNGIQMCCNNNNGNQGCNL

SEQ ID NO: 54221 - protein, 98 aa, Sorghum bicolor
  Clone ID: 14367006.pep
MSRAPPPLPPPLPPPEPAGAGAATSSRGGDELSPTPSSTGPPSSAAATIPRPAPPPPTPRRAAPSRRHLPRIAAPRASLASPRPPATASSLAHSSRVF

SEQ ID NO: 54222 - protein, 155 aa, Sorghum bicolor
  Clone ID: 14367007.pep
ATEHIESSCYTLLHPLLAASAMCLPFSCGGGDKGDDWSHDSSSVHHHFRQPPQPQPPPPPREDEKQTYYKPPPEKEAYGHHGTNMPAGGGDGMNNGGARAAEVNKNGGGHTTDFGYSDGNVHASVGVFRGRESQSAAGKKIVASTAPAMQAFNTS

SEQ ID NO: 54223 - protein, 99 aa, Sorghum bicolor
  Clone ID: 14367010.pep
MATAFSLRAAAPATAPCAGLRSTSAVRVVSVAAAPAGRGRLVARAAVAAKADAPSSAVAGKSDGHELLLFEALREALIEEMKLDPTVCVFGEDVGHYGG

SEQ ID NO: 54224 - protein, 167 aa, Sorghum bicolor
  Clone ID: 14367011.pep
TRVARSMDPGNKRAGNGDYPVPSGVTPNPVMNGAVVYHSNEPLPAFKDVPASEKQNLFVKKVNLCCAVYDFADPTKNLKEKEVKRQTLMELVDYVTSANGKFSEVVMLEITKMVSINLFRTSSPTPRENKAIEGVDLEEDEPLMDPAWSHLQIVYEVFLRFVASQET

SEQ ID NO: 54225 - protein, 108 aa, Sorghum bicolor
  unsure (1)..(108): unsure at all Xaa locations
  Clone ID: 14367012.pep
NAATKNRLGDGAKALFWHSSXVRITKRELRPFFFSARKRNKTIQQALQDNLWVQYINILASKMPQQLSQFVALWDCLQHVHLNVSAADHIXRALNTNGEYSTKSAYMV

SEQ ID NO: 54226 - protein, 137 aa, Sorghum bicolor
  Clone ID: 14367014.pep
ASRSSWNGPDPLRERHTRTQRPKEPSPIWVHNTTMSEYSYAPPRHRNREPEYVTETTYIERGGRGGAVRDLVYRPAAREDSIEEIPRDFPPGTEFRQTKYREEYAPPRRTRSMNRSYDDDYYDRPRHDRRRDRDYDD

SEQ ID NO: 54227 - protein, 133 aa, Sorghum bicolor
  Clone ID: 14367017.pep
HEDTDYTPCQDQNRAMKFPRDNMNYRERHCPAQKEKLHCLIPPPKGYVAPFPWPKSRDYVPFANCPYKSLTVEKAIQNWVQYEGNVFRFPGGGTQLPQGADKYIDQLASVIPIANGTDRTALDTGCGVASWGA

SEQ ID NO: 54228 - protein, 162 aa, Sorghum bicolor
  Clone ID: 14367023.pep
ARGKSPLSSDTVIGQGNTSAWKMCGLDRKTSLCLVYDIAKKDGPDSIGQSTSNQFYFQFLTYYQHNEGQMRLRSTTISRRWVSGDNNVEELVAGFDQEAAAAVMARLVSFKMETEVDFDPVRWLDRALIRICSKFGDYQKETPSSFSLSPRLSIFPQFIFNF

SEQ ID NO: 54229 - protein, 167 aa, Sorghum bicolor
  Clone ID: 14367031.pep
TRPPQRGLRTLGDLQASAAGGSHGHSHAGDDDDDDPDYQDDENQDLFAGGEKSGLAVQNPNQSNPQDYINNILRRARQNAPRPGGDDERPTSRFQGTGMTLGGDDAPSRAIPDPNAHVPQPAPRVRRELHLWRDGFSVDDGALYSYNDPANARTLEMINTGHAPLHI

SEQ ID NO: 54230 - protein, 72 aa, Sorghum bicolor
  Clone ID: 14512903.pep
RCVDPDSEKRPKMGQVVRMLESEEVPCREDRRNRRSRTGSMDIESIAEGSNSAEFGKKVERTGSSTSDRSQP

SEQ ID NO: 54231 - protein, 173 aa, Sorghum bicolor
  unsure (1)..(173): unsure at all Xaa locations
  Clone ID: 14512905.pep
MTYFKGFXHFCIGNGVASVDTEGQTLRISQVRQSGGWSRFTSVCHSQGRLLYVDTLGTSSSMSIYFLEDLDSEEWIWIFKQSIEKADLFGPLNLGRICWDYYTAAFHPDCNLIFFYHWTQKNLIFYDMKHRDVHVICTLEVPYFEFQETDDVHRKFFPYVPLYSRALPSSSLN

SEQ ID NO: 54232 - protein, 82 aa, Sorghum bicolor
  Clone ID: 14512907.pep
FKILPFSAGKRKCPGAPLGVALVLMALARLFHCFDWSPPDGLRPEDVDTQEVYGMTMPKATPLVAVATPRLPPHLYGGGSAS

SEQ ID NO: 54233 - protein, 66 aa, Sorghum bicolor
  Clone ID: 14512909.pep
CGIGRNRGMITCLPFLRPCLNRQAYIFWDAFHPTERVNVLLGRAAFSGGNDVVYPMNIQQLAAWQP

SEQ ID NO: 54234 - protein, 79 aa, Sorghum bicolor
  Clone ID: 14512929.pep
MNFYSKQMSKIFPNFIYLLGYKKKISICILDQLLVAKSETSSASRSPSRASRFSQSWRNLSLQKSLFAGREVNSTFSTR

SEQ ID NO: 54235 - protein, 102 aa, Sorghum bicolor
  Clone ID: 14512932.pep
QQFVPQPGGVMMGMPYNMSTMAPPPPPPPPQMMNLGRPSPSAPQPQMAVMPQSQPPTPPMLQQQMPMNLAPQMQFALQPPGIPPFRPLQPPPGMQYFHPQSQ

SEQ ID NO: 54236 - protein, 89 aa, Sorghum bicolor
  Clone ID: 14512933.pep
GERLHEGCDKAYMLRFDGSSEMQPEGTQEVIVTGKECCREFIKRFLAAIPLREELEMEKRGAGSIDGGGAPHRRLQIEFHFTVLRDDDR

SEQ ID NO: 54237 - protein, 61 aa, Sorghum bicolor
  Clone ID: 14512943.pep
CCRLEIMDRVNRSGKFETQFQGFTGTDGPLGKRMENSKTRAELGWQPKYPSFTEFLGLSNL

SEQ ID NO: 54238 - protein, 100 aa, Sorghum bicolor
  Clone ID: 14512953.pep
RVKLTIARLWPCKHVSLVVLLYHAHMSQAHEKRNQNPFPRARFTPYIGLGISDLERFSFIMITNLLWLLFSMEKHGTRWKPQVTPAQQKILIKRIEWRFY

SEQ ID NO: 54239 - protein, 41 aa, Sorghum bicolor
  Clone ID: 14512960.pep
TMPMKPAKLSCNPQCYNISPPNGSSPLGCMHTKLSLDEQDP

SEQ ID NO: 54240 - protein, 102 aa, Sorghum bicolor
  Clone ID: 14512963.pep
DGTSPKKSANQLSIDSPNKVLRLDVFKGTKGGHQSEDEGIVKDGHPFRRTTDEISLKPIEVRKKSLPGHSCSDAEIEYRRTRSLRDANGVLSRRSALARQLH

SEQ ID NO: 54241 - protein, 76 aa, Sorghum bicolor
  Clone ID: 14512968.pep
EKVLNVKLFDCSVVWLCEVVVQHSVLEGLTVLFTSAAQPLSVVSTGRSSPHSSWEAALAGQRTMLCGPGSNSFLSW

SEQ ID NO: 54242 - protein, 44 aa, Sorghum bicolor
  Clone ID: 14512969.pep
KGQTVHRSSLRGTKSKIMERGKHLSIKHLELHGSTLYTTLLFFH

SEQ ID NO: 54243 - protein, 115 aa, Sorghum bicolor
  Clone ID: 14512982.pep
LFVQFPNYRYAPMEGSIDQVWEEPPEVGLDNLVMVKVMNFNWNPAEVQLVSFLLRKAKSLHKLLIVSHNVTPVDLPDTPEADLSPLKEALVNGKIMFTKSDNAATQPYHDAFIKV

SEQ ID NO: 54244 - protein, 90 aa, Sorghum bicolor
  Clone ID: 14512988.pep
LVSHHECKTAISKAHAIPLLIDLLRSGQARNKENAAAILLALCKKDTENLACIGRLGAQIPLTELAKTGTDRAKRKATSLLEHLSKLQVL

SEQ ID NO: 54245 - protein, 52 aa, Sorghum bicolor
  Clone ID: 14512994.pep
FLPINLNRSYIIHTQLTNTVARCYTSYTLSYSSSSQMLLRLKQMGGQAASVT

SEQ ID NO: 54246 - protein, 93 aa, Sorghum bicolor
  Clone ID: 14513021.pep
SVCKKQPDRIIIIFLCVHIVFSVRLAKTDRIILNFLCVFTRTEKVLYFSVSNWIFLAVFLKLTLLLLIVLCVLRKTHRKIQHPQKYHTAKTLI

SEQ ID NO: 54247 - protein, 82 aa, Sorghum bicolor
  Clone ID: 14513041.pep
TFTSTPLLININSIPYAIRMDSPGSHKKKLQTGGSKSNPYKLRQPPITKLLQHRPISSCTEQKKTICHQAKPPISFICLTPE

SEQ ID NO: 54248 - protein, 55 aa, Sorghum bicolor
  Clone ID: 14513045.pep
FLREGREGKEEENARGFVTCFVLWGGMFGFPIEIMYNLQPVRGTFFLVKYQKGQG

SEQ ID NO: 54249 - protein, 75 aa, Sorghum bicolor
  Clone ID: 14513058.pep
QKEAIDLKELKRIDHILSSLKRKIGAAPPPPPYPEGYVPPSAEQEKAPDDVAASEAPPQLDPIIDQGPSKRPRFQ

SEQ ID NO: 54250 - protein, 87 aa, Sorghum bicolor
  Clone ID: 14513061.pep
AGTMKSVNRISQWGVLTIDSCHPQAHLPSSHASFLVSSSNAFYTSLAASLAALIAQMVDCQKLYLHQTEFQFLLPEKSSEELTSPHL

SEQ ID NO: 54251 - protein, 101 aa, Sorghum bicolor
  Clone ID: 14513074.pep
LFTHFFSACCSELLNCDDTARFQVPRIYIFLALFYHSNIWNYPLESCRDFLFSSRLRACTAVSSASIFFSRFNFVFRTCNFRLKKEYSAMCTGTWWDIQMQ

SEQ ID NO: 54252 - protein, 185 aa, Sorghum bicolor
  Clone ID: 14513089.pep
LGLHPEWQDRVRAEVHEVCGGQPVDSRSLQKMKNLTMVIQETLRLYPAGAFVSRQALQELKLGGVHIPKGVNIYIPVSTMHLDPELWGPDVKEFNPERFSDVRPQLHSYLPFGAGARTCLGQGFAMAELKILISLIVSKFVLKLSPHYQHSPTLKLIVEPELGVDLTLTKVQSFYTKRGTAIQAR

SEQ ID NO: 54253 - protein, 128 aa, Sorghum bicolor
  Clone ID: 14513091.pep
HGGGIKGLMGLNNSIGLVNATMPLAHGLYYTPAGESWTTNGNNAAVHDHQVSHHGTSPQTTVAHHSPFSSLLSLAAPGPQLVFYSPEGGGFAMKEAADHQFPVDSLEHSQGQLSLSSARSFLHPGNQG

SEQ ID NO: 54254 - protein, 131 aa, Sorghum bicolor
  Clone ID: 14513092.pep
FSMADCNIEGYTIPSGTRTIVNSWALARDPSYWEKAEEFMPERFMKGGSATAIDNKGNDFQYLPFGAGRRMCPGGNFAIANIEVMLANLVYHFNWELPLELARTGIDMTESFGVIVHRTKKLLLVPIVPQD

SEQ ID NO: 54255 - protein, 73 aa, Sorghum bicolor
  Clone ID: 14513100.pep
PYFVSIYDTNYQVIVHSRECQRDVQVEKGENSFFFTQETILMHVVFFSKRMRWFSSGLNLSTKNLQLNIVKMQ

SEQ ID NO: 54256 - protein, 95 aa, Sorghum bicolor
  Clone ID: 14513102.pep
GLFLFWNIQRCMYVCMDGWAQATSWSTSSLASMLTPTTPSRPPITCLPACLPFFTKGGIRRMVPPNLLIELNKLSCHFLDVRLVPLHLCLQISFP

SEQ ID NO: 54257 - protein, 152 aa, Sorghum bicolor
  Clone ID: 14513111.pep
CDKLLDRKEEAAKSRERRSNQKLLFDYVNMALVEIGHDTLLSAYPWRQAHSMAWKETLPQALVEEVPQHMRDWLYGLGKFAVNENDDAGSILERIMQQEVEGRGWVKSMRWELDEIMEQIAGKVLEELVEEATEDLGICSLWPETPLTIPNL

SEQ ID NO: 54258 - protein, 49 aa, Sorghum bicolor
  Clone ID: 14513146.pep
TKTNYTSSPCLGNACIWVYSSIGLSKKIHNALVKFPKGAHPKTKNLGPI

SEQ ID NO: 54259 - protein, 71 aa, Sorghum bicolor
  Clone ID: 14513147.pep
NEAISALYCSFFHIESVPLFGIMKERRALPSSHTLPDILDLTYLPLRPPLDCCLFSLFSVFFREDYCEDSC

SEQ ID NO: 54260 - protein, 93 aa, Sorghum bicolor
  Clone ID: 14513173.pep
QRYILRVQDVFLPTIQSVKLKRRGWERHSENVFLKHKRKSYPGLPMMSWAPSRRHGLILEDCMLSLCLSLHVIGHIQSIYLSCMVGLYEDRFV

SEQ ID NO: 54261 - protein, 97 aa, Sorghum bicolor
  Clone ID: 14513179.pep
TSPAKFGFDEDVLTLCCGGPGRFNYNRHVFCGEPGANECKDPSARLFWDGVHLTEAAYRYVAAGWLSAITSPPPGRSGGGGGGATLPTGTGRRRLQL

SEQ ID NO: 54262 - protein, 49 aa, Sorghum bicolor
  Clone ID: 14513180.pep
LLDNTLDVRDAARDRGMPWWARFRTFRGDSRNEEFYTLPFNLNRFFPPT

SEQ ID NO: 54263 - protein, 196 aa, Sorghum bicolor
  Clone ID: 14513193.pep
QSLVNQLHATQGVEALSEKEKTEQDLAMEFNGYVNGSRFLIVLNNLSTIEEWDQIKKCFPNNKKGSRIIVSSTQVEVASLCAGQESQASELKQLSVEQTLYALFDKGSPNGEDSVKRVSILDVATTSIDDQIAPHGEITDDQYMDADEKKVARKSLSRTRTCLGALEELQLIGRNREISEIIDLVSNNDNSQQVQV

SEQ ID NO: 54264 - protein, 76 aa, Sorghum bicolor
  Clone ID: 14513201.pep
IPFNPIGSLSNFKTSSDQNVKKFQKVLKGIYHIRTTVRQQMGQDIAGACGQLVVSLPDERSAGGATLLSDIEDLRI

SEQ ID NO: 54265 - protein, 89 aa, Sorghum bicolor
  Clone ID: 14513206.pep
AMNVIACEGSDRVERHETYKQWQVRNHRAGLKQLPLDPDIVKVVRNKVKDSYHKDFVIDMDHQWLLEGWKGRIICAMSTWVADDAFSEH

SEQ ID NO: 54266 - protein, 122 aa, Sorghum bicolor
  Clone ID: 14513220.pep
MDPFVLSILICSWIFVVVYWRTLNNMRLRLPPGPPTWPIFGNLLQLSPLPHKDFARFCTKYGPLVYLRLGTIDAITTDDPEVIREILIRQDEVFASRPRTLAAVHLAYGCGDVALPPLGPNW

SEQ ID NO: 54267 - protein, 127 aa, Sorghum bicolor
  unsure (1)..(127): unsure at all Xaa locations
  Clone ID: 14513222.pep
MEEGSCRAAAAAAAVLPDELIVEILARLPAKSLCRFKCVSRAWRSLISDPANRRRFAHTLSGLFFPRPYGSRPAXDFIGLSMSSVSPPPPGVDTALSFLPPTCGEMELLDSCNGLLLLCCTGNIHES

SEQ ID NO: 54268 - protein, 77 aa, Sorghum bicolor
  Clone ID: 14513232.pep
MGSSPTSIVMEKNLKQQAYSAADGEQREKLRHRLEEMTEVLGLAILQQLEASNYSHCDSVLMLKHAESRLSSCFPHH

SEQ ID NO: 54269 - protein, 188 aa, Sorghum bicolor
  Clone ID: 14513236.pep
TRQGLAVITVMIVTTCFMSLVIVLCWNKNVVFALAFLLFFGAIEAVYFSASLVKFHEGAWVPIILSFTFLIVMCVWHYGTTKKYEFDVENKVSISWLLNLGPSLGIVRVRGIGLIHTELVSGIPAIFSHFVTNLPAFHQVLVFLCIKSVSVPHVQSEERFLVGRIGLKQYRLYRVVVRYGYRDVQQDS

SEQ ID NO: 54270 - protein, 179 aa, Sorghum bicolor
  Clone ID: 14513244.pep
MSPQPAPDDLAEDKERETNVLIEAAAPGPPAKAAEDGDGHGRPAPSPVAWFRMLARELHWSFVFGVVATYGISQGLGGGITRVASDYYWKDVQRVQPSVAQVYQGVTSIPWMVKPLWGLLTDVLPVAGYRRRPYFILAGFIGVIAMLILALHSKLHALFALLALMTGSASVAIADVTID

SEQ ID NO: 54271 - protein, 146 aa, Sorghum bicolor
  Clone ID: 14513247.pep
MNSAFSEDILADKLAKLNNTQQCIETLSHWCIYHRKNAEQIVQTWDKQFHSSGKEQMVPFLYLANDILQNSKRNGTEFVEEFWKVLPGALKNVSENGDDRGKKVASRLVDIWQERRVFGSRAGGIKDVMLGAAPLPDLDMTKKRSH

SEQ ID NO: 54272 - protein, 183 aa, Sorghum bicolor
  Clone ID: 14513248.pep
ARGQEQGRGKELVRLEEIGTAMISLEECCWEMQLQQQRQQLVVVPIRVRKDGWASDAMLYVNVELVDANTRSDIERAVSFREKPRTNMAPRPTMRDSRKSLEAAAYDVLDLKQLLDLAEKEGRVAVYGNKRNSDTSSVSSISSSSSSSSSSSTISISSASTSGGASPEPASTSKRRFLPWMRR

SEQ ID NO: 54273 - protein, 179 aa, Sorghum bicolor
  Clone ID: 14513252.pep
ARGKVVRRGCEALGLCADAVPRNSSDGHFCGSCNFGCPTGDKRGTDTTWLVDAVARGAVILTGCKAEHFVFEKNRSGVSGRGKKCVGLVATCASNGVTKKLRIEAKVSIAACGALMTPPLLRNSGLKNRHIGSNLHLHPVSMAWGYFPENKQDPPLPGKCFEGGIITSMHRVTERTIIE

SEQ ID NO: 54274 - protein, 90 aa, Sorghum bicolor
  Clone ID: 14513256.pep
QHRGQRPETATQLLCWLSKAHTRTLRAAQLHQAAALVRSLAPACSRSCVRAISIATSMAHHKQGQRQREMPSTCSIECCKEGNLTRLKMW

SEQ ID NO: 54275 - protein, 110 aa, Sorghum bicolor
  unsure (1)..(110): unsure at all Xaa locations
  Clone ID: 14513259.pep
HEGLHDVFHVGLLKPYTFPTGVPPSGPAMLPPVQDGRLLPAPEKVLRAQLRRGEWKLLVQWHGLAADEATWEPMEDFXRLYPDVQLEDELFAEGGRDVMTGITYKRRISG

SEQ ID NO: 54276 - protein, 58 aa, Sorghum bicolor
  Clone ID: 14513267.pep
MAVSMREVDPVFQGAGQKDGLEIWRIEKLQAVPVPKESYGKFFTGDSYIVLKTTALKN

SEQ ID NO: 54277 - protein, 182 aa, Sorghum bicolor
  unsure (1)..(182): unsure at all Xaa locations
  Clone ID: 14513275.pep
ESNQQRKHELTDSFEKVPNIEPVESSAEKFVGTDDDVLQLGKGGCHSEISDDSKAQQQPDSTSGMADHLAISKGADNVEGQHYPTTDESIGAISSTSGLAVDAKFISVDATANLTEDVSSSGITIDDSMQENVTSGTIIPSQADLLNFSPSATAHEINMVDSINDVEEXSQNEKSSTDLASY

SEQ ID NO: 54278 - protein, 119 aa, Sorghum bicolor
  Clone ID: 14513277.pep
MGFSFFTYRAGARLLDGIARPGVSTAALLFAAASGGGLVAYADSAAESAPEPSQGAPKKKLLVLGTGWAGTSFLKNLDCSQYEVKVISPRNYFAFTPLLPSVTCGTVEPRSIIEPVRRM

SEQ ID NO: 54279 - protein, 182 aa, Sorghum bicolor
  unsure (1)..(182): unsure at all Xaa locations
  Clone ID: 14513279.pep
TRVFSTYTTEPSTAPLTPPPELAHATTPSSPDVPYARFLSSSMDIXTASKEHNMPFLSTAYSGGSGLQASYPLYPESPCSSLISPASVTPRTGLSSPIPEQEVPPAHWKTSRSACDTPYFRASPIPEQETTAQWKTSRSACDTPYARNSPTNIFGLDSSTPRNYMLDSNFFRPAASAQFYLD

SEQ ID NO: 54280 - protein, 157 aa, Sorghum bicolor
  Clone ID: 14513285.pep
MSKAGALDLASGLGGKINKEEVKSAVDEYEKYHGYYGGKEEARKSNYTDMVNKYYDLATSFYEYGWGESFHFAHRWNGESLRESIKRHEHFLALQLGLKPGMKVLDVGCGIGGPLREIARFSSTSVTGLNNNEYQITRGKELNRLAGVSGTCDFVKA

SEQ ID NO: 54281 - protein, 207 aa, Sorghum bicolor
  unsure (1)..(207): unsure at all Xaa locations
  Clone ID: 14513298.pep
ARGEGSSQIGDEQEMAIDSGGGGGCSGSGSGAKKQRLVELDDRCEAVESDAIRADRISALPEELRLHVLTDLPLKDAIRTGALARGWRDLWKRRWAHRASLKVHLCSRDDPRRELDALAREPRPRRRLERFSLIVDTSYLKSSEFQRFLDYATECGVEDLHVETQSRSTTAAAKLKFHLPLSSPALARLSLRDIPVSMFYKGAQQPX

SEQ ID NO: 54282 - protein, 211 aa, Sorghum bicolor
  Clone ID: 14513305.pep
TRGGVTPMARQNSGPLPPILPTTGLITSGPITSGQLNSSGAQRKVSGPLDSSVSMKMRATSFAHNPAVTNLNVGGGYSIKGSIPTTIIWLVGLLFLVGFVAGGFILAAIHNPILLIVVVVIFGFVAALVTWNICWGTKGVIGFISRYPDADLRTAKDGEYVKVTGVVTCGNLPLESSFQRVPRCVYTSTCLYEYRGWDSKAANTTHRRFTW

SEQ ID NO: 54283 - protein, 203 aa, Sorghum bicolor
  Clone ID: 14513312.pep
TRGDATGDYPFSHHKLTVQFSEASAAQDRKLEGLVHKAIRELWRPNPSQLTLLQTKGIGALHKELPKACTLTGSSDPCYIEAYHLADPTDGRITLHLKILNLTELELNRVDIRVGLSGALYYMDGFSRTVRHLRNLVSQDPVQSSVTVGVSHFERCSLWVQVLYYPFYGTGGSADYEGDYAEEDSQMMRQKRSLRPELGEQLF

SEQ ID NO: 54284 - protein, 176 aa, Sorghum bicolor
  Clone ID: 14513316.pep
HEAHGDDYSPSICTLQPYACGKVNIRYPFYLSDETADVLGNNSSCGYPGLVIDCVDDKYPIMQLGSSSSNTGYYYNYNVTDIDYNNFTISLAYPDVLDDESCPWVDHNVTVSPTLWLNLSEYTVGYLLFFANCSTNTVPGQPNIDPIPCASSSDDGVDYYSFVIPSSEVLHQPLSQ

SEQ ID NO: 54285 - protein, 189 aa, Sorghum bicolor
  Clone ID: 14513317.pep
MPQSVLVERATSESLIGPDWSLNLEICDILNHDPSQAKDVVKTIKKRIGHKNSKVQLLALTLLETLIKNCGDFVHMQVAEKDILHEMVKIAKKKPDYHVKEKILILIDTWQEAFGGARARYPQYYAAYQEMLRAGAVFPQRPESTVPIYTPPQTQPLRNYPPSALRNTDYRQDVPESSSAPEVPALSLT

SEQ ID NO: 54286 - protein, 173 aa, Sorghum bicolor
  Clone ID: 14513327.pep
TRLLSMSSTAVVLKFLMERNSINALHGQVTVGTLILQDCAVGLLFALLPILSGTSGLLHGVASMTKSLVVLISFLTILSILSRTGVPWFLKLMISLSSQTNELYQLASVAFCLLFAWCSDKLGLSLELGSFAAGVMISTTDLAQHTLEQIEPIRNFFAALFLASIGMLINVHF

SEQ ID NO: 54287 - protein, 168 aa, Sorghum bicolor
  Clone ID: 14513352.pep
TRLERSLSRKNVIRVVRGYKDPGCLSGKVYIYDGLYRIHESWKEKTKSGIFCFKYKLLREPGQPDGVAIWKMSQKWVENPITRGSVLHSDLSSGAENLPVFLVNDIDSDKGPHHFTYTTRVKHLKPLSSVKPLEACRCLSVCLPGDANCCCAQRNGGSLPYSSSGLLV

SEQ ID NO: 54288 - protein, 214 aa, Sorghum bicolor
  Clone ID: 14513356.pep
ARGPLPRFSAFSSGISAQEVSKPPTRLPSPFSSGFSSQDGPNTSSRFPSAFSSGLPSHDGPNPPSRFPSAFSSGFSSQDGSNQSYGSTYQDNLLQDTVLGGNSNHYQSQFGRHASDMEFDDPAILAVGKGLMPGIGDSGLEMKNSPAFQAQLQPERSDPRFQLHVQPNVQSHQNLRFTDPMQDGLNHMNDNYLASRFLAQNHDPISPYAQIPQQ

SEQ ID NO: 54289 - protein, 110 aa, Sorghum bicolor
  Clone ID: 14513359.pep
MVNGEPAGAECTRASLLGRYEIGRTLGEGNFGKVKYARHIGTGGHFAIKILDRSKILSLRIDDQIRREIGTLKLLKHPNVVRLHEVAASKTKIYMVLEFVNGGELFDKIA

SEQ ID NO: 54290 - protein, 185 aa, Sorghum bicolor
  Clone ID: 14513365.pep
TRAAAATAAHEFLAIDARFPTDDDLRRDLLDIKRRLEGLARRRLAAVIDAQDHPAVLRLVRLFPLLGLADEGLQVYVAYLKKVVALRARADFEHLAELTSATQPTSERLDFVGCLTRLFKDIVLAVEENDAVLRELRGDDGVAYAIIELQEECDSRGTQILRRYADYRKLARLASDINSYKNLLS

SEQ ID NO: 54291 - protein, 85 aa, Sorghum bicolor
  Clone ID: 14513374.pep
RLLFVYSPFLDGLQGYKNEYCSYRALSCNMICQLNAYCTGPACMFLLLSFLCDVEFHLCFRDHSLKQPVHVTTPPPQRSDRCSNG

SEQ ID NO: 54292 - protein, 170 aa, Sorghum bicolor
  Clone ID: 14513377.pep
ARGKGVSVLVTLTNDFSKVLSSINGLQIGGEANLIAAIRVAQLALKNRKNKQLQQRIIVFVGSPVKDEKSSLEVLGKTLKKNNVALDVVDFGESDDEKPEKLEALVAAVNSGGNSHIIHIPAGGVLSDEIFSSPILSEDPGSDSAAAASGASSFKFGVDRELALALQISM

SEQ ID NO: 54293 - protein, 159 aa, Sorghum bicolor
  Clone ID: 14513379.pep
ARGSLASRGIRPQRRRPHSSPRTPPHEPPQLPAPLPSLLGLPPHASRTVALSPRPRAPPSSALRSPRRRPWLSAPPRRRRDLRSIPARSSARPRWDELVRENFGGRVNPDLRYIRWFRRFGSAACAHSSVRFGGPTSSTALPARRCRRRRCPRRAPTAR

SEQ ID NO: 54294 - protein, 207 aa, Sorghum bicolor
  Clone ID: 14513390.pep
MALLLLMMTAVLLLQQQALATGGGDPSFDELRYRRHRGFRHRNAPPQTPTAPAQPVHPPPPPPTTRHCNDTLAPEESLTASGDVCVPVPAPSPPVPPPRRGLRCPPCTCPRPPQPPRPFPGWPVPRPLPVPVPVPVPGSKAGGDAGYDCVTPLAPLTTCGEFITGNDTETPAPTGACCSALAAFLRASSAPAAAGGGTTCCAACARS

SEQ ID NO: 54295 - protein, 118 aa, Sorghum bicolor
  Clone ID: 14513392.pep
MAEAAAILSLSAAAVVEDVLRQHGCRLSDRDLASRRAEEAAARRNEAAGWLRRTVGAVAARDLPEEPSEEEFRLGLRNGQILCGALNRVHPGAVPKVVVNTAADSVLQADGAALSAFQ

SEQ ID NO: 54296 - protein, 86 aa, Sorghum bicolor
  Clone ID: 14513396.pep
GPPASPRGPRAQRRRRRGQRPRRQRRGRMRRPQRGAGRRRGGTGGGKTNPGGCYGDAAASPARGVGEGLWQATRRAGSASESVPRA

SEQ ID NO: 54297 - protein, 160 aa, Sorghum bicolor
  Clone ID: 14513405.pep
MEVAMTVTVTKVVLSLCCVGACGLAVYLYHILWLVPQRVLAKFKDQRIGGPRPSFPYGNLADMRAAAAAAKAARASACRSGGGGGGGIVHDYRPAVLPYYEKWRKEYGPIFTYSMGNVVFLHVSRPDVVRDINLCVSLDLGKSSYLKATHEPLFGGGILK

SEQ ID NO: 54298 - protein, 51 aa, Sorghum bicolor
  Clone ID: 14513416.pep
ISILSLHNYFPLHFQHRAGALQSPFNLPLSRKFSLTHTSFTISKYIFNTKH

SEQ ID NO: 54299 - protein, 78 aa, Sorghum bicolor
  Clone ID: 14513418.pep
TSCTHHKKIKMFSINAYYSLQVQIRWKHKSNQELVVFYHAMKRGSPLVLLCCYKPLLFPAVGCLGTKMHDIYLVYEFP

SEQ ID NO: 54300 - protein, 109 aa, Sorghum bicolor
  unsure (1)..(109): unsure at all Xaa locations
  Clone ID: 14513428.pep
MLGGRVYDQKKAMINLFDLSAGMSSTNVLTDRARTDGSPACRNKQAVKRTVDSAKVYADDKVGASNWSSSRNKSXASPLNVALEKEMSKELEAKKSPSVVARLMGLEED

SEQ ID NO: 54301 - protein, 99 aa, Sorghum bicolor
  unsure (1)..(99): unsure at all Xaa locations
  Clone ID: 14513432.pep
RRMAEEVDEIKEPSLVAAGGELDRTAATTESLPQISNLEWGKAACTEDAIQKCVAAGAFHPGELIEWRAPIXDETPRLSILEDQFVILSLTHIICGLRL

SEQ ID NO: 54302 - protein, 94 aa, Sorghum bicolor
  Clone ID: 14513444.pep
MSQTNWEADKMLDVYIYDYFMKRNLQATAKAFQAEGKVSSDPVAIDAPGGFLFEWWSVFWDIFIARTNEKHSDVAASYIETQLMRAREQQQQQT

SEQ ID NO: 54303 - protein, 86 aa, Sorghum bicolor
  Clone ID: 14513458.pep
DGLLDVAEVGVEVHRTVVEVASGNPQEPHFARYPDQGATQILPLLLPTPESRPPACEARWFGLRRAPGRGLKAAVEECFVSAFPSC

SEQ ID NO: 54304 - protein, 168 aa, Sorghum bicolor
  Clone ID: 14513462.pep
VFCYRKVSAVEQIKASLRRKNYKEAISLLEEFESDGEISKEMISFVQAQLGFLLFFDLRFEDAVNHFLLSETMQPSEVFPFIMRDPNRWSDLVPRKRYWGLHPPPKPLEEVIDDGLVAVQQALFLKKAGVDTVVDEDFLSNPPSRADLLELAIRNIIRYLCASRMKNL

SEQ ID NO: 54305 - protein, 99 aa, Sorghum bicolor
  Clone ID: 14513464.pep
HEGYLSLHSPPPLHPSSSDFYLLGGAGDPHRPVEHTLLRHQIPSPRVVTFVEFRVKASASPSAFKTILVPELAPQLALLDFCLLRRRSFITGQPVSEGS

SEQ ID NO: 54306 - protein, 120 aa, Sorghum bicolor
  unsure (1)..(120): unsure at all Xaa locations
  Clone ID: 14513483.pep
ANPVSSILDGSRSGLEGSGSDWPTPAALRRGLPRYARAAVDVVGPVAACSTPSSLSCASMLTLPCAPMTTLSISVVRXEVKALFQPATLHCLHANMDAPLVEVLPLSFILCFRFFWQRTS

SEQ ID NO: 54307 - protein, 131 aa, Sorghum bicolor
  Clone ID: 14513489.pep
ITIPGALVSGNWNEYNLNPLTRIPRTVRVGYRSCSAAPTPLGGPPPRCAAAGSTATSVASPRQNALLPPLHVILHARDLTLSSMEGSHAIEQGLGEGPDEHDACWRSRWCLVADWTPPLVRGADPGHKFKK

SEQ ID NO: 54308 - protein, 160 aa, Sorghum bicolor
  Clone ID: 14513495.pep
MRCKQLLPPCAVWQLLVVLVLSSSSAAAAAAPVPASSTTLRVQQRYDSIFSLGDSYADTGNGPVVFGWHAIASPVMRPPYGSTFFGHPTGRNCDGRLVIDFLAESLGLPLVPPFLRHGATSFRRGANFAVGGATALDASFFHRWDPPGGGSVFPLNVSLA

SEQ ID NO: 54309 - protein, 135 aa, Sorghum bicolor
  Clone ID: 14513496.pep
ARGALLLAVSRHHPPRRRLPRRPLTAAAAPADICLPIQRPQRRTLPCWTGFAFIYPHCSWTLLGFRSDVGCCYSLSFSPLPLLCSALRVALLCCQDCSQASDRGPFRPVIQSFSPNSQYIKRTCSNKFRNGRGEA

SEQ ID NO: 54310 - protein, 174 aa, Sorghum bicolor
  Clone ID: 14513497.pep
ARGPRGRRQIQPRRGAPKSSSSSEPRAAAQRGVSSASSLSSRRKEVEAREESEASNGRPPKERKKKKLTFFSLFLLALKSPPPPPRAPSPKSRALPLFRPLPYLAAGGAQIAAPRPYRSPPRTFPSVPARATAAIPASHRRLLLLFLQWLLGLRRFLRSPPSSIGCLAAPPPSP

SEQ ID NO: 54311 - protein, 82 aa, Sorghum bicolor
  Clone ID: 14513511.pep
FKVKERKLTGMRQITGYWHSGSNLRMYELGRRRQMCFGRRRAAGKFSLKPHLRRMRSFAAAARRRATTRPGSPRLTPVRRLV

SEQ ID NO: 54312 - protein, 120 aa, Sorghum bicolor
  Clone ID: 14513515.pep
VFALLYECCAFATSLLWFLSSFNSTPTLLGTKLFCCFALASDLRSAMSLIIIDLTHNSYTTSQFFLERQLHRFMCFDFDRQKPLNRLAETHTHKNTDKRSRFGGWNDLAFSDFLSSIYRQ

SEQ ID NO: 54313 - protein, 146 aa, Sorghum bicolor
  Clone ID: 14513519.pep
SFDFYRQSGMAGTPEEFPVQGGPEPEPFSPSVFLDLPPTPSEEDPPASTDDLALTFISRILMEEDIDEKFLYHYPDHPELLQAQQPFAQILSDAGASSDFFATNNDGSGACTLPPSSDVPALANTTWPFDPVEFPQLFLSSPCPDM

SEQ ID NO: 54314 - protein, 179 aa, Sorghum bicolor
  Clone ID: 14513522.pep
HEGFVGAALCLELLRRGAREVRSFDLRAVSAWSPQLLDAGVRLIQGDVRNKDEVGRAFRGVDCVFHLASYGMSGKEMVQAGRCDQINISGTCNVLDACHEHGVRRLVYVSTYNVVFGGKPIANGNEALPYFPIEDHVDAYGRSKSVAEQLVLKSNGRPAKSDKSTCLYTCAIRPAAIYG

SEQ ID NO: 54315 - protein, 129 aa, Sorghum bicolor
  Clone ID: 14513523.pep
GSLLEGYAGLRAAPAPRSTIPGGDERGLGFARSYLTSALGSRAAAPTGAGKVGDWRFLLASSQFRRLFSDGSNKDYEKYHPKEKEQKPEGDGSDKSDSKKDSNSNNQWNFQEDVMKKFQEFLAPILLLG

SEQ ID NO: 54316 - protein, 121 aa, Sorghum bicolor
  Clone ID: 14513532.pep
IRGNNLKQTMGGTNAFCCLQIGNGPPRQTKVVNHSICPAWNEGFTWLFDVAPKGQKLYIICKSKNTFGKSTLGRVTIQIDKVVTEGVYSGFFSLSHDGGKDGSRTLEIEIVWSNRPSNDSM

SEQ ID NO: 54317 - protein, 98 aa, Sorghum bicolor
  Clone ID: 14513547.pep
EKITQMEEQLELLRIAMDDKIRFSQRPGSGAGRVIASPPTNSVDEPQIKESMERPRSRSGTEQYPKPTEERWGFQGSRDRGSFGGNRISERSSGGQRW

SEQ ID NO: 54318 - protein, 67 aa, Sorghum bicolor
  Clone ID: 14513553.pep
LEGDPKLYWTVKEEAALREAMKKFTPRDNGPIPWVQILEHGRNVFHRTRLPCDLRVKWRNMENRGDA

SEQ ID NO: 54319 - protein, 62 aa, Sorghum bicolor
  Clone ID: 14513555.pep
FSLTVGEMCNRNPRTITAEAMAVEAMEKMESPPSPVQFLPVINDNNIVCGIITLHGLVSAGL

SEQ ID NO: 54320 - protein, 77 aa, Sorghum bicolor
  Clone ID: 14513560.pep
GDDSVAGKKKGLTTARHCYFLLTVTCPRVIRFTPRSSRTSSNSPSPKMKVTMKNSLRTSRLAIHQSVVPVIGAAKLS

SEQ ID NO: 54321 - protein, 74 aa, Sorghum bicolor
  Clone ID: 14513561.pep
RKKRGGGGGQGFILLLCTATEIHSPPPQTQKLSQHSSTCSGTSNWHSNKHHGRQCKQGTITHAQLHKLSGGFDF

SEQ ID NO: 54322 - protein, 114 aa, Sorghum bicolor
  Clone ID: 14513572.pep
MELHGGGASSNSRIHRREQLAKRLLNHQPKLDKFGIKSRVRFGISLAEKLLTREGKKKDSLRIVLDVWTDILVYVANRCSRESHAKQLSIGGEFTTLIWLMTEHCHQASYRPTS

SEQ ID NO: 54323 - protein, 129 aa, Sorghum bicolor
  Clone ID: 14513590.pep
SLLAVAVVFYIQDNISNDSDLYNILSMVSLVGVVACAIAYCFGMAAIPWIIMSEILPVSIKSVAGSFATLANWLTSFGVTMTANLLLSWSAAGTFASYMIVSAFTVMFVILCVPETKGRTLEEIQWSFQ

SEQ ID NO: 54324 - protein, 68 aa, Sorghum bicolor
  Clone ID: 14513592.pep
PGNHPILIHSLQVLDRIISGVEEFGFCNKGWIESPIKGAEGNKEFLACFHRIPISESQPDVEAKEPVT

SEQ ID NO: 54325 - protein, 87 aa, Sorghum bicolor
  Clone ID: 14513602.pep
AKTLMFVNVSPAESNLEETYNSLMYASRVRCIVNDTSKHVAPKEIMRLKKLIAYWKEQAGKRSDGDELEEIQEERISKERADNRLTG

SEQ ID NO: 54326 - protein, 67 aa, Sorghum bicolor
  Clone ID: 14513630.pep
LTLIIKSAMQCNESKILHTCELSCSGAPNPFCGSQPCTPRASAEQKCLQHPGPQYRSKSLGIISGLN

SEQ ID NO: 54327 - protein, 157 aa, Sorghum bicolor
  Clone ID: 14513637.pep
VLVVSNDHFTIVKPVDSGLASQEGSDSNVASDTQQSPPPTGEGEEEAPNQNGPEKDKQKEPVSAGCSSRQLFPPGRIIHMVALPPPLDPNPGDGTSSCEIIGIYETPRDLYGKIRLAPNMIKEHYMPSYISTMESLLEQLQKEDDDDTSVCTASNDL

SEQ ID NO: 54328 - protein, 49 aa, Sorghum bicolor
  Clone ID: 14513655.pep
LSEFDESREIIESLVDEYKACESPDYIKWGMEDPGEANVAAALDSKLVV

SEQ ID NO: 54329 - protein, 66 aa, Sorghum bicolor
  Clone ID: 14513676.pep
AEKETDRVLGVHIMALNAGEIIHEAVFALQYGASREDFARTCHVHPRVSEALKEASLDPYTKPIHM

SEQ ID NO: 54330 - protein, 80 aa, Sorghum bicolor
  Clone ID: 14513680.pep
ASAGRWRDAAKIRTEMRRVELRKETGWSFVDVGGVESFKFVSADTRHHDAEEIYSVWHSMNRHMADLAADVHKLSPISAV

SEQ ID NO: 54331 - protein, 79 aa, Sorghum bicolor
  Clone ID: 14513682.pep
NKILPFQNQFMHGVQVQISTMADPRQWQQPISQQPHTRGRLAMLLLMARALSLSLSLSLSHTHTHTRTHTYFLPLLLLN

SEQ ID NO: 54332 - protein, 91 aa, Sorghum bicolor
  Clone ID: 14513683.pep
QKMNKVLMVEEIGIGVELAGWQHGLVKADELEAKVRLVMMESEEGEQLRARVTAHKEAAGMAWKDGGSSRMAFGQFLSDAAKVGQDRLTLG

SEQ ID NO: 54333 - protein, 58 aa, Sorghum bicolor
  Clone ID: 14513694.pep
CCLRLPTMPLVVVGLEMFVIASAMLSSPPVSGHFLLLYSWGLFEYATDGLFGLVSFGR

SEQ ID NO: 54334 - protein, 82 aa, Sorghum bicolor
  Clone ID: 14513702.pep
VSGGSMNPIRTLGPAIVLGRYTSVWIYLVAPVAGMLIGALCNRVVRGSDAILAFLCGTKPTRAVAPRATPRAVGSLASSPHY

SEQ ID NO: 54335 - protein, 55 aa, Sorghum bicolor
  Clone ID: 14513714.pep
IGKHHYSRYPHLNKPIEYLSNSPPLVTILAFHHKPYHFRTVIHATIAFLLVALYG

SEQ ID NO: 54336 - protein, 101 aa, Sorghum bicolor
  Clone ID: 14513730.pep
RVHSHYSDHLGVKSKATKIANIPFSLHSTSINKGTTKAKQITALSLFSGPTEPSLNKGPVLDHWLLLACLRLLMGMESVGLQDLHTLLHGGPCFGASLSMT

SEQ ID NO: 54337 - protein, 107 aa, Sorghum bicolor
  Clone ID: 14513733.pep
HDNTDNMHYTIQGDDTMERSTAPVPVPTPAPGSGITDCNYKNGSANPSSYCLLIKLRGKEMLPLNISTSLLTYVLPGACSTTFSRLPPKQPLSANNTTSSGENGSAP

SEQ ID NO: 54338 - protein, 104 aa, Sorghum bicolor
  Clone ID: 14513771.pep
HLIHGDRRVDMNMASPPLMQGDARVDMNMVSTFQNGMHTFDLVNINLESGSLPMAATDFMQMHPHPAVYHPKQFFDMRDQVMDANKRPNMETNPYFMGGGMHVG

SEQ ID NO: 54339 - protein, 128 aa, Sorghum bicolor
  unsure (1)..(128): unsure at all Xaa locations
  Clone ID: 14513793.pep
TLISYSSPDVEAEVHQSLSRTVFTSERPIXFLLDAYKDLLVYYSPTASSEIPFPPPRDCLLRSTVDRLKQERNITPKLVFIQGAHDDTSEFEKYLVEDQTLDGSLLPSSTGFSSFLDEVRSKVAEHSI

SEQ ID NO: 54340 - protein, 80 aa, Sorghum bicolor
  Clone ID: 14513796.pep
KYKSAHNKISSPVIPVLVTWALGYIVAKLFFAVVEMSIDTIILSFCQDAEEHQGNAQYAPPALMETLDEQGELQRLTQGP

SEQ ID NO: 54341 - protein, 68 aa, Sorghum bicolor
  Clone ID: 14513806.pep
IRDKVRKMVYRNRDEFRHDVAQIQLNAHLYNDGRHPHIPPLADELMEVCDHLLDESADLLTEAEDAIE

SEQ ID NO: 54342 - protein, 139 aa, Sorghum bicolor
  Clone ID: 14513814.pep
ATTCLLVVLNCLSSFQIYSMPVFDSFEAYYTGRTNRPCSAWVRSGFRVFYGFLSLFISVALPFLSSLAGLLGGLTLPVTFAYPCFMWIRVKKPERFSFSWYLNWGLGLLGTAFSLAFSLGGIWSIVNNGMKLKFFKPTN

SEQ ID NO: 54343 - protein, 141 aa, Sorghum bicolor
  Clone ID: 14513818.pep
MECFSMECDVREPNEYATLGNSENDANAGCCCQIDSCQGGNNSFSRSPKVNDIPAGGVLRYALHLRFLSPFSKNSSKSRQPGKLDLSSEPHTRSRTEKERRFYLYNDIRVVFPQRHSDSDEGELRVEHDFPANPKYFNISN

SEQ ID NO: 54344 - protein, 193 aa, Sorghum bicolor
  Clone ID: 14513828.pep
HEDRDWSMSKKSFAPSPADSASRSRYGGLGGGAPASVGRADDDGDWSRGKKPPPPSGPSRYPSLGSGGGGGFRDSPVSADSSDRWSRAAPSNGERERPRIVLDPPKRDASATPTPPVEAGRSRASPFGAARPREDVLADKGLDWKKMETEIDQKRTSRPTSPHSSRPESAQSSRPGSPGSQISATATEAAPRA

SEQ ID NO: 54345 - protein, 177 aa, Sorghum bicolor
  Clone ID: 14513835.pep
MEALRKQASKFKEQVAKQQQAVIKQFSTTGYERSDSVVIDEVELQRHQQLEKLYTSTRSGRDFQKDIVRAAEGLVSIGNKHIEVGTKFSEDCYRYGGENTASDEALGKAASLYGGALRNIEKEYEDFNRILSSQTIDPLRSMAMGAPLEDARGLAQRYSRMRHEAEILSAEIARRKA

SEQ ID NO: 54346 - protein, 127 aa, Sorghum bicolor
  Clone ID: 14513836.pep
MNGMPISASSAAGVDGGAVAAGTPMKNATAAAAVAEMARHLTVDTEDAFAGLLEFAADDNAEGLRRALERAPPAAADEAGLWYGRRKVLEHRTPLMVAATYGSLAALRLLVSLPSGDVNRRSGTDGT

SEQ ID NO: 54347 - protein, 212 aa, Sorghum bicolor
  Clone ID: 14513840.pep
TRDRPNCKLDMVKAGIIEHALDMILDVPVSVSSSIAELLRILTNNSGIAKSSAAAKMVEPLFLLLRRPDVTMWDQHSALQALVNILEKPQSLAALKLTPSQIIEPLISFLESPSQAIQQLGTEVLSHLLEQEHFQQDITTKNAVVPLVQLAGIGILSLQQTAVKALENISQSWPKAVADAGGIFELSKVIVQDDPQPSQALWESAALVLCNV

SEQ ID NO: 54348 - protein, 161 aa, Sorghum bicolor
  Clone ID: 14513843.pep
HEGFFYFPSTGLQRAAGGFGGIVVNNRDVIAVPFGRPDGDITIFIGDWYNKNHTDLRKMLDKGNDLGMPDGVLINGKGPYRYNHSLVPAGIEYETFNVHPGRTYRIRVHNVGTSTSLNFRIQGHNMVLVETEGSYTSQQNYTNLDVHVGQSYSFLVTTDQN

SEQ ID NO: 54349 - protein, 163 aa, Sorghum bicolor
  Clone ID: 14513849.pep
HEGSVSITSVHIAIHPQSSPVFGMPSPSSAECLAALWVADTLAAGQAFDFAVIKALVGASPEHFIGAPDSSRERVALRCLEEHATFADADEGGAAVAPPPSKILRVDAVRSCEDLLAELTGQVGSSGILDKDIILPFRQDIQNFICIKKPTLPESSLELLGEV

SEQ ID NO: 54350 - protein, 144 aa, Sorghum bicolor
  Clone ID: 14513851.pep
MGSLPVPASAECAPQGRATVSASDLAPLFSAQRRHLDHFFDSLDMSQAAAFAQALIDAPGAVFFTGVGKSGIVACKIAQTLASLGFARAGFLAPVDALHGDIGALFPGDVLVLISKSGASDELLALAPCARAKGAYLISLTSAS

SEQ ID NO: 54351 - protein, 50 aa, Sorghum bicolor
  Clone ID: 14513856.pep
TTMNPPLPICRPSEKFFVIAFRSDIGRSIGLICSSFLRSTSWSHLDVISM

SEQ ID NO: 54352 - protein, 144 aa, Sorghum bicolor
  Clone ID: 14513857.pep
TRAPAANGAAAVLPAAAGPPPLGVIVVERHHHLRRELIAAIILSSVAIVVITIAALYAFLLWRRSRRALVDSKDTQSIDTARIAFVPMLNSFNSYKTTKKSAAAMMDYTSLEAATEKFSESNVLGVGGFGSVYKANFDGRFAAA

SEQ ID NO: 54353 - protein, 76 aa, Sorghum bicolor
  Clone ID: 14513865.pep
ARGGGPEERVLISEVAVRGKDGEPLERAELEAAAAAALRACRPNAALTVREVQEDVHRIVESGLFRSCMPVADDTR

SEQ ID NO: 54354 - protein, 122 aa, Sorghum bicolor
  Clone ID: 14513869.pep
MQEAGLTLVWLLDLWNRWATQFLVVFSLMQQLVLLFFAGVRRHKDGGVKMGFLWLAYQLVDYTTTYALGNLAISSAPHEHQLVAFWAPFLLLHLGGPDNITAYSLEDNKLWERHFLTLVAQV

SEQ ID NO: 54355 - protein, 202 aa, Sorghum bicolor
  Clone ID: 14513877.pep
HEAAFERPLTSGVAYGVKVTHAEREQFERQQGWSIKKMYSSKTKKQSQGQGNGEDAEVREPAEEYAPVIFAQDAYKHVISFDLLSGADDRDNVLRARESGKGVLTAPFKLLNNRLGVISTYAVYKYELPPNATPQDRIQAAIGYLGGIFDIEALVDKSLHQLAGKQSIMVNVYDTTNEKPISMYGSNDTGSGMCQVSTLNFG

SEQ ID NO: 54356 - protein, 46 aa, Sorghum bicolor
  Clone ID: 14513886.pep
ARGSGCACSRYGRARGVASASCRVARDQEAPAAVRHRLLATSYHPL

SEQ ID NO: 54357 - protein, 178 aa, Sorghum bicolor
  Clone ID: 14513896.pep
MMQMLGLRGSSKDRGRGGDPSPSSSSAAAGGTGTPRSPFAAEAGGEGGGGRPLRLVYCDERGLFRMDPEAVAALQLVKGPVGVVSVCGRARQGKSFILNQLLGRSSGFQVASTHRPCTKGLWMWSAPIKRTALDGTEYSLLLLDSEGIDAYDQTGTYSIQIFSLAVLLSSMFIYNQMG

SEQ ID NO: 54358 - protein, 180 aa, Sorghum bicolor
  unsure (1)..(180): unsure at all Xaa locations
  Clone ID: 14513901.pep
ARGQGEEICVALQTHINDVMLRRYSKARSANSVTSQNDVNQAYKPPNIEMYEKRVQELTKTVEESQKKADRLQEDLQLKTKQESEMQEELEGLRDTLQSERQSSKEVKNELDKLKSLCDEKESALQAALMEKSRLETRLTSGQGRERDTVTTVGSVNSDIEMLTKLKEELKSYXKELDAS

SEQ ID NO: 54359 - protein, 92 aa, Sorghum bicolor
  Clone ID: 14513912.pep
ERHHVGANEVGQALCSKSKKIQAIKFHRVRLDRNILNTSEKFLCIQVIRIQFLCTQKIIFQFCSYCIKVKHRRKPQAYMKKKSISMHKKLTF

SEQ ID NO: 54360 - protein, 171 aa, Sorghum bicolor
  unsure (1)..(171): unsure at all Xaa locations
  Clone ID: 14513928.pep
MAAAAAAIATASASWLLKRSISSAFLARRAGPSILRTALSYSSSASACPKPAPSLSPPDTSANDGGGGMRWESARKKRVVLRIGYIGTEYRGLQKQRELGVDSTIESVLESAIFKSGGILESNYGKLQKVGWERSSRTDKGVHSLAXMISLRMEIPDRAWEDDPDGIALAS

SEQ ID NO: 54361 - protein, 218 aa, Sorghum bicolor
  unsure (1)..(218): unsure at all Xaa locations
  Clone ID: 14513929.pep
TRLLIAMLFMQQAIKGLVDEFRIPERENRKALEFVPSWRFANGMFAIVLSFGLLLTALRSRKARSWRYGTGWLRGFIADYGVPLMVLVWTGVSYIPYGNVPKGIPRRLFSPNPWSPGAYDNWTVIKDMTQVPLLYILGAFIPATMIAVLYYFDHSVASQLAQQKEFNLRKPPSFHYDLLLLGFLTLMCGLIGIPPSNGVIPQSPMHXKSLATLKHQLL

SEQ ID NO: 54362 - protein, 166 aa, Sorghum bicolor
  Clone ID: 14513938.pep
HEEEEEPWPDRAPLTCCEATAVAARTARRTWELTVGRWGLHGLAFGIKRHMKRQGNLQHEYSGNDCLQLKGHQTYTEVSSLLEYLKLCMFFSKKSFSAFLKFGGYKQDDILIHKARARLMQPSFALVCDQRTKCLLLFIRGAISTKERLTAATAAEVPFHHIILSE

SEQ ID NO: 54363 - protein, 107 aa, Sorghum bicolor
  Clone ID: 14513939.pep
MLRRLRLRSPGRAASAVAGAAAAMASLTNVAYADGLFRRQSPPSNPGDEDNLGASAFGRDPETLERMARALRQINNSPLAKQVFELMRKQEETRLTELEAEKVLHAV

SEQ ID NO: 54364 - protein, 216 aa, Sorghum bicolor
  unsure (1)..(216): unsure at all Xaa locations
  Clone ID: 14513956.pep
ARGWKQLCLEHGIGKDGLLEDFATQGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSXPTFAQTNSLVST

SEQ ID NO: 54365 - protein, 89 aa, Sorghum bicolor
  Clone ID: 14513965.pep
MDRAALTVGPGMDMPIMHDGDRYELVRDIGSGNFGVARLMRNRADGQLVAVKYIERGEKIDENVQREIINHRSLRHPNIIRFKEVILTP

SEQ ID NO: 54366 - protein, 184 aa, Sorghum bicolor
  Clone ID: 14513973.pep
TRISLTIAYFWQLYTLWILVKLHEAVPGRRYNRYVELAQAAFGEKLGMWLSLFPTIYLSAGTATALILVGGETMKLFFQIVCGPLCSPNPITTVEWYLVFTSLAVILSQLPNLNSIAGLSLIGGATAIMYCTMSWVLSVSQPRPPTVSYDPVTSNSFGISLFSTLNALGIIAFAFRGHNLALEY

SEQ ID NO: 54367 - protein, 125 aa, Sorghum bicolor
  Clone ID: 14513988.pep
SLRLLGAELEERSLLEGSELVVLVFACCFSCSCSCAAIFLLSTSPPTTPRTDQDLLLPPASHHSFPDSCFDSASSPRGKKKEKEKSNLCARQKGQETRGEGRKADADRTRERGREGGGGERKASC

SEQ ID NO: 54368 - protein, 148 aa, Sorghum bicolor
  Clone ID: 14513990.pep
MPAPANYCSPGKSFPPLTNEDNLDHITPNNLDDAVKIDTTMRLNNLSLLNRELLEGSWLDNIIWDPNEVTPKPKLIFDLKDDHMLFEILDEKNVGHIRSHARAMIVSQSTKTSTPTVDNFDNQAKTLSGRFNISNDKFYSNRKTPQQA

SEQ ID NO: 54369 - protein, 158 aa, Sorghum bicolor
  Clone ID: 14513991.pep
HEGQTEKMFSDSVIRFYAAELVLALEYLHSLGIVYRDLKPENVLIQDSGHIMLVDFDLSTRLPAPPQEPDAPATSPKPVAPVAAPLPSRGRARKPAGAALCFPFRTGSAARPAAKPAADSPSPLSTSRTASSSSSSSTATTASSSAGSPGARTPAKSN

SEQ ID NO: 54370 - protein, 170 aa, Sorghum bicolor
  unsure (1)..(170): unsure at all Xaa locations
  Clone ID: 14513993.pep
MIVNSSFGFNQGNPLRLTYELDYKGNICGDKHGSPNLQELDVRYWMNPNQVYQSGLKDSKVNLADAKAICLMECPNPAVDGLNFICDYPEGDIHLSVDDWINRDYDYFEFLTPDMRNSSLQLQGPCYPIIFPTVNVYWSCQFIARASNVSLKHWHEMGGVSIDEXILIDK

SEQ ID NO: 54371 - protein, 135 aa, Sorghum bicolor
  Clone ID: 14514005.pep
MAVRASLACFPSDPALHEACGIPWGVAVTPFSATDERGSTPATGAEGHLLPRCQSCFAYFSLLCPLDRWSWNCAVCGAENDLPADAAARYARDGGHDPPEMRSAFVDLLLPPREEGEAAAAAAPTPVYVAAIDLS

SEQ ID NO: 54372 - protein, 148 aa, Sorghum bicolor
  Clone ID: 14514007.pep
HEDGTKFDSSRDRDSPFKFKLGQGQVIKGWDLGIKTMKKGENAVFTIPPELAYGEDGSPPVIPPNATLQFDVELLSWVCIKDICKDGGILKKVLAEGDKWENPRDPDEVFVKYEARLEDGTVVSKSDGVEFTVRDGVFCPAISKAVKT

SEQ ID NO: 54373 - protein, 167 aa, Sorghum bicolor
  Clone ID: 14514008.pep
ARGHGKIVVCDRGVNSRAAKGDVVHRAGGIGMVLANGAFDGEGLVADCHVLPATAVGAAAGDRLRKYIASSTKQRPATGTILFEGTHLGVHPAPVVAAFSARGPNPQSPEILKPDLIAPGLNILAAWPSGVGPAGIPSDIRRTEFNILSGTSMACPHVSGLAALLRR

SEQ ID NO: 54374 - protein, 199 aa, Sorghum bicolor
  Clone ID: 14514016.pep
MVRFLKAYREMPESAKKKAKITDEMDEMVEKSLSEIAETRKFPTRPKRGASVGAAVGSQRFSRLESFMQRFGEDDLNSLKKFIEKMQHRKPNFIHSWDLDRESHVKNFFWTDSRAQAQYRYFGDVITLDVMYLQHSRASLPLATLLGVNNHGHLVLLGCGLLSGDSKENYVWLLKRWLSCMNGKSPEAITTGYSDVISE

SEQ ID NO: 54375 - protein, 116 aa, Sorghum bicolor
  unsure (1)..(116): unsure at all Xaa locations
  Clone ID: 14514019.pep
TRLTARYGDSEESGLAPVDFFVSTVDPLKEPPLITANTVLSILAVDYPVEKISCYVSDDGSAMLTFESLAETAEFARKWVPFCKKYTIEPRAPEFYFSQKIDYLXKDKIHPSFVKE

SEQ ID NO: 54376 - protein, 163 aa, Sorghum bicolor
  Clone ID: 14514030.pep
MANDSSALQASSESIAQKMGFFRVPDLLVKLSAKCLSELDVVRSPTSPLDLKFFTGLGNKSPRSSSLDASQNQKILLGDRVGLGLVDALTDENPVPLGGRKVLLGSEMRITDNMSRKNSSTAPGQAGEVEQKDDNMSDGLMGSVMSLDDIVNSEDYTCVVSRG

SEQ ID NO: 54377 - protein, 36 aa, Sorghum bicolor
  Clone ID: 14514046.pep
SIVTLLGRTPSSSIMTNTSRPSSSIPLSTHPDMILV

SEQ ID NO: 54378 - protein, 174 aa, Sorghum bicolor
  Clone ID: 14514049.pep
TRQAGAWASALRAYATIEDTDVVVVGGGPGGYVAAIKAAQLGLRTTCIEKRGTLGGTCLNVGCIPSKALLHSSHMYHEAKSSFAHHGVKFSNLEIDLPAMMSQKDKAVAGLTKGIEGLFMKNKVEYVRGIGRLVSPSEVAVDLLDGGCTTVKGKNIIIATGSDVKSLPGVHIDE

SEQ ID NO: 54379 - protein, 148 aa, Sorghum bicolor
  Clone ID: 14514051.pep
AVVSRGKYGVPGPGDNCWPQMAGMIPLPHSTFNWQGDLPLKYHQKDLVIYEMHLRGFTKHDSSNAKHPGTYIGAVSKLDHLKELGVNCIELMPCHEFNELEYFSSSSKMNFWGYSTINFFSPMARYSSSGIRDSGRGAINEFKTFVRE

SEQ ID NO: 54380 - protein, 54 aa, Sorghum bicolor
  Clone ID: 14514052.pep
KPGVVLLSPNVVVPEVPNPVADVPKAVEPIVGVLEAPNKDVDGEPNAGVVVAPK

SEQ ID NO: 54381 - protein, 212 aa, Sorghum bicolor
  Clone ID: 14514065.pep
ARGFVAKHFFSQSVVDLSWSPDGYSLFACSLDGSVANFHFEAKELGYKLSDSELDELKRSRYGDVRGRQSNLAESPAQLLLEEASAKQSASKKGTSIVQQFQAPPKVSSDVPNPAPVVQSKKPALPEAEKKTSGPTAEDMNKVTRLSSPVKQREYRRPDGRKRIIPEAVGFPSNQDNIPSRSQNPGVDFSSLDQRMNGIGPSYGSNSNSNNS

SEQ ID NO: 54382 - protein, 199 aa, Sorghum bicolor
  Clone ID: 14514075.pep
VTTHGWTGQDDLWRSKLASNFHRCSNSSNKFLDSGVTTQPDRYLIVVTSGGLNQQRTGIVDAVVAARILNATLVVPRLDQTSFWKDSSNFSEIFDMDWFISYLEKDVRIIKEPPEKGGKAMKPYKMRVPRKCTPRCYLNRVLPALLKKHVIRMTKYDYRLSNKLDTDLQKLRCRVNYHALRFTDPIQELAEKLIQRMRE

SEQ ID NO: 54383 - protein, 184 aa, Sorghum bicolor
  unsure (1)..(184): unsure at all Xaa locations
  Clone ID: 14514081.pep
MARISSFHLATVLHDIHQRQRADGPAAILGLGTANPTNCVLQDHFADWYFHVTKSDRLAELKAKTKKICDRSGIKKRYFYHTEEIIGGHPELIDRTLPSLKTRLSIIADAAPNLAAEAASRAIVDWGRPAADITDQIVVTNSGANEPGADLRLAGLLGLRPTVRRTLLYLHGCSAGLTALRIAX

SEQ ID NO: 54384 - protein, 120 aa, Sorghum bicolor
  unsure (1)..(120): unsure at all Xaa locations
  Clone ID: 14514085.pep
GGVRGVQHAASRRPGPAEAGPKPARPGGRRGRTASPCAPCPSPRPXPSASPSFSPPSDTPTPTPTPTPTPTPSPELDPLARLILMVPSRQLPTTGMSILELARSRGIFDGMKPQPPTRPS

SEQ ID NO: 54385 - protein, 107 aa, Sorghum bicolor
  Clone ID: 14514097.pep
TRVLQRSLEIPVIEEGQEHALAKFSGCMQLGDTYGMLGQTALSLQWYASGLEIQKQTLGEQDPRVGETCRYLAEAHVQALQLDEAQRLCQIALDIHREHGETASLEE

SEQ ID NO: 54386 - protein, 138 aa, Sorghum bicolor
  Clone ID: 14514111.pep
MAEKDFADGVGAVDEQDLERSCRDQDDPAAAADGVSRGLAIGHFVRELMVECVASFLLVFWSAVAALMQEMHGTLTFPMVCLVVALTVGFVLCWLGPAHFNPAVTLTFTVFGYLPWPKLPLNVVAQLAGSLLACVAAN

SEQ ID NO: 54387 - protein, 54 aa, Sorghum bicolor
  Clone ID: 14514124.pep
MTLLCVPLVGRTVEEMIADAAAAAATGGDMVEIRLDFIQGFRPREHLPPPVPQL

SEQ ID NO: 54388 - protein, 188 aa, Sorghum bicolor
  Clone ID: 14514137.pep
IADSLSLTLPCHGGGFPLPWWAIQWSYLIFYLCFHYSIGSVLEVFVLIEYIMFVSGLFPSSPSNESRQPPRVCTGGAARDRRCRRLAARRCPFSAAMRGGRRRREVGGTPVAISKARSRGTVVNSREFFFDDNLSLLSVEPFFPLMLGATDRNFPLLDRLSSKKNSYISWGHRMVILKGKYFFAYVAH

SEQ ID NO: 54389 - protein, 132 aa, Sorghum bicolor
  Clone ID: 14514162.pep
MINPYLWLHMQSQVRCSLQNVRIDTKCIHQQVTYLLPSLDFIPHWTSPTTTNIAGNLTVAATSDHPCIHVEAEQRPHTHCFLTLYIIFLLNALLCFWILHLTEHTMDIILILYNINTHHSNVFYMRSSNLPS

SEQ ID NO: 54390 - protein, 101 aa, Sorghum bicolor
  Clone ID: 14514207.pep
ADLHSNCLRRGPILDSAVILFRTLAILDRLGLPPPKFIFLVENLRACRQHNCLTEPSSSSSASSSSSSPYSTASSTLLGLPFTLLPLRFPPLPLLPPLPTS

SEQ ID NO: 54391 - protein, 105 aa, Sorghum bicolor
  Clone ID: 14514209.pep
MIAARYLLQNISDELLTEIFFRFFGQYIYCWTAKGQSTDSEDTLSPVSSTQVLPVTVSVHYRLLKLWKSYYMQQFLLSPETIEQFCTDNLPDENNQSSELVSKPV

SEQ ID NO: 54392 - protein, 47 aa, Sorghum bicolor
  Clone ID: 14514210.pep
YARRPFQSSSSDLPHSVVRLTSTLMQHPELTLCSEQKHLDQEISFCL

SEQ ID NO: 54393 - protein, 79 aa, Sorghum bicolor
  Clone ID: 14514224.pep
VDKVLLPQKLFGAAEAPAPAPLAPAKKKGKTPAAVADSPEAEAEASPDATTASLAPARLTTGGAGLAAALALAGVWWGL

SEQ ID NO: 54394 - protein, 79 aa, Sorghum bicolor
  Clone ID: 14514227.pep
SLSSASSKEQQFSSMSSGPVAEKAGKAEAGKDLGGLFAIHLPIITQNPSIHVSSVCRPSVLASCRMQRLPCAAESFSYI

SEQ ID NO: 54395 - protein, 77 aa, Sorghum bicolor
  unsure (1)..(77): unsure at all Xaa locations
  Clone ID: 14514233.pep
KMNTLGSLLKICHQLPDKNNKLSVYQANRFNXKTPLGKSVAEVGCEPILHMRHFQETKRLPHKLVHQVVHGSGDEPL

SEQ ID NO: 54396 - protein, 39 aa, Sorghum bicolor
  Clone ID: 14514234.pep
CIRISSTNTSSLPSEVYLLRWKIINDCQFVFWLGSNRNV

SEQ ID NO: 54397 - protein, 90 aa, Sorghum bicolor
  Clone ID: 14514257.pep
PPPWGVMKNMHKKIPDVAYKKFQVYGHLFEQNKNSTLQSVPDLPEFALSLRPEGYELPTTDSIWENVNGQPQIQSLKEHLDDGEDEVDTK

SEQ ID NO: 54398 - protein, 47 aa, Sorghum bicolor
  Clone ID: 14514263.pep
RHGIFFFCQKHHSSQGCTKHDHKNRMHQAVTILVHSSKQLLVVIEII

SEQ ID NO: 54399 - protein, 80 aa, Sorghum bicolor
  Clone ID: 14514275.pep
ISYHNNILIFVIKIKIFLLLNQIKSEKYNAHYFHKVHMNTKNNYGILKLYYTCFQKYIIQHTCIPHKHHKNTLEYHMYTM

SEQ ID NO: 54400 - protein, 74 aa, Sorghum bicolor
  unsure (1)..(74): unsure at all Xaa locations
  Clone ID: 14514285.pep
YEISIHNACRNTNTAGWIYIAHIHRQDFFFVCVCVTRAGGQYLYMYRAKSIMRPKQTLLLVSCNNCTYVIIIRX

SEQ ID NO: 54401 - protein, 67 aa, Sorghum bicolor
  Clone ID: 14514310.pep
YTPKLNKGFASQKSVLCFSKHPCPSSGAEILSVTIIHLKCFRMPTSLCPRTPILLRIWHESWALPSD

SEQ ID NO: 54402 - protein, 65 aa, Sorghum bicolor
  Clone ID: 14514319.pep
NLLGKKQSGHLPEFPIARLEIDGSILQEAHLAALKVLVASNDLALYPRLKVELTHEAAHCAFLEN

SEQ ID NO: 54403 - protein, 69 aa, Sorghum bicolor
  Clone ID: 14514324.pep
KQTHKACFFYSLMIHKLTKAYTWMMDHGCMLMETHGKRLAHTSSIHSTTVVHTLSLYITIYKERTHSYT

SEQ ID NO: 54404 - protein, 41 aa, Sorghum bicolor
  Clone ID: 14514333.pep
AHHRSGRAQTRADQTVNQALDTTPHGNTSSSFSSGMNTNGS

SEQ ID NO: 54405 - protein, 65 aa, Sorghum bicolor
  Clone ID: 14514341.pep
YPHHQICEIRKSSTKESKELWLHPTLTKKKCNLMQTSQLTAIYLHCTAAAAASFGRFYFVLVRVF

SEQ ID NO: 54406 - protein, 91 aa, Sorghum bicolor
  Clone ID: 14514358.pep
TLDVYKGIFSVPLYGHKTSKKTCSSRRPVLPCPTTGQELDGTTNPYQHYTRAPNAWSWLTRRSTCSLYISFRSTISFLSSSNSSSRSPMSS

SEQ ID NO: 54407 - protein, 90 aa, Sorghum bicolor
  Clone ID: 14514361.pep
HRKDSNKMACIINKSTFDYIDSNASRSLAYEYLRFSPRHPFISDIRAWMSLLFLYKGANIIEVFGIELDFCDAARSENEILWLLDMLDWK

SEQ ID NO: 54408 - protein, 98 aa, Sorghum bicolor
  Clone ID: 14514379.pep
QIPVKKNELEREANRLISEGAKVLASVFPYEEAVILCGGSLPSYISKDSTPRIVKFGDNPGGPCGGTHVADISIINSLKVTNIRVKKGLTKVSYSISP

SEQ ID NO: 54409 - protein, 51 aa, Sorghum bicolor
  Clone ID: 14514383.pep
GKASSCGENIGLSSYAYNVMGDDGGPQRWMTDMSDTSLQRLSYGTNNVSCH

SEQ ID NO: 54410 - protein, 69 aa, Sorghum bicolor
  Clone ID: 14514391.pep
FAYEILDTVRVFVFVKIFSNLNPIALQTYLLSVLQNLHATTNGSRRLRAILTLEHRLEPLSRGRGKKGK

SEQ ID NO: 54411 - protein, 86 aa, Sorghum bicolor
  Clone ID: 14514392.pep
SVEPLKSASVFSELRLIVLHGFQATPAAVQYTITNTLHQNTLSSDLPTLSVVQTLPNPLSEVLTLQWLYISKTYPNLRSALPAIKA

SEQ ID NO: 54412 - protein, 45 aa, Sorghum bicolor
  Clone ID: 14514399.pep
SRSDPQGDDEETRRLRAERAARAGGWTAELSKRRALEEAFSAIFI

SEQ ID NO: 54413 - protein, 53 aa, Sorghum bicolor
  Clone ID: 14514408.pep
TEGLSRVIREQVETARAPCLTVRDVQPLADYAAFDGNFCLGVWSLGVLIKVCR

SEQ ID NO: 54414 - protein, 55 aa, Sorghum bicolor
  Clone ID: 14514410.pep
AGGQKDSSSDNCSTKETTVAIEKVIVSDSEDSADERERPPRSRLSLMRRRLAGKF

SEQ ID NO: 54415 - protein, 75 aa, Sorghum bicolor
  Clone ID: 14514413.pep
DAIRKEGCNVHGYFVWSLLDNWEWNSGYTVRFGLYYIDYNNNLTRIPKASVEWFKQVLAQKTANLEYSGSTIASS

SEQ ID NO: 54416 - protein, 110 aa, Sorghum bicolor
  Clone ID: 14514418.pep
NRLGNGLVIFFLVLCANKNVIKAKNKIYEQFNFSPSKIGASIQKVVRPSWPFSFQKCPAFLAEDYRILKHQALRYRKPCTTFAATTSNSDRSSSSASTKGVKIHGVSLLH

SEQ ID NO: 54417 - protein, 144 aa, Sorghum bicolor
  Clone ID: 14514421.pep
NFFFIATNYPAKAVNTQKRCRSGHYNNSTHSRQFTLTSKKVELRIQAYRDISEKQTTKPSVIQKPILSTISVPSLLVGPIIRLLFFHMVCSVFSSMSTIWAPFPVADFISPVVFALLVGIISMAPLAIRFIASSAFLYLPTSAS

SEQ ID NO: 54418 - protein, 167 aa, Sorghum bicolor
  Clone ID: 14514424.pep
TRPPTGIIPLGTGNDLARSFGWGGSFPFGWRSAVKRYLSKASTAPICRLDSWQTVIQMPEGEIKELPYALKKVEPGDPLEISQENGTELSEKASFYKGVFYNYLSIGMDAQVAYGFHHLRDEKPYLAQGPVANKLIYAGYSCTQGWFCTPCTASPQLRGLKNILRLS

SEQ ID NO: 54419 - protein, 79 aa, Sorghum bicolor
  Clone ID: 14514430.pep
MVLSLLPSYEGKSVLELGAGIGHFTGELAKIAGNVLALDFIESAIKKNESINGHYNNAFIYLTPRIPVEILQGSTGHVC

SEQ ID NO: 54420 - protein, 207 aa, Sorghum bicolor
  Clone ID: 14514470.pep
RGEDEPALQQKKASADGVCHEDDDDCVVLDGDPDKVVTVADAGSAGDGSSDELQIVAEKGPIACRDFPHSRHLCSNLPFSTTTHVKHCTMCHCFVCDAPAPCKYWGNSNSADDHCHATDKDSKWRNMRQTFKKKLLPASFPEKHQNGVYSTMSPPRQCHVSVPQSPPISHGSHPSLSIQSPLLNEGSQNRQRHPSVRVSLSVEATVR

SEQ ID NO: 54421 - protein, 65 aa, Sorghum bicolor
  Clone ID: 14514474.pep
ARGVPRESRRPEPQNPWCRRRTASSLQSPVSVLLAALRHHSRQRCPPSGGLPSSSRFRSYSCSCT

SEQ ID NO: 54422 - protein, 181 aa, Sorghum bicolor
  Clone ID: 14514494.pep
ARGSGPCHSSVVLKWFDNAILDDLISNLSSNAYKKELLHHAKVAACLCIIHLITKLSTGDSGSLSFSFMKKIQIISTKLSQHHAFLALLSQYSRNGYSGEQELNNLVINDLYYHICGELEGRQISSGPFQELLSFLLEFKLFEHNPLEQLQNTYLMPNEKFVFDVEHIHDELGVDLWTDSD

SEQ ID NO: 54423 - protein, 169 aa, Sorghum bicolor
  unsure (1)..(169): unsure at all Xaa locations
  Clone ID: 14514495.pep
HEGKFLIESAVAHVDFSGNLLTSTTPKELKFLADISETVLYLNLSNNKLTGSLIDGVELSTFGRLKVLDLSNNQLSGDLPGFNYVYDLEVLRLANNAFTGFVPSGLLKGDSLVLSELDLSANNLTGHINMITSTTLQVLNLSSNALFGDLPLLAGSCTVLDLXNNKFRG

SEQ ID NO: 54424 - protein, 146 aa, Sorghum bicolor
  Clone ID: 14514503.pep
KSTGRSKLGVPEGVDNSTTQWPRSSRPSCAATPTAAAAAEKAPTSETMPCRWRWPCPCASSTTRSASRCSSPPTRSTPYTSSSSRAASSRWRPSSGRSSSPRRSSSPRSPPSGRTSAAAAPSGQGSGLSAGPAALPSPRSAPSSGP

SEQ ID NO: 54425 - protein, 64 aa, Sorghum bicolor
  Clone ID: 14514504.pep
TESCPFAQEIWNRVASWENFGNLQPAIQAHADTLVDWWEATLLSVPKEKRWEFNGMAIYIMSSC

SEQ ID NO: 54426 - protein, 179 aa, Sorghum bicolor
  Clone ID: 14514512.pep
MTAAAERRKLSGYLRAVVSVPGVDASAASSIPPLSPCTLSACGAVALAPLPDDVGTQPRWPRWRAPGVVRLLRTLVANRCVEVEGTLLRVVTRKAGEGDGDGAEVEARAVLLLDVYLPVAAWSGWQFPRSRSAAAAVFKHVSCNWDARKALLDFDWTSHANTHCDDRSIWSCTDCHVLG

SEQ ID NO: 54427 - protein, 147 aa, Sorghum bicolor
  Clone ID: 14514523.pep
MGFLDVVEPKAAAADGVGVGGAAAGLEVCKVEPVLAESGGAFGPGPGLGAAPTPAPASKKKRVEGMPSKNLMAERRRRKRLNDRLSMLRSVVPKISKMDRTSILGDTIDYMKELLERIKLLQEEIEEQQQEAPGMLSVCRELNPIEM

SEQ ID NO: 54428 - protein, 73 aa, Sorghum bicolor
  Clone ID: 14514528.pep
EFQIWKFWLGWAWAFMDRKFQRGRSCLVLKKSLINNLTAGQCKLHCKLQDFQSLCAIYNATYKIRRVSAERIS

SEQ ID NO: 54429 - protein, 202 aa, Sorghum bicolor
  unsure (1)..(202): unsure at all Xaa locations
  Clone ID: 14514530.pep
ARGLVARCNAATGWRMRFAADSDSDLSRGYCACLVAALDGAKPEDVLAVDPADPDLAPLGAGITAARSRASTWHNVLVGMQKRARTAIAAREGRHPGKPFPSLVIARDGAVRAQGSYAEAQAMFLSPDESKISGLVNTLKEKKIGVVAHFYMDPEVQGILTAAKKQWPHIQISDSLIMADSAVXMAEAGCDYITVLGVDFMS

SEQ ID NO: 54430 - protein, 68 aa, Sorghum bicolor
  Clone ID: 14514531.pep
SIKPDNQPRCNIETKMKVNRSVKLYSLLSSYTPFFRLLGRNRSVKLYSLLSSYTPFFRLLGRQYFILV

SEQ ID NO: 54431 - protein, 98 aa, Sorghum bicolor
  Clone ID: 14514545.pep
GCACQVGVCVLDKQDGHHSRFRIRGRRPHVHHWSDHLDDRFRRLHRHDHRRNTDLICASFFFDHVGCDHDHVSHDYHDSDNVSNCVDDTSSTYPIQRE

SEQ ID NO: 54432 - protein, 111 aa, Sorghum bicolor
  Clone ID: 14514556.pep
MGCGPSIPEKYSIRGKSGKRRSIIQEVAVFVPTIRIPLASDIAHPLRGIVSKDLVDRLSTLRAHVVALAEEIYSADVSAVQELQHALEEYLPVVLGLTMKESRLESSVQFT

SEQ ID NO: 54433 - protein, 142 aa, Sorghum bicolor
  Clone ID: 14514563.pep
MFPSSSASATAPRFLRPFTGATAVPRRAMAAASAGGPSDPSTPQQSSPTTKAVRVVVKGRVQGVFFRDWTVETARSLGLAGWVRNRRDGTVEALLSGDPDKVDEMVSRRIPVGPPAAVVTAVVPSPAEPVAPDEGFHRKPTA

SEQ ID NO: 54434 - protein, 92 aa, Sorghum bicolor
  Clone ID: 14514574.pep
LSPWSLIAQVIMVCWCEWLINFHRLGLEGVLFCSCWVLLLYYCYYYSSPSLAAGCGRYLPQLPSLGQGSAVCIVCLPSCYYWIGWPSSRRVW

SEQ ID NO: 54435 - protein, 142 aa, Sorghum bicolor
  Clone ID: 14514583.pep
MGGVCSAGIAGDKSPAELSFRAMGFVVEQDFRTFSAAGKNKTAPVEEAVDPNQVSDQSFRLSDEGSPPSTGSKVRRSVSKEPHLTHAESRKAKGGKPRRSASGKAGPSKVSDIGIALGRESTSGLGKAVEVLDNLGSSMSSL

SEQ ID NO: 54436 - protein, 112 aa, Sorghum bicolor
  Clone ID: 14514590.pep
HEAQIPFATVSLAAAAATAYPDPDTSPPAATSPSDSRRPAAPPTIPPCSALRRLDSRYPQTNPIARGSVVEEHWGRERGSHQPSRSLPPASTTPLTLAKNGHLKSHLTPFDL

SEQ ID NO: 54437 - protein, 197 aa, Sorghum bicolor
  Clone ID: 14514591.pep
TRLKTGNESSVDRLIKQITNFMSDIADEFKIVVVEAIRSLCLKFPLKYRSMLNFLSNSLREEGGFEYKKAIVDSIVALISEIPDAKEIGLLHLCEFIEDCEFTYLSSQILHFLGNEGPRTSDPSRYIRYIYNRVILENATVRASAVSTLAKFGALVDTLKPQIFVLLQRCLFDTEDEVRDRATLYLKLLVVKLPLVT

SEQ ID NO: 54438 - protein, 216 aa, Sorghum bicolor
  Clone ID: 14514592.pep
HEAEAAIRAFREKYPQVYTSDDKFVIDVDSVTVEKYHFLEAMSTITPAAHRGSIVHSRPLSTVIAPCLKRHLEKIMEQISDIFPFLSSIDFSKFSALSYGSSIPLVYRPRLLICGGESVGLDHVGPAVLHELEKFSVHSLGLPSLLSDPSAKTPEEALVHIFGEAKRTTPSILYLPQFHLWWETAHEQLRAVLLTLLNELPSNLPVLLLGTSSVAF

SEQ ID NO: 54439 - protein, 125 aa, Sorghum bicolor
  Clone ID: 14514608.pep
MTLALCFSRSGLLNRRINHLANQVLRLHLAFSSSASPSPSDPSSSSAAAAATGPQTTIREGKAEIFLDESNSVFYNKAQVNNRDISIAVLRSFILKRHEEYATRSRKAGTKDTTLSEHAKYKEPK

SEQ ID NO: 54440 - protein, 180 aa, Sorghum bicolor
  unsure (1)..(180): unsure at all Xaa locations
  Clone ID: 14514611.pep
HEAEGLRVEQTIISKIMTRNPIYVMSDTPAIEALQKMVQGKFRHLPVVENGEVIAMLDIAKCLYDAISRLEKAAEQGSAIAAAVEGVECQLGGNFSVPSALIETLRERMFKPSLSTIVTENTKVAIVSPTDPVYVAAQKMREFRVNSVVVATGNTLQGIFTSXDILMRVVSQNISPDLTL

SEQ ID NO: 54441 - protein, 207 aa, Sorghum bicolor
  Clone ID: 14514623.pep
MADASDVRIEDPLSILNSRTNEHHALELRNKELLVSELQNTLDQKSKQLGETEIKLSAMMDEVNSLNKELEQTRGLLDESQMNCAHLENCLHEAREEARTNKCSADRRAVEYDALRSSALRIHGLFERLNNCVTAPGVTGFAESLRSLAISLASSVKKDEADTTVQFQQCIKILADKVYLLTRQSADLLERYSAMQAVHGGITKELD

SEQ ID NO: 54442 - protein, 34 aa, Sorghum bicolor
  Clone ID: 14514624.pep
AGAARAGGRQARRAPHPALAILSLPRAEPGSYCS

SEQ ID NO: 54443 - protein, 58 aa, Sorghum bicolor
  Clone ID: 14514629.pep
AVMNGMESVTPRGRRPSAAGTATRKWIDNLLPTRTASWWKNTDVGALAVGVGVGVPRA

SEQ ID NO: 54444 - protein, 177 aa, Sorghum bicolor
  Clone ID: 14514639.pep
HEEFIHLGIPLPEGEGEDLLAQNAAEEEEDLLLLEGEDGYVDGDGGGYYPELRCNDGEYYYEDGQEEEDAVALDLERRICRLEHDQETRLLEPPLEVEEEEEEGTHLYTDEALPNLSGHERSGLYADVVLSEEDVEVEARSNLHNDDEELPESPTAGSADGEEASEADGVDSVSGSG

SEQ ID NO: 54445 - protein, 74 aa, Sorghum bicolor
  Clone ID: 14514651.pep
ARGSSVPLSLGVNQKTRRFSKHVTAVVTQAPAPGNRRRGLSTRGRHSESHRDSRALCTPNLAPTVLNLSRRGHH

SEQ ID NO: 54446 - protein, 162 aa, Sorghum bicolor
  unsure (1)..(162): unsure at all Xaa locations
  Clone ID: 14514652.pep
ARGLLLSGGASLGSFHVGVVKTLVEHKLLPRIMAGSSVGSIICSIVATRTWPEIESFFTDSLQTLQFFDRMGGIFAVMRRVTTHGALHDISQMQRLLRDLTSNLTFQEAYDMTGRVLGITVCSPRKNEPPRCLNYLTSPHVVIWSAVTASCAFPXLFEAXEL

SEQ ID NO: 54447 - protein, 80 aa, Sorghum bicolor
  Clone ID: 14514658.pep
MYVPPLPTGGAGEQPRVYQVWRGSNEFFLQGRFIFGPDVRSVFLTMFLIIAPVVVFCVFVARHLINDFPDSWGISVMVVA

SEQ ID NO: 54448 - protein, 70 aa, Sorghum bicolor
  Clone ID: 14514663.pep
FCVTENDSPTILITSSFSLMLIFYLHASIVPVDIDLVLCPYHLVVVMGFRQLVEPPQSPPPTTVGRLHCD

SEQ ID NO: 54449 - protein, 135 aa, Sorghum bicolor
  Clone ID: 14514683.pep
HEAHVFFFFLLRSARNPPRATSPPLGDIGLLRCCRPSSPPPPPPCRGARTRLHRLDLAPPSAPVAVGHTPPLPLPDELAVERRGRRRRQEEPRDGQRILLFLLAPSVLISTAASCIEHVLNCSWRNVNKYADISA

SEQ ID NO: 54450 - protein, 95 aa, Sorghum bicolor
  Clone ID: 14514699.pep
LNQRAATDPQVAELEVVESTGCHRPTGRRPVKAVEAARHRRIRRRWNKSRVLAGSAGRRPAVVVAIADAAFRAEKRRVEGWRRKRKGKAKGPSLV

SEQ ID NO: 54451 - protein, 163 aa, Sorghum bicolor
  Clone ID: 14514709.pep
ARGYHIPMATTEGCLVASVNRGCRAIAASGGAVSSLFRDAMSRAPVVKLPSIKRAAELKEFAEALTNFETLAAVFNRSSRFGKLQGINCALAGRNVYIRFTCSTGDAMGMNMVSKGVENVLGYLQTDFPDMDIISLSGNYCSDKKPAAVNWIEGCGKSVACEA

SEQ ID NO: 54452 - protein, 160 aa, Sorghum bicolor
  Clone ID: 14514711.pep
MAQAKRLNLRMQKEIKLLLDDPPHGVSLNLSEDENVLSSLSSIEARIEGPEGTVYANGVFILKIQIPERYPFQPPNMTFVTPIYHPNIDNGGRICLDILNLPPKGAWQPSLNISTVLTSIGLLLSDPNPDDGLMAEISREYKYNKQVFDINARLWTEKYA

SEQ ID NO: 54453 - protein, 153 aa, Sorghum bicolor
  unsure (1)..(153): unsure at all Xaa locations
  Clone ID: 14514714.pep
ARGYDLGIQAPGRCSILSHIFCREGKSSTEPYVVAHNILLAHAGAFHSYKQHFKKDQGGIIGIALDSKWYEPLSDVDEDTEAAARAMDFELGXKLAGDRLPKFSTQASKLVSGSLDFVGINHYTTLYVRNDRMRIRKLVMNDASTDAAIIPTG

SEQ ID NO: 54454 - protein, 177 aa, Sorghum bicolor
  Clone ID: 14514718.pep
TRLFPDINGNRNKAFFLGYMVKCLLMAFTGKRKCDNKDDFRNKRLDLPGELLGRELRAQLRLLERRMVKAIQRDLNNDRELQDLERYIDASIVTNGLNRAFSTGSWCHPYKRAERCSGIIATLRRTNPLQMMSDLRKTRQRVAYAGKAGDARYPNPSYWGKLCFLSTPDGENCGLVK

SEQ ID NO: 54455 - protein, 143 aa, Sorghum bicolor
  unsure (1)..(143): unsure at all Xaa locations
  Clone ID: 14514720.pep
PPAHQGAARAGXAVHIIAPGGKLIYWNRYAEQMYGYSTSEAVGHDALELLVHPDDAEAANNIIGNIFMGKCXRGKFPVKKKSGERFFIVANNTPLYDDDGSLVGLICLSVDTKTLEDIMGPSTSVRSYAHPVKPRFQVNNRPK

SEQ ID NO: 54456 - protein, 143 aa, Sorghum bicolor
  Clone ID: 14514757.pep
MTMMTPPPLEQQQEDDEMLVPHQELPVAGPEAAPQPMEVVAQTEPANTAESQPPEDPQTSRFTWTIESFSRLNTKKHYSDVFVVGGYKWRVLIFPKGNNVDHFSMYLDVADSGNLPYGWSRYAQFSLAVVNQIHPKYTIRKDT

SEQ ID NO: 54457 - protein, 219 aa, Sorghum bicolor
  Clone ID: 14514767.pep
TRARYLLEGMQNGDNEGLSFDPRAMRFECPRLVEGLSWLGAQLGVLYGESNGKLFALVSVKEAVLQMAYCLAVCVGDGAAGVGDDKVGAGEKGSDVGDVVAGPVFLSQVAASIVALYERFYLEEKTKALQAQRLSNYQLYALLKFHDVLISALHISIIVISYASNYTRKVDRAYIVPNAERGICLREEGVIIKRQLRHQSNFWIRDAISLVLLVFAYPL

SEQ ID NO: 54458 - protein, 81 aa, Sorghum bicolor
  Clone ID: 14514777.pep
SALLLNTLHHVLEAGAGAVAPFLRPSTHQVLWYLKYHDLHGGEQESRKSNYTDLVNKYYDLATGFYEYVWGDSIHFAGRYP

SEQ ID NO: 54459 - protein, 164 aa, Sorghum bicolor
  Clone ID: 14514779.pep
RAAGRGHRQVAAGHSRSATRVRASAAGHWSPQRSPARSLGQPARSGGAGRGHRRVAARAAGRARPPESARARRGQGSGRTARPPGISGSQRGRRGAAPESAWARAGQREPALGAATGVLFSAGSRSGRVAGAHGAATGRLQRGRGRRSRGGRETRVGWKEWPSC

SEQ ID NO: 54460 - protein, 61 aa, Sorghum bicolor
  Clone ID: 14514793.pep
MSVWNYVVTAHKPTSVSHSCVGNFTSPNQLNLIIAKCTRIEIHLLTPQGLQPMLDVPIYVR

SEQ ID NO: 54461 - protein, 163 aa, Sorghum bicolor
  unsure (1)..(163): unsure at all Xaa locations
  Clone ID: 14514824.pep
HEGQGNDSLAYVDGPLEAAKDSGEVTDEEATSSGSDDERGPGPADVDRLREMLHRSRNELEVARLNSTMFEEKAQRISESAIALKDRADGAQRDVSAAVATVQEIIGKEADAKEAVQKATMALSMAEARLQLAAEALEAKRGSVGPMEVSIXGVEEEALVSAQ

SEQ ID NO: 54462 - protein, 203 aa, Sorghum bicolor
  Clone ID: 14514854.pep
HEAAISASSIAFLDASPHPAATRSLDQVPDRQVDGYANGYEAHAEAVDVDTNSPRVEEAAKDEDDDGEEDGDTGVAALGIVERLALLRSQISGKLDTIQQRAAAVAAKRRLLAGRRRKVAEEAASVASSHKDMERELEEACEAEDFEKAERISDSLAALEKEKDRLLTVLRDAELDYDSVDSELQEVLESRIAAEEEAASLLG

SEQ ID NO: 54463 - protein, 167 aa, Sorghum bicolor
  unsure (1)..(167): unsure at all Xaa locations
  Clone ID: 14514875.pep
TRLNSIDMEVDGGNITCNVENPRSFKSDKSAEDKIMDCEMISLKGSELKNGVRVRDVNLNSCLDSISSPISGGNYETSDTPDDAIRSSIIAQCFGTTSNDDTACKDGNFANQNNTCKGENFVNQKNDMMYQSNLTMDPIPRAQINVDCFTSSCSMTPXIKDYGNRGE

SEQ ID NO: 54464 - protein, 195 aa, Sorghum bicolor
  Clone ID: 14514882.pep
HEDSLDILLETWNVILGDVDADKSPISVDGALAASSLFKIIVESHLKAAADSAFEDTDDTEYFHVSVSKRDEQLALYALIARAAADTTIPFLAQLFSERFARLNQRNGESDPTQTLEELYWLLLVTSHVLTDSGEGETLLIPEALQAGFPNVIEAAQHPVVTLSWSIINFSRQCLDPGIRAKYFSPRLMEAVIWF

SEQ ID NO: 54465 - protein, 132 aa, Sorghum bicolor
  Clone ID: 14514891.pep
TFFLSEKDVGQNRAQACVPKLQQLNNAVIISTITGDLSKEQLSNFQAVVFTDISIEKAVEFDDYCHSHHPPIAFIKSEVRGLFGSVFCDFGPEFTVLDVDGEEPHTGIVASISNDNPALVSCVDDERLEFQD

SEQ ID NO: 54466 - protein, 89 aa, Sorghum bicolor
  Clone ID: 14514904.pep
ARGEEEGRVSVCIPPRNALLLMRCRSDPVRMAALATHFWGSPSAATVEHVDNEVTGCLNDNGEEEEEEAEAEPDGVQRRSSLFSCFCQR

SEQ ID NO: 54467 - protein, 101 aa, Sorghum bicolor
  unsure (1)..(101): unsure at all Xaa locations
  Clone ID: 14514928.pep
NFNSTSLCTELVCTVSSSGGLQVMSVKFQVPSPLVPTRESXFVRYCRXNADGTWAIVDIXLDSLRPSFVLKCRHLPSRCLIQGMPNGYSKLYYQKHGCKGP

SEQ ID NO: 54468 - protein, 78 aa, Sorghum bicolor
  unsure (1)..(78): unsure at all Xaa locations
  Clone ID: 14514991.pep
IFLLLYKFIYSDPGSCCAVXLIISLLMFWKHFQLVFKLSLKNNLFWIFTRYEQKKKFQLSVCFEHREFYFPQRLKHRY

SEQ ID NO: 54469 - protein, 85 aa, Sorghum bicolor
  Clone ID: 14569449.pep
LPQQGVDRIDFCNIFGALEELLEAFNSNPDHAMADFTAFKSGFCQRVVYEDVCESFETLLEMYRTTRTRYMRGMLALHGAGAHVS

SEQ ID NO: 54470 - protein, 76 aa, Sorghum bicolor
  unsure (1)..(76): unsure at all Xaa locations
  Clone ID: 14569465.pep
YFLNNPCPTATIRRIQSGKQYSRYKTDPRGXKHTGSFYNSTIYTTAHQQDRRAAKKLHGRHDGRYPILQPEYLTIT

SEQ ID NO: 54471 - protein, 93 aa, Sorghum bicolor
  Clone ID: 14569469.pep
CIVDHRMAARSLSTPERDAVDNECNKAEQWLREGSQLQETLPKNVDPVLWSCEIKRKEEELDMFCRNIARYKGSPARTDGSRGSDHMPTPDRD

SEQ ID NO: 54472 - protein, 44 aa, Sorghum bicolor
  Clone ID: 14569479.pep
DSIYDQSFVNNCYCNLQRSLLTRKIQMIFITLFKYSCFHYALIC

SEQ ID NO: 54473 - protein, 48 aa, Sorghum bicolor
  Clone ID: 14569508.pep
WENYSQTSCMLGSQRNGYTRTNEYTNILFIAFRIKLFFKGVPPFLQCT

SEQ ID NO: 54474 - protein, 65 aa, Sorghum bicolor
  Clone ID: 14569525.pep
AGSCSFCAPFIQGSNTNALQCSVSTTIFTERSTINYCVTTQRRTARLQALKVTRERENSTGSKLR

SEQ ID NO: 54475 - protein, 77 aa, Sorghum bicolor
  Clone ID: 14569529.pep
WQHKRPAMKVCPICGKNAGLSSSSLKLHLQKAHKKISSGSVDSAMTLEIQKAIEAIKAGWSGSDSPVHKSQSHIEGF

SEQ ID NO: 54476 - protein, 87 aa, Sorghum bicolor
  Clone ID: 14569591.pep
HIIHVICEEKLPWTMTSATLLCGCRFSDCRRCYRPQSMMMSRCDLGLLLWHSLLSVTSFACTVSMCMCTSEVVAFGSLWLGCVVLSF

SEQ ID NO: 54477 - protein, 69 aa, Sorghum bicolor
  Clone ID: 14569593.pep
EPLLPNSVTVLPQPFCRTTEVLPPTSYSAQTHQLLSAPNLITGSASYQQLSFMQIKKSSINISKLNKFL

SEQ ID NO: 54478 - protein, 103 aa, Sorghum bicolor
  Clone ID: 14569594.pep
ATNNAAEYRALILGLTYAAKKGFKYIRAQGDSKLVCNQVQDLWRVKNENMAGLCKKVKVLKGTFHLFQIRHVLREYNSAADAQANFAVELPVGEVQEQSNFPC

SEQ ID NO: 54479 - protein, 201 aa, Sorghum bicolor
  Clone ID: 14569604.pep
EDFRQYTKLFLSELIAFVSNGDRDIPYLGSFNDILSKMEEFAKYWLDEKTAERFRELLINHPFLKPSIIRSYLLSGIYTACRAHDLSDSDATFKSTLKLAGGTVSWIRQIKTLANTVCTAVLCFDPRTDHGKKENDKDKRSGQVVEDDKADEIFSENLESFVEYMRHTFHHGPDHSKEKRKQIVDSDGNFYDPENKPRKQY

SEQ ID NO: 54480 - protein, 87 aa, Sorghum bicolor
  Clone ID: 14569612.pep
NSPTKIFLVLLGFYTANALATILGQTGDWDVLVAGVVVAAIEGIGMLMYRKPITRPPGRFQSLISMVNYWKAGVCLGLFVDAFKLGS

SEQ ID NO: 54481 - protein, 63 aa, Sorghum bicolor
  Clone ID: 14569620.pep
TILHLSVCNCRSKYLFGLFLKALVVSSHSTQQSELSRMLIVPGRSFPKMNTTNKPLKAWFRGF

SEQ ID NO: 54482 - protein, 114 aa, Sorghum bicolor
  Clone ID: 14569631.pep
WCRPQKILSQQLKRRPLQMAVNFHCMPSAIGAWSKETPFVPQKRWCSSHSRFCYVFFSLCFSFAMMLGCRRVQSKAILYPARFLDALSFKVVRWILAVLIPSSSVLCLVVWSCT

SEQ ID NO: 54483 - protein, 135 aa, Sorghum bicolor
  Clone ID: 14569641.pep
FEEGAVLCNFLPLIREYLPSAAEEIESDIISLAQSEDSEVYDIYTVKEVDDTNMEATSAASYPRLQVDDGEDECYDDDYPYDTDDSNAEDNPLFDYPDELSEDEDDGSNDEDPFGDEEGSDTEYEKEEVEAEEDE

SEQ ID NO: 54484 - protein, 111 aa, Sorghum bicolor
  Clone ID: 14569647.pep
KRCSLIISDADSWQWIKILQCQSHIPITLKKDETCPIWKGMLYTRLSRYRRTQNSDSEPVYSYSRIYSNLVFVFFYGFGGHCTEGNSQQEIQIKRHRRKQMSHSPTFSFSF

SEQ ID NO: 54485 - protein, 146 aa, Sorghum bicolor
  Clone ID: 14569674.pep
SDLSFRMESVLLAIARKTKKTNKKEWDAVSGRRRHDVPCVPMPAGLRFQAMQCRGNFYWILAGAATAFALCLLAVKSIFHYSWQWQLVLLRRSTPSTASSPIWVIRPWPWPAIHDMSEKASEIRGPDGQICREETGEGGKEGRCQV

SEQ ID NO: 54486 - protein, 112 aa, Sorghum bicolor
  Clone ID: 14569678.pep
LAGCVLARELWFAVLAPLGVSALVPVTNTRLIDWWLRSRIALLGDLRPAFDCLVLLVAWILWKERNARTFNQEACNVQELLSKLLCEAQDWVAAGFVSLSVLPQLSLLNNAL

SEQ ID NO: 54487 - protein, 96 aa, Sorghum bicolor
  Clone ID: 14569680.pep
DQAVEVDSAAKLPVMLALTSLWLRKNYADSFLVNFIDSLPEIYPVVKEWVEDVLMDEGNATILTLFACLVTVLYLRERQRRQVAAANPQQPDDVAM

SEQ ID NO: 54488 - protein, 62 aa, Sorghum bicolor
  Clone ID: 14569682.pep
VAAQVGTWQTLLTTASTCMIEVMMELQNDQVIDHFTVVPDHLLLLGMMKIQCSRRLLQQPWH

SEQ ID NO: 54489 - protein, 157 aa, Sorghum bicolor
  Clone ID: 14569684.pep
CALLITSILSERWLKHTHTTHLIVQQAETHTNRQPDSRWLPHGQACTQHQAGMQASGTNQAPRMAVFLISKSNQTHAENCKRKQLANSASQSSKAGATLKPRTFPGLSHNKQTDQLAVADSIHRSSETTDDIAAISDAYSPDRMSFHHLRTVVLSVR

SEQ ID NO: 54490 - protein, 67 aa, Sorghum bicolor
  Clone ID: 14569709.pep
YYNYDSANVLSANSQMEGDPFLQTEICVMDSVQLDQHILGDYVSTMVGTCVLDAKFCKPMGSACKSS

SEQ ID NO: 54491 - protein, 98 aa, Sorghum bicolor
  Clone ID: 14569728.pep
KWDPVMLGGAESGDTIGVHGHGADMETGLRCQGGADAWEVQCVCGAQDDDGERMVACDACNVWHHTRCVGIADGAPVPPLFLCISCSGALMAAGPISG

SEQ ID NO: 54492 - protein, 171 aa, Sorghum bicolor
  unsure (1)..(171): unsure at all Xaa locations
  Clone ID: 14569757.pep
ARGPILFAAARATRQTSSSSSPPAALAARLLRRVLSRSPQTLSPLPGSFVALLPLLLSSSCSSVAALSCEVLGAAALRCMETGEMLASDSGIASGLARALGSRSQRVIEAACNSILDLSASSVGRERLAGSPVLPRXIVESVYGFAQSGSTESTESPTEANKILCLIIDTM

SEQ ID NO: 54493 - protein, 175 aa, Sorghum bicolor
  Clone ID: 14569768.pep
HEARRDAVHRHRSPVKEIKREYICKVLPFRFVDDERDYLSVTKRYPRLAITPEFSKIVLNWAKENLNLPLHTPVSLEHDVLDSDDGADEGAIVATEKTSPATIWNAKVLLMSGMSKGAFADITSLRSTEERVAHLNNILKFAVLKKDRSLFAIGGPWNAAIDGGDPSVDCSCLIR

SEQ ID NO: 54494 - protein, 150 aa, Sorghum bicolor
  Clone ID: 14569773.pep
SRNTCSWRTEEPDAAKLYPWYAPCTAGTSVGAALMTGGGPWRWSAACASPMRRPRSWFATSCCSWSSTPSASGGPHLNTNQQHSGTHTQRPRNDGKSKPPEGLRKIGEIGRREWGRRIRGSGVGADRDWGAGVSSSGGGGGRGGRRWRGR

SEQ ID NO: 54495 - protein, 156 aa, Sorghum bicolor
  Clone ID: 14569777.pep
ARGFEHFAQEFRDRYRIDVVGNVKASMRLRAACEKAKKVLSANAEAVVNIECLMEEKDVRGVIRREDFEKLCARLLERVVEPCKRAVADSGVGLERLHSVELVGSCSRVPAIAKVLAGFFIREPSRTLNASECVARGCALQCAMLSPTFRVREYEV

SEQ ID NO: 54496 - protein, 147 aa, Sorghum bicolor
  Clone ID: 14569793.pep
TRAMDAFRILQKRDVVFGVDRSAKVSFADSYPQVDDEIMAQVRTVFLDGLPPSWDEDRVKKYLKKYGAIEKIELARNMPAAKRKDFGFVTFDTHDNAVACAEGISNSEVGEGDHKAKVRARLSRPLQRPPRMKHGLRGNFRVGHGAP

SEQ ID NO: 54497 - protein, 140 aa, Sorghum bicolor
  Clone ID: 14569798.pep
MTSPGGVFSTALVAEDFPWVEREEEMGMAPDTYSEVFGLAQRGTLAFRDRRFDEAISCYTKAQNLRPDPIILGNRSLAFCRLSQLLRERSAADSEYQPLNGLDPTTHAELALKDAEKILSINSNSPRPYLLRAYALILME

SEQ ID NO: 54498 - protein, 211 aa, Sorghum bicolor
  Clone ID: 14569806.pep
TRISGSIKSKSSPPQQHPIPECSDLVNFPFTDPQHLQLRAQIFVYGALIQGTPPGEAYMLAAFGEPVGCGKPTWEAAWRAAFERFQYQKSLYVSLETPTSARIGSSVPEKASKSTAITTVPASKKGGKTVAPAHPAVTLSPTSNVPFGSSTFNLQRGTHLDFSQAVSPFAHMRHPSPGVAPWYTQSPGPRPAPWLIPPQNLIFDSSMQPAI

SEQ ID NO: 54499 - protein, 147 aa, Sorghum bicolor
  Clone ID: 14569815.pep
HEARAERKAEEAPQRPPRSARPPNVSSGADRPPPRWGLTGWSWCPIPTCSAASRRPTFACSRPSMRRCGTRRLTGGCGYGTSPPPSLASAAAVRSGAGTPRRRIARRSQAPAWASLTRSGPPCLRPSRAPTRSRIRTPASSSSSAFT

SEQ ID NO: 54500 - protein, 92 aa, Sorghum bicolor
  Clone ID: 14569818.pep
TREELNRTARAATARTPVSNFYCITKDTEMGAKENGEERDDHSSDVERDGKHRKETETDYEPARNSLSSPDEATNNEDTKVKRVSRVPKKLA

SEQ ID NO: 54501 - protein, 190 aa, Sorghum bicolor
  Clone ID: 14569821.pep
ARGRAVQRLDLMKSKASVLSSGATTLGSSFFFLGSRLADSLLVQFSCGVPTSVLPDLTDESADIEGDLPFSKRLKRIPSDVLQDVTSVEELSFHNKTVPNIVDSAQKISFVVRDALINVGPLKDFAYGLRTNSDPNATGIAKQSNYELVCCSGHGKNGTLSALQQSIRPDLITEVELPSCTGIWTVYYKS

SEQ ID NO: 54502 - protein, 202 aa, Sorghum bicolor
  Clone ID: 14569822.pep
ARGIDPTKVHSEDLLHVWSMPSTANVSQQEVPRPLEKVNLLAARNERESFQIALRPKVSWATSGIAGSVQIQCTDLCSSSGDRLVVGQSITLRRVVPILGVPDALVPIDPLSPQVTLQPGETAAVWVSLNVPCGQPPGLYEGEIFITAVKTELDSRTESLPKSEKYRLYRELRSCLDLTGPRDYSSPEEMVQRLTSASSALR

SEQ ID NO: 54503 - protein, 163 aa, Sorghum bicolor
  Clone ID: 14569826.pep
HEEHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWVKPADSEPPPLL

SEQ ID NO: 54504 - protein, 87 aa, Sorghum bicolor
  Clone ID: 14569834.pep
METTTAARRRRRLLLLLVLLALAAHRAAARFVVEKNSLRVTSPAALRGVYECAIGNFGMPQYGGTMHGVVVYPKVDAKACRPFDASG

SEQ ID NO: 54505 - protein, 164 aa, Sorghum bicolor
  Clone ID: 14569838.pep
ARGRLRCRPLGWRGNYANLLVANREAYANLDTLDDVYDSAIIRYKPEIIRSPQKQKQRRAVSISGSIGSDVSDLILEDSYASGGHEFSSFNIVAIDSGVPRRPPASKRAKDQESYPKLVELTLNNFDYSSKLLFEVSFGKLGTPGHEEFDVSSDYSYNSPLSES

SEQ ID NO: 54506 - protein, 101 aa, Sorghum bicolor
  Clone ID: 14569841.pep
MGLLWGSLAFLLLLVVSPAQAQLPSQDILALLAFKKGITHDPAGYITDSWNEESIDFNGCPASWNGVVCNGASVAGVVLDGHGISGVADLSVFANLTLLVK

SEQ ID NO: 54507 - protein, 90 aa, Sorghum bicolor
  Clone ID: 14569845.pep
THTSIGHRTRRTLPQTRWRPVTVDFPAYPAIPNQHVTSGGPGSATGLLPPGGTTHRSGLERGRRRAGFEPSGGGSAPTGVRNCGTRLALV

SEQ ID NO: 54508 - protein, 129 aa, Sorghum bicolor
  Clone ID: 14569852.pep
EMCWAGSRADLDKQTARIVTMAHPSQANNPKFLSLRWPLATHYPSCLASLRLNQTSPLFDLVSLRSLPTETLEDDDGNGPPCGYAGCRPSHSYPHGRILIYFDLLKWYNNNDLICRVSLEGRLVCCFRF

SEQ ID NO: 54509 - protein, 134 aa, Sorghum bicolor
  Clone ID: 14569853.pep
TRSSGSSASSSSSEASKLYVRKKNKKSLGRNLQSQYREASKNPNAQEATQGSEKKQHDVNDTCIENNPVLNDDVGHYSQARENQSRNVDGVPEKSQASVPTVRDGGIFKFLGGPKPGDIEYNLSSAIHCYGAAK

SEQ ID NO: 54510 - protein, 68 aa, Sorghum bicolor
  Clone ID: 14569858.pep
MRGVTSAAKRAGEMAFNAGGGAVNWFPGHMAAASRAIRDRLKLADLVIEVRDARGSSPDIILLCPIQL

SEQ ID NO: 54511 - protein, 156 aa, Sorghum bicolor
  Clone ID: 14569900.pep
MTTNTKRAYKLQEFVAHSSNVNCLKIGRKTSRVLVTGGEDHKVNLWAIGKPNSILSLSGHTSAVESVGFDSTEVFVAAGAASGTIKLWDLEEAKIVRTLTGHRSNCMSVDFHPFGEFFASGSLDTNLKIWDIRRKNCIHTYKGHTRGVNAIRFTPD

SEQ ID NO: 54512 - protein, 176 aa, Sorghum bicolor
  Clone ID: 14569901.pep
HEELTGTLPPELCAGGKLQTLIALGNFLFGAIPDSLGQCKSLSRVRLGENYLNGSIPKGLFELPKLTQVELQDNLLTGNFPAVIGAAAPNLGEISLSNNQLTGALPASLGNFSGVQKLLLDQNAFSGAIPPEIGRLQQLSKADLSSNKFEGGVPPEIGKCRLLTYLDMSQNNLSGK

SEQ ID NO: 54513 - protein, 83 aa, Sorghum bicolor
  Clone ID: 14569902.pep
IGRAAEHAKRREGQSVGLNSRRDYLSLLALDKGKATDDILLMYLLPLRQGIEGKNFAPIPTTSTTYVVGVRCRYSLCPNHATS

SEQ ID NO: 54514 - protein, 133 aa, Sorghum bicolor
  Clone ID: 14569903.pep
MDSAPAGEPFYVVRKGDVIGIYKTLSECQAQVGNSVRDPSVTVFKGYSLRKETEEYLAARGLRNALYAIDAADARDELFDDLVPCPFQQPDGAASSTLKRPHEIETGPSKKHPKVDEQELPDSHLSCILEFDG

SEQ ID NO: 54515 - protein, 159 aa, Sorghum bicolor
  Clone ID: 14569914.pep
SQAGSILVSVVWAVNLWLHHISASCASFPNLAGEVLPLLVGLPLLVGLLHKVFQYIHFFLDVCHSLPVLLLIHKVRQLQFVLVDRVVRCNRGRCGRRRRADRADRRGACRMGFTCRRARRGEARRGPHRPRAPRLRTRIPELVAVLLAPPRRRPGLPSC

SEQ ID NO: 54516 - protein, 99 aa, Sorghum bicolor
  Clone ID: 14569918.pep
TRQRFDGIDRHDRYANRNVVFFDINMKGLDGIQGPIYVGTGCVFRRQALYGYDAPKTKKPPSRTCNCWPKWCICCCCFGNRKTKKKTKTSKPKFEKIKR

SEQ ID NO: 54517 - protein, 69 aa, Sorghum bicolor
  Clone ID: 14569925.pep
MTTSPPPAEQQQQEEEEVLVPHGPQQELPNGAQPMEVVPAEPAATVENQQIEDPPISRFTWTIENLSRV

SEQ ID NO: 54518 - protein, 138 aa, Sorghum bicolor
  Clone ID: 14569930.pep
AKRFHVALTATDALYSQWQSRIMHYWYKEMRDRPGSDMGGFTRILHSGKPDGLMDEIPTMVVDPLPEGKDKGYIVLNRPWAFVQWIQRAKIVEDYILMAEPDHVFVKPLPNLAHGDEPAAFPFFYIKPTDNEKILRKF

SEQ ID NO: 54519 - protein, 175 aa, Sorghum bicolor
  Clone ID: 14569936.pep
ARGLLASLRGAARDREAEIEELCRAHFHDFIRAVDDLRSLLADADALKGSLSASHSALLSSAAPLLASLESFLVARSLAGNLSSALASSRRCVRLLALAARANAHLQAGNHGLYLALRAVDAIDRDLASGPEPLPLPTLRRMLLSVVPAVRAHAEREISREFSDWMGSIRAASRH

SEQ ID NO: 54520 - protein, 175 aa, Sorghum bicolor
  unsure (1)..(175): unsure at all Xaa locations
  Clone ID: 14569941.pep
RGYNTNTYAPSFWYGSHVYGPGLYGGWNAFSNGKYRPRGKTYGSYGFGNENLDSLDELKRGPRSSLFKKQQGSGAAVDSKGQEPPNSDGSNAVKQEQYNLADFCETYSDAKFFIIKSYSEDNVHKSIKYNVWASTPSGNKKLDAAYQEAKEKSSXCPVFLLFSVNTSGQFVGLAE

SEQ ID NO: 54521 - protein, 140 aa, Sorghum bicolor
  Clone ID: 14569948.pep
TRANHTATIVFNSTVVGVKPAPIVAAFSSRGPSVASPGVLKPDVMAPGLNVLAAWPSEVPVGGPESNSFNVISGTSMATPHITGIVALVKKAHPDWSPAAIKSAIMTTSSAVDNDGNQIMDEEHRKASFYALGAGHVVPT

SEQ ID NO: 54522 - protein, 200 aa, Sorghum bicolor
  Clone ID: 14569951.pep
ARGSSAAAPAGEASTSEPAAKGKPIVVRVKRKPSQTRPDAFWLEINERPAKKAMLDFSSLSISDPPSSSSAASAKASEEPRVKKLLVQHIETVHHSEAVEDVLHSLLLADLNSKEIKSKTKEWNDRIKQDKKPEELRSAARQRHEDMGRNARFAQIWKSRKGENNDADDSLREICHLYDAVQVDHDDEKHPAEPRITSFE

SEQ ID NO: 54523 - protein, 108 aa, Sorghum bicolor
  Clone ID: 14569957.pep
CRLHLKASKTTKAIQARADLRSTARSGTPLEQAGGRGGRRWRWGATSRTAKTSVEADLPCYTRAEVAGDDEAQRIAREEKSAPGTTTTTTSSEAKRNRAGRRRPRPRA

SEQ ID NO: 54524 - protein, 124 aa, Sorghum bicolor
  Clone ID: 14569961.pep
HEVLFLQFQFAGAAQSLGAGAILVNPWNITEVADSIRHALTMPSDEREKRHRHNYAHVTTHTAQDWAETFVFELNDTVAEALLRTRQVPPGLPSQTAIQQYLRSKNRLLILGFNSTLTEPVESS

SEQ ID NO: 54525 - protein, 163 aa, Sorghum bicolor
  Clone ID: 14569964.pep
TRLMAVKAGFGNAANALADWDGGRDHCAWRGVACDAASFAVVGLNLSNLNLGGEISPAIGQLKSLQFVDLKLNKLTGQIPDEIGDCVSLKYLDLSGNLLYGDIPFSISKLKQLEDLILKNNQLTGPIPSTLSQIPNLKTLDLAQNKLTGDIPRLIYWNEVLQY

SEQ ID NO: 54526 - protein, 155 aa, Sorghum bicolor
  Clone ID: 14569978.pep
TRRTFNGIRIFEDITNPKGGKGILLKSVGVVGANPDTVFEVVLNLDKHKRYEWDMLTADLELVETIDGYCDVVYGTYEPKYLNWWKSKKDFVFSRQWFRGQDGAYTILQTPVGHKKRPSKHGYERTKINPSTWEIRSLNTSGSSSPKCVVTLMLE

SEQ ID NO: 54527 - protein, 44 aa, Sorghum bicolor
  Clone ID: 14569979.pep
KNFLGSKEPKVADHKLELDMNFAEVIKIQIPFIRISLISSSPQE

SEQ ID NO: 54528 - protein, 57 aa, Sorghum bicolor
  Clone ID: 14569986.pep
WIVRIHLSSIKSQISPNFHPLYSKTPTPRKQTKDLISKLLTSKLTFPLNIITTNPRA

SEQ ID NO: 54529 - protein, 205 aa, Sorghum bicolor
  Clone ID: 14569992.pep
HEDFLKDSATAHPSLPSADSADDDGWDDFADDSPAADPLLSPSSWVPLLDPTSPPPSGDETDSPADGLFVAGARAMLSAASDGDDAAFATAAAQIEAAAEAGHPGAQSALAFLTGAGMTRPASRSLAFLLHKFAADAGDLQSKMALAYSYFRQEMYEEAVILYAELAEAALTSSLISKEPPVIEPIRLHSGTEENKEALRKSRGE

SEQ ID NO: 54530 - protein, 137 aa, Sorghum bicolor
  Clone ID: 14569996.pep
ARGLHVVFPPGAKDYHGNLETIWASDLLMARCVWSKGSINYYANRFRSLRHLHLRCCPSLQFGLAMGTRPSFPSLETLHIIHCGNLMHIFVPADKRYKMYQHTSIEFPKLTTIHLHDLPALQQICEAAAEVLAPALE

SEQ ID NO: 54531 - protein, 150 aa, Sorghum bicolor
  Clone ID: 14570009.pep
TRVHTTVVQEAALPICLEGKDVLVKAKTGTGKSAAFLLPAIESVLNAMKTNTNQRVSPIFVLVLCPTRELAIQLAAEANVLLKYHEGIGVQTLIGGTRFKLDQRRLESDPCQILVATPGRLLDHIENKSSFSVRLMRLKLLVLDEADHLL

SEQ ID NO: 54532 - protein, 203 aa, Sorghum bicolor
  Clone ID: 14570014.pep
ARGVDAAIHRGKKHFYGDDLDAEEGRCSKHSAPAIDTDHLVREMMDKVLLCNGEMCSKGVKELREALQHDVAKNSHGVHGKGSGHGKGRGKKQPKKKEVVDLETLLVHCAQSVATDDRRGATELLKQIRQHASPNGDGDQRLAHCFANGLEARLAGNGSQIYKSVIMTRFPCTDVLKAYQLYLAACPFKKISHFFANQTIMNA

SEQ ID NO: 54533 - protein, 63 aa, Sorghum bicolor
  Clone ID: 14570015.pep
GPFLYFASKKEYPQHRKGKQFILQLLVHGSTLIYKQAQKYVTNSERGDGPTILHQQSSEEPLL

SEQ ID NO: 54534 - protein, 111 aa, Sorghum bicolor
  Clone ID: 14570016.pep
MAAPPQPHPPAAVEGAAPAAPLTAAAPGPRPYDVAVAAAELRPVDCNLASLCDHVQAEGFGSGAFSDLVVEAMGATYRLHRLILSRSAYFRNMLHGPWREAGAPTVVLHID

SEQ ID NO: 54535 - protein, 201 aa, Sorghum bicolor
  Clone ID: 14570023.pep
TRLISSSCRPVVRKKAALCLLRLYRKNPDVVNIDGWADRMAQLLDERDLGVLTSVMSLFVSLVSNNAEAYWNCLPKCVRILERLARNQDIPQEYTYYGIPSPWLQVKTMRALQYFPTIEDPNARRALFEVLQRILMGTDVVKNVNKNNASHAVLFEALALVMHLDAEKEMMSQCVALLGKFIAVREPNIRYLGLENMTRML

SEQ ID NO: 54536 - protein, 165 aa, Sorghum bicolor
  unsure (1)..(165): unsure at all Xaa locations
  Clone ID: 14570030.pep
ARGRRRFFYPHSSTRPNSPPPPPHSLSSPPRLLPCSVPVSSLHLGPRLLPIPLHRAGSSLSSRLQIFTFFRIPMLSESTTATTSYPQLPCPMDSAAATSSPYLQHPSTYGGIGGGVHGGAVSAPSTASLHRAPQHDSTAAAAPSPYTYEENRSPQPSPSMIQDLX

SEQ ID NO: 54537 - protein, 174 aa, Sorghum bicolor
  Clone ID: 14570039.pep
ARGWNSMIFGCCQSNEWEEARMLLDDMRREGTLPGVVTWNTLISSYARSGELDVAMEMLEQMEESGVAPDVVTWTSLVSGFVHSDRSGEALRCFMRMRLAGVEPNGMTIASAISACASLRLLSQGMELHCHAIKVGSVNNVLSGNSLVDMYAKCGEIVAAKRIFNEIPEKDIFS

SEQ ID NO: 54538 - protein, 215 aa, Sorghum bicolor
  Clone ID: 14570042.pep
TRVHWFRVVLDEAHMIKSSKSLISLAAAALTADRRWCLTGTPIQNNLEDLYSLFRFLKVEPWRNWALWNKLVQKPYEEGDERGLKLLQSILKPIMLRRTKNSTDKEGRPILNLPPANIEVKYCVLSEAEKDFYEALFRRSKVKFDQFVEQGRVLHNYASILELLLRLRQCCDHPFLVMSRGDTQEFADLKKLAKRFLRGGNGAVNGDSSCIPSRA

SEQ ID NO: 54539 - protein, 145 aa, Sorghum bicolor
  Clone ID: 14570058.pep
RIAISAAMMNVSSPISLTSIMDRLAKKASKCPSPVSCAAAARAPAAWWRNILVRRSRPTPVPFPAAPSAAWTSPAETETGTESARRRTAAAANAARLCIAAGRKTRRDLRMPRSGRGSGGPVGAAGREGAGISEGRKKGGSQPSC

SEQ ID NO: 54540 - protein, 80 aa, Sorghum bicolor
  Clone ID: 14570072.pep
FNPTRFKDKPEIDRGSRHFMAFGGGLRSCVGADFSKLQMSIFLHFLVTRYRWKNLWGGKIVRNPGLEFSDGYHIQIRHWN

SEQ ID NO: 54541 - protein, 36 aa, Sorghum bicolor
  Clone ID: 14570086.pep
GYSSSLTLSGAATVSTSSLTLSGAATVSTSDICSFS

SEQ ID NO: 54542 - protein, 110 aa, Sorghum bicolor
  Clone ID: 14570088.pep
GARAMPVLPAGSQGRRVWSDILLWQQLGEVAKNCWVSSAFHNFSLMYLRGVWPMTSGMVGFDRNCKVDERFDSALIYSCCCCDISVGIGCISLWVHSSRPSKRIQQMFGP

SEQ ID NO: 54543 - protein, 123 aa, Sorghum bicolor
  Clone ID: 14570115.pep
ANDQKARYMSSSLKLKNCTVIDDSHGSSFTICSSLGLMNVIVKDRENMAVTDAEEFETVLVVDLPPSVDEYVEILTGVALHVIGGEVHSIFCNADAFIAKPLAELLADCRQVVPEFFKNLESS

SEQ ID NO: 54544 - protein, 113 aa, Sorghum bicolor
  Clone ID: 14570122.pep
WKESITKKSFIQLNILQHVAQGIQAFPWLFPTPVQHVPPLLNTYTATCRLPQASGLCYAYVSSKCTLVGTREAWLPPLYAILSVIQSSQTSLHLRSRLSTFCTCFVQDLVRSL

SEQ ID NO: 54545 - protein, 136 aa, Sorghum bicolor
  Clone ID: 14570132.pep
PPTENVGAIRDSNPVHDFEAMLANRSSSTWVQKAIEDMQNYTAALLQKSHDGSNYQKALECFAALRKACIIEQEPQEFNEFLTKIYERLKEGDAAKFFQLLSSKNISLISKEEAPDSDVTEEMAKSFYLKREKASQ

SEQ ID NO: 54546 - protein, 95 aa, Sorghum bicolor
  Clone ID: 14570192.pep
QGRSREDRHAFSMTSFKEGLYTVEFRSSIALLQAFAMCIVMLHGRYPSRMQVGSQAAQEHDLLAGHELKAMAASQGRAPTSYVPHRPPLSPVGRA

SEQ ID NO: 54547 - protein, 99 aa, Sorghum bicolor
  Clone ID: 14570193.pep
DPVINPVAMAAEEWRRLPCARVLVTVAGLDMLSARGRAYVHALRASGWQGAAELYETPGEYHVYFLNKPDSDEAAKEMEVVVDFINGDQVSSRASRMDA

SEQ ID NO: 54548 - protein, 108 aa, Sorghum bicolor
  Clone ID: 14570196.pep
SNNNIEHSTPHTTDSSNTAAPHSSVYQTKVHKHTIQNQSPQTHHTRAQQLAVARMGACLMLLLHKLKGIQLSDPMLTGSCFISLLLQTAHRPVRLYHTIFRTGAHRQK

SEQ ID NO: 54549 - protein, 84 aa, Sorghum bicolor
  Clone ID: 14570199.pep
GDPLHGIQKTPLFWKPRTEICIGAVRGLHSLHELPFIHGNVPSEKILLVEEWVAKITVLPLSNTWTLSVEHGTYGYAAPEYVRT

SEQ ID NO: 54550 - protein, 56 aa, Sorghum bicolor
  Clone ID: 14570222.pep
INFFRSDYPLAWCRIHHDESEDHISAGYYTIYVGEMNGRKKLFSLCNPHKWGVTRI

SEQ ID NO: 54551 - protein, 90 aa, Sorghum bicolor
  Clone ID: 14570300.pep
EQSPTNQAFDPRCQPLNKSVHCRLTAKLQAPEPPRKKFRHSLPSDSETNKKINDLRSIQPSLRQDLTLTTKKVRYWNLWFLADHLQSSFI

SEQ ID NO: 54552 - protein, 87 aa, Sorghum bicolor
  Clone ID: 14570308.pep
ILSGGLYWKIKYISRLEYLWGDIKKGEVEIPEFVIEHDKVLEHRPLTDYGIEPDPLHLADVPAVGYSLGRYEDKWTPEDRRYSRNYM

SEQ ID NO: 54553 - protein, 80 aa, Sorghum bicolor
  Clone ID: 14570347.pep
ASSKYRARVEAPPGVDVTVSPSLLTFNSTMRSLTFKVTFQAKLKVQGRYNFGSLTWEDGVHTVRIPLVVRTMVSKFYVNS

SEQ ID NO: 54554 - protein, 69 aa, Sorghum bicolor
  Clone ID: 14570359.pep
MCAYHYHMRLSGVAAVVLLLLLYAVHRWRNPRCSGGRLPPGSMGLPLVGETLQFFSPDASLDVPRFVRH

SEQ ID NO: 54555 - protein, 71 aa, Sorghum bicolor
  Clone ID: 14570360.pep
LAYEYAASTSSHLDLGAGPPVGGAAAGGGAPHRARAPTQFERMPWMGRKRGWRRGWGVVHGCAKGRPVPRA

SEQ ID NO: 54556 - protein, 146 aa, Sorghum bicolor
  Clone ID: 14570368.pep
HEGLTHQRRAMAPAPVPALPPAMDNKDEGDGGAKNQNGMVVDEGDSGAKNQNSMVVVKSEAVCTDDGPLVVATELVKYEGGDTTECSSSFGDTCSGFEGEADNGEPEVNSGMSAHDNGVGPSKPPRRKKVMAEWSNSVRPIEWRCH

SEQ ID NO: 54557 - protein, 45 aa, Sorghum bicolor
  Clone ID: 14570369.pep
RRGGRGSSSTCAGNGNGNEPPGGDKEIRRLRGREDLRRATRESGA

SEQ ID NO: 54558 - protein, 94 aa, Sorghum bicolor
  unsure (1)..(94): unsure at all Xaa locations
  Clone ID: 14570373.pep
MAVAGPGQLNLDESPSWGSRSVDCFEKLEQIGEGTYGQVFMAKETETKEIVALKKXRMDNEREGFPITAIREIKXLKKLHHQNVINLKEIVTSP

SEQ ID NO: 54559 - protein, 79 aa, Sorghum bicolor
  Clone ID: 14570380.pep
TRKVLEENRKLYNQVQDLKGSIRVYCRIRPFLPGQASPSTVGSIDEGNITIVTPSKSGKEGRKNFSFNKVFGPSATQDE

SEQ ID NO: 54560 - protein, 76 aa, Sorghum bicolor
  Clone ID: 14570392.pep
MIKEAIEKRASYFRKNSDTLTLQGVRRTLEEDLKLQKKALDAYKNFITTELDRILQEPANGTKKKVKRDLPRILTQ

SEQ ID NO: 54561 - protein, 118 aa, Sorghum bicolor
  Clone ID: 14570400.pep
GTRHPSTPGGRRLPRRSGPAGAPEMAKGDDALARKRNRVRRKRLRSSENAVSARVAAIIASKRRRKSGKRRGCEGMCFSLPTPDDPFNERHGKKRKVDDEPTEDTAAAKDGDDPKKKG

SEQ ID NO: 54562 - protein, 121 aa, Sorghum bicolor
  Clone ID: 14570411.pep
ARGKLENLLLDEAGNLKVADFGLSALAGHARSDGLLHTACGTPSYVAPEVLGGKGYDGAKADLWSCGVILYVLLVGRLPFHEDNLMVMYRKMQRGEFLCPPWVSADARKLIGDLLDPNPSR

SEQ ID NO: 54563 - protein, 87 aa, Sorghum bicolor
  Clone ID: 14570417.pep
TRQNTTLPKPIGNSGITRVGCDPTTASTTQSSGSVPSFGPGSGEVLDFDAHHRLTINNTDGDGELQQFPACPLNFSEYTPCEDRKRG

SEQ ID NO: 54564 - protein, 113 aa, Sorghum bicolor
  Clone ID: 14570419.pep
HEDGVLQEVKNICSTLVHKKLVYNRSDEVGIVLFGTKGTCNELAKELGGYKHVTVTRDIKVVDEGAAQALQNLPLGSAPGDFLDSIVVGLDMVMRKFGNTKGKRRLCLITSAQ

SEQ ID NO: 54565 - protein, 118 aa, Sorghum bicolor
  Clone ID: 14570427.pep
TRLIMEELDRDNLGYIELEDLEALLLQSPSQAAARSTTQSSKLSKALSMKLASNKNTGPLYHYWQEFMYFLEENWKRIWVMTLWLSICIGLFIWKFIQYRNRAVFHIMGYCVCTAKGA

SEQ ID NO: 54566 - protein, 52 aa, Sorghum bicolor
  Clone ID: 14570430.pep
MATSYLLPCYVLITVLVLFFSVDVTEGAIREYQFDVQMTNVTRLCSSKSIVT

SEQ ID NO: 54567 - protein, 136 aa, Sorghum bicolor
  Clone ID: 14570454.pep
TVRTFVIPIELEVHTRTYYDSSGLIAVTFEHISTCDETGSIFSLSLRNDGPKLLRVIGVTEDDRNGPMIFQVKYLNGSILFPNTVTDIALVRYTSSVPEDISSDSCNIVVETNSTLGSSIILPCKDLVRASLFYTS

SEQ ID NO: 54568 - protein, 92 aa, Sorghum bicolor
  unsure (1)..(92): unsure at all Xaa locations
  Clone ID: 14570463.pep
ARGKIVTMVCGTFEKEGPALVVACGXDTIPYASSVRRLAPDNVFVIQIQHPRSRLGRFDLVVTPRHDYYALTTKGQQEVPRLFRRWITPQEP

SEQ ID NO: 54569 - protein, 98 aa, Sorghum bicolor
  Clone ID: 14570480.pep
HEGCGCPPLGNFQPSTRNANSASANVIAVLPDGFHGTSTTGQPLPLIERWKSGGACDCGGWDEGCTLSILTDAAQENDAIQANLAKDGSQRFELLVQG

SEQ ID NO: 54570 - protein, 90 aa, Sorghum bicolor
  Clone ID: 14570481.pep
TRVLYKSGRVQRFMGTDTVPASTDPATGVASRDVVVLDASAAAAAAGLAVRLYLPPSRLATNRTGTDADDESERLPLLVFYHGGAFVTES

SEQ ID NO: 54571 - protein, 117 aa, Sorghum bicolor
  Clone ID: 14570483.pep
TRVYSSHLHLPAAAHSVLLWMTGLGLPPTPIDYTDLIFSFCRAGCLDNALQLLDEMRALNYPLTPHTFAPILKAICDNADIQAADALISSMRSSGCLPDVVIYDIYIQGLCKIGDFD

SEQ ID NO: 54572 - protein, 86 aa, Sorghum bicolor
  Clone ID: 14570485.pep
ARGSVPSVCLLSPATACQFKLTEANTRCNCLFDPFGFLHISSYGFDKIIICICPTAACQFNITEQCCPSRKPPNSASVCMDHSLPK

SEQ ID NO: 54573 - protein, 103 aa, Sorghum bicolor
  Clone ID: 14570488.pep
QTLTIATLRPPPITWQSPQPTCSHPKRVWAGREAVRKRGDAAMPSTSSTEQLKVAPLRMDLGVGYRVKLKKLRGYECVGMSRRAHASPAMKALSTTYGALTLV

SEQ ID NO: 54574 - protein, 119 aa, Sorghum bicolor
  Clone ID: 14570493.pep
CRFVSNLTGSSLLEIAALSTVVPALVVLRKWSSRDNSRKDSAKKNDDQVHPVHKDWMQYFSTLGVDYLTVVLPIILVFTVLSEWAFTCAISLVVLISIYIMFERSQLHLKDGFSQLPSL

SEQ ID NO: 54575 - protein, 141 aa, Sorghum bicolor
  Clone ID: 14570502.pep
TRPVSPKPPPIPMAPPPPPKLPIPGRRNILITSALPYVNNVPHLGNIIGCVLSADVFARYCRLRGYNAIYICGTDEYGTATETKAMEEKCTPKEICDKYHAIHNEVYKWFNIKFDKFGRTSSPEQTEVCHAIFHKLMENNW

SEQ ID NO: 54576 - protein, 115 aa, Sorghum bicolor
  Clone ID: 14570512.pep
MDTVEKIVEDFASDIALSPFSSGTSLREMIRAIRTCKTAAEERAVVRRECAAIRTAISENEPVLRHRNMAKLMFIHMLGYPTHFAQMECLKLIAATGYPEKRVGYLGLMLLLDER

SEQ ID NO: 54577 - protein, 176 aa, Sorghum bicolor
  Clone ID: 14570518.pep
ARGDGLGIVASILLVVFVTATSDYRQSLQFKDLDKEKKKIQVQVTRSGFRQRLSIYDLLPGDVVHLAIGDQVPADGLFISGFSLLINESSLTGESEPVAVNEDNPFLLSGTKVQDGSCKMLVTTVGMRTQWGKLMATLSEGGDDETPLQVKLNGVATIIGQIGLFFAVITFIVLSQ

SEQ ID NO: 54578 - protein, 161 aa, Sorghum bicolor
  Clone ID: 14570519.pep
LADVAMLTGLDISSADSTHFFDTAPSAKVETRAIGGWSGYIQKYRGKGPVTLKEQTTFLNMWLDKFVFCGRSAGPTSVYLSAAERLASGGQFPLGRYLLGAVYHLLHQVAQKLLLGQPIGNLGGPWWFINMWLNLHLHKRLDLNLFSQHFPRDIAENHASC

SEQ ID NO: 54579 - protein, 171 aa, Sorghum bicolor
  Clone ID: 14570528.pep
TRVPSTGQFAYFNGTSFAGNAGLCGAFLSPCRSHGVATSGFGSLSSTSKLLLVLGLLALSIIFAAAAVLKARSLKRSAEARAWRLTAFQRLDFAVDDVLDCLKEENVIGKGGSGIVYKGAMPGGAVVAVKRLPAIGRSGAAHDDYGFSAEIQTLGRIRHRHIVRLLGFAAN

SEQ ID NO: 54580 - protein, 182 aa, Sorghum bicolor
  unsure (1)..(182): unsure at all Xaa locations
  Clone ID: 14570529.pep
TRAARAAAGPSLSFADPRRREVPRDGADTPAVVPAFEVAAEGAQKVVIKLPPGTSFYGTGEASGPLERTGKRVFTWNTDAWGFGPGTTSLYQSHPWVLAVLPDGKALGVLADTTRRCEIDLRQESTIKFFASSAYPVITFGPFNTPADVMTSLSHAIGTVSMPXKWSLGYHQCRWSYDSSER

SEQ ID NO: 54581 - protein, 93 aa, Sorghum bicolor
  Clone ID: 14570540.pep
HEARFNHRFFSSKKKIQEFSAGVVLVNKQCWKHRSKECKIKIQSSTETILRRLKERILARVLIEPHTSCGSGFGKQIVLETLLQRMQNQNILR

SEQ ID NO: 54582 - protein, 172 aa, Sorghum bicolor
  Clone ID: 14570553.pep
MSSSSAAARRLLLLRHRHGHLLPKRHFSSSSAADGLDDGGRVKIFDRDLKRRHRDRAAWAMRETDGLVDAVAENLLDRLEDCRKAFPSALCLGGSAGAVRRLLRGRGGIERLIMMDMSADMVKKWRESENGTGDEPEMHFVVGDEEFLPIKESSQDLIISCLGLHWTNDLPG

SEQ ID NO: 54583 - protein, 93 aa, Sorghum bicolor
  Clone ID: 14570554.pep
RGRRGARRRRRPPSPPPSAAGPAAAPPSTPPPASSLSRSSPAPAPEPPPPPPPPHPWFVPLSETRGEEVSLARSAAQTTELTGELGFRASASC

SEQ ID NO: 54584 - protein, 183 aa, Sorghum bicolor
  Clone ID: 14570556.pep
TRQHITCVLIPDKPTEGGGPDIPPHFYCELCRLNRADPFWVTTGNPLLPVKFMSSGVGNDGASVPQIVEKTFQLSRADRETVQRPEYDLQVWCILINDKVQFRMQWPQYAELQVNGIPVRVMTRPGSQLLGINGRDDGPLVTTCSREGINKISLSRVDARTFCFGVRIVRRRTVPQVLNLIPK

SEQ ID NO: 54585 - protein, 56 aa, Sorghum bicolor
  Clone ID: 14570562.pep
GGCRGQQVRGVATAQAKRRVELPIRRRRRLERTEGLDRRKGGRQGRDWDLGEAPLV

SEQ ID NO: 54586 - protein, 134 aa, Sorghum bicolor
  Clone ID: 14570570.pep
AKRRASVGTAPAPTPRGSGGRGCRWGRAAAHVMPNAPSRPRRQSKKSSMHRPLPPAAPAPVPAVPAPSPPATAGPADRVVTMATRAATASATRRWCSPPLPLGRRRLVPGRRPAAASTMHPRPIRARRRAPPSC

SEQ ID NO: 54587 - protein, 146 aa, Sorghum bicolor
  Clone ID: 14570579.pep
HEAHFYESCPYLKFAHFTANQAILEAFAGCRRVHVVDFGIKQGLQWPALLQALALRPGGPPSFRLTGVGPPQHDETDALQQVGWKLAQFAHTIRVDFQYRGLVAATLADLEPFMLQPEGDDKDEEPEVIAVNSVFELHRLLAQPGA

SEQ ID NO: 54588 - protein, 126 aa, Sorghum bicolor
  Clone ID: 14570581.pep
ARGSVMQLTGVDAFGMVSMIIQAARTARRNRDLCQQLAKKVEIVSGLLEELNIPELRRHRKTRRPLDELRSALFRGYVLVWSCSQQQQGASQFWQMFMAGDMAAMLRQAKDEIDSYIILIPLITTD

SEQ ID NO: 54589 - protein, 142 aa, Sorghum bicolor
  unsure (1)..(142): unsure at all Xaa locations
  Clone ID: 14570585.pep
ARGSYTGLSSTSSFGPLRRGSWCTPPRLFLEDQFDVIPSEAASSHNSSMKRKEDEGKRKKGSGAVKISPWALARLNAEEVSRVAAEARKKSKVLVPIRKDDYSRGHETDSSYGGMSSGRIDLGPDSKRTNRRGRQPSDLSLX

SEQ ID NO: 54590 - protein, 101 aa, Sorghum bicolor
  Clone ID: 14570590.pep
LKSKAYHTDAGAKSNVKNLSSTNNTSADRLQKGSLSESPQNGAQRREANEEPDHGCAQTSSISAPESSSNSTVTRQEDQHRGDQISDGDSGYSTNARSPKH

SEQ ID NO: 54591 - protein, 162 aa, Sorghum bicolor
  Clone ID: 14570593.pep
ARGGGSDFSVFVVGSDFATDAGAALLAPADREVWHDCLPDLAEADACFFDLEERQVVRVQGTDRAGRTVVRIVGKFFPASVVDGERLKKYVFYKLRTELPVGPFCILYMHSTVQSDDNNPGMSILRTIYEELPPEYKERLQVFYFLHPGLRSRLTIATLGRL

SEQ ID NO: 54592 - protein, 111 aa, Sorghum bicolor
  unsure (1)..(111): unsure at all Xaa locations
  Clone ID: 14570634.pep
MAALLGFFLLLVLQLGPSSCSNVYIVYMGEGNPELHPELVRDSHHGMLAALLGSEQAAKDAILYSYRHGFSGFAAVLTDSQAARLADSPXVVRVVRNRVLDLHTTXSWDFM

SEQ ID NO: 54593 - protein, 62 aa, Sorghum bicolor
  Clone ID: 14570637.pep
FTVSLARKSPYGLLDACHLGCLMHQHPVFSKHFGCSWAGNEPGHPLFLECLYNFCSRPLGRS

SEQ ID NO: 54594 - protein, 58 aa, Sorghum bicolor
  Clone ID: 14570638.pep
SWLGLVVDWRETRWGARVGGGGGERCRSPATRVQRWCPCVPHPVPCGGTHVPRGLPSC

SEQ ID NO: 54595 - protein, 70 aa, Sorghum bicolor
  Clone ID: 14570650.pep
VYGVRSAVQNALWLGLVLASWHFLFDKNVQQETNSAVLPYVTKILFCFLVATLIRLVKTLLVKVLASSFH

SEQ ID NO: 54596 - protein, 102 aa, Sorghum bicolor
  Clone ID: 14570653.pep
SGKSRLQFVTSGDNEAEDDFSPKEVNQRHLLHEGSLGGSAASIAIFSHVTPIRCLIAGLLDCNPIMSKRICIDDSSVTVLEHSLKTGWQIKRLNDTAHLRLL

SEQ ID NO: 54597 - protein, 116 aa, Sorghum bicolor
  Clone ID: 14570658.pep
LGYKTTKERMYKCNANHHPSVHSLHRLCTDKATIQHVCNYVYTCVCVCPPPPVCVYTKRKTKSSSKHITKSMYCAVLCCTAPFLSSQLPLIHAHSTITLCLLRNGDSRENDRKAFE

SEQ ID NO: 54598 - protein, 73 aa, Sorghum bicolor
  Clone ID: 14570662.pep
TLMQGSFRQFNLCTVSFIDSTMILLDSAVASLTNSAETSHYSQFHVASLLVPLICSCYDLDLYFTRDRNEVQT

SEQ ID NO: 54599 - protein, 99 aa, Sorghum bicolor
  Clone ID: 14570665.pep
EGDSLITGLKNLICRPACDIAISGLGWISVEPSGVPSNSSDDNVEEEYDGGELHLVVHVPKPVEVFVRPPLPVGKAASQWYQYQELTEEEEELRPKWHY

SEQ ID NO: 54600 - protein, 143 aa, Sorghum bicolor
  Clone ID: 14570668.pep
ILAQRSRNGECAAELMRAASLFNPQLARVLDQLNARFGAGTFIAANAFRVHFDFVSDPAAFGFATAKEACCGQGPHNGLGLCTPASNLCPDRSKYVFWDAYHPTERANRFIVSQFMSGSLDYVSPMNLSTVLQMDATLDKIEA

SEQ ID NO: 54601 - protein, 147 aa, Sorghum bicolor
  Clone ID: 14570692.pep
HEQEYGQPAYSARCSAPPTVSELIKAVDGVVVFKPPVNLEPLMKRSVSDLVVPAANKFGEITVGGWSVHVDDSLLGRLAAGAARAAAGATAATPMEAWTGEVLCPSSIRQFKRSLSTNDVDGATVEGGGRRKDSEMFPMMPVTVDGN

SEQ ID NO: 54602 - protein, 136 aa, Sorghum bicolor
  Clone ID: 14570699.pep
HRDLKSANCLVNKYWTVKICDFGLSRVMSDSAMNDNSSAGTPEWMAPELIRNEPFTEKCDIFSLGVIMWELCTLCRPWEGIPPVQIVYSVANDGARLEIPDGPLGSLIADCWADPEKRPSCQEILTRLLDCEYTLC

SEQ ID NO: 54603 - protein, 179 aa, Sorghum bicolor
  Clone ID: 14570716.pep
PSASRSTSAEIYIICQKYKAPAKIQPELLDIKHLFSVVPEQTKSRDVMDGRKKRHRDGYEEGNTTLRKVGLASDFVWSDAQAPLEFLGSYNAISFDNPESLPIKNHELTTDDIKNFCEDLLLLDKNSFKHILKWRIRLRKSLSASSQVTPKVNDAVENTKVTDDDVLLQEMEELTSVID

SEQ ID NO: 54604 - protein, 122 aa, Sorghum bicolor
  Clone ID: 14570724.pep
RGGGDAGAHRVDEEPGAGRTWRRQRLHSGQAPRPHRRGAPAVAARRWRAPRPWRVQGLQWPRRQGRAVTLLTPAVTDDDDSSSSCKWRNFFFGRSVCCSMFMHARCCHGSSLMTHEVILAQS

SEQ ID NO: 54605 - protein, 92 aa, Sorghum bicolor
  Clone ID: 14570726.pep
IFVSPCSSGTFHVCQYDGVEDDLVYFIDGVEDDFAYFNDGEFLSDENAAPAFVKFVYNMRDGTVAPFAAGILEYLQVPKGRPMNPTWLFPSE

SEQ ID NO: 54606 - protein, 113 aa, Sorghum bicolor
  Clone ID: 14570727.pep
FNEYRYVLAASVLAFTYSGFQLVAEVHYLVTGRRIIRAPFRSYFNLAMDQMLAYLLLSASSAALSRNDVWMSRFGGDQFTKLINASASMAFLAFIALGLNSVISAYCVFSLVS

SEQ ID NO: 54607 - protein, 47 aa, Sorghum bicolor
  Clone ID: 14570736.pep
SHYHSLEHNRLQTDSILVEAMDRQLRLMIYLLSKWQEAAMGVVSVVN

SEQ ID NO: 54608 - protein, 123 aa, Sorghum bicolor
  Clone ID: 14570738.pep
LATLPSTDQGRGLKQAAMDDPTRCSGCPTVSHTEKKGITIDKTVNQPKGESFLFPLSQPEIIIYSYKNVTIRRDSMPSISSGKRPRNRPWQHPEARSIIPGDATPEASQESLIAPSLAFPSSI

SEQ ID NO: 54609 - protein, 126 aa, Sorghum bicolor
  Clone ID: 14570740.pep
VLETKKSTQKSDVYSFGVLLLEMLTGKAPLRSPGREDSIEHLPRWVQSVVREEWTAEVFDVDLLRHPNVEDEMVQMLQIAMACVAIAPEQRPKMEEVIRRITEIRNSYSSGTRTPLEDKPETAQAP

SEQ ID NO: 54610 - protein, 61 aa, Sorghum bicolor
  Clone ID: 14570757.pep
TNFMDSNGKLLYIVLIVPNDPYSFSDKTPVVIWPGFALWVPSFHIPLLSSNQSICCSILAI

SEQ ID NO: 54611 - protein, 76 aa, Sorghum bicolor
  Clone ID: 14570770.pep
QLSSHLDIICATICTKKGERADDSCTPVLLGVKLLRLLLSLAAVPGSIELFHQVLNGGRGLPELHLQVFLLLIAAL

SEQ ID NO: 54612 - protein, 98 aa, Sorghum bicolor
  Clone ID: 14570772.pep
EPTACTSSLAYTRIWQARIIFLVVGVRMIQNYRWCSYKDCKTLSPLFYWFVGLGPSGSGRLVLLAIGCYFNAYGDVYVLCTCCTVVLLLGARLLVMVR

SEQ ID NO: 54613 - protein, 51 aa, Sorghum bicolor
  Clone ID: 14570787.pep
RGTHWLRQWANLQRHDVLREQLIHVGTYLETSALQFFSARGWLAARYIGHV

SEQ ID NO: 54614 - protein, 37 aa, Sorghum bicolor
  Clone ID: 14570790.pep
HVVIINHEYHLSISLGCYLIKHDFTPTSNQRLQMFIL

SEQ ID NO: 54615 - protein, 44 aa, Sorghum bicolor
  Clone ID: 14570793.pep
AHGSFSSNSYTESSGISYINQEFVHVRIMQEQEGFSCLSFISLQ

SEQ ID NO: 54616 - protein, 47 aa, Sorghum bicolor
  Clone ID: 14570801.pep
GQSAGFTISYSNNMTFATIKGGGHTAPEYEPERCFAMFSRWVLNRPL

SEQ ID NO: 54617 - protein, 94 aa, Sorghum bicolor
  Clone ID: 14570820.pep
MVLQSRPVHPCCVPYLHGLLSRANLLFVSCSCPLVTKNLLLLPCRVLLHVSLYTSLPCVQYARAGSSCVAVAVERAPVSERSTSGSMHQHEPQR

SEQ ID NO: 54618 - protein, 175 aa, Sorghum bicolor
  Clone ID: 14570848.pep
ILAPAYNRVVMPMVCRITGKKRGLSELQRIGVGMVFAMFSMASAALVEMVRLDIAKNRVLMNILWQAPQYMFAGVAKVFSVVGFIEFAYEQSPDAMRSLCQACSLLMVTLGSYLVSIMLKMIDSVTAGRGSHGWIPENLNEGRLDQFFWLMAGLHLLNLLAFAYCATRYKCKLAT

SEQ ID NO: 54619 - protein, 148 aa, Sorghum bicolor
  Clone ID: 14570869.pep
ARGWEGGECDLRHQLHGDHAADREQAEVERDQLASVTGQGVAGGELRVLEHDGGGAGTNGRPAAAEAFSFKNRPPHAPQASSPSMSPPPQQQQPPPEGGGVDPPTRLIGNFLRKQAASGGEMSLDLDLEMEELGRTALREQPSFSSSL

SEQ ID NO: 54620 - protein, 125 aa, Sorghum bicolor
  unsure (1)..(125): unsure at all Xaa locations
  Clone ID: 14570872.pep
HEGQADAAAVEVVLVSHGECAAAMRPDLVGGRWPAAALTARGERQGRALAVFLRSRGARLAAAYASPLDRARATAALVCRELDFPEEQIQLSDALTXMSQGQWEGCPKSEIYTPXMVNLMESTXP

SEQ ID NO: 54621 - protein, 118 aa, Sorghum bicolor
  unsure (1)..(118): unsure at all Xaa locations
  Clone ID: 14570873.pep
ARGALLPSREPAAPAADQVEPAETAPAPGLAATISEFFRRMVFPPLDPNLLEEFDTQKVSWNPYKHCLAFVSGKNQVTVQDFEDSDAKEPCILTSDHXTDVKAVEWRPNSGKMIAVAC

SEQ ID NO: 54622 - protein, 171 aa, Sorghum bicolor
  Clone ID: 14570877.pep
ARGEEEQIKRLEKLKLERQKRIAARSSTSNAPTPQQPRVKPSPKVSPSTYKSSKFSDAEPASSSPLRKLPVKTTTGTDPKKTAKSSKLNDSTNAVSKSTSSLTDMKEKSGRTESSNERLRKLAEPKTNSSTGHPLNSKSARVDHPRRKSMPQDTQTVKISAIMQLDQTKSA

SEQ ID NO: 54623 - protein, 136 aa, Sorghum bicolor
  unsure (1)..(136): unsure at all Xaa locations
  Clone ID: 14570880.pep
HEGDPTTPMWASSEGCERVSVEEAMNTDDMPLIPALPVSAQDAMEIHRAMGGAVAPADWQSRKGSPVYHLGPGPAVLNLTYLGNDTMATIENVFAIIEGTEEPDRYVILGNHRDAWTFGASDPNSGTAAMIELAXR

SEQ ID NO: 54624 - protein, 119 aa, Sorghum bicolor
  Clone ID: 14570881.pep
MAVGDALRRLCEEIGWSYAVFWKAIGAADPVHLVREDGYCGHTSCPVGSEPSESLPSDAAGCSAPAADTICSLVNNVMASQVHVVGQGTVGRAAFSGNHQWIVHGTANGHGLSLEVAAE

SEQ ID NO: 54625 - protein, 149 aa, Sorghum bicolor
  Clone ID: 14570883.pep
VGMAATLASVCSVPLTSVLLLFELTKDYRILLPLMGAVGLAIWVPSVVNQPNDTEPSGFKTPKRGYSSISAEDRNGSSRQGDVVDDLELSIIQTDISNYGTYNEEMLLDDLKVSQAMSKVYVKVLPSVTVTEALKLLHDKQQNCALVVD

SEQ ID NO: 54626 - protein, 95 aa, Sorghum bicolor
  Clone ID: 14570887.pep
RLQRGAAPVARGEAGGLPRQCPALLLASAAPVGVVGREHARGGLGGQLAAEEAVATRGRGGPRAVRRGGRGSRSSGDGEGGAVGVGLERWRWPRA

SEQ ID NO: 54627 - protein, 133 aa, Sorghum bicolor
  unsure (1)..(133): unsure at all Xaa locations
  Clone ID: 14570890.pep
HEALVDNGNNNYLMTTARADSPPYGIDYPTHRPTGRFSNGKNIPDIISEHLGAEPTLPYLSPELRGQKLLVGANFASAGVGILNDTGFQFVNIIRMSRQLQHFGEYRXKLRALVGAARARQMVRRSLVLITLG

SEQ ID NO: 54628 - protein, 102 aa, Sorghum bicolor
  Clone ID: 14570902.pep
TRLLNQRDDNILERLGYITRSEKRLEEEKLNLEDERKVLLEEKNKLDLNMQAIISREEAIIQKESILDKRESELLVLQETIASKERAEIERLRQEQEVALVR

SEQ ID NO: 54629 - protein, 147 aa, Sorghum bicolor
  Clone ID: 14570911.pep
HEESRLEQEEEAKAALLARIQRLTKLILVSTKATPTSRFSPHPGPRRRHSFGEEELAYLPYRRRDIMMDNESNELLLPVEGFGVSLEDSSKEEKKNRKGLLNWFKLRKRDGASILTSSEGDKSSLTKSTAPSTPIGESINFPAEPRI

SEQ ID NO: 54630 - protein, 161 aa, Sorghum bicolor
  Clone ID: 14570916.pep
ARGFRVVVLDGVDHADSVVRGSILRAIESGRLSDSHGRDVALGTNIFVVMSQWSPPLPDHLMRSSQEAEPFLPDLPWNLEHGMITGGKKRRPEQLLEAGDRCTKARKHSAREPLPLDLNLSMSDDHTDAVDDSGGEGSRNSSSDLTVEHEQEYGQPAYSAR

SEQ ID NO: 54631 - protein, 122 aa, Sorghum bicolor
  unsure (1)..(122): unsure at all Xaa locations
  Clone ID: 14570920.pep
MGTGGDGDKAGPALPLEALLALGLDQRTAENALVNSKVTANLAAVIAEAGIKECDKSVGNLLYAVATKYPTNALVHRPVLISYVLSTKIKNPAQLDAALSFLTNTGPDSLDVGKFEEACGVX

SEQ ID NO: 54632 - protein, 117 aa, Sorghum bicolor
  unsure (1)..(117): unsure at all Xaa locations
  Clone ID: 14570927.pep
TRPPPASASAGQEPVVRPSKRVRSGSPGSAGGGSGGGGAANGGAGYPMCQVDDCRADLTSAKDYHRRHKVCETHSKTTKAVVANQAQRFCQQCSRFHPLAEFDEGKRSCRRXLAGHN

SEQ ID NO: 54633 - protein, 72 aa, Sorghum bicolor
  Clone ID: 14570957.pep
IHGIALTPPKHQNSRDSMIYKPEINPSYLHHQRPNEKTDIDNELTSTKLPSSNPLKLLHNFSSPSTSSLLIS

SEQ ID NO: 54634 - protein, 129 aa, Sorghum bicolor
  Clone ID: 14570984.pep
KDAKQLNGTHKFHVHSKEEAEILAKFKPHLDPSTLISNIRNLEKAIRDCLDPFKSPRHMILYYEDIISNSNALFQVQEFLRVPVRRLMSRQVKIHPRPIPDLVKNWEEVSSKLNGTEFAPFLDGSDYVK

SEQ ID NO: 54635 - protein, 70 aa, Sorghum bicolor
  Clone ID: 14570989.pep
KYSIGVFFVIVMEQIIGVLHGFWHLIFVTTFLQRGSLMKFLTGSGVRLYPHLNKIDFVCRNLIERLAVWK

SEQ ID NO: 54636 - protein, 61 aa, Sorghum bicolor
  Clone ID: 14571000.pep
RLRRSAPHARVPADDVPAAARGRLQLQVGGDAIAASGRWGTLFLGASAASHLWILIITADA

SEQ ID NO: 54637 - protein, 100 aa, Sorghum bicolor
  Clone ID: 14571001.pep
KFGETVEKCLADYGVERPSMGDVLWNLEYVLQLQDADSTVSDVNSMNRIVELPSQVQNVGALESISVTMAEAGASNEPDHDLSDVSMSRVFSQLIKAEGR

SEQ ID NO: 54638 - protein, 68 aa, Sorghum bicolor
  Clone ID: 14571011.pep
PSTLGLENVREGCCATGKVEMSYLCNDKSPHTCQDADKYFFWDSFHPTQKVNQFFAKKTLDLCYQELL

SEQ ID NO: 54639 - protein, 69 aa, Sorghum bicolor
  Clone ID: 14571038.pep
RGAKFVVMVRVVQIKGVRMFMEHLIATLPDRKLVLEAMATVVCLNQDYRPTRMFPEMANLLHFFSHPSN

SEQ ID NO: 54640 - protein, 76 aa, Sorghum bicolor
  Clone ID: 14571050.pep
ALTIRTKLAEATVSAGGSLPPPMPLLREQQRVHDEPHPLPPRLELLARSAVVVYPQRGEHFVLLAQDLPERNLLPR

SEQ ID NO: 54641 - protein, 83 aa, Sorghum bicolor
  Clone ID: 14571061.pep
LIPNKRGKKTSQTPDIVPALSSEDYIIHVTRRLSDTVMVGTTQLTPSYMHLARLCKEVTNCVHLFPQKDKNNLIQAWKQPIRS

SEQ ID NO: 54642 - protein, 50 aa, Sorghum bicolor
  Clone ID: 14571063.pep
QNLNILSRLEPFCYNKTTIRIAAQPPLNQKIPCQWTYYPYKKIWNGCICI

SEQ ID NO: 54643 - protein, 95 aa, Sorghum bicolor
  Clone ID: 14571070.pep
LNTSHLSPSSRQERHPTAHTERNVEKRGYNYSEKDSENNVQSSMSSTSSSGMFHFSGSLRHSSLVDRKCITSAIEGRHIAGHIMQRDATATILFS

SEQ ID NO: 54644 - protein, 96 aa, Sorghum bicolor
  Clone ID: 14571086.pep
ACPTGVDPNIALQLDPVTPQAFDNQYFVNLVNGRGLLTSDQVLYSDARSQPTVVAWAQNATDFELAFVDAITRLGRVGVKTDPSQGNIRRDCAFLN

SEQ ID NO: 54645 - protein, 74 aa, Sorghum bicolor
  Clone ID: 14571087.pep
YQIKLEKKRSSSLDKILNTLKSAQRKAQVMRERERDAVTANQDGKGSRKAKKRVQLSKNGQISSLSGCFTCHAF

SEQ ID NO: 54646 - protein, 78 aa, Sorghum bicolor
  Clone ID: 14571096.pep
DPYPYNTMPQAQLHMYVQYEQPVVAHLVKMHYNRLAHNIKHYYPQPVTSQPETNACLQGTSGYQGLFATEAAILPYNK

SEQ ID NO: 54647 - protein, 36 aa, Sorghum bicolor
  Clone ID: 14571103.pep
QHSQQAYAITHKFGISRHALNTYNIDHQLLLESTCA

SEQ ID NO: 54648 - protein, 87 aa, Sorghum bicolor
  Clone ID: 14571104.pep
LYSNRSLCKLRMGDGEGALSDAYQCRMMRPDWAKACYRQAAAHMLLKEYKQAYDALLDAQKLDPGNDEIEKELSKAMESMNVSPDED

SEQ ID NO: 54649 - protein, 96 aa, Sorghum bicolor
  Clone ID: 14571109.pep
TSRKKTLTLTVVLLALIYLGSTMIPNIWMAFKFTGATTGLALGFMFPALVALRLDKEGSRLGHGERLLSLGLLGLSIVVSVIGVVGNVYTLKSKSE

SEQ ID NO: 54650 - protein, 89 aa, Sorghum bicolor
  Clone ID: 14571124.pep
AAAAVYTAQCAINRCPHWTKVCESHSRYTSDQLLECSRMMVDFHQKAGTGKLTGVHRKYSTYKFGCAAKTLPAQFLLESGGTPPPSGAI

SEQ ID NO: 54651 - protein, 59 aa, Sorghum bicolor
  Clone ID: 14571127.pep
RWDYLDNIMLVIFSLASSTFQARYYYFVHIYDYVWKLYFLKCDHSNPMNTSEPKGRYPS

SEQ ID NO: 54652 - protein, 75 aa, Sorghum bicolor
  Clone ID: 14571135.pep
RWWSNVEAGAQLNRPSHGGNVTHFLAFLWSKMDMKMLKASVTNYSDATHTLVDTTSTSSSASLPPVCEYDASCKS

SEQ ID NO: 54653 - protein, 128 aa, Sorghum bicolor
  Clone ID: 14571142.pep
IIRDFNIEQLASYNMYPLCFQPYIIWIKRKPQNKTARAKQKSKSLFFQLICCKLPMPNSSHAFSKRVPVDIGETDIIIHVSNLRCCSQCPDFRADTIRPLPSSQCSEITRPTKDNLMYTLPNPAYLLC

SEQ ID NO: 54654 - protein, 107 aa, Sorghum bicolor
  Clone ID: 14571147.pep
AMHHQWTGLQRTRRNTCQQQQHPELPPGVGSQTTRPLCPGIMPELCHQETPSPDCACGKDATPLVSSCPKARAIRPSIKGHQMLGLRMKTIRPRLPRGKKIPLLLVK

SEQ ID NO: 54655 - protein, 54 aa, Sorghum bicolor
  Clone ID: 14571150.pep
PLKKIGAGGGIVQYWGGFFPCTLFFLPLGTCPQISPYIPAYCIGGEIHAFCPGC

SEQ ID NO: 54656 - protein, 106 aa, Sorghum bicolor
  Clone ID: 14571153.pep
NSRVYYITKTSSSPVKNKQKSRNHLIYPWQLTFLWISTVFSLTPLHTVHPWEDEDGMGEERRRQADMYIGIKVALALCNRINKPEGQHHDSAACTANNQTTRGSAS

SEQ ID NO: 54657 - protein, 65 aa, Sorghum bicolor
  Clone ID: 14571220.pep
EQKPPKKKKINPAPAKITGNPSHWGFCRGEKKYLTMPVSSPSVFLALRGNLPFRGAPGPKRFVGS

SEQ ID NO: 54658 - protein, 86 aa, Sorghum bicolor
  Clone ID: 14591955.pep
MHLCVEDWKWWWKSFFSSGSVAIYIFLYSINYLVFDLKSLSGPVSATLYIGYSLFMVIAIMLATGTVGFISSFCFVHYLFASVKAD

SEQ ID NO: 54659 - protein, 71 aa, Sorghum bicolor
  Clone ID: 14591982.pep
PSRTLSRDNLDLSSPSCRENFISKHFKGNGDASRGLRLTMKLRDFNKYAKVKTFEVWMDNLYIIKCIYVGV

SEQ ID NO: 54660 - protein, 79 aa, Sorghum bicolor
  Clone ID: 14591984.pep
SNEDVSFGSWLIGLEVEHVDERSLCCGTPPDCEWKAQAGNPCAASFDWNCTGICNPVERMTEVHRRCWEGIGAEGHTQF

SEQ ID NO: 54661 - protein, 111 aa, Sorghum bicolor
  Clone ID: 14592002.pep
VSILIATLLGCIEQLPPSEVALHTTHFTGSVTLLYSSINGATMHLIQLCDTPISTLLIHSPVTLRNRLVYTHNHTTPPLSPEISIYHPKKSAGKSINQVFMANNNNTHGTY

SEQ ID NO: 54662 - protein, 116 aa, Sorghum bicolor
  Clone ID: 14592022.pep
TLLQRVLEALSYSPPVLIALHGVWVLTEKIPSSRFTELKEHAKSKSPRCRFFTVMPSIQKDFQLIQCPLVYSAKKSSVPARQGTVVHHVTLMDHKHKNCWGTIFQVNHQGKLADLD

SEQ ID NO: 54663 - protein, 52 aa, Sorghum bicolor
  Clone ID: 14592093.pep
VKLFISPGRSHGNFSPNKMLIGYPVIVSIFLFRLRVELQDKLILGFAFQLKR

SEQ ID NO: 54664 - protein, 76 aa, Sorghum bicolor
  Clone ID: 14592106.pep
TTSISHTLYCRLPPRKTFNDISFVCQMSNMASRLWIHQPSSSFNCREDGKSGKHKQHHVIMRYKCLPNKIYQLSVF

SEQ ID NO: 54665 - protein, 111 aa, Sorghum bicolor
  Clone ID: 14592132.pep
MAPVFSRDAWRCVWHMIQNDLVHGWGLDFALRKCVEPAHEKIGVVDSQWIVHQVVPSLGNQGQAENGRAPWEGVRERCRKEWGLFQTRMAEAEKAYYEMMGVTPPNVTFVS

SEQ ID NO: 54666 - protein, 125 aa, Sorghum bicolor
  Clone ID: 14592139.pep
FTVFGSPRNNRANQFIDGQNYTRLTAKGWLVPDLRSGAGWSSKECVSSGTQKNSIYRRHAVEKTGTDGTGRGVHMVSWQTPGLDHSQTVHDAEDGQGVSKLARPSLLGVFLEVDKLSADFPFMAR

SEQ ID NO: 54667 - protein, 78 aa, Sorghum bicolor
  Clone ID: 14592159.pep
GNSILQFSIVWYISVRPQRIAGESWPHYTVLQWCGNNNTLCMDNLGSPCPASPDIHGPYYPKTKNKQSFTENNEKPNS

SEQ ID NO: 54668 - protein, 89 aa, Sorghum bicolor
  Clone ID: 14592164.pep
DGTNGAAVPSVTGIAEVHKTVITENGVAGAGVSEHRVFLLGENRWEDPTRLTQNKKPVSTGTTASTKACISCRGEGRLMCLGNKPYYLH

SEQ ID NO: 54669 - protein, 142 aa, Sorghum bicolor
  unsure (1)..(142): unsure at all Xaa locations
  Clone ID: 14592168.pep
MISSKKLAQLSKKWQGMGAXARRRVTTVDKDPSCSSVVAGKGNCVVYSSDGKRFEIPLTYLHTRVFAELLKLSQEEFGYTSDERITLPCDTAVMEYVMCLLRREASEDVEKALSSIVMPCHHQSRMVQPSSGFNHQFALSSS

SEQ ID NO: 54670 - protein, 123 aa, Sorghum bicolor
  Clone ID: 14592171.pep
ISTDMLSCLLKSCQTSGSNSPDSTAVDGSGNNSSESILDIRNSQGDIPTRSSRKIGRPVVGKGVAGGIRFNRNKVLKDGRGARAVDDGPLKQRAQEASSSFMLHRKIPASFLDRAEEFFCRET

SEQ ID NO: 54671 - protein, 155 aa, Sorghum bicolor
  unsure (1)..(155): unsure at all Xaa locations
  Clone ID: 14592216.pep
TRILNSLMVIAFLAGIVFVILLRTVRRDLTKYEELDSEAQAQMNEELSGWKLVVSDVFRAPSNPMLLCVMVGDGVQILGMAVVTILFAALGFMSPASRGTLITGMLFFYLVLGILAGYAGVRVWKTIKCGDHSXWVGVSWRVACFFPXIAFLILT

SEQ ID NO: 54672 - protein, 102 aa, Sorghum bicolor
  Clone ID: 14592219.pep
MIEFFRSVSSRINIGRFEKSLELSILGGATDMLREYEKISKNITDKLLVQDSELLPSVVPVGAPWQQIHLLATEQKKVYIELFQLTPVKLTFSFTSTPWLNR

SEQ ID NO: 54673 - protein, 53 aa, Sorghum bicolor
  Clone ID: 14592223.pep
ISWVVMPVMLVASNSMTLEMSYSCLTTIHDLLVHSSSAELLCWNCAGHPGGLD

SEQ ID NO: 54674 - protein, 139 aa, Sorghum bicolor
  Clone ID: 14592230.pep
HEDDFDRYEPYHGYERQEETENVIKASSYDSREHKHFSEKWQEHSDKHVDISHDKSRSPPTCYSCGVAGHIARNCPRGIDDNFIPRRDGLNFKEKWQLRQRRFGSPSRRRPEFPIHPLDQTNHKVQDGRKPFAERNMQM

SEQ ID NO: 54675 - protein, 123 aa, Sorghum bicolor
  Clone ID: 14592240.pep
ARGSCPVSFPSSSWPKAKGTTFPFARRLVRSATKPNSTTFPPAACSRNLDQSNLNSIAHSAGSPLSCNGRGDHGIRIVLPLFLLRRVRGVGGIGEETQWEGLLVRASGSPFISQFRSTRSCRS

SEQ ID NO: 54676 - protein, 128 aa, Sorghum bicolor
  Clone ID: 14592242.pep
ESPGDMPWLIACAALAAARRISMSDIVLSNAMTTSRVCDTWSNAALERSEPALSGQPGCSGTAQYLLTTQTPRMKQAAQSAATHRVGTRAGEALCGLSAAAAIIVGVAGHLGWLLLVRKGGEGKRSLV

SEQ ID NO: 54677 - protein, 123 aa, Sorghum bicolor
  unsure (1)..(123): unsure at all Xaa locations
  Clone ID: 14592249.pep
ARGEDGSAGTPEICCRHSHAALAREVRVQVDVLVRCASSWRHADRAAAKRATHVLAELAKNEEVVNVIVEGGAVAALVCHLEEPAVAAPTQEEQQLRPFEHEVEKGAAFALGLLAVXPEHQQL

SEQ ID NO: 54678 - protein, 122 aa, Sorghum bicolor
  Clone ID: 14592252.pep
MAKTAVMELRTLPLGFRFHPTDEELVTHYLKGKITGQINSEAEVIPEIDVCKCEPWDLPDKSIIQSDDPEWFFFAPKDRKYPNGSRSNRATEAGYWKATGKDRIIKSKGDKRKQHTIGMKKT

SEQ ID NO: 54679 - protein, 57 aa, Sorghum bicolor
  Clone ID: 14592260.pep
MCSQLWWRCRGFARFVNVRDDTGATPLHLAARQGWRRCVHVLLENGAIVSASSGAFG

SEQ ID NO: 54680 - protein, 140 aa, Sorghum bicolor
  Clone ID: 14592267.pep
ARGQHHFGTNSHVSNNMPSVSEKMMMAQEQLQSRHGLPNSSSALPFGGADTGLSQNRAVQNSQHMLQLLHKVDNSRNSNVDADIPNNSLGVDSAQQQLNHSSLQGFGLRLAPPSQRQSDSGNLWSSQTNADGKQSDHSAQ

SEQ ID NO: 54681 - protein, 146 aa, Sorghum bicolor
  Clone ID: 14592284.pep
TRSFWTFVCVSCSGIHREFTHRVKSVSMSTFSTQEVEALQKGGNQRAKESFLKDFDTQKMRLPDSSNIGSLREFIKAVYVERRYAGGRFSERPPRDKQNQKAHEEEHRRPSSYHSFSQSPPYGCQYEERRNGKQSAFLSRKPGSDR

SEQ ID NO: 54682 - protein, 58 aa, Sorghum bicolor
  Clone ID: 14592338.pep
WWRRQRRRPRRLSSPATAGRRGSTGCSSTGTSWPRRWCGRSRSGSPSTPWWFLTFVGP

SEQ ID NO: 54683 - protein, 152 aa, Sorghum bicolor
  unsure (1)..(152): unsure at all Xaa locations
  Clone ID: 14592339.pep
MPATASVGGARPEPEEASPAPAPASTSASSCMGTRPEELTARLAAAGPGPAEGCGGAGAGGEEVEHERVRALREIKNQIIGNRTKKLLYLRLGAVPSVVAALAEPGASPAALVQAAAAAGSFXCGVEDGARAVLAAGAVEHLTRLLAHPDEK

SEQ ID NO: 54684 - protein, 144 aa, Sorghum bicolor
  unsure (1)..(144): unsure at all Xaa locations
  Clone ID: 14592354.pep
MAEPKASKSKSKSKSKSSHDGAASKKSKASAAAAAPGTLDAHFAPCADVKGLRFGAQLVTRALTVRRAAPLELPHLLRATPCPSPSPATTASADALSFAPTTTAYIPTNFAILAHHAWHTLTLXLXTKNSKAAVFVFESAAMKA

SEQ ID NO: 54685 - protein, 55 aa, Sorghum bicolor
  Clone ID: 14592366.pep
RSFKQPPAPMARSTSLSEAEAGISCFASSLSGFRGVLKHRYADFIVHEVARDGAL

SEQ ID NO: 54686 - protein, 100 aa, Sorghum bicolor
  Clone ID: 14592374.pep
GGIWLQPPNPPNPKQSCADAEVRVTRRTRCVGCRRSAPAAVAGGEAAKADGVARVPGSGGGGASSGGVSPGAETLVAYSPAERDMAEAGVLRGGRRWGLV

SEQ ID NO: 54687 - protein, 147 aa, Sorghum bicolor
  Clone ID: 14592392.pep
TRDFHQHRLWGDPDEDLPFKPKYLVTFTVGISQKDNINRAVKKFSKDFAILLFHYDGRVTEWDEFEWSKRAIHVSVRKQAKWWYAKRFLHPDIVAAYEYVFIWDEDLGVDHFNGDEYIKLVKKYRLEISQPGLEPDRGLTWQMTKRR

SEQ ID NO: 54688 - protein, 132 aa, Sorghum bicolor
  Clone ID: 14592400.pep
MPKSGDEELTNIDENISKPSGTERGVGKFCSSDDWTKEQDMALRKAYFTARPSPHFWKRVSKMVPGRSAEDCFNRIHADLTTPTPIAPRPRTSKTTFSPIGNFTLSDPKLPNLLESRVARQRTAKQKGLTAQ

SEQ ID NO: 54689 - protein, 78 aa, Sorghum bicolor
  Clone ID: 14592407.pep
ARGTDPFDVPMTDSVRGNPKDIEDEVAKEWEHTMLQDSMGKELNELNRQLEQKESEMKMYGCDTVALKQHFGKKLMEL

SEQ ID NO: 54690 - protein, 215 aa, Sorghum bicolor
  Clone ID: 14592416.pep
TREDHSNQLNGTTGKFSSSLAFSDGLNTNKVSAMNHGIGTLADIQRLMALEKSQASQQMINFITSQNNMNHDKGFIALPNKQFRSFIAQDIPLPGSTVNKLEENDILRNGVHQIHPWETTSRPHHSSNNFALPNKLPGYLTAGNAQLSSSTVNPSTENYIQSNAIHQHQCLENVVAKVPVLSETHNISSQEGHNHCTAATTDEHIRNYSNEVVRS

SEQ ID NO: 54691 - protein, 178 aa, Sorghum bicolor
  Clone ID: 14592422.pep
TRIKYNVCSNHAVGSSLIDLYSKFGDVESSRKVLAHVDASSMVPINALITGLVQNNREDEAIELFQQVLKDGFKPSNFTFASILSGCTGPVSSVIGKQVHSYTLKSALLNQDTSLGISLVGIYLKCKLLEDANKLLAEVPDHKNLVEWTATISGYAQNGYSDQSLVMFWRMRSHDVRS

SEQ ID NO: 54692 - protein, 187 aa, Sorghum bicolor
  Clone ID: 14592429.pep
ARGEIQRKKEEAIFRREEERKASSAAREARAAEQQRRKEIRAKAQQEEAELLAQKLAEKLRESEQRRKYYLEQIRERASMDLRDQPSPFQRRFPSKDGQNRSSSANSGEDSQTTGNSSAADSMAKSSNNVQTKRRIKKIRQRLMALKHEFIEPSIGESTGITHRAALGAAKAKLSRWLQDLQRLRQA

SEQ ID NO: 54693 - protein, 127 aa, Sorghum bicolor
  Clone ID: 14592437.pep
ARGQAVITGTFSMIKQCTSLGCFPRVKIIHTSAKVHGQIYIPEINWILMILCLAVTIGFRNTKHLGNASGLAVITVMLVTTCLMSLVIVLCWHKSIFLAIAFIVFFGTIEALYFSAALIKFKEGAWV

SEQ ID NO: 54694 - protein, 157 aa, Sorghum bicolor
  unsure (1)..(157): unsure at all Xaa locations
  Clone ID: 14592442.pep
TRSPPAFSTVFRHLQIVGRGNGDDTLAHWPSSAGIMTVEDAFLQVLQYLDKIWGTLSSSEKTELEKLAFIPVANGTRLVPVKSLFARLTINMSPFAFELPSRYLPFVSLLREIGMQESLTNSYARELLLDLQKACGYQRLNPNELRAVMEILDFMXH

SEQ ID NO: 54695 - protein, 192 aa, Sorghum bicolor
  unsure (1)..(192): unsure at all Xaa locations
  Clone ID: 14592458.pep
TRLFIIVYIALVIHGECLYLIHDWYKKTTWMYLAVPVGLYVGERTLRFFRSGSYSVRLLKVAIYPGNVLTLQMSKPPAFRYKSGQYMFVQCPAVSPFEWHPFSITSAPGDDYLSIHVRQLGDWTRELKRVFSAACEPPVGGKSGLLRADETTKKALPKLLIDGPYGSPAQDYSKYDVLLLVGLXIGATPFIS

SEQ ID NO: 54696 - protein, 124 aa, Sorghum bicolor
  Clone ID: 14592539.pep
NAKLGKARYLKNLYVKMAATVTAQRDVAWQREDQLQLEKLELAHHLDTVNDLAMQYRDIAFNLYHQLHPPPGEGEMDTDGELADDGEPDPGLSDEEESDPNDHNPGGNQDDGNDDPGYSSGHTD

SEQ ID NO: 54697 - protein, 122 aa, Sorghum bicolor
  Clone ID: 14592548.pep
SLDLIWMNVRNLVRSWSEAQILRSAADPSSLPRRRFLSLAAPEVPRPGHSGGSSTCSAIDPSTPLRRRFLSLDASEVPRPDHSGSSSACSAIDPSTPLRRRFLSLNASRLLPSTAFLAILGL

SEQ ID NO: 54698 - protein, 77 aa, Sorghum bicolor
  Clone ID: 14592554.pep
VCLCARWPGRPVEKIQQKKSVYFHSLATCPLTSRSMASRLCFFFLPVFLSRSWLSPPRLHPVQSGCVLLVDGKFMVQ

SEQ ID NO: 54699 - protein, 117 aa, Sorghum bicolor
  Clone ID: 14592572.pep
AYGSGYSSIAIQREAEPWPSTQQQRVRENGSEPLDTTEASAPARIAKSGSVDRGVGGSSCKLFGFSLTEKILGTEGVGGKEGNYEADRQTPRVLDLLGHGHSTPGALHALCAAPLGI

SEQ ID NO: 54700 - protein, 70 aa, Sorghum bicolor
  Clone ID: 14592603.pep
PSRLRMALKTCFSKMDSTLQRQRLQQPTWASLHSSRLGRHVLNLARRVAIALVLHSRVSSQILISVSRVV

SEQ ID NO: 54701 - protein, 95 aa, Sorghum bicolor
  Clone ID: 14592768.pep
HYGIYYFLPNASGNHVLFTFSWEQLHRRWNANGLILKLRFACTGTTATIRTRLSYLMYSEPEGFNSKTQRSIAPALFYSYAQLSQPPSVTRSKVE

SEQ ID NO: 54702 - protein, 84 aa, Sorghum bicolor
  Clone ID: 14592769.pep
SPKNYTTNKRNWSSEHPSLQTKLTSLDREPNQRCSFNNFCHAGNEKRFSQTIDRSRWMYIQYLANPKKNTLKFLIHAFPQQVIY

SEQ ID NO: 54703 - protein, 135 aa, Sorghum bicolor
  Clone ID: 14592773.pep
EHSCSCGQWQLTKKPCLHALAWITTETNANVESFVHDYYSVERFRAAYRGIVPPMTDKSQWPQVDPGFKLLAPQLKPGLGKRKYTTKTSEEPCASKQCEQCGEVEHREKGCTLHCPKKRKRCQAEEGWKAEYDAN

SEQ ID NO: 54704 - protein, 72 aa, Sorghum bicolor
  Clone ID: 14592790.pep
PVLTAAAIPPWSSLFQIYLAQIDKQFHDTTSADRKCKCRGDEIDQHSNCEITERIQCLYAFHIQQLHLMVPR

SEQ ID NO: 54705 - protein, 118 aa, Sorghum bicolor
  Clone ID: 14592813.pep
SLEPVPTHAELEEITDEELMEILGDQFTPRKRKITKAKQVHDRHLRCSKRSASKLGGFKKDVLHPVPFAMITGPPRTPALATTPFLLLEVAQGIATGFLQIYPSDVSASILKKDANGK

SEQ ID NO: 54706 - protein, 62 aa, Sorghum bicolor
  Clone ID: 14592835.pep
LPQTNEKCYSVTKFFSSPTKHGLCAQKAIYGIKLFYMDYVLKHYRRFYKLNIVYNKNYPYHY

SEQ ID NO: 54707 - protein, 95 aa, Sorghum bicolor
  Clone ID: 14592838.pep
RSLADNTTLNEMDPGSFLSFDASYYRLVAKRRGLFHSDAALLTDPATRAYVQRQATGLFAAEFFRDFADSMVKMSTIDVLTGAQGEIRNKCYLVN

SEQ ID NO: 54708 - protein, 46 aa, Sorghum bicolor
  Clone ID: 14592840.pep
VNQILRNWQYGYPGLVKSKHRHHFLTDSLSAVTVKQKHQHMENCFD

SEQ ID NO: 54709 - protein, 99 aa, Sorghum bicolor
  Clone ID: 14592866.pep
MACINMYNPDGAAGFGGGPQAPAALGPRISFSSDFAVEPPVQNRAMSLRCHAEEDLNFEFSVGSHPMMAADQLFSKGRILPLKDNAGGATAARPPTTLR

SEQ ID NO: 54710 - protein, 151 aa, Sorghum bicolor
  unsure (1)..(151): unsure at all Xaa locations
  Clone ID: 14593088.pep
HEAAPKAVLSLHWLKDGRGIVICLEDGTLKFLSLPRIANDVPATGRPFAGTKTQGVGTYQLSEYLIWSVHASEPTGCVAYCGADGTAVYFQLNSRFWDKEPGRNRVPYFLSGSLSEEGENIKIGSRLQTSPLPNVPVMTKRXSKPCQNIVQ

SEQ ID NO: 54711 - protein, 68 aa, Sorghum bicolor
  Clone ID: 14593089.pep
MDDLKQILARPIQLAEQVIKWSDEAYTFRQECMELKAKVERLAGLLRQAARTDLYERPARRIFDDTEK

SEQ ID NO: 54712 - protein, 150 aa, Sorghum bicolor
  Clone ID: 14593094.pep
ARGTIYDLNHESLTLHEMARGGDPGAVVEKMSMLLKRIKDFVQTEDPEMGARASTANIFPKDNSARPVIPDDFRCPISLDLMSDPVIVATGQTYERGYIEMWLEAGHDTCPKTQQKLANKSLTPNYVLRSLITQWCEANGIEPPKRPAQT

SEQ ID NO: 54713 - protein, 173 aa, Sorghum bicolor
  unsure (1)..(173): unsure at all Xaa locations
  Clone ID: 14593105.pep
ARGALVAHRLPYPSRSFDMVHCADCLVPWTAXLIPDGLYILEIDRLLQPGGYWVFSKPPVKWKSTYNISNQGTRDMQNNQLAMDYMLNKLHWTRVSEEGTISVWRKPSCHLHCNQEANAKLLGLPPLCTGEDPDSAWYANISMCMTCIPRAXTFNGCAGGAMEKWPXRLHAVP

SEQ ID NO: 54714 - protein, 180 aa, Sorghum bicolor
  Clone ID: 14593110.pep
HEGLVRGFVDVLVLAGGRTSSGAAATWSAEEVKKALRWALFFEEIFKDLRDSGQYEDSARELDAALLELTSSPGFPKGLAVVRSEMLSMARVLVVRHFLKAKTTMNARVGGLPTSSDELHAESTGHSRIIVKEFQKTLDSALCACLAERGLETLFDSVKRNSLENSINKPSIPAIQKHRE

SEQ ID NO: 54715 - protein, 118 aa, Sorghum bicolor
  Clone ID: 14593149.pep
MDEFELEDNLEFILQSIQELMEDQGDNNAFGDANQNELFASLVSYDQENMLPDVSAADVAAGKDMQGIPWEKMLFGRDKYREMKMKNYRNYQNLSYAREDALQECKHVEKDSPYYDFH

SEQ ID NO: 54716 - protein, 123 aa, Sorghum bicolor
  Clone ID: 14593167.pep
ARGQARGFARRRPRRAILLCLRCVSHVLAGDGRGPRGRYTSAGTRAYSATQRRLQAPRSSVLAAAWLGPSHRGWAHTPTPLLLFSGVHGLWSEDQGWPLQLKDPDAAAWTRTMAGHLEPRREP

SEQ ID NO: 54717 - protein, 46 aa, Sorghum bicolor
  Clone ID: 14593168.pep
PLEIHIHRVDIANFEARMQAMTKSTYTAITQYAKNSKPALEYVPTR

SEQ ID NO: 54718 - protein, 115 aa, Sorghum bicolor
  Clone ID: 14593175.pep
ARGSASRSNPRPLLAPAPLPPPPPPRPFVLPLLISRLPNSRVSRRPPGSSSAWREPLKLRIARGRALLIRCSPPSPPPAPPRRRGAAVRLCLCSEPTSSLRWPPGYQLMMWKSQL

SEQ ID NO: 54719 - protein, 62 aa, Sorghum bicolor
  Clone ID: 14593176.pep
MLFDIGLAKLFTSHDCVASCIFDMVCLFSAYSSGRPNIASSAPQPAGLSIYSSYPILYYIKT

SEQ ID NO: 54720 - protein, 125 aa, Sorghum bicolor
  Clone ID: 14593181.pep
MGKAKGKQRQDKFYHLAKEQGYRSRAAFKLLQLDARFRFLPTARSVLDLCAAPGGWVQVAVNHAPVGAFVVGVDLVPIRPIRGAHSLTEDITTTKCRAAVRRLMDSNGVSAFDVVLHDGSPNVGG

SEQ ID NO: 54721 - protein, 87 aa, Sorghum bicolor
  Clone ID: 14593188.pep
ILQKQDNYGPRRHIRVCQWWLLWYYTPADILPFRLFYSPCLKDCQEPLSCLGRNIIRPLFFELSGVLSHLLFCHCYSVSTVMDNGFV

SEQ ID NO: 54722 - protein, 201 aa, Sorghum bicolor
  unsure (1)..(201): unsure at all Xaa locations
  Clone ID: 14593194.pep
HEAGLNLLHRSWADLLPDILCAVAGRLARAEDRARMRAVCSAWLAAARLHRQPPPLPLLVLHDFNVSSFCSDGAMTGIRRIPLPLDGVXGXGDVRCVGSFEGWLVGVQPYEGLYSGDGPCFLMKAFSRDVNVIHLPPPSPEPDSNSVAALSNSADAYSRYFAFAFVNGSNSFNAYIRSLTNSADAYIRYLPVINGSGEMQC

SEQ ID NO: 54723 - protein, 157 aa, Sorghum bicolor
  Clone ID: 14593203.pep
MRHRSHPNASIPCRGCSPLSSSPPAPAAPFSPSLRRSPPPPGFLTHVLGAGHFLLQKMSRALHSPCFMAPLLWVASLLVVVSPGDAFYLPGSYMHTYSQGELIFAKVNSLTSIETEMPFNYYSLPYCRPQGGIKKSAENLGELLMGDQIDNSPYRFR

SEQ ID NO: 54724 - protein, 182 aa, Sorghum bicolor
  Clone ID: 14593204.pep
TRAGRGPGLLENLVNIFYKHLSGANSDSQLLGRSLFCLGLLLRYGYQLMLTSENQLDFPKIINLLQRKYLLRDDFSLKVRALQTLGYILIAKPEFMLQRDMLKLIETALSSGVDYRLKIQGLQNLYEYLRDAESQLTAESTAKPPVQCEINGGSEVPVAAGAGDTNICGGIIQLYWSSILDR

SEQ ID NO: 54725 - protein, 172 aa, Sorghum bicolor
  Clone ID: 14593206.pep
FMNFGERKDPPHKGEKEVPEGAPDCLSGLTFVISGTLDSLEREEAADLIKRYGGRVTGSISKKTSYLLADEDLGGVKSNKAKDLGVPFLTEDGLFDLIRKSKPAKAPVDKQQSNNSFEKLQKSQTKSSPAKVEKRAEASAVGKSIASNSNAASASADKQKPKNVDRGSMQWT

SEQ ID NO: 54726 - protein, 80 aa, Sorghum bicolor
  Clone ID: 14593213.pep
EEAAQEPHLRRRRALLRGPGPRGRLRIHLRLLVLRARRRRRALLGGGGGHRRARPAWGQPRLERPHPHERHRWRTPRLRR

SEQ ID NO: 54727 - protein, 158 aa, Sorghum bicolor
  Clone ID: 14593218.pep
TRDEPRFLSQFSRDILPVLIKAVNSGANSYICYGCASIVNNICYFSEPEILQELLKETNIPGFLAGLLSRKDHHVLTSSLKIIEILMQKLPDAYLGFFIKEGVVNAVEALLNQEDCSKSTHLPDDMQQPETQPVIRDKTTCYCYAFDARRSEAAEKRT

SEQ ID NO: 54728 - protein, 191 aa, Sorghum bicolor
  Clone ID: 14593225.pep
ARGEEPASGIDDDKGKVSFAIAGLGQEGSSDLISEKDAFYVEGTLPTGISTSPPMKSLEENASSNQYGITDIREGLKTDEIKSSADHDLGTKLPDDSNTLFDVPSFEHSSEPPMPYQSSDMDIKVSGHANYPEELTLYYLDPQGGVQGPFLGADIISWYEDGYFGLELPVRLSQAPDDVPFRPLVEVMPHL

SEQ ID NO: 54729 - protein, 42 aa, Sorghum bicolor
  Clone ID: 14593234.pep
WVQLRSYVLSPPKKTFSSIMEMVLTYKLLNLFQIIRHLIFLP

SEQ ID NO: 54730 - protein, 143 aa, Sorghum bicolor
  Clone ID: 14593244.pep
HEARQYGVVGIAPGIGRAFVGFIVQPLSGALDFFSLTVDGISASFMRCVNILSNKSVPQRIRDPRAIHQDVIVRDYDKVEAAGQMALYLAEASRYFACTDLFREPSKYAWSDYYEDHFILPNHRIALVTNKRVMLLQCLDLDK

SEQ ID NO: 54731 - protein, 174 aa, Sorghum bicolor
  Clone ID: 14593248.pep
ARGIIVPMIDYEKEKEWKRKARTTLTDWCMSLETIIQWSPYSTEAELIQEFGSIGEQGTRIIIYNLWEDDEGELELDFDADANDIQIRGVNRDQNKIQKANQFPNSRHFFTYRHSLRSYASILYLRLPDNFKMILRGKKIEHHNIINDLMLKKQLNYKPTVCDGLPKDMHMAAK

SEQ ID NO: 54732 - protein, 110 aa, Sorghum bicolor
  Clone ID: 14593250.pep
MESKAENSMISPIENSVSPPSVKRQKTLSDKDSDQCDDASQQVVIYKNDKSDRGRDEQSGSHLPIVPAKPSKKQKRALGKQIGAFAAQCAKCQKWRLISTKEKYEEIREQ

SEQ ID NO: 54733 - protein, 192 aa, Sorghum bicolor
  Clone ID: 14593260.pep
ARGLILVNYGRVTCGNSLFGPGFTRDADAFSRVWQADVDFRNNDLSYDAITAGGKKIFGSNQPPNYFPTKLYESAVTTGGDATNEIEYLMPVDTRLSYMVWLHFAEIDAGIGSAGQRVFDVVLAGENVTRIDIFKQVGGFTAFKWTYIVKNLTSSTLSVKLVPVVGRPILCGLENYAMVPLETRTLPSQVAA

SEQ ID NO: 54734 - protein, 170 aa, Sorghum bicolor
  unsure (1)..(170): unsure at all Xaa locations
  Clone ID: 14593271.pep
VQGKIKFEKSVEDDVYKYEIEKVWVQFKGLPEELREFPIIWAIASILGVPRAVDTKFTKAFGRARMKVAVLDPSLIPVFVDVVIXGDDVFQLHFGVEQGGQEGEPXLLDLDSTMEDEDPQNELVGKEVDDPKNNEIGDKAMEIDGKNEEQPPKGSDGGSKKNANSKSTAI

SEQ ID NO: 54735 - protein, 169 aa, Sorghum bicolor
  unsure (1)..(169): unsure at all Xaa locations
  Clone ID: 14593277.pep
TRLVSAQVQXQMLAAYAANRANNWKEKDAAIYLVIALMQKPGATGGGTPVVDMESFFTSVIVPELRAPDWQSEPMLKATVLRFLKEFRDQIPKATALALLPSVVRFLTHESNVVHSYAATCIENLLIIKDAVPVPGLTTVTRSPRYVAADINPFAPQIIQNLSTALSFP

SEQ ID NO: 54736 - protein, 76 aa, Sorghum bicolor
  Clone ID: 14593280.pep
EVPNSLVFYSKFQGKLLHYLVINKLCCYNTDNFMPFCCQVHGSLVLPSSVHLHCCMADAFVWTISISWSYICVFPE

SEQ ID NO: 54737 - protein, 211 aa, Sorghum bicolor
  Clone ID: 14593283.pep
HEEILRLQQQLDAKQKLELEIQSLESKMKVMKHMPGEQDSESKKKMDELAEELKEKMDEMEAMEFLNQTLIIKERKSNDELQHARKELIHGFNELAVAGRANIGIKRMGELDLKVFGIACRKRLPKEDAAVTSALLCSKWEEEIRNPNWYPFKVKVVDGKEMEVLKEDDAMLQELKQEHGEEIYGLVTKALLEINEYNPSGRYPVPELWNY

SEQ ID NO: 54738 - protein, 101 aa, Sorghum bicolor
  Clone ID: 14593295.pep
MKYVLVTGGVVSGLGKGVTASSIGVLLKSCGFRVTSIKIDPYLNTDAGTMSPFEHGEVFVLDDGGEVDLDLGNYERFLDIKLTRDNNITTGKIYQSVIDKE

SEQ ID NO: 54739 - protein, 130 aa, Sorghum bicolor
  Clone ID: 14593307.pep
GSVRQHQLRPPRLLARTRGAAAALCIHSRPLTQQLKAPPFLRPCTQRCLIESGEARIWAKISLGLDLTCEKDKQDFRSFLSYSKASCNNHQQILSCSLQSSQLFTWQLLATDEQEEIEIEIEIEIQSPRS

SEQ ID NO: 54740 - protein, 129 aa, Sorghum bicolor
  Clone ID: 14593324.pep
MAIGGSDAGGGGAAAGRRSVLVTGGAGFIGTHTVLRLLEQGYGVTVVDNFHNSVPEALDRVRLIAGPALSARLDFIRGDLRSTEDLEKVFSARRYDAVIHFAGLKAVGESVAHPEMYYENNLVGTINLY

SEQ ID NO: 54741 - protein, 153 aa, Sorghum bicolor
  Clone ID: 14593326.pep
MKKTVVLYPGLAVSHFVPMLQLADVLLEEGYAVVVPFIDPTEKGDIALAAVIDRVAASKPSVVFHVLPRTEDSPCTFVHDSEFIVRYLEIVGRYSQHLHDFLLSMPPGSVHALIVDMLSIEVLDVTTKLGIPAYAFFPPNASALAVSVQAASL

SEQ ID NO: 54742 - protein, 50 aa, Sorghum bicolor
  Clone ID: 14593341.pep
ARGSDSVPQRRSSALGPRNRSGSPSAASRDGGAVPSSAAAVAAPPPASRQ

SEQ ID NO: 54743 - protein, 70 aa, Sorghum bicolor
  Clone ID: 14593353.pep
TRVLCSSTSLFPVLTLPLSLSLSLSLSPLENGCVGGGRRREERERGELRFCAVVYYHPQALNPSGPVCGG

SEQ ID NO: 54744 - protein, 217 aa, Sorghum bicolor
  unsure (1)..(217): unsure at all Xaa locations
  Clone ID: 14593356.pep
ARGSAGSLDEPHYQHGFRPMDPVAFARERNMPSDSDRTVNEDKRFMSCSMPREHQKFFEVPVSSVRELHLQSDEPSTSEANHSRGRMTSDDLFAPRTRSLSPVPKGHVFAVSNGNSREFGFSPRSPVRKMXDGLRSPPHPLPLPPASATCSPLLPASAACSPLHPASGACSPLHPASGACSPLPPIHSPCSPLPSSPSSCPPLPASPTTSSQSQSQW

SEQ ID NO: 54745 - protein, 194 aa, Sorghum bicolor
  Clone ID: 14593361.pep
ARGSRFPFPISPPFLGSGTRSSSCPRMASDGAARVRPPKLPVWEGLDPSNVLTYKRRRRGTGANAGHIAVTPSPDPVKNKMSAVVHAINSQQGGRQMLDRHWRSWRDTLEGVLQSTPGNQSAGGIQSCIRDALRYNGCHPKEHGNLADGRGAGGEDPVGAVHSEENNAAFQLEDGTAASLEATRQCAIKLFLTF

SEQ ID NO: 54746 - protein, 158 aa, Sorghum bicolor
  unsure (1)..(158): unsure at all Xaa locations
  Clone ID: 14593378.pep
HEDAHASMPLKFXDEAFITATYLINRLPXKVIHGQTPLERLFHQXPDYSTLRTSGCACWPNLRPYNSRKLQFHSKQCVFLGYSKMHKGFKCRYVAEGRVYISRDVFDENVXPFAQLHPNAGARLRSEILLLPLTLLNHSSNFGNDNSFDLFGNGSLKI

SEQ ID NO: 54747 - protein, 75 aa, Sorghum bicolor
  Clone ID: 14593394.pep
HEERFDGIDRNDRYANRNTVFFDINLRGLDGIQGPVYVGTGCVFNRTALYGYEPPVKKKKPSFFSSLCGGRKKTS

SEQ ID NO: 54748 - protein, 185 aa, Sorghum bicolor
  Clone ID: 14593397.pep
ARGSSQDDFAVLIHLKAPYANPEQVTGRSVSATSVGYPTSRAPVDLVTVLDVSGSMAGTKLALLKRAMGFVIQHLGPSDRLSVIAFSSTARRLFHLRRMSHSGRQQALQAVNSLGASGGTNIADALKKAAKVIEDRSHQNPVCSIILLSDGQDTYNIPSNITGARPDYSSLVPSSILNHTFRLVP

SEQ ID NO: 54749 - protein, 70 aa, Sorghum bicolor
  Clone ID: 14593398.pep
TRVELQALAELEQSTRKLPTDEARRALQQCARWRRHDVRRLRESSLWNWTYDRAVLLLARAVCAIYHRIR

SEQ ID NO: 54750 - protein, 150 aa, Sorghum bicolor
  Clone ID: 14593426.pep
MPPLPRQFQQTRMNFPSCSKSVPDTGTGGKRGSEGAPPPRPPPPPPPPPPMPPVKDKGGATAAASAPPAPPPPLPRAGNGSGWLPRRHSERQATTVIRASASAVHPEESPGRAPSEKQTDSDADAAALPKLKPLHWDKVRASSGRPTVWD

SEQ ID NO: 54751 - protein, 173 aa, Sorghum bicolor
  Clone ID: 14593427.pep
MPEPQSSVASSGSVDRLRNAFGGVLCTFTLLLIGVLAFSIRLFSVIKYESVIHEFDPYFNYRVTQFLSKNGIYEFWNWFDDRTWYPLGRVIGGTVYPGLTLTAGTIWWLLNSLNIPLSVETVCVFTAPIFSVNASWATYLLTKETKDPGAGLMAATILAMVPSYISRSVAGSY

SEQ ID NO: 54752 - protein, 204 aa, Sorghum bicolor
  Clone ID: 14593438.pep
TRVNKSKTALLPSYLQPYAHVYGGGGGSNNMRATMKSFQTAGAGGASLMSFVPAADHGIQQGIPTYSVYAGYSPYISDYGYPLSYYQPYAGLQQGAQLQQYAILGGGGATATAPAGLTMAPEAANPSALYPYFQYAPAAAMAAGGYGMVQYPQLYQYAAAAAVGGTTAATTLAAVAGGLQQYGGAVAFTPNSIAQAGMTMSLTS

SEQ ID NO: 54753 - protein, 172 aa, Sorghum bicolor
  Clone ID: 14593439.pep
TRVRLMCSFGGRILPRPGDRQLRYVGGETRIVSFPRAAASFAALVAALAKAAPALFAPGAPRPSLKYQLPQDDLDSLISVTSDDDVDHLMDELDRIHDLSANVARPPRLRVFLFAPAPDAAFGSVLSGTAGEAAASTDQWFVDALNAPAPPPIERGRSEASSIISEGPDYLF

SEQ ID NO: 54754 - protein, 166 aa, Sorghum bicolor
  Clone ID: 14593440.pep
HEGSAFTVGSGSGNKNWGVILGAALGGVGLFIIVVVLVLLCRRKKTLEKQHSKTWMPFSINGLTSLSTGSRTSYGTTLTSGLNGSYGYRFAFSVLQEATNNFDENWVIGVGGFGKVYKGVMRDETKVAVKRGNPKSQQGLNEFRTEIELLSRLRHRHLVSLIGYCD

SEQ ID NO: 54755 - protein, 210 aa, Sorghum bicolor
  unsure (1)..(210): unsure at all Xaa locations
  Clone ID: 14593452.pep
TRGRFCNGRLPPDFISEALGLPPLVPAYLDPAYGIQDFAQGVCFASAGTGLDNKTAGVLSVIPLWKEVEYFKEYKRRLRRHVGRATARRIVSDALYVVSIGTNDFLENYFLLVTGRFAEFTVGEFEDFLVAQAEWFLGQIHALGARRVTFAGLSPIGCLPLERTLNALRGGCVEEYNQVARDYXAXVLDMLRRVMAARPGLKVAYIDVYK

SEQ ID NO: 54756 - protein, 191 aa, Sorghum bicolor
  Clone ID: 14593464.pep
TRGCRGFHSSFRGTQSGLSLNVDVSTTMIVKPGPVIDFLLSNQNVNDPSRIDWQKAKRALKGLRIRTTPANAEFKIFGLSERICKEQTFPLRQRNGSNGDCDTIDITVYDYYAKKGIDLKYSGDLPCINTGRAKRPTYFPIELCCLVPLQRYTKALSTLQRSSLVEKSRQKPQERMTVLNDALQRSNYDSD

SEQ ID NO: 54757 - protein, 182 aa, Sorghum bicolor
  Clone ID: 14593466.pep
HEAECFRCHACSQPIYDYEFSMSGNHPYHKTCYKEQFHPKCDVCKQFIPTNMNGLIEYRAHPFWLQKYCPSHEVDGTPRCCSCERMEPRESRYVLLDDGRKLCLECLDSAVMDTNECQPLYLEIQEFYEGLNMKVEQQVPLLLVERQALNEAMEGEKAGHHHLPETRGLCLSEEQTVSTILR

SEQ ID NO: 54758 - protein, 35 aa, Sorghum bicolor
  Clone ID: 14593469.pep
GWTWTLCGRGAQSSGSASRQPPMPEADSTNSRPRA

SEQ ID NO: 54759 - protein, 158 aa, Sorghum bicolor
  Clone ID: 14593473.pep
ARGTITVQVKFAGRTIPVEVPAAASGAELKRLLQPLTNVLPRGQKLICKGKVLEDAASLSSMQVVDGSKVMLIASQGLHQGDGPITKNSNSSATTVRRPSNAKENQAQKPEAVVTKSRSERWKLTGVVALHDCDLKVVPEEVWDCGPSIRILDINNNS

SEQ ID NO: 54760 - protein, 64 aa, Sorghum bicolor
  Clone ID: 14593476.pep
SHTYMHWIIGALHTVTQVCTVQQAACDATWISIYINASRNTYVYTNKSCRAFVHSLLLASSRHL

SEQ ID NO: 54761 - protein, 152 aa, Sorghum bicolor
  Clone ID: 14593482.pep
ARQQQLFNRSPPPSTTKRCQRPAAPSTARASWPRSRHPAVGLVCCPSLAALQVTTASTTTNAARSSDSEGICFKNIILDTKLPREGKFFELEMTVRDCDLDVYGVVNNAVYAGYIETARQEMAASLGVCTGSIVRTGRAMALSELNVKYFAP

SEQ ID NO: 54762 - protein, 133 aa, Sorghum bicolor
  Clone ID: 14593496.pep
TKSSISSFTVCSSTFISSSSSGRRWTTGGGWRHWETAAAPPPNRSTAWRTDWNGDDVSTSPRARIAAACSPPPAGTPPTARCACAATPAIAGVRPRRGAPPHFRSADECSGVGERRAGRRQWDYGSVLSCPRA

SEQ ID NO: 54763 - protein, 202 aa, Sorghum bicolor
  Clone ID: 14593499.pep
ARGHDKSLHVYRGNFDDFESGYEQKRKEMNKKFVMYEKQMKAARKSGSKAAQDKVKGQALSKAAKEAAKNKGKGKSAADDDDDQKQVAVPQKWRDYSVEFHFPEPTELTPPLLQLIEVGFSYPGRPDFKLSGVDVGIDMGTRVAIVGPNGAGKSTLLNLLAGDLTPTEGEVRRSQKLRIGRYSQHFVDLLTMEEDPVQYLLR

SEQ ID NO: 54764 - protein, 65 aa, Sorghum bicolor
  Clone ID: 14593512.pep
MERLSTNQLYKSGVPVTIPTSLPSIPASLDESFPRLPDTQSVLMERELRSTPLPTHQTTVAPIRG

SEQ ID NO: 54765 - protein, 147 aa, Sorghum bicolor
  Clone ID: 14593514.pep
HEGRVKTYWIDGKSATGIHPTSENITFVRCKSENGIITFEFTRPLNPSCTGKVECKNIIDPTTPLKVVWAMGASWSGDDLTDSNMHSVTSSRPIRVLLLRGSAEAEQDLRPVLAVHGFMMFVAWGILLPGGTMAARYLKSLKGDGWF

SEQ ID NO: 54766 - protein, 60 aa, Sorghum bicolor
  Clone ID: 14593522.pep
VVRHADEDPVAEAAQQVAASIAALLDGVHLLNTYPPSLTALAARGRHPVVHRHPWIAASC

SEQ ID NO: 54767 - protein, 60 aa, Sorghum bicolor
  Clone ID: 14593526.pep
SAHHKGAKGERSSVSWPLLLPSGTGAQAHESEDEERERMTSNNSKSTTQGEQIRFGERYR

SEQ ID NO: 54768 - protein, 171 aa, Sorghum bicolor
  unsure (1)..(171): unsure at all Xaa locations
  Clone ID: 14593536.pep
ARGCNGDHTVFYKHRGAFITIMAVYVDDIVITGDDVGEIKCLKENLGKAFEVKDLGPLRYFLGIEIARSPKGIVLSQRKYVLDLLTETGMLGCXPCSTPIDKNHQISVESGDPVNKETYQRLVGRLIYLCHTRPDISYAVSVVSRYMHDPRTGHIELVYRILRYLKGTPGR

SEQ ID NO: 54769 - protein, 146 aa, Sorghum bicolor
  Clone ID: 14593539.pep
MGAGIRILAAFLAVLAAAAAGGVTAQLRQDYYAAVCPDLESIVRDAVSKKVQAQPVAVGATIRLFFHDCFVEGCDASVILVSTGNNTAEKDHPSNLSLAGDGFDTVIQAKAAVDAVPACTNQVSCADILALATRDVIALAGGPSYA

SEQ ID NO: 54770 - protein, 142 aa, Sorghum bicolor
  unsure (1)..(142): unsure at all Xaa locations
  Clone ID: 14593540.pep
TRQRLDYALESSASLPSTRESIQDEQVEITEDSASTIASIISRKDAATQTSPELSRSSSPNTRPTFNRSLSTEQVKESGSCFSDLDIRDVQMDDRVTLTRWSKKNVTRSSNKNSTNIIEWKEKTVESNSSSWGFAEAKCISX

SEQ ID NO: 54771 - protein, 163 aa, Sorghum bicolor
  unsure (1)..(163): unsure at all Xaa locations
  Clone ID: 14593548.pep
HEGKNKVFVAGDDLWYNKIIDPSSDFILIWIYVFRVSCFIALFMDPLYFYVPEIDYKQTNHCVRKDTRLAIIVTVFRSIVDLFYVIQMIIKFRTAYLNPSSNLGVFGRGDLITDPKEIAKQYLRSDFAVDLVASLPLPQIIVWSVIPAIXYSSSEHGNDMLLL

SEQ ID NO: 54772 - protein, 172 aa, Sorghum bicolor
  Clone ID: 14593551.pep
TRVPSMPPALPAPSVTTIPQESYYPPSAQPTEATHQQYQAPPAPQQPQAPQPAPPQHYQTLPQYAQYSQPPPSASVNPTAALPPPVPQQPEEPAPYGPPSQGYPPNVRAPPPYMPPPSGPAAPFYGPNPGMFDVSAARPNSGPPLPYNAGYKPPAAGGFSESYGYAGSPSHH

SEQ ID NO: 54773 - protein, 136 aa, Sorghum bicolor
  Clone ID: 14593554.pep
MAAPFVYLPSTFNGNSPDALLKAALDGNLGRIKGIIRNLGIGNGDRAAVLSFHKDGFGVLHCAACQGHLEVCKYLVEELGCDPNMAEGSCEGATPFMASAQSGDISTVKYLLDHGGDLMKADAKGRTVLHHAVCAG

SEQ ID NO: 54774 - protein, 113 aa, Sorghum bicolor
  Clone ID: 14593559.pep
HEDKAQISRHCSTPQSSLSVHPLVLPNSQAPLVLTKIHLLPPLYPQISSAGNIFCCFDFQRPFLQQAILCFLVVDWARISFHSSEIQAFGFYSSRNLFLYPVLPRIFHPLLAS

SEQ ID NO: 54775 - protein, 126 aa, Sorghum bicolor
  Clone ID: 14593566.pep
FVQQEDDVEKNEEDDGVTTDLDEVATASPAPPLDVVGISTDPSTEVPDPVVGSPEQLQQAVRQIGWKPSRDSAATAPPVLRLPRRWEVGLGAAARLGSPCRGVAAPPSACRDVCNGAHPNVERASC

SEQ ID NO: 54776 - protein, 132 aa, Sorghum bicolor
  Clone ID: 14593571.pep
HEDQKVWISIEKDTRPTTSSAASRGLSPRRRLSSDGVNVIPKSMDLVENNNKLVTMSAAARGVSPRRRLASDGVHVISKSIDFDENSNKPLAMSAAARGASPRRRLSSDGMESISKSTNITEKSIRPSTSSM

SEQ ID NO: 54777 - protein, 163 aa, Sorghum bicolor
  Clone ID: 14593576.pep
ARGAAGGKPAPGVREMGSRRALTEIKNLVGVAPYPCAVAKKPTLQKSRRDEKKTTLLPSSRPMTRKFAASLASKGQPECQPILTECQPILTDPEPGVDQQKESIGDGTVDIDVEIHELVDDSDSDIDMGETENKEMNQDEPLMDIDRADSGNPLAATEYVEEL

SEQ ID NO: 54778 - protein, 161 aa, Sorghum bicolor
  Clone ID: 14593586.pep
TRLRRSARLSKQPENPINNEPAQQPAASNQCNSDLDLNIDKIISNLCRSPSPQLQMPRASSNQSGRVDAATGPPVSNHTAPQDRQLPLSYSQLYPPEVPGEHWLDRSGDEQPHSPDARFHDVHMQGQWQQVREPSAHSTDLGALICVPTCGYWLKPWLRYT

SEQ ID NO: 54779 - protein, 149 aa, Sorghum bicolor
  Clone ID: 14593589.pep
QNKRTQMKNQHERHENSQLRAENEKLRAENMRYKEALSSASCPNCGGPAALGEMSFDEHHLRVENARLREEIDRISAIAAKYVGKPMVSFPVLSSPLAGARPSPLDIGGGVGGAAAYGAVDMFGGGVAVDLLRGAVPQSDADKPMIVEL

SEQ ID NO: 54780 - protein, 196 aa, Sorghum bicolor
  Clone ID: 14593591.pep
TRRTSPEATKALELISNALHICPHSDSLKEMKADALLMLRRFEEVIQLCQESVNPTERNSVLFKDNGEPKNSRVSEQTQFSGRYWRPYLICKSYFLSGKLDEALELLKKHEQVTPVKESEVSTYQEKFSSLSATVRELLSLKAAGNESFQAGRYSDAVKQYSAALACNSESRPFSAVCFCNRAAAYQALGQVTDAI

SEQ ID NO: 54781 - protein, 115 aa, Sorghum bicolor
  Clone ID: 14593596.pep
MAGRACEDRYANADLVCALCDNGGEIVSCEGRCLRSFHATNDSGEQCPTLGYSRQQLDVMKVFKCKNCEYEIYQCFACGRLGSAKTNPPEVFPCASSTCGHFYHAKCVAQLLFPE

SEQ ID NO: 54782 - protein, 164 aa, Sorghum bicolor
  Clone ID: 14593602.pep
TRSGGANHVRRACSVGVVGGGGGAGSPPGSPGHSLSPRMFVPQTPVPPLQRAADVTPVFNQILMNEQEEEYDGPPQKEIPALIVWTLGGKNVYVEGSWDNWKSRKAMQKSGKDYSLLLVLPSGVYRYRFVVDGERRCLPDLPCETDAMGNAVNLLDVNDFVPES

SEQ ID NO: 54783 - protein, 93 aa, Sorghum bicolor
  Clone ID: 14593621.pep
ARGYFSDCHSLNLLFSDSSTGVANNTVVSLDHPYSRKHVAGDDVMNSWVPRKGQAIMKPDIMVPEAPREALPLITSSNVKPDKKKELVTPHLR

SEQ ID NO: 54784 - protein, 153 aa, Sorghum bicolor
  Clone ID: 14593624.pep
HEATKYWDKLCERLPARETSVTEVFDKQVNSLTLEGVKRILDCCYNDLHGDLKTCLLYLAMFPKGCKTSRKCVTRRWIAEGFVTKKYGLTEEELAETYFNQLLRRKLIRPVDHSSNGKLETFQVHDMVLDYIASQAREENFITVIGGHWMMPA

SEQ ID NO: 54785 - protein, 170 aa, Sorghum bicolor
  Clone ID: 14593625.pep
TRVAVNDDQPSFVPNCESASLDKPGCFSKKDDSSEIVEDSKSLENQSEICNAECSSRIANEGPSLINMSDECSSRIANDCSPNEASHLTEEPCLSDKSCNTINYENGNEPAKSSDVVETKCVEALVTEQKDNGHHASGEWHGDHAQVIGPQRVYIIKVPKFAGDDLWNRS

SEQ ID NO: 54786 - protein, 91 aa, Sorghum bicolor
  Clone ID: 14593633.pep
VPARIENLMAEKQLYAAVQLHVQSVLILEREGLQAVGALQDDRSDLTKLRGVLFYKILEELHGHLYNNGEYSSATLSMVDSDEVLTNTAAG

SEQ ID NO: 54787 - protein, 115 aa, Sorghum bicolor
  Clone ID: 14593635.pep
HEGLVGFIPAEFGNLRSVMEIDLSYNHLGGLIPQELEMLQNLINVSYNNLAGVVPADNNFTRFSPDSFLGNPGLCGYWLGSSCRSTGHHEKPPISKAAIIGVAVGGLVILLMILV

SEQ ID NO: 54788 - protein, 51 aa, Sorghum bicolor
  Clone ID: 14593650.pep
HEGHLKERRLKDQMEKDPTEVIRKAVLRMLPRNRLRDVSETSFLSHSAFEA

SEQ ID NO: 54789 - protein, 51 aa, Sorghum bicolor
  Clone ID: 14593687.pep
TKTHSILHPFVFQFNNLQVTRNQLFCFFLLFHQPLDHPIDSNERTSNKNIK

SEQ ID NO: 54790 - protein, 82 aa, Sorghum bicolor
  Clone ID: 14593712.pep
QGSKQDEPPYGKHRLDNPECILQKSNVLPINCDDSDLAITQNLLPWSLSEIPCTYLGLPLSVKKLTNNQVQPIIDGIADQLP

SEQ ID NO: 54791 - protein, 68 aa, Sorghum bicolor
  Clone ID: 14593717.pep
EDIRDGMMLHVICFIRWKPCEAKSADFFFFGGSPTLWWSCFKSSTGPVGYCFLSDFSSGVHFKKPSYD

SEQ ID NO: 54792 - protein, 23 aa, Sorghum bicolor
  Clone ID: 14593728.pep
MMKIQLYKPYDITYVSRAFFLTM

SEQ ID NO: 54793 - protein, 115 aa, Sorghum bicolor
  Clone ID: 14593731.pep
HLFSSQPQSSHRKIYIFCTKYKCLYEQCHLQYTTACLFLPPVIRSCHISSPNLVSGTNRQNKKLHRNLEATCNLLIISFKTDNAKVDPDDYNYASTPDHRACDMACNRARFNHLL

SEQ ID NO: 54794 - protein, 54 aa, Sorghum bicolor
  Clone ID: 14593736.pep
IQGGQTTHICRYSILFIDSAYRERKMHRNGREYTVHVYHPFARVEILACQLMLE

SEQ ID NO: 54795 - protein, 45 aa, Sorghum bicolor
  Clone ID: 14593749.pep
APPVTLQFSKLKINVPPSSALYGLFLTKKRLNLYFLTRLILSALP

SEQ ID NO: 54796 - protein, 46 aa, Sorghum bicolor
  Clone ID: 14593752.pep
LPYFLLLYHNKSIHHHCIYVHITQAQILITPDIWFHVYMCISGLTV

SEQ ID NO: 54797 - protein, 47 aa, Sorghum bicolor
  Clone ID: 14593753.pep
LGAIRNEFLRQVILLSGSVVVILSPSLSSTTNTDHVLRSAYLCKDLL

SEQ ID NO: 54798 - protein, 69 aa, Sorghum bicolor
  Clone ID: 14593757.pep
QQAFKCQLIPQIWLPIGKYYRSTTLTKAVQTNLSSIQAQQNLAAQFIFFPLLLDLQFQYDSYNIIQTMC

SEQ ID NO: 54799 - protein, 63 aa, Sorghum bicolor
  Clone ID: 14593774.pep
HLLSVNNDHRIIFNYRLYSNHLMKKWKSANPSQPFTIIIIFNRSKLDLSAANPAEWRELRVLG

SEQ ID NO: 54800 - protein, 61 aa, Sorghum bicolor
  Clone ID: 14593775.pep
LSHVLYSCYIRFVSYHVYVVSSPICGAFSPSPLLVLVSFCHEKNDELYDSRQLINVMNFCW

SEQ ID NO: 54801 - protein, 47 aa, Sorghum bicolor
  Clone ID: 14593781.pep
RMPIGLSPSTYTVAQGFCRGQLAQLFNVHNLSTTTQNPHFHDGYKVK

SEQ ID NO: 54802 - protein, 55 aa, Sorghum bicolor
  Clone ID: 14593800.pep
TVTGFFMYLTLFWSVWFKVFVAFSCSFLTLATCYSIHLPQMIDSGSSESIHAKEA

SEQ ID NO: 54803 - protein, 50 aa, Sorghum bicolor
  Clone ID: 14593805.pep
EPLIIGFGRFRFSFDLFSSALFFLLNLQLPCLKNLLVTLVSGMGEKNKMS

SEQ ID NO: 54804 - protein, 124 aa, Sorghum bicolor
  Clone ID: 14593820.pep
RKRAMRPTTTQQAAARATPPKSFKRLPWTGRPEIHTKTQLKTCSIKGIIQGGIEEKGGGEGGTGPPCRRQARRREGRGPAAGLATTLYCRTEVALTRRKATPLVNSWNWNHSCHLPSTWQPFCQ

SEQ ID NO: 54805 - protein, 65 aa, Sorghum bicolor
  Clone ID: 14593861.pep
YNFQFNREREVILVLAQISKPNLWNDPIDIKYSYRDGRLQQEGKYHNCCNSCAYTQAWYKSKTVM

SEQ ID NO: 54806 - protein, 78 aa, Sorghum bicolor
  Clone ID: 14593867.pep
QTSVKFQLVKVYNAKSSPLLQHIIFLLWSDDPLVQTFDSKESDTKPLILLAESTGTLLCNLIHTVLQLHYIAHLTQRL

SEQ ID NO: 54807 - protein, 65 aa, Sorghum bicolor
  Clone ID: 14593885.pep
GDKMFRYMLMFLSLILVVFLGQTHKSAALDKDNSAFVLLYILLLFPRPPLAAKQRCRYQVLMCRC

SEQ ID NO: 54808 - protein, 49 aa, Sorghum bicolor
  Clone ID: 14593888.pep
YSIPKIWDVCFANLPDELYYIFNLRPQQHHGKNKTTWLVNLRWLLMVPR

SEQ ID NO: 54809 - protein, 56 aa, Sorghum bicolor
  Clone ID: 14593895.pep
ELEGDWAEGCSNGMLNLDHDEERYLAIKNLREQMLAGSGFIMSQGREDAEREYCGL

SEQ ID NO: 54810 - protein, 42 aa, Sorghum bicolor
  Clone ID: 14593904.pep
FNYQPNTIIVQLDAAFPGSSCNRFGNKRGTYGSKNVMLGFGS

SEQ ID NO: 54811 - protein, 69 aa, Sorghum bicolor
  Clone ID: 14593906.pep
QPVETVVGINQHQQEGTAEVVLKKQCDQQDDVVFLVLSWVLKCLQQKILEIRTFFFKVRSENFSVIAGL

SEQ ID NO: 54812 - protein, 53 aa, Sorghum bicolor
  Clone ID: 14593911.pep
CSGADLTPHGRARENANIMKQTIAQPAVWFHTALRQPNLLHATQGEPAVWFAL

SEQ ID NO: 54813 - protein, 62 aa, Sorghum bicolor
  Clone ID: 14593931.pep
PNSRRIKNIWTKLPDASSFTSFFPVIHLYIRLQLSHRWPSIPSVWYCAVGSICPRSRLPLIA

SEQ ID NO: 54814 - protein, 59 aa, Sorghum bicolor
  Clone ID: 14593947.pep
HEGRLADAGDMCEDCAAAAAPEKAMLSWMGRSELGERDLACACCGVALESGFYSPPFLL

SEQ ID NO: 54815 - protein, 56 aa, Sorghum bicolor
  Clone ID: 14593951.pep
PPVVLWIESELSLCCLFSRVTVHQFFPFLIRACFEFFCEVCLVRLMLYQVIDKITK

SEQ ID NO: 54816 - protein, 79 aa, Sorghum bicolor
  Clone ID: 14593967.pep
ARGSNGNLQSTGRVRCTPVLNTERSANAQGHRTLSTGPSGAHRVLNPERFAKRTGHRTHTTGRSLSVRCFQSGLLTEDR

SEQ ID NO: 54817 - protein, 53 aa, Sorghum bicolor
  Clone ID: 14593988.pep
TYNILLCPIFFKMMPVFIVKCLNSETHEFYKPSELHVPLFLSCVKNYNINKSW

SEQ ID NO: 54818 - protein, 84 aa, Sorghum bicolor
  Clone ID: 14593989.pep
HEGLMKSLRYLNLSGIPFSGEVRPQLGNLSELQYLDLGSQDLGYRMYSADITWLQHLPLQYLGMSNVNLSQVSTWPHVLIGFPL

SEQ ID NO: 54819 - protein, 79 aa, Sorghum bicolor
  Clone ID: 14593992.pep
ARGLEWTLPAAPRPGQNASSKQSSTSKERSAEASGAENSDETCESFAFALVNGALGVFEVHGRRIRDFRPKWPSSSFAS

SEQ ID NO: 54820 - protein, 40 aa, Sorghum bicolor
  Clone ID: 14593997.pep
ARGLCRAVHHLCCSLHSSILGVQAHCQAEVVSHFSSNKQS

SEQ ID NO: 54821 - protein, 106 aa, Sorghum bicolor
  Clone ID: 14594002.pep
HEAESWANALVSELSQLKKEKVAKSSATESSNRLELMDDFLEMERLACLSSEVNGNGSTIDKMKIDDVGATLSGSTERDGVKDLQSASPMSETPSNKQRLSEKSSL

SEQ ID NO: 54822 - protein, 82 aa, Sorghum bicolor
  Clone ID: 14594011.pep
KKDMMWWMRQSGRELSLSLAKLLLLPPLLARGRFPMASSSMGRFPQVPQPQGRRTRTRSEKTQGATGEAEVPDAWTLRLPAR

SEQ ID NO: 54823 - protein, 49 aa, Sorghum bicolor
  Clone ID: 14594012.pep
LPPPPPPPPCGPVLLCFYQGQPPMLSFLAACFMPSASSSLTLRLRRPSC

SEQ ID NO: 54824 - protein, 103 aa, Sorghum bicolor
  Clone ID: 14594013.pep
TRKSPADEPIHFSKDYGNSVDVSRLLQNVEISWIELDSSYLIHHGSESSSFEREKWRRFFEEMGVTDFVQVVKVEKSLSQVDSLLAGGLSLADVSAKPCTVYD

SEQ ID NO: 54825 - protein, 116 aa, Sorghum bicolor
  Clone ID: 14594015.pep
TRTGWKLVHGDVFRPPSNSDWLCVYVGTGVQFFGMLLVTMVFAVLGFLSPSNRGGLMTAMLLLWVFMGLLAGYSSSRLYKLFKGSEWKNIALRTAFTFPGSVFAIFFFLNALIWGQ

SEQ ID NO: 54826 - protein, 82 aa, Sorghum bicolor
  Clone ID: 14594017.pep
SVGVVVTGDGVAVEGGKVALMVPGEGEGDDAIGAQQQARKHYSAVTVELLPWWWNWRKEAWHMPQFKEKSSQSRGFAQQPLV

SEQ ID NO: 54827 - protein, 67 aa, Sorghum bicolor
  Clone ID: 14594022.pep
VVHGEEAVGLHARVGRAAAGHDLGLGLHRRVPEVHGGSDAAARRRRRRRRLDVEPEVIGPQPHGPRA

SEQ ID NO: 54828 - protein, 33 aa, Sorghum bicolor
  Clone ID: 14594023.pep
HEAEFSVEKQSHPSGEPSKAVHVDKGGCDHVKD

SEQ ID NO: 54829 - protein, 67 aa, Sorghum bicolor
  Clone ID: 14594042.pep
PHPHVYCSLARASRRFKVAAVMSPMAAAAVGMSPMAAAVAASSFPSCGPFRCPAAATRPHCSVSRRR

SEQ ID NO: 54830 - protein, 126 aa, Sorghum bicolor
  Clone ID: 14594050.pep
HEDFVFNVDIGDGEPIRKLPYNRSDDAYTVADKWLLKENLPLTYRQQVVEFILQNSGQNNFVPDPSFRDPYTGANAYVPGQPSSSNGNAPKPIFKHIPKSGMLLFETAQFDGILKKVTEFNARLSS

SEQ ID NO: 54831 - protein, 63 aa, Sorghum bicolor
  Clone ID: 14594058.pep
ARGSGFIYRPQSEQNLIDGRPASAHYSLENSKVTIINACDLFKQPLRASRPDHIVIILRGLPG

SEQ ID NO: 54832 - protein, 105 aa, Sorghum bicolor
  Clone ID: 14594059.pep
TRVFSEELTESKSQDLPLTKVGEHKSRMLSEVTVAADGTTLKADEVIEQVTTLEPQDGSLVKGAGISDEQEKNIGSQQQSSSEESSQDTMLKQTPEKVIVENSQS

SEQ ID NO: 54833 - protein, 127 aa, Sorghum bicolor
  Clone ID: 14594065.pep
ARGEDQPLLRASKLVKVRNILHERNYKKEKESTNVFELPPELCIVVMAPVSANTLRCFTFIPSIMYRIQCMLLSVNLKTQLGPSMKQFDIPALKVLEALTAKKCKEEFSQESLETLGDSFLKYITTQ

SEQ ID NO: 54834 - protein, 51 aa, Sorghum bicolor
  Clone ID: 14594066.pep
RTRDVSHTSEVIFELVDKAIEDIGPENVVQVVTDNASNNMGVKKLLLEKRP

SEQ ID NO: 54835 - protein, 104 aa, Sorghum bicolor
  Clone ID: 14594076.pep
ARGLFMPQLELMCLLSCINNRQVQDVTIKLKVTWDTRCKAHHPCIMLCLTMGSNILPMDLTLCTLVPLAMVGLSEPKSTTLKLWSTHTINQFLCPTVLPIHLQQ

SEQ ID NO: 54836 - protein, 109 aa, Sorghum bicolor
  unsure (1)..(109): unsure at all Xaa locations
  Clone ID: 14594077.pep
TRPVIVTAMASGCVRNNLVYTALSIFRSMVASDSAGVVDEAAALVALSASARVPDRGITGGIHALVSKIGLDGHTGVVNTMLDAYAKGGGHDLXAARKLFDMMERDVVS

SEQ ID NO: 54837 - protein, 60 aa, Sorghum bicolor
  Clone ID: 14594088.pep
MESSASAPASKGPRYAPPDPTLPKPWRGLIDGNTGYLYFWNPETKVTQYERPVAAVPSSP

SEQ ID NO: 54838 - protein, 120 aa, Sorghum bicolor
  Clone ID: 14594091.pep
ARGSSIGPLPPRHHRPPPLGSLPTARYSPLPHRKKNPAVAHSELSERGEPHSPCYYAFLAARRSPPPPGRNHHHHHHHHLVPVPDAHGAGPPLRGLFRRRPWRHRAPSASPSRHPHPWIP

SEQ ID NO: 54839 - protein, 128 aa, Sorghum bicolor
  unsure (1)..(128): unsure at all Xaa locations
  Clone ID: 14594124.pep
MCRLHKYCCFIAAILSCTMPSTLLDGLPNEVALQCLARVPFLFHPMLQLVCRSWRASVCSGELLKIRNQIDAXKXLLCVLAFEPENMWQLYDPLRDKWITLPVMPSQIRNIARFGVASIAGKLYLIGG

SEQ ID NO: 54840 - protein, 68 aa, Sorghum bicolor
  Clone ID: 14594131.pep
MMVGSSQQQLLQRKGKSVAGKAAAAATAAAEKVVVAVKAATREISKTAIVWALTHVVQPGGSIILLVD

SEQ ID NO: 54841 - protein, 149 aa, Sorghum bicolor
  Clone ID: 14594134.pep
ARGQVDQLAVQYNLTDFTSGFRHFLISQSVDPKSKALISSRPHPYSMKLQSIATCVKNREWVEIYRELDSFFRELLITREDLVVKAKGLALQGTEIAKRLLSSSTLVLGGSANLMLSIALRILSSAAEVVNFLSQLMVFLWVLYYLITV

SEQ ID NO: 54842 - protein, 85 aa, Sorghum bicolor
  Clone ID: 14594139.pep
IIMNYSALLQGFEFNMCVFSTKGTRKIQPQILMVTGGKAHFITKRTWWPLLGEQGTKFVAVLTSHVHISHFCTRESFSNSILILS

SEQ ID NO: 54843 - protein, 97 aa, Sorghum bicolor
  Clone ID: 14594142.pep
TRAQRQHQQAQAQQQRKARRCWSPELHRRFVAALQRLGGAQVATPKQIRELMKVDGLTNDEVKSHLQKYRLHTRRASSDVGGGDHLAAAAVGGLWSS

SEQ ID NO: 54844 - protein, 89 aa, Sorghum bicolor
  Clone ID: 14594143.pep
WQATTDGLGFSGSKKKEKKKEKKERELCTNSSLLLLLIAAKTRFFTGGIGDGERDQKSERRTNEIFTGRGAGAGLGPSDSDRNANRPRA

SEQ ID NO: 54845 - protein, 92 aa, Sorghum bicolor
  Clone ID: 14594145.pep
MGTYKLGVEVVSAHDLMPKDGHGSASACVELTFDGQRFRTVVKEKDLNPVWNERFYFNISDPSNLRELALEAYVYNVNKTLESSRSFLGKVM

SEQ ID NO: 54846 - protein, 93 aa, Sorghum bicolor
  Clone ID: 14594148.pep
LAGGPAMDGGASELREAHRLTGHGDRVWALAWNPAPGPGSGPVLASCSGDKTVRIWKRAPDGAWQCSDVLEDTHNRTVRSCAWSPNGKMLATG

SEQ ID NO: 54847 - protein, 61 aa, Sorghum bicolor
  Clone ID: 14594149.pep
MPAETAGAVEVLEDDTVKRTPMARPSNGREGKPIRLLSNHFAVKLIGVDAVFYQYSVCIKS

SEQ ID NO: 54848 - protein, 106 aa, Sorghum bicolor
  Clone ID: 14688919.pep
ARGTLLDWWMFGSRVIVPLNFLKFNLFSSGGDYYGTHVFHWYFTQGFPSMIWTFLPFAMHGIVKSREWRLSRLIAWVLGVYSILGHKEFRLLLSCHVTTQGQKSAW

SEQ ID NO: 54849 - protein, 116 aa, Sorghum bicolor
  Clone ID: 14688947.pep
TRDAWPAASHPTLSGEEVELAAAGTGTGMRVGHAAVTRPDAVLRPDGVIHGIERLLVPRSVQEDFNRRRSLAAISAVLPTGAPEVDPRTHRLKKPAPPVLPGAPPVLPIWDAMAPG

SEQ ID NO: 54850 - protein, 165 aa, Sorghum bicolor
  Clone ID: 14688966.pep
MGGCFSLDGDVRGGMEAVGGGVTAASAQQGGLNDAVDYFFQTRGLRGLYTPIELSFSASKLRNLDAFSKSDPMLVVYTNIKGKLEEIGRTEVILNSLEPSWITKVTMSYQFEIVQPFIFRIYDVDTKYHNTPVKMLNLSQQDFLGEACCNLSEIVTKFNHSLTLN

SEQ ID NO: 54851 - protein, 102 aa, Sorghum bicolor
  Clone ID: 14688980.pep
HLSMEVDNSHGTLINKSEENDFEKKGTSDPVVYQLVRVEGDGTLVPATEDDVLQFEHFLHNDEKVDLPSIEDVRHVEEFFNNDCMLLKKPDLEDGSSKLETV

SEQ ID NO: 54852 - protein, 71 aa, Sorghum bicolor
  Clone ID: 14688990.pep
MEEVKADSVLALQVVLVKKIKIKKKRELTRAYENLPNNASNVRAMNSLFRGTVQNWEFWKKKLKSFRLMIS

SEQ ID NO: 54853 - protein, 191 aa, Sorghum bicolor
  Clone ID: 14688991.pep
HEGVLETMSAVGVSPDVESFGCLAFLYAWRGVRSRVDELDTLLDALGFSKKGFFKNLVSGYLKSGDFESVSPIILRAVKERRVGDDNGFDEETYSEVAQCFVDQSRIKELAQLIIQAHEIELTQQSMSVEDSVGFGIVNACVELGLLNKAHSILDEMTAQGASIGLGVYSSILKAYCKEHKTAEAAQLVAE

SEQ ID NO: 54854 - protein, 51 aa, Sorghum bicolor
  Clone ID: 14689015.pep
AAAHAASTNSRFTIFYNPRASPCEFVIPMAKYVKAVDHTRISVGMRFRMLF

SEQ ID NO: 54855 - protein, 37 aa, Sorghum bicolor
  Clone ID: 14689016.pep
HDSLLVDEPHEGPSMPWMRSGRGGMPWMMGGLDMHSP

SEQ ID NO: 54856 - protein, 67 aa, Sorghum bicolor
  Clone ID: 14689026.pep
MVRLPYVTALTTLFSYGLLFAFGQLRDFFRRILDARKPSNLKGYAPICLGLEDFYTRRLYLRIQDCF

SEQ ID NO: 54857 - protein, 182 aa, Sorghum bicolor
  Clone ID: 14689033.pep
TRPRGKAPLSGKAVVALCVTSFVVGLLLSGNVSLMSASASVSSSRDSAENEKSIRVSGCDNKRKLGENHPNDLLNEVSRTHEAIQSLDKAVSTLEMEMAVERARSGGGSGAAVASGGRTPQKAFVVVGINTAFTSKKRRDSLRDTWVPRGDKLRKLEQEKGIVIRFVIGHSGTPGGGALDRA

SEQ ID NO: 54858 - protein, 166 aa, Sorghum bicolor
  Clone ID: 14689035.pep
ARGTEEVCNKLVREIEEHKSEIEALKQDSVKLRGELDEDRKLLQMAEVWREERVQMKLVDAKLTLEAKYEQLSKLQEDVEACISTFSSSKGDSTIVEAAHNIVQAIESARDQEVEFTYEPPRASEDILAIFEELRPSEEMETKETEPCLKQEIQEASPTADIFLED

SEQ ID NO: 54859 - protein, 154 aa, Sorghum bicolor
  unsure (1)..(154): unsure at all Xaa locations
  Clone ID: 14689069.pep
HEDGVQLTANLYLPPGYDPSKDGPLPCLVWSYPGEFKSKDAAGQVRGSPNEFPGIGATSPLLWLARGFAILSGPTIPIIGEGDEEANDRYVEQLVASAEAAVEEVVKRGVAHPDKIAVGGHSYGAFMTANLLAHAPHLFSCGIARSGAXNRTLT

SEQ ID NO: 54860 - protein, 168 aa, Sorghum bicolor
  Clone ID: 14689096.pep
HEDFLTCLLLLLAASAAAAAADVESTSGRCVDSCGGMSIQYPFGIGAGCFRKGFEIICGDGGRPVLAGTTMPIPVNHLSIRTAEARVTLPIGWECFNASDEVHAWSDGDVQFNQEDVYRISNTHNHLVVVGCNTLGYIQGQRTQGSDDYPFAYYTGCMSFCNDSRSAV

SEQ ID NO: 54861 - protein, 152 aa, Sorghum bicolor
  Clone ID: 14689111.pep
TRLIDKIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNQKLLEDKLYLGLRQPRLEGEEYLAVVDEFMEAVHARWPKA

SEQ ID NO: 54862 - protein, 179 aa, Sorghum bicolor
  Clone ID: 14689112.pep
TRQEKSRLNLLKIGDQEAYMKMVEESKNERLKMLLDKTNELLEGIGKAVQRQKDAEHVSQPEGSEVPKGSESEDCSGVKSESPGESPSDDDADFAGPADESKFNAGRRLDFTVHSIEEKVTEQPSALEGGELRPYQLEGLQWMLSLFNNNLNGILADEMGLGKTIQTIALIAYLLEKKE

SEQ ID NO: 54863 - protein, 79 aa, Sorghum bicolor
  Clone ID: 14689125.pep
MDAGTGGGGPTAIRVPYRHLRDAEMELVSLNGADAGPTPHKDADQPRSRGANADRTKLVLACMVAAGVQFGWALQLSLL

SEQ ID NO: 54864 - protein, 170 aa, Sorghum bicolor
  Clone ID: 14689126.pep
MSTMERQHLPPSWQGNGDADAEVEEEEDHLWPTKDGPLPIFLKFENVEYRVKMTMKNPLTAARVAFASQMKVDQGSSCKHILKGIAGSVDPGEILALMGPSGSGKTTLLKILGGRLDGGIKGQITYNDTPYSPCLKRRIGFVTQDDVLFPQLTVEETLVFAAFLRLPACM

SEQ ID NO: 54865 - protein, 114 aa, Sorghum bicolor
  Clone ID: 14689132.pep
MAAGRWGRRRPEPVFRSCSWDLLRRMAHQGVPKFGSWEDEGDHLYTQYFENARKGKSPGRSASQNDHSGDPEALSKDSPSAKASPLRTGSDPVVQKPKDERRANREDDLRRHEG

SEQ ID NO: 54866 - protein, 166 aa, Sorghum bicolor
  unsure (1)..(166): unsure at all Xaa locations
  Clone ID: 14689134.pep
HEGLTNCLDGGPIADGKAQSVHSRGDTKMYGSNTGRVAVRSATTVSQSERCNDALGDDMLNIRMKNTGWDMMPEDQKHSQHDARDVTDSSNRCVLSSDAARDDESLRKRGLSNRDLQRVERQKSFDKPQRNELSRSDDGYGSGSXSERTMDSHRSHGMYGTSRHVQ

SEQ ID NO: 54867 - protein, 127 aa, Sorghum bicolor
  Clone ID: 14689156.pep
TRVGSDLPPCARTRRRPPSSPAERRSPAAGRPSAADLAVPVSAVHKSAGNIPLLQPWTMPGRSICLVLQAHGFAGLEKWGAGRWRRTSLSRTPKQSASLCIEMNPWSLRNGDICCQCFKDKMDASSV

SEQ ID NO: 54868 - protein, 40 aa, Sorghum bicolor
  Clone ID: 14689164.pep
TRAALGTSHEEICEDIKNILYTDSAVAGEAAGIGMGLLMV

SEQ ID NO: 54869 - protein, 99 aa, Sorghum bicolor
  Clone ID: 14689166.pep
ARGVIPQSLTNLSSLREINLGTNHLEGTIPMGFGRIHGLESFIVAGNHISRTIPADLLNVSSLIMLAESDNTMHGTLPSDMGAGLPMLRYLLLSMNHFS

SEQ ID NO: 54870 - protein, 77 aa, Sorghum bicolor
  Clone ID: 14689220.pep
DADNGKRLESSTGRIATRDIVQFVPMREVQGGEISVVQSLLEELPGQFLHYMRTRGIKPQQQQGAGLASAPVYPPQQ

SEQ ID NO: 54871 - protein, 85 aa, Sorghum bicolor
  Clone ID: 14689232.pep
KPFRDEINRELQRVGRGVLYMCNGGPDSNTSQFIISLKRTPWLNRCHTVFGRVVKGLDVLKAIEEVGSRSGTTTAEVKIADCGEL

SEQ ID NO: 54872 - protein, 57 aa, Sorghum bicolor
  Clone ID: 14689244.pep
MQVIEKAQEFKIFIDKWRYKQAFMETPKKLKVAKLRKRNFRKMEALVAFKNWAGINT

SEQ ID NO: 54873 - protein, 75 aa, Sorghum bicolor
  unsure (1)..(75): unsure at all Xaa locations
  Clone ID: 14689284.pep
EVEHVDDRSMCCATPPACGCVSVCAXDCEWKKRAGNVCVASFDWSCSGVCKSVDRMRHIHKACGEGEGAVWNAAT

SEQ ID NO: 54874 - protein, 142 aa, Sorghum bicolor
  Clone ID: 14689285.pep
EVQEAFHANVTGIPYAWIGCSDPVYEYWQDSPRSMLPIYRELISAGLRIWVFSGDTDSVVPLTATRYSIDALSLPTITKWYPWYYDEEVGGWCQVYEGLTLVTVRGAGHEVPLHRPRQGLKLLEHFLQGEPMPKSVESVQSF

SEQ ID NO: 54875 - protein, 92 aa, Sorghum bicolor
  Clone ID: 14689286.pep
TKDVPEMTNARLSSASLPNGVYSTTRGSNLDMGDSTPSTAQWSSPDSMNSQLNRGFRGCMEMVQRQSLKAKLLEARMESQKIQLRHVLNQKT

SEQ ID NO: 54876 - protein, 73 aa, Sorghum bicolor
  Clone ID: 14689295.pep
RLKAKIQEMKEKDTDPLSDKDGNSHVCKVCFESATAAVLLPCRHFCLCKPCSLACSECPLCRTRIADRIITFT

SEQ ID NO: 54877 - protein, 85 aa, Sorghum bicolor
  Clone ID: 14689349.pep
ITRKKASDSNGLLSNFLDCYTKDKKVIELVDSEIAVTGNMELLHSVAGMILKCLDLNVDQRPEMIDVAENLRFLLKRSRREKIEI

SEQ ID NO: 54878 - protein, 70 aa, Sorghum bicolor
  Clone ID: 14689351.pep
LYTVTRVQSASLALIYPLLFSMPPNRLDGWLHGSISLRFRSKGLPCSCSTLLMYTKQLRLLPVMTYFEKG

SEQ ID NO: 54879 - protein, 83 aa, Sorghum bicolor
  Clone ID: 14689364.pep
PILILFGDGKYLQKVALVVLKGTMTTWNVVYRGKKPRVYDSWPLCCDAVAGYSNNCYKGFNAKKLLLHSWSTRGLKISLWRKM

SEQ ID NO: 54880 - protein, 94 aa, Sorghum bicolor
  Clone ID: 14689365.pep
YQTRCSRMNSNARNLGGNCRDNISFSCDVVVMDNRINQSNSMAKRFVTRKGSQIDQTGILCGVLVWRHCIFPSHVRGVLKSLDASYLLIVNLKL

SEQ ID NO: 54881 - protein, 53 aa, Sorghum bicolor
  Clone ID: 14689366.pep
GAAVVRAAVAEDLAEGCCDVGPRELGSMSESESVDYVARKMWYPIYSPLVSDK

SEQ ID NO: 54882 - protein, 69 aa, Sorghum bicolor
  Clone ID: 14689385.pep
LLLKAQYHGHLTYNCGSRGGCQRLQSSPSFGTVDLDGGMREVWILLAMALAYRLLAYFCLLKRISLTPL

SEQ ID NO: 54883 - protein, 58 aa, Sorghum bicolor
  Clone ID: 14689393.pep
EYSDRYANHSVKPYDRSGAVKQFRNNTGDKFRTRISAPRSPELQRRVSPRRFDRSFER

SEQ ID NO: 54884 - protein, 90 aa, Sorghum bicolor
  Clone ID: 14689413.pep
QNLHPLPWVTECPGEGELAIHLPRAGCHLPLGRILEGSFSPESGGMRNATKLMASIVCICNARLDYLQGWLLVLQFVVFLRSLSQDVRFK

SEQ ID NO: 54885 - protein, 99 aa, Sorghum bicolor
  Clone ID: 14689415.pep
WKQQVVLKISMIFCDETAVMAHKLVGQIIESSLHADTKEVDECTRGYLRGGYDSQGPQAPAVEDTQSADIMINAVKTLFPNLSESCFEKVRRILNGGEQ

SEQ ID NO: 54886 - protein, 48 aa, Sorghum bicolor
  Clone ID: 14689425.pep
SSFILPAFRLQSLSLNTLNTKHMQEQLTFLLPRCNTQQYQPSDTSYPI

SEQ ID NO: 54887 - protein, 54 aa, Sorghum bicolor
  Clone ID: 14689465.pep
SKSSSIYINSTFRATKLQPILPSPVWGKLPDITKRVPPTKFPPFLGSTSNQHIY

SEQ ID NO: 54888 - protein, 44 aa, Sorghum bicolor
  Clone ID: 14689491.pep
QHTAQSKNHSLLLHNRLTNSITHYLTRHHIPATVWHGSEPNSNC

SEQ ID NO: 54889 - protein, 159 aa, Sorghum bicolor
  Clone ID: 14689519.pep
HEGGSPANSSGVHGTAAEVGENSVDGSNKQSGSGSGALSDAAAGHGSTVRAEANKVASDVSTNSSAGSGNLGKVDLSTGSSNNPAGSGSGVSGSDSDAGNSSTVKPHAGDAVGAGSRGSSGNGTDTKVNLNKGSDAQTGNSNGDASHKSDVSSSLGKKD

SEQ ID NO: 54890 - protein, 97 aa, Sorghum bicolor
  Clone ID: 14689521.pep
PYRLPLCPEHSRRPPPPSSKAATMAALLLLAASSTAVNRCRLLVSPPSLRMCLASLVHFLLAPNLRVFSTFFFRCQVMLGILRKGFEQLVACVCLMR

SEQ ID NO: 54891 - protein, 66 aa, Sorghum bicolor
  Clone ID: 14689524.pep
HEANPPLLGFFDEFVDFTFFKSVMDLPDRIPPRHFCPPIVDEKGGCDRKHWRNFGCHHGRVLLYNR

SEQ ID NO: 54892 - protein, 188 aa, Sorghum bicolor
  unsure (1)..(188): unsure at all Xaa locations
  Clone ID: 14689529.pep
AYIQNLETSRIRLTQLEQDLHYRSRTQGAVFGGGALSGCSGGLSPEAAWFDMEHARWQEEHGKMMRHLRAALEAEHAASAASTSTAAEAQLLRQLVDAAAAHHGVLAELKAVAARADAFHLGPGAWASAAERCFLWIGGFRPSELIKIAARHAEPLTEQQAMGVCGVQXWARDAEAALDHELQAMHRS

SEQ ID NO: 54893 - protein, 142 aa, Sorghum bicolor
  Clone ID: 14689546.pep
TRVTPTSTTPVSTASAAAPAPGSGRGGVLRLLRYSACSLLPSAAAARSGARLTTALRARTQPAEPELVEQSVNTIRFLAVDAVEKAQSGHPGLPMGCAPLGHVLFDEFLRFNPKNPAWFDRDRFVLSAGHGCMLQYALLHLA

SEQ ID NO: 54894 - protein, 118 aa, Sorghum bicolor
  Clone ID: 14689563.pep
SGHGNDVDDMMEGPSSSKEDNGSVSKGDKQNGENMNPKKNKKTKKGTEKKTTVSTDQKGTSKAEQKSTSKGKKQKEVSKAPSNDCETCGGTFESRNKLFSHLEETGHAMLKTRQKSRR

SEQ ID NO: 54895 - protein, 56 aa, Sorghum bicolor
  Clone ID: 14689573.pep
ESRFIEKLVEDETQMEGLTDNCTRVMVWNFDLEPPQLNYPTGWLLQKNLDIIVPIT

SEQ ID NO: 54896 - protein, 73 aa, Sorghum bicolor
  Clone ID: 14689577.pep
FLTLLGYSSSNCPACSNAVLFEYRRRGMDFVMQVINEPTYLEDLTGLPDLMKSPFYSQVEWVDETDEDEFVEV

SEQ ID NO: 54897 - protein, 86 aa, Sorghum bicolor
  Clone ID: 14689581.pep
REMLSERGWLYMVALEDNDPSDICHLMSEMGYASRVVLKRCTEEESLYVLKFWRDPHAVSSASPKSSGSESWFSQLPFKSLWHKNS

SEQ ID NO: 54898 - protein, 123 aa, Sorghum bicolor
  Clone ID: 14689606.pep
KILKTNHFTNLTANGAGYPMETLLNMSISANINLIPKHTNDTTSLEQFCRDTVTTIWHYHGGCHVGKVVDQHYRVIGISGLRVIDGSTLFSSPGTNPQATVLMMGRYMGVKILRERLGRAAGV

SEQ ID NO: 54899 - protein, 66 aa, Sorghum bicolor
  Clone ID: 14689609.pep
LRTAGMNIFLKDMCCTWYTVVGFYSKIKVETKFNVPEEYSDSQIGLCSSSISYSAPKEVGRTWTNL

SEQ ID NO: 54900 - protein, 151 aa, Sorghum bicolor
  Clone ID: 14689622.pep
SQAVMQGYYRRKEETESTIDAAGWLHTGDVGYIDDDGDVFIVDRIKELIKYKGFQVAPAELEAILLSHPSVEDAAVFGLPDEEAGEVPASCVVRRRGAPESEADMMAYVAERVASYKKLRLLRFVDAIPKSVSGKILRRQLRDDFIKTAAA

SEQ ID NO: 54901 - protein, 124 aa, Sorghum bicolor
  Clone ID: 14689635.pep
HEGTASLLPPLCSSPDLQTPDLCSGPRPPLARDNPAAARGGRGEMLRLRAFRPTSDKVVKIQLHPTHPWLVTADANDRVSVWDWEHRQVIYELKAGGVDERRLVGAKLEKLAEGDDSKGKPTEA

SEQ ID NO: 54902 - protein, 186 aa, Sorghum bicolor
  Clone ID: 14689637.pep
ARGRKKEEEKRKKERAMAYQEPDWARAEEEEEGLYDEDEEEEMRAKKKEELYCVACNKKFKSDKQWKNHEQSKKHRDKIAELRMAFKEEEESLKEAEEGEGDWNEVDVGFDFKPTQESDDESAFSDAAEELAEEFEEGLEVHDKEDGDKDFDSAEQEVGSYDEASVLEAMLSSRKSRKGGYVAPPE

SEQ ID NO: 54903 - protein, 107 aa, Sorghum bicolor
  Clone ID: 14689643.pep
MSLRVLNPNAQVLNKSEALHMTINAAKGLQDVLKTNLGPKGTIKMLVGGAGDLKLTKDGNTLLKEMQIQNPTAIMIARTAVAQDDTSGDGTTSTVLFIGELMKQSER

SEQ ID NO: 54904 - protein, 76 aa, Sorghum bicolor
  Clone ID: 14689645.pep
MGRKRNPIVFLDVSVGDEPDERMIFELFADVAPLTTENFRALCTGELGIGQKTKKPLCYKGSSFHRVIKGFMAQGG

SEQ ID NO: 54905 - protein, 178 aa, Sorghum bicolor
  unsure (1)..(178): unsure at all Xaa locations
  Clone ID: 14689646.pep
ARGFTPLFSLDLSNNIDSENETLPFDGDVVDRQMLELKSTKLEPFVAAAESEATEEQLVDESPPVPAMLDDEADFIEASHVQPSANDSDFVARKQLIIVTTTSVRPHQAYYLNRLAHVLKNVPPPLLWIVAEWPYQSRETAEILRSSGVMYRHLICNRNSTNIRKIIVCQKXNAIFHI

SEQ ID NO: 54906 - protein, 125 aa, Sorghum bicolor
  Clone ID: 14689656.pep
HEAGAPAEDESLKNDVYTAAAYGDLEKLQRLVEGEGRPVTEPDGGGYHALQWAALNNRVAAAQYILEHGADINAVDHTGQTALHWSAVRGHIQVAELLLKEGAKVDAADLYGYQATHVAAQYGQT

SEQ ID NO: 54907 - protein, 129 aa, Sorghum bicolor
  Clone ID: 14689665.pep
HEANMEMRHEWLARDNIERRRGMSVEQFIAEVEEPNRPVLLEGCIDTWPALQKWSRDYLLEISAGKDFAVGPVSMPLDRYFRYADNVQEERPLYLFDAKFAEKVPEMGRDYEVPEYFREDLFSVLGKER

SEQ ID NO: 54908 - protein, 134 aa, Sorghum bicolor
  Clone ID: 14689668.pep
HEGCFATNKADASRAPMDSSSRPPSPSPAPSGSRGASNATQRWSILRRALLARSSSARAQEGISSDHQIKDDTYNISRKASCGFNLIECHSLPISQLAKSLGNSLNGNENDFGQKDVYVCYKLPCRDSSKLDLV

SEQ ID NO: 54909 - protein, 149 aa, Sorghum bicolor
  Clone ID: 14689671.pep
HEGGGEGSDYGSSDAGSYEYDEEGEEDYEEELEHHLRVHHHGHPSGDGEGEGEGEAEGAEGSDYDEEFEEDEEGEPEVDPAEFEDDEAYARALQDAEEREVAARLMALAGLSDWRTVDVEHEEDHVNDPQEAWQEVDPDEYSYEELVAL

SEQ ID NO: 54910 - protein, 186 aa, Sorghum bicolor
  Clone ID: 14689678.pep
HEDLTKLNLPPFLKASRFPTFQHEAYDYIIIGGGTAGCPLAATLSQKYKVLLLERGGSPYGNRNITLLENFHICLADVSPQSPSQGFISTDGVINARAKVLGGGTCINAGFYSRAKPSFVQKAGWDAELVNQSYPWVEERIVHWPKVAPWQAALRDGLLEAGVSPYNGYSYDHLYGTKVGGTIFDE

SEQ ID NO: 54911 - protein, 175 aa, Sorghum bicolor
  Clone ID: 14689692.pep
ARGPFFHIYGITGICCATLRHKGTVVVMDRFDLRGFLGALLTHKVMFAPVVPPIMLAMVKSPVADEFDLSGLALRSVMTAAAPLAPELLAAFERKFPGVQVEEAYGLTEHSCITLTHAGGDDPQQGPVQIAKKKSVGFILPNLEVKFVDPDTGRSLPKNTPGEICVRSQAVMQGY

SEQ ID NO: 54912 - protein, 123 aa, Sorghum bicolor
  Clone ID: 14689693.pep
GKVVGKKAIKSADPQPMFVEFVLSALWKMYELVLEGGGESNAVKKLIENFDLKIPERELKNRDTKAVLQSVMSRWLPLADAVMDMVVECTPDPVAAQGVRVARLMPNREVTPEDAAGCPDVVE

SEQ ID NO: 54913 - protein, 158 aa, Sorghum bicolor
  Clone ID: 14689697.pep
MSGSGDRRGGGPPGSDGGWETMGRKSKKQGQVGGRQWASWNSTNATPNTARPAWGGNGSSHPSGTSWAQASDRGAPNRCNPRPPPQTVRPVVTPPLANGWQWQSRSRTSGSEVEKDDAPPSGSDPEVENVDGNNASDDEDDLSDDISDDYDSDASEKS

SEQ ID NO: 54914 - protein, 71 aa, Sorghum bicolor
  Clone ID: 14689746.pep
LGSFPTPKKKSPLTIIQFLNQNTQKQKHPLLSTIMHVHLSVHHRALQSHALHSGSALANLSESPYAFCATH

SEQ ID NO: 54915 - protein, 74 aa, Sorghum bicolor
  Clone ID: 14689747.pep
SLIRVKNYWHLQIGAPGITHSKQSANKRAQLLLWVLATNLPLRFAFSQGQKGIAFFPPHPEFIGEGTHCPCKKP

SEQ ID NO: 54916 - protein, 58 aa, Sorghum bicolor
  Clone ID: 14689768.pep
AVQNAERNSIPRHRMLPHILQVMAYDLSQMPIISYINNGFSACSIAAHVRKRRGGKSM

SEQ ID NO: 54917 - protein, 150 aa, Sorghum bicolor
  Clone ID: 14689792.pep
SLTRSKIEIYAMHSSVFPFIEIVGLTFLDSTEFIFFEMNLIFLKMMDFISMLTRRFFIQAEEDGVDCMLVSLEQVDASRACEVFCNGGNGAELRFESPGTVGARDVLEVSAMVFDDPLFIGFCLFLATHSLCNRVVLPRASLFGLCLVIF

SEQ ID NO: 54918 - protein, 45 aa, Sorghum bicolor
  Clone ID: 14689811.pep
LTPSSVSDADAKMLVPGEGFPSHPNGMFPSTFALLPGREGCTSFN

SEQ ID NO: 54919 - protein, 141 aa, Sorghum bicolor
  Clone ID: 14822810.pep
SETTNCRIMRYWLEGPRTGEVEVFANLPGFPDNVRSNGKGQFWVAIDCCRTRAQAVFAKRPWLRTLYFKFPLTLKMLTRRAAKRMHTVLALLDRDGRVVEVLEDRGREVMKLVSEVREVDRKLWIGTVAHNHIATIPYPLD

SEQ ID NO: 54920 - protein, 100 aa, Sorghum bicolor
  Clone ID: 14822827.pep
LEILAGSYFCVAGALIGIINPGRMTLFGTLLVIWGLVKDALFGKPVNSDPTQSTYVYPTILIALICAFMSITYNVKKTARSSPPVSIAKPLKSSAKSKLK

SEQ ID NO: 54921 - protein, 93 aa, Sorghum bicolor
  Clone ID: 14822829.pep
GVEVVELKMDSKSALALAKNPVFHEKSKHIRIKYHFLRSCLEDGTIKAEHVSTTDQLADILTKSLGKAKFQEMRGRIGLRQIIPKAHKAKGEN

SEQ ID NO: 54922 - protein, 102 aa, Sorghum bicolor
  Clone ID: 14822832.pep
WSLWNEEKSIELADERMNGSFNSDEVQKCIRVGLLCVQENPDDRPLMSQVLLMLASPDATSLPTPKQPGFAARRVLMETDTSSTKPDCSIFDSATITMLEGR

SEQ ID NO: 54923 - protein, 76 aa, Sorghum bicolor
  Clone ID: 14822891.pep
GHNSRSRTTKGTAPNKPRKRKIAVQLFFPHISRLVPYTEPTTPCHHKFKTQIPHYETRLGLPRAEGNRQTPHLLSG

SEQ ID NO: 54924 - protein, 103 aa, Sorghum bicolor
  Clone ID: 14822914.pep
ATSAAAIAHCVQTFITAMDAVKLNMLANDQVRPLLQDVATSMARLGPLLPPDFEGKVKVNEWLGKLHKMGAADELTEQQARQLNFDLDSAYSAFLAALPAAGL

SEQ ID NO: 54925 - protein, 59 aa, Sorghum bicolor
  Clone ID: 14822918.pep
RVKFQFAPLAVSAFRCCLMSSASIACGEEKKNRTFSRVPNAKSSIIDYTHQSMLKIKKV

SEQ ID NO: 54926 - protein, 75 aa, Sorghum bicolor
  Clone ID: 14822920.pep
DHSTTMLGDATKGKHEIYHDEVHRHGHYERKLRSQSLKGNTDYFCFICQACLLNYVGFSKFLAIVITLLFDMTLQ

SEQ ID NO: 54927 - protein, 63 aa, Sorghum bicolor
  Clone ID: 14822922.pep
TTQKQLYWIKDKSIVILQCRHSAVHTSRSLKQQLISKKNKKGTQQGRVDTEKFQASESNLCDP

SEQ ID NO: 54928 - protein, 49 aa, Sorghum bicolor
  Clone ID: 14822926.pep
FHPTEKANRIIVSQFMDGTQEYMHPLNLSTILAVDARAAAAADAAATCN

SEQ ID NO: 54929 - protein, 72 aa, Sorghum bicolor
  unsure (1)..(72): unsure at all Xaa locations
  Clone ID: 14822953.pep
SMDEDLAEEADDGMHPGNDQWLWPLTGQVFWPGIAXREREEKYIKKLDKKLKNKVKLLERQKSGYKQKPLGQ

SEQ ID NO: 54930 - protein, 128 aa, Sorghum bicolor
  Clone ID: 14822962.pep
QLKLNIREIHSRKSQSARTKVSDEFRKSKGLILVSSDVSARGVDYPDVTLVMQVGLPADREQYIHRLGRTGRKGKEGQGILLLAPWEMHFLSIVNDLSISEAATPSIDSSIQAAVSSIKLVLILYLPI

SEQ ID NO: 54931 - protein, 69 aa, Sorghum bicolor
  Clone ID: 14823033.pep
AAAVYIACNGLVATYKSSSLRRLSLSPCIGTLQGCVHNFIAAYVIYVSVGLLDCNVYTETSLKMARPFA

SEQ ID NO: 54932 - protein, 134 aa, Sorghum bicolor
  Clone ID: 14823043.pep
NIVEHARTVNGDVPGQETTQRGCMVTMGKRKRKGSLSSSPMEVQEDIKRAMDLQTMLQKDREKMSEVQLRLSKEKLELARLKQLEAKDKKETTLYEKYTELLTADTQGFNEFQKKEYEKAVKRMGEMLFGKDAK

SEQ ID NO: 54933 - protein, 51 aa, Sorghum bicolor
  Clone ID: 14823073.pep
DVEDQTMWKRERSKARQKTKIGFTARVDAKIKQIKGKLHKKGPSLTIHTVS

SEQ ID NO: 54934 - protein, 39 aa, Sorghum bicolor
  unsure (1)..(39): unsure at all Xaa locations
  Clone ID: 14823099.pep
LFFLVXILTFNSNLRTCNCKTSRTLSVILQPHSHMITVC

SEQ ID NO: 54935 - protein, 85 aa, Sorghum bicolor
  Clone ID: 14823117.pep
QQYVLHAPSNISALNKGKDKHQYHIQPTFMFVKKSFNMSWSMYYSLSSSTASAILVSQAIVAMKAIEITTSLRGSKVSVFYQFMF

SEQ ID NO: 54936 - protein, 83 aa, Sorghum bicolor
  Clone ID: 14823154.pep
RSVSDENSTPSYFICPISQDVMDDPHIAADGFTYEAEAIRSWLDSGHDTSPMTNMRLEHDELIPNRALRSAILEWLQQQNTAL

SEQ ID NO: 54937 - protein, 90 aa, Sorghum bicolor
  Clone ID: 14823166.pep
LIIAGINCSLLINSPLPHLDALGADSLHCIQVVVARRLPFTFYITSTSLAQVIRYCHWLVLKLLFPPASFGHTRCLVATRVPCTYNATVT

SEQ ID NO: 54938 - protein, 77 aa, Sorghum bicolor
  Clone ID: 14823203.pep
VHRQPCIFFSFSILVVQYKTCCTCLASISRAYKYISKSTQRMHMHQSICIDLERFGTKSEKVYIVVHHCHINCCCNV

SEQ ID NO: 54939 - protein, 62 aa, Sorghum bicolor
  Clone ID: 14823221.pep
ANPNLSDRTFPLSSTCIDPKKRMKKERENRIKKSSKWSSNQIILWGTLRTPHHLKHTDHLSH

SEQ ID NO: 54940 - protein, 65 aa, Sorghum bicolor
  Clone ID: 14823248.pep
HSCMPNCYARIMTVSGDRNQIILIAKRDVSAGEELTYDYLFDPDESEDCKVPCLCKAPNCRGYMN

SEQ ID NO: 54941 - protein, 87 aa, Sorghum bicolor
  Clone ID: 14823255.pep
GFFTRNPPKGGSFVCLHPHSHCIDHSQLILRAEHIQLTIAVKSMKKARRLRVPDISTPRRTNNIFHQGRFRGRKFSRTYTASRKQLK

SEQ ID NO: 54942 - protein, 150 aa, Sorghum bicolor
  Clone ID: 14823274.pep
MDRSEIGWDVRIALSAYGSFSSRDYLNSQRLRCRQMYFHEKIFETADAIVTPMTGVTAYALQDDALSTGELDYINGAALVRYSIAGNFLGLPAITVPVGYDREGLPVGLQFIGRPWSEATLLHLAYAMQESCGKEHCKKPKVHYDLLKKQ

SEQ ID NO: 54943 - protein, 80 aa, Sorghum bicolor
  Clone ID: 14823343.pep
MGVVLAASSLVLVLLLLFCSCGPASGLLSPKGVNYEVQALMMIKNYLKDPHGVLKNWDQDSVDPCSWTMVTCSPENLVTG

SEQ ID NO: 54944 - protein, 112 aa, Sorghum bicolor
  Clone ID: 14823347.pep
MASGSDPPKQYGITKPLSLLGPVEADLQRTAELEKFLVEAGLYESPDESARREEVLGKLDQIVKDWVKQLTSQRGYTDQMVEEANAVLFTFGSYRLGVHGPGADIDTLCVGP

SEQ ID NO: 54945 - protein, 46 aa, Sorghum bicolor
  Clone ID: 14823380.pep
GEQPSRMEPLPDGSMNPRRSAIKQVASGRFGVSSYYLTNADELQIK

SEQ ID NO: 54946 - protein, 87 aa, Sorghum bicolor
  Clone ID: 14823384.pep
MTPARRMPAMIGRNGMAFGSSSALSLSQADLLDSHHLQQAFQQQLFDQIPATAVDSSDNIIHGRSDTLVDEFESKSCSENPDGTSGD

SEQ ID NO: 54947 - protein, 161 aa, Sorghum bicolor
  Clone ID: 14823400.pep
ARGTVRMWHSTTYRLENTLNYGLERVWALGYMKGSRRVVIGYDEGTIMIKIGREVPVASMDSSGKIIWAKHNEIQTVNIKSVGADNEIADGDRLPLAVKELGSCDLYPQSLRHNPNGRFVVVCGDGDYIIYTALAWRNKSFGTALEVVWSTDGEYAIREST

SEQ ID NO: 54948 - protein, 79 aa, Sorghum bicolor
  Clone ID: 14823403.pep
MSFNKSSRGGGGLGGAAGGGDELVLRGSISKKWTLLLCLGSFCIGLLFTNRMWTMPEPKEIIRRSTLEVEKMSLVEGDC

SEQ ID NO: 54949 - protein, 148 aa, Sorghum bicolor
  Clone ID: 14823434.pep
HEEAVVAADDADVLEVKATDGVKLLPPDSVLGSASGGGKEGTGTVAAIRMPMLKVADFKGGTPEVIKTSYAVLVLVPPSDRNWAPHELEIVEVVADQVAVALSHASLLEESQAMRDRLAEQNRELLQARRDALMANEARDAFQRVMSQ

SEQ ID NO: 54950 - protein, 151 aa, Sorghum bicolor
  Clone ID: 14823436.pep
ARGEGEPSQLAAVDIFVSTVDPMKEPPLVTANTVLSILAVDYPVDKVSCYVSDDGAAMLTFDALAETSEFARKWVPFVKKYNIEPRAPEWYFCQKIDYLKDKVHPSFVKDRRAMKREYEEFKVRINGLVAKAQKVPEEGWIMQDGTPWPGN

SEQ ID NO: 54951 - protein, 60 aa, Sorghum bicolor
  Clone ID: 14823443.pep
RRQKAPVVRSPDQVSTRPTLIGAIGNLAATGRKGMVPPPWRGGVEGFGHRQRRLGMAPRA

SEQ ID NO: 54952 - protein, 166 aa, Sorghum bicolor
  Clone ID: 14823463.pep
MGKGKKSKEKEMEKKPVDILAGSDEDSDGGEDLSKVQINEEYARRFEHNKRREALQRLEERRKQGLVPASDDGESDSESESTEEEDEEAAIASRLVDRRVFEVIRRIRSGDPRILDKDAKVYSESEEEEGGEEGEDAEKEEESKQGKKKTKKEKPLYLKDVNARHL

SEQ ID NO: 54953 - protein, 123 aa, Sorghum bicolor
  Clone ID: 14823467.pep
SYGGSSRSATTTATEDEQWGGGAAVGGAPTTSASGGDASSLRSVSQLSANKSGGRSGSGDRKKAKGGAVAPAPARRVLGKLWSGKASSVENSGSDDTSESPAGSLNLEETKSTPSRITRHSVS

SEQ ID NO: 54954 - protein, 52 aa, Sorghum bicolor
  Clone ID: 14823492.pep
AVLGGSIFTFGGVKGEADTILDVVERYKEGCGWVTTGLKSFGKRCYCSAIVL

SEQ ID NO: 54955 - protein, 122 aa, Sorghum bicolor
  Clone ID: 14823507.pep
TTISSFMEDYRPVDGIMIAHSGRSAVTLFRFGEVAMSHTKTRMEEVWSIEEVAFNVPGLSMHCFIPPTDIKSGSVGEAMELTHGERSRAGPPQGYCAKVAALEKAEEDKVAWGGGTVLESHN

SEQ ID NO: 54956 - protein, 150 aa, Sorghum bicolor
  Clone ID: 14823542.pep
VEWEDERSLYSECIIGLLNNDEMKDELGSLLKMLDAAGFFSVNDDMVDWNNRLFSDSIDKFNEMVFPGRCVGRCLVIQGIMDYQKIMQMKDVAWQDAFKMVVSNTIDLWKENLRQFWLTTRHYKHDYYDVLAHPLQKVFLMGGAPKPRYG

SEQ ID NO: 54957 - protein, 66 aa, Sorghum bicolor
  Clone ID: 14823560.pep
TSGDLMVSNCVVHAGLAPHISSLMFTETLDAFESIEKKQCLHIPSNVLLVQIVICIIFHGRVKTAR

SEQ ID NO: 54958 - protein, 67 aa, Sorghum bicolor
  Clone ID: 14823566.pep
VRRSCCRWLFPYPVSSTACRSASYVLSIRFPLVSLLYFCVVCVYPCPFSFSAVVYIVAARTPGKCKF

SEQ ID NO: 54959 - protein, 73 aa, Sorghum bicolor
  unsure (1)..(73): unsure at all Xaa locations
  Clone ID: 14823584.pep
NEERKTKLSXTEASTFVEYRLPVLAMTADVXIQATYEECIKSGMDGYVSKPFDEEQLCQVVSRLVVETTDSAV

SEQ ID NO: 54960 - protein, 62 aa, Sorghum bicolor
  Clone ID: 14823592.pep
IMVQGKIVFPMMELRLMQEVLLYVSFYIHRSSMYLVAPENVHHPNNPLRVLFKLLWRFGAEN

SEQ ID NO: 54961 - protein, 120 aa, Sorghum bicolor
  Clone ID: 14823601.pep
HEAAKQLSQSVSLFRRQNHAQVLKHTAAVCSIASSLLTRAGRCCLLCLRLRSNPNCRSPRRLFPPGIAAWLLGPGGAWIDLLSTSPIRSARFLATSAQISASGGHWWFLALNWCCCLVRA

SEQ ID NO: 54962 - protein, 108 aa, Sorghum bicolor
  Clone ID: 14823632.pep
KENPPSPQISVLLSKNKTVACSRNFQNQCPCPWNRFALLGVEPWRSANCQAPLPHCSKKEEDGRRRSLSTLAAAKPSPTPHRSKWFLLALTLRRRSVDGVNCSASPSC

SEQ ID NO: 54963 - protein, 144 aa, Sorghum bicolor
  Clone ID: 14823638.pep
TRALSYLSSSAGRIRFLLGTPGMVALDLDATLKGLFQQVLHCLENIPKPQGESVPAITADLTDLRKHWLSILMIVTSSRSSINIKHLEKATVSTGKEGLVSEGNAAYNWSRCVDELELQLSKHGSLKKLYFYHQHLTTVFRNTM

SEQ ID NO: 54964 - protein, 153 aa, Sorghum bicolor
  Clone ID: 14823642.pep
TRKINKDELREIWQQITDNSFDSRLQIFFDMVDKNADGHITEAEVKEIIMLSASANKLSRLKEQAEEYAALIMEELDPEGLGYIELWQLETLLLQKDTYVNYSQALSYTSQALSQNLAGLRKRSPIRKISSTVNYYLEDNWKRLWVLAVWIGI

SEQ ID NO: 54965 - protein, 169 aa, Sorghum bicolor
  Clone ID: 14823648.pep
ARGFARAPSSAVAAAGAGALRNDLRMLLGVLGAPLAPVHVCATEPLPHLSVKDTPIETSSAQYILQQYLAASGGHKLLASLRNSYAMGKVRMVATEFETGGRLTKNRNAGRGGEPGRFVLWQMAPEMWYIELVVGGSKVHAGCNGKLVWRHTPWLGAHSATGPVRPLRR

SEQ ID NO: 54966 - protein, 67 aa, Sorghum bicolor
  Clone ID: 14823681.pep
HEALSGLRVLDASTNNFSGPLPAAVSKLGALTDIDISTNQITGPLPEDLPDNLLSFNASYNDLSGVA

SEQ ID NO: 54967 - protein, 200 aa, Sorghum bicolor
  Clone ID: 14823685.pep
MSMLEEVDAMDGCLKDNYLDDEILFEKLRPEFKSMYGIDSYLHPYLNTMTCMLQRTDSWGSILKRLLENYEPQSDLVQCNPASVVDIFRRSLLFYWEPQFHPLIREAHQELLKTIACQLALADKSVMFEPLEPHPHDFLEHLQPYACMYIKRKKQEFGYFRIEEQVRMHEEFDHHLASGILDHRLNEFNCSKDDFVHNFA

SEQ ID NO: 54968 - protein, 201 aa, Sorghum bicolor
  Clone ID: 14823703.pep
ARGLLLLEPVYEARFSPKSFAFRPGRSPHAAIRTIRRSFAPYLWYIKGDLSPLLHSPDPALVVGALIRDVRDKKVVDLIRSALLTPVVTASDDAAAKKKKTKRKYQKKKVLPEGEPKPDPYWLQTFFGFAPEEAQTQPDWGHCGVLSPLLANVCLDELDKWIEEKIKELYKPSKLDVVGGDDGIEQGNTSWPEFVPTSGPD

SEQ ID NO: 54969 - protein, 86 aa, Sorghum bicolor
  Clone ID: 14823709.pep
HEACSSRFKSASNFITKIPDIEPSNPAAFGFIHSSLPFRLALRHFGIGGQRAPARVCRGFRWAYSPPVDLESCLLGTHKWHASIMQ

SEQ ID NO: 54970 - protein, 149 aa, Sorghum bicolor
  Clone ID: 14823726.pep
ARGPVIFSQDTVSYLARIDMMSGEEDQENILRARTTGKAVLTNPFRLLGSNHLGVVLTFAVYRPDLPADASVEQRVEATIGYLGGGFDVESLVENLLSKLAGNQDIVVNVYDVTNASEPMALYGPSILDEQVPLHVSMLDFGDPFRRHE

SEQ ID NO: 54971 - protein, 105 aa, Sorghum bicolor
  Clone ID: 14823735.pep
MVCAAGDPRDPPEMPLNQPALFVDDLAAFRAVLGADLPVAAAVDALTRCSGDTERAIKWLLDDATAAGGDGGRNGIRESGVEAEPGIGGASCPSPPPPLLPVKVE

SEQ ID NO: 54972 - protein, 188 aa, Sorghum bicolor
  Clone ID: 14823755.pep
TRLADGRVVRWMGEEAGWETFAVMNPEWSEEVCANGVNSTTRKQHEKEEFCGRPLGLRFHRETGELYVADAYYGLMVIGQSGGVASSVAREADGDLIRFANDLDIHRNGSVFFTDTSMRYSRKDHLNILLEGEGTGRLLRYDPETNAVHVVLKGLVFPNGVQISEDQQFLLFSETTNCRIMRYWLEGP

SEQ ID NO: 54973 - protein, 70 aa, Sorghum bicolor
  Clone ID: 14823763.pep
HKKKRYAGECSSSLQLVFFCLCFLPLKLQPPISDICVIKTNRVNSYFPILAQRLLLTRLDLPFIFTLNIL

SEQ ID NO: 54974 - protein, 127 aa, Sorghum bicolor
  Clone ID: 14823777.pep
ARGGVGGAVAWEGFDYPTDTMLPEMKVGIDYVKKKNRTLTSWKSASDPSPGPVAMVMDTNGDPQVFIWNGGEKVWRSGPWDGVQFTGVPDTATYSGFTFSFINSAQEVTYSFQVHNASIISHLGVVS

SEQ ID NO: 54975 - protein, 177 aa, Sorghum bicolor
  Clone ID: 14823787.pep
ARGDSAFANLYDLMMELVEVYKIRVPKFTVKMAVQYMRRVIQKRAKFDIMDLNVVQFAPKTFIPALFGHASNDMFIQPHHTERIHQAYAGDKNLIKFEGDHNSPRPQFYYDSVSIFFYNVLHPPQFPSTCTNKFDKYYNLGAFKGGAGTNESLLYEIINGLRAAGTDAGSSSAATAN

SEQ ID NO: 54976 - protein, 126 aa, Sorghum bicolor
  Clone ID: 14823800.pep
ARGIEGLAVSEGKCVDTVSASLENEERAKISYCSNTETKTSKSAIDNQVEIHHLGTGPVKLNSSFNEMSVPTDLMSDEPQVGSHSAVKAIEHQSNNSANLKHESPHIGFHMLEDTQVASMAAVPST

SEQ ID NO: 54977 - protein, 91 aa, Sorghum bicolor
  Clone ID: 14823802.pep
LRSTVGLSAAEMEALPLIDISAEDDLLYDLASLAPPRPDPPHAGSQVGAVATSSVGSPLAAVRSMDPEGVMVDQAPLSGRSLRSSGKPKRG

SEQ ID NO: 54978 - protein, 206 aa, Sorghum bicolor
  Clone ID: 14823822.pep
HEGFLVNWLERFPEYRDREFYIAGESYAGHYVPQLAELVYDRNKDKEGKTYINLKGFIVGNPITNYYYDSKGLAEYAWSHSVVSDEIYDRIKKYCDFKNFNWSDDCNAVMDIVYSQYDEIDIYNIYVPKCLLNQSSASSENHAPFKNDQEKFRRRVRMFSGYDPCYSSYAEDYFNKKEVQKAFHANVISESLPVKWHVCSDPILNS

SEQ ID NO: 54979 - protein, 103 aa, Sorghum bicolor
  Clone ID: 14823824.pep
MLAGSCVFVALALLLPSVPPAAATQEFYCDDSTYADNSTFQANLNLLGAALPANASASPAGYATGAVGAAPDQVNGMVLCRGDTNASSCSSCVAAAFRDAQQR

SEQ ID NO: 54980 - protein, 177 aa, Sorghum bicolor
  Clone ID: 14823828.pep
ARGLRASEVVRREMGLEWMLKPASSSRAEGSTVGKADNIEKDETANEEIMRPNPKELNPYLKDNGTGYPEESTPSNAGSQLLASSVVGDGGASWRLKALKRAKEQAAREGRKLEEVVEERWGSLGDLAVSVSASRAAHSHAHLHAIRGRKSGNADNSEERVKGNPEGQLDGSSGRRE

SEQ ID NO: 54981 - protein, 63 aa, Sorghum bicolor
  Clone ID: 14823833.pep
MEGRGNPLLNTTHAVINKPRSVASSKPRSTEQLTSEYNGICPPSRSAPHDDDTGIEAGGHLRK

SEQ ID NO: 54982 - protein, 169 aa, Sorghum bicolor
  Clone ID: 14823848.pep
GRSRRWWRREDGGSPAAGTSLRTRVPLPPPTKGIEQSINQSGVGGGKPPESGKPAPLATDGGEKEEQWRILGWVGGGGFLLTFSRGGARSRPPNAFSPPPTSSLPSNKLTIEIQPKPKGERNQAPKWQGEARRGAARRWTSEGERDLRCCLPSPVRHKDSKRRRRRSLV

SEQ ID NO: 54983 - protein, 96 aa, Sorghum bicolor
  Clone ID: 14823856.pep
DGLDAVLLYPYSIHVQKEQTGFAVPRFGNLDSKKKNEKTPLSHSVVVSQSKVYRCIGWLSTINQSQLELKLTGVTCYRSIYLPNQAYMSIYCRSIG

SEQ ID NO: 54984 - protein, 157 aa, Sorghum bicolor
  unsure (1)..(157): unsure at all Xaa locations
  Clone ID: 14823858.pep
TRPPPIPHPPPPAPXSRPPSPTFAPSSPPHPLPSPLYPPLSNLTQPLLSPVSPHLSLPPQXPPLPPPVTAINLPLPAAPAPYSDCPAVVRXAPSQPPRPPPFPPSSLACAQISPLPLPTGAPPIRPASCRRSSASCTGSWTPGLRGATTSRDHTPML

SEQ ID NO: 54985 - protein, 75 aa, Sorghum bicolor
  Clone ID: 14823864.pep
MHSIAATACFLLALLQVRPATVTATATPPRAFFVFGDSLVDSGNNNYLGTTARADSPPYGLDYPTHRATGRFSNG

SEQ ID NO: 54986 - protein, 133 aa, Sorghum bicolor
  Clone ID: 14823870.pep
TRAEPPVKRRVQDFDLNDACIEEAESRTDKIVFKLFGKEPKDFPVDLREQIQNWLSHYPTDMESYIRPGCVILTIYLRLPNWMWDELDDDPASWIEKLISLSNDGFWRKGWLYARVQDCLTLSCNGSLMFASP

SEQ ID NO: 54987 - protein, 74 aa, Sorghum bicolor
  Clone ID: 14823901.pep
TRLKSKVGRRPRSDDVDAVTRLSVLDNPYYRDLLCEFGAMFAIANRVDNVHKLPWIGFQSWRAAGRKVPVFPFS

SEQ ID NO: 54988 - protein, 145 aa, Sorghum bicolor
  Clone ID: 14823913.pep
ILVATPGRLKDHLENTPGFSTRIKGVKVLVLDEADRLLDMGFRRDIEKIISFIPKERQTLLFSATVSEEVRQISHLAMKRDYNFINTVQEGDEETHAQVNQTYMIAPLDLHFPILYDVLKKHVAEDAEYKVIVFCTTAMVTKLVA

SEQ ID NO: 54989 - protein, 120 aa, Sorghum bicolor
  Clone ID: 14823925.pep
YNDTQLSCVFEREKNKLFNGENENTNVQLDNSFDDTNRSFVQRIQESEVREALKRMKGCKAMGPDAIPIKVWRCLGDIAIVWLTKMFNSIFQSNEMPEEWRLEKHIGTNLQEQGRHPKLY

SEQ ID NO: 54990 - protein, 191 aa, Sorghum bicolor
  Clone ID: 14823930.pep
ARGLFPAIITQVAFPNSDFTPDPKYTLKGVTCSVHEMSMYQRLTKHSIVIDDSRMSPLGWSGLSWAIGILIVAPLLTQTAHHLDRGQYQSLILIAATSFGSFFCLLTGFFKTVWVFLFYILFIAGSIIIAEAVHTRNLGLMIRGLAAHDSSKHLVLRRRAAASQLSLYCTAIGGIGAALMAAFMYHMLRRT

SEQ ID NO: 54991 - protein, 201 aa, Sorghum bicolor
  Clone ID: 14823932.pep
ARGYGANCPQWIVAMEACNANSLICVPLYDTLGAGAVDYIINHAEIDVVFIQDKKIKEILSPNCKSAKRLKALVAFTSATSEQIKEADNFGMKMYAWNDFLKVGKDNPHQPCPPQASDICTIMYTSGTSGQPKGVMLTHESHAMYVKGVDLFMDQFDDKMTTDDVFLSFLPLAHILDRMIEEYFFHKGALIGYYHGDLNAL

SEQ ID NO: 54992 - protein, 164 aa, Sorghum bicolor
  unsure (1)..(164): unsure at all Xaa locations
  Clone ID: 14823941.pep
ARGPVEVSGYVVVVDELLAVQNKSYDKPTILVAKSVKGEEEIPDGVVGVITPDMPDVLSHVSVRARNSKVLFATCFDHTTLSELEGYDQKLLSFKPTSADITYREITESELQQSSSPNAEVGHAVPSISLAKKKFLGKYAISAEEFTEEMVGAKSRXIAYLXGK

SEQ ID NO: 54993 - protein, 107 aa, Sorghum bicolor
  Clone ID: 14823948.pep
TRIVNHLVRAKHKEVCLHKDSPLGETILECYNCGCRNVFLLGFISAKSENVVVLLCREPCLSVNALKDMNWDLSQWCPLIDDRCFLSWLVKVPSEQEQLRARQISAP

SEQ ID NO: 54994 - protein, 135 aa, Sorghum bicolor
  unsure (1)..(135): unsure at all Xaa locations
  Clone ID: 14823966.pep
MAPDPCADLAVTPKTAAKDEASCSMATPPKVTPDEVRAVAQKFANQPIQETEPGVWAVLTAISKKARLRPQGMNILLSADEHCLGRTVEERFQIFAQQISGKHCKIYKDTVLXELNRHEPVPVYLKDTSSGTFIN

SEQ ID NO: 54995 - protein, 179 aa, Sorghum bicolor
  unsure (1)..(179): unsure at all Xaa locations
  Clone ID: 14823970.pep
ARGVDEETNVENLDEDESDSGNEEAEESEDDAFDVNDEEDMNWRIGDGQGDEGMSHSLQRCNTFGGMQFENLNKGEAEMRDELRFDDFPARSSLERMTSSNLLQAMSSIPSSYNVAENVHDLPSGDFLAMGADAHKSGVDLXPGSSYLFGNNGKRNIDDIDGYNGNTQVQEEFPQSNQQ

SEQ ID NO: 54996 - protein, 143 aa, Sorghum bicolor
  Clone ID: 14823976.pep
MSSFKQSSGTSRGVYVFSENNPYVGHPNPMQEGQELFRKGLLSEAVLALEAEVLKNPDNAEGWRLLGVTHAENDDDQQAIAAMMRALEANPTNLEILLALGVSHTNELEQGEALRYLSRWLQNHPKYGGLVPPQSTDSPYGPD

SEQ ID NO: 54997 - protein, 173 aa, Sorghum bicolor
  Clone ID: 14823990.pep
MRSMESTDSSSGELPPPQKQPSSAPDLPPGFRFHPTDEELVVHYLKKKAASVPLPVAIIAEVDLYKFDPWELPDKATFGEQEWYFFSPRDRKYPNGARPNRAATSGYWKATGTDKPIMASGGNREKVGVKKALVFYRGKPPKGLKTNWIMHEYRLADAASSTTSRPPPPCNVG

SEQ ID NO: 54998 - protein, 147 aa, Sorghum bicolor
  Clone ID: 14823998.pep
YKLLFSFTMDPRPPSHFSHWKSYPNEPPGMLNPMNFHHQQFPQHLSFSHPSYAMNFPHQQFPQPHLYPQNVHYVVVQPQYAPFSLPQLPHPPVGVMPTPPPPPAGVMPSPAVALPRPPGGVMPFMTVPDSGTPHSVTGPDDKTLLVG

SEQ ID NO: 54999 - protein, 78 aa, Sorghum bicolor
  Clone ID: 14824016.pep
TRVDPFTDEMLARFVVDSHARSQPKGANLEDRVSTDVDDDPLAAARQADPDVLSQDMLKKYITYAKLNVFPKIHDADL

SEQ ID NO: 55000 - protein, 103 aa, Sorghum bicolor
  Clone ID: 14824022.pep
TRPPRHRLLCTLSLLDLSHRGVSQPHSGGVLAAFTFFFLGSRRFRTSTTGSKASMSGSVRSSTGSGLEASTRYVRRRGMRHGWERPVDVYLLRGVHTLQLRKL

SEQ ID NO: 55001 - protein, 144 aa, Sorghum bicolor
  Clone ID: 14824030.pep
HEAHIQWDDNGYKLFAVEESLSERVLAFSFAKCCLNRGLSGTTYSHQVLYGEDRILLVQPDDADELKILHLHVPVSYISQNWPVLHVVASNDGMYLAVAGSHGLVLYDLRNKRWRFFGDVTQEQKIQCKGLLWLGKIVIVCNYV

SEQ ID NO: 55002 - protein, 147 aa, Sorghum bicolor
  Clone ID: 14824078.pep
TRLYSGPLSKLRMLMICRMAKPEEVLIVEDENGNIVRETMKDNDVLVQYKIMRETLIYLSHLDHEDTEQQMLKKLSKQLNGEDWSWNNLNTLCWAIGSISGSMVEEQENRFLVMVIRDLLNLCEITKGKDNKAVIASNIMYVVGQYP

SEQ ID NO: 55003 - protein, 141 aa, Sorghum bicolor
  Clone ID: 14824080.pep
ARGEDFYWPEDFVLGDVVWARSGKKSPTWPALVIDPMQHAPEVVLNSCVPGALCVMFFGYSANGHGRDYGWVKQGMIFPFVDYLDRFQGQPLYKLRPSKFRAAIEEAFLAERGFFDLEMDGVCSPRKSVNKQSDPNGFQEE

SEQ ID NO: 55004 - protein, 163 aa, Sorghum bicolor
  Clone ID: 14824085.pep
TRLPSPSRVSYLLQSMQVSKVKLYDADPYVLSAFLDTDVEFVVGIGNENVSAMAADPSAARAWVQRHVQPYLLATGDGGTRRRRITCITVGNEVLKGNDTSLKAALLPAMESVYAALSALGLQGRVNVTTAHSLDIMGTTYPPSAGAFAPDVVPYVQPLLSFL

SEQ ID NO: 55005 - protein, 193 aa, Sorghum bicolor
  Clone ID: 14824093.pep
HEAALMLSAGISPGTEPHLKAMLLAIRSSQLLGLLEKTRIFVPKGRWLMGCLDELGILEQGQCFIRASSPSLNNCLVKHGPRFSSANKNAETIVGTIVMAKNPCLHPGDVRILEAVDVPELHHLVDCLVFPKKGERPHANEASGSDLDGDLYFVTWDENLIPPGKKSWNPMDYSPTEAKQLPRAVSPHDIVDF

SEQ ID NO: 55006 - protein, 83 aa, Sorghum bicolor
  Clone ID: 14824095.pep
VSRFESGCSLCCLFRGFGLSCVSLEFWRQLLNYLFLHASRFEPCHSETWEDITLKNACKLYARYHYFTVPRIVPTQCIGLVLI

SEQ ID NO: 55007 - protein, 126 aa, Sorghum bicolor
  Clone ID: 14824105.pep
MGLFSSPAKVYKPAAEVDLGPHSVAGEHYISPNVKAPRVAGLLVKMLAWVLETPVLGWIVLSVLKRDNLVYKLVSDAEIPEPPLFTATHTWQAAMPEKNVSVTEAGVSPAERVQVAVAGIPADMEP

SEQ ID NO: 55008 - protein, 71 aa, Sorghum bicolor
  Clone ID: 14824170.pep
YPKWVFCMDTLLEAIGIVLETYFGFGFPNACPIGDSLRTEIKVFGPGIWCVFMVKVFAVLCPLSLCFQQRS

SEQ ID NO: 55009 - protein, 92 aa, Sorghum bicolor
  Clone ID: 14824190.pep
MATRRRMLLKVIILGDSGVGKTSLMNQYVNNRFSNQYKATIGADFLTKEVQIDDRLFTLQIWDTAGQERFQSLGVAFYRGADCCVLVYDVNV

SEQ ID NO: 55010 - protein, 69 aa, Sorghum bicolor
  Clone ID: 14824195.pep
ARGLHQLHIFIFILAIAHVIFCVLTMLLGSARIRQWKHWEDEIHKGTTENGPRKVTYVHQSEFITEHFK

SEQ ID NO: 55011 - protein, 36 aa, Sorghum bicolor
  Clone ID: 14824212.pep
EPFRSCFERRRLTSISRSSRSPHEESKAMPWLGASC

SEQ ID NO: 55012 - protein, 109 aa, Sorghum bicolor
  Clone ID: 14824214.pep
YCSSACSASLPPPQQSAGDESNGSGRGRHWNSSDVTARSLPSPSPPQRLRPSVPSLVSERKKEKRKARPKSRDTYGSRAAQSGGPFLSFFLSRRAPPTTAATTAPHPRA

SEQ ID NO: 55013 - protein, 69 aa, Sorghum bicolor
  Clone ID: 14824219.pep
TRLILSAPLHTTAPSLFFSSTTVHHCTTVAPGSFLPPTWQARQITPLEQWLFLIIQLISVHHTVELQMM

SEQ ID NO: 55014 - protein, 161 aa, Sorghum bicolor
  Clone ID: 14824238.pep
TRQNSSGQIVLDYTKAIQESVFEQLRVVREGHLRIVFNQDLKIASWEFCARRHEELIPRRSIIPQVSQLGSVVQKYQSSVQSSASLSSQDLQNNCNSFVACARQLAKALEVPLVNDLGYTKRYVRCLQIAEVVNCMKDLIDHSRQTGSGPIESLHKFPRRG

SEQ ID NO: 55015 - protein, 149 aa, Sorghum bicolor
  Clone ID: 14824246.pep
TRRAEEARRAKEAGNDAYRKSFLETAVEHYTRGGLLDPRDISFLTNRAAAYFRLGKYKECVRDCDEAVKRGRDLSADNKLVAKALLRKASALLELAACSGDYAPAIRALEQSLTEHYSEETHEMLNRAVVVQKELEEQERLDQEMADQH

SEQ ID NO: 55016 - protein, 200 aa, Sorghum bicolor
  Clone ID: 14824248.pep
ARGRSTSWICQLCYGRSPTHGDLVELGEAVGIIAGQSIGEPGTQLTLRTFHTGGVFTGGTADLIRSPSNGKIQFNEDLVHPTRTRHGQPAFLCYIDLHVTIQSQDILHSVNIPLKSLILVQNDQYVESEQVIAEIRAGTSTLHFKEKVQKHIYSESDGEMHWSTDVYHAPEYQYGNLRRLPKTSHLWILSVSMCRSSIAS

SEQ ID NO: 55017 - protein, 200 aa, Sorghum bicolor
  Clone ID: 14824250.pep
TRIIQSNTEANGNLEGAQEVQVNSTSMSHYKEIQRKIVEFLRKRYHLLERALNLEYAVIKNKIPVPDDITEQGVPAGHVPLLPDISELLRELPNLEPISTNEVAPEGTAGQSEVPHLYNKMCGVLEESGGSAISSFFGDKSASSSLANSLHQFEIVCENVIEALRPQQNGTASAIKEEVVDPATKAAAAPQQDSNGQSST

SEQ ID NO: 55018 - protein, 129 aa, Sorghum bicolor
  Clone ID: 15045481.pep
MIHYNNRHLYMIRGPKISKEESKNPGRKKGHIAENACFKQCKPKLICQSSSRIPAALSLLRAFRAFVTVIARDGVVDHDAGSGRQPFLDLDELLLLPERVRSRGRRCDRGVSEPLAPVPRGHFVAVLPG

SEQ ID NO: 55019 - protein, 87 aa, Sorghum bicolor
  Clone ID: 15045485.pep
DYKTTLPLSIPSALENLPLLGQLFAQFSLLIKQTANKPWDRCLTFLCEHIHVHGRSRCLLYPLFTGSEVASGHQASANPIEMTTAAV

SEQ ID NO: 55020 - protein, 70 aa, Sorghum bicolor
  Clone ID: 15045523.pep
YIEMIQRFRGSLSYSTSRQTLSINQSILCFSTPHRLGIMTITVTQKCQQLILLLSYYRLTRRYNARSQRS

SEQ ID NO: 55021 - protein, 85 aa, Sorghum bicolor
  Clone ID: 15045529.pep
TFNSNPDAAGASVGLVTLVIGITCAYLVRERRKLHRIKQRYFRRHGGLLLFEEMKSQHHQGAAFTIFSEEELQQATNNFDGQRVL

SEQ ID NO: 55022 - protein, 65 aa, Sorghum bicolor
  Clone ID: 15045530.pep
HELFISVLPLSCTVAVVVVPCCSRYRCLSLYVSSCMYHWSLYFMPLYQPQTLIITIHLAAEILVS

SEQ ID NO: 55023 - protein, 141 aa, Sorghum bicolor
  Clone ID: 15045540.pep
TPTKRSGAGTARHPYALHHPEPVAHFALSTGAFSDPPVRLYTAKKIQQQLEAARTELIQGSVVVRKQALLLPKVLHYYARDAALELRHLVELVCESMSDAQQKQLQQLQLQHGLRRRVDKCVEWMPYKSSFRYVVHRDLAD

SEQ ID NO: 55024 - protein, 98 aa, Sorghum bicolor
  Clone ID: 15045546.pep
MTTFLLCLGLVARPQNDQTTMPRPWSSYTKVEKLFSRITTSCLTSDQQMPSRHSIASVFVRSLQWKKNIAFPLEIFYPVFNIFSNTPNPPNECGKRVN

SEQ ID NO: 55025 - protein, 98 aa, Sorghum bicolor
  Clone ID: 15045549.pep
KKEEVKIEAWESRQRGKIESEMRRIEEHAERMRSEAMAKMAEKLEMTRRIAEEKRASANAKMNQQAAIAVQKAEKIRQTGRVPGSSILCCSGCFCGPY

SEQ ID NO: 55026 - protein, 109 aa, Sorghum bicolor
  Clone ID: 15045554.pep
GWEQVLEELAAEILDDPAPKRLFLARGKLQKLLVEFVPPKLILQKLVELFLKGIHTGVKREVYYWHAYYDKRLPVGASALLKLEEFVAKFMSIHRKSLSHEPKIREVAP

SEQ ID NO: 55027 - protein, 122 aa, Sorghum bicolor
  Clone ID: 15045559.pep
LEYLVSERRIEMPFTLLVRILAITLQQPPGGRDQLSHTTENAATLPLSLVTGAKTNRYLALFIRSQESVSVCELIPASWLLELDRYLRHLGLMLPDLQSLHKKIFRFSNSTHQQLLLPPLQI

SEQ ID NO: 55028 - protein, 75 aa, Sorghum bicolor
  Clone ID: 15045573.pep
YNGLKKVHDTSIIFSCHCYSRSGDLFPLLSLCSAQNVLEVLLEGGGMHSAHLGTRGITLGCQLSLGLLMSHFHPL

SEQ ID NO: 55029 - protein, 116 aa, Sorghum bicolor
  Clone ID: 15045585.pep
VLSCLIAVSVNFSTFLVIGTTSPVTYQVLGHLKTCLVLSFGYTLLHDPFTLRNILGILIAIFGMALYSYFFVREGKKKSANDALPVSQMSDKEAEPLLATKDSTDSKKANGLSHDC

SEQ ID NO: 55030 - protein, 41 aa, Sorghum bicolor
  Clone ID: 15045599.pep
PPAMDSDLETTAWILKLKRRTKNILNNIQSLNCHGNFDLVP

SEQ ID NO: 55031 - protein, 111 aa, Sorghum bicolor
  Clone ID: 15045604.pep
TIGGALSFLVSGMTPRIGIFFFSFATIKTVDDHCGLWLPGNILHVFFSNNSAYHDIHHQLYGNKYNFSQPFFVMWDKILGTYMPYALETRKGGGFEARPVKLNQAEQTKAD

SEQ ID NO: 55032 - protein, 81 aa, Sorghum bicolor
  Clone ID: 15045608.pep
LHGAPILIFANKQDSPAAVTEEELARHLHLKELDERPCMFQAGSAFDGTGIKHGVDWLVEEMERSKRTEALRARTEAAGKI

SEQ ID NO: 55033 - protein, 112 aa, Sorghum bicolor
  Clone ID: 15045612.pep
DQTPQVQGFHLLRYHRNPSTHGLEQSVPPGCADASTVPPAPLPAAAMPRGFVPRLAAQQGDTPVQPSFVRWQISLMYYAEWPMFMHNLQRGMHMIGELRCLGIQFLFVYPRR

SEQ ID NO: 55034 - protein, 74 aa, Sorghum bicolor
  Clone ID: 15045637.pep
HRSCSCRKYATDMNQSSWAWLPEVRRTLAWRHLAPRTSHLQASVTPDIIMKTSICKLNKPTSPDKRAILRGEQQ

SEQ ID NO: 55035 - protein, 66 aa, Sorghum bicolor
  Clone ID: 15045639.pep
LTSGWLRDENSFQQPDKVVPAASPITNAGKQMGVVLNSYSLTSFDLLLDSDQSVPPVSVSSLHSSV

SEQ ID NO: 55036 - protein, 62 aa, Sorghum bicolor
  Clone ID: 15045659.pep
ERPRRIRGKIDTRPLVLLRLLIRWCSLARWIILAFFPFFFFFSFLFFSYHHDDDDDDSILCE

SEQ ID NO: 55037 - protein, 70 aa, Sorghum bicolor
  unsure (1)..(70): unsure at all Xaa locations
  Clone ID: 15045680.pep
TGFRFSSCTTLFHRLCTLRQNRLITYIEPCIVYPLIQDCSANKIMAAGLLASPSIYDLGYVLGFILXCCC

SEQ ID NO: 55038 - protein, 48 aa, Sorghum bicolor
  Clone ID: 15045683.pep
KYQIVKIISICANIEGYRTSQNSLVPNAFSSCSLYCQYEDFCYRQLVK

SEQ ID NO: 55039 - protein, 85 aa, Sorghum bicolor
  Clone ID: 15045696.pep
LQEFGTRQRPAAPRKVPVVYYLTRSRHLEHPHFVEVPLASPEGLYLRDVINHLNMVRGKGMAAMYSWSCKRSYKNGFVWHDLSED

SEQ ID NO: 55040 - protein, 77 aa, Sorghum bicolor
  Clone ID: 15045699.pep
ARGLLLSGGASLGSFHVGVVKTLVEHKLLPRIISGSSVGSIMCSIVATRSWPELESFFEEWHSLKFFDQMGGIFPVG

SEQ ID NO: 55041 - protein, 83 aa, Sorghum bicolor
  Clone ID: 15045703.pep
GRRAVARRGWIRSRRGGTGRGRAGPAAVEVAATPAAGVGTGRRRSKPVAWSPVAAGNGRCRRRGGVGREAFGSRWVEEGNPRA

SEQ ID NO: 55042 - protein, 58 aa, Sorghum bicolor
  Clone ID: 15045707.pep
MAPPPEFVEVRCAGCGETLEVEPGLSEFACPDCGTQQALPPELMPPPPPRPRRALPIP

SEQ ID NO: 55043 - protein, 79 aa, Sorghum bicolor
  Clone ID: 15045712.pep
TRQNWIQVEGDKFKFPGGGTMFPRGADAYIDDIDKLISLSDGKIRTAVDTGCGVASWGAYLLKRNIIAMSFAPRDTHEA

SEQ ID NO: 55044 - protein, 75 aa, Sorghum bicolor
  Clone ID: 15045716.pep
HEGHFPPPNSSRLPPHRRRRVHFPPPADDAVLQLRPRGARRGAEGGDLRRRERVPVAESGRPRGVRRRARRAPPQ

SEQ ID NO: 55045 - protein, 68 aa, Sorghum bicolor
  Clone ID: 15045738.pep
CLEGLRSSSTSGVKHPKQPKPIRTSQADAVDEVFAAATQPDWQHSQEQSRPRRRARGERRGGGNRPRA

SEQ ID NO: 55046 - protein, 77 aa, Sorghum bicolor
  Clone ID: 15045747.pep
ARGSRRNPQRRCTPSPAISDLNPAPLPIAFKLTPLPPCRRATGAVRRTHTIHSDSRCSLAVATHRPHHSAAHSSLSE

SEQ ID NO: 55047 - protein, 123 aa, Sorghum bicolor
  Clone ID: 15045754.pep
VDCKWAPLQKTSTKHTNIDQSFTSDSNAHAKNDGTVTQSNLGQPSQFVSARTGVSRTTTKSNYATGRHYQISSTTTSSSPYSNGRLSGESGKFSEITGKLVGGVMKLTSTKVQNDAWLPCMTG

SEQ ID NO: 55048 - protein, 87 aa, Sorghum bicolor
  Clone ID: 15045760.pep
MASIRDLAIASLSAAAGAVAAAAALRLLSSRRTSSVRPQNLSLAANGSASERLLAQSPFDPAKREGYISCDDYFMAIAFLSAERSKD

SEQ ID NO: 55049 - protein, 111 aa, Sorghum bicolor
  Clone ID: 15045764.pep
MPSLSSSPPDAHSQHHHSILRVHSPDKLVGDLHLFDNSVVFTAEELSRAPAEIIGRSCHGTSYKATLDNGYMLTVKWLKEGFAKSKREFSREIKKLGSVKHSNIVPLRGYY

SEQ ID NO: 55050 - protein, 57 aa, Sorghum bicolor
  Clone ID: 15045774.pep
ARGTCGMFVHMVTVLPLFPVLSSYPAVNGPCFCFCFMIWSLIFCYHGHNVQLCYNDT

SEQ ID NO: 55051 - protein, 119 aa, Sorghum bicolor
  unsure (1)..(119): unsure at all Xaa locations
  Clone ID: 15045775.pep
FLIHAQDKMPGGRRPRRKEVASTFTRHNDTNDTDDTDLQPQLESSMSRDRGRGQVTTSSSPMAQPEEEHFEGDHVGDEDEEPVVEAASSSSSSKLYARXITRLPDRAPARHARALITPC

SEQ ID NO: 55052 - protein, 170 aa, Sorghum bicolor
  Clone ID: 15045780.pep
ARGDYEDDRMNLRLLVPNKVIGCLIGRGGSIVNDMRKKTKANILISKGDKPRRASSSDELVEVSGEADKLRDALVQIILRLREDVLKESVESQNSDRDGKLTVATSDSLYGSSLSLPALLPHNPQIAPLSYDRRGESERALEVFPRTSSYGYSSMQVTDDGYGGLPSYTS

SEQ ID NO: 55053 - protein, 121 aa, Sorghum bicolor
  Clone ID: 15045785.pep
MSAGFQLGVIGSLALSVASSVAIVICNKALISTLGFPFATTLTSWHLMVTFCTLHVAQRLHFFEPKAIDGHTVILFGLLNGTSIGLLNLSLGFNSIGFYQMTKLAIIPFTVLLETIFLKRR

SEQ ID NO: 55054 - protein, 41 aa, Sorghum bicolor
  Clone ID: 15045798.pep
HLLGDRGCGAIGGPARGIIGGEERGEQEGGEEGVRRREPRA

SEQ ID NO: 55055 - protein, 33 aa, Sorghum bicolor
  Clone ID: 15045799.pep
MAAAYITPSDYLFWFRSHTAKEIKWGGAKHHPE

SEQ ID NO: 55056 - protein, 164 aa, Sorghum bicolor
  Clone ID: 15045801.pep
MGMSFEKEKSHLRIDNQDIQNPVNEVVNFPLKEGKQKVYPTSVKSDSLKMKAKLVRFNVETGVQHGTVKQATSNTLKTSPMRKDGSMITFALKEARDLKHKANDLKNKGQELESTGLYFEAALRFLHVAFLLETPSFDISRPGDGAKSMKMYSETAKLCNFCAH

SEQ ID NO: 55057 - protein, 144 aa, Sorghum bicolor
  Clone ID: 15045805.pep
MAFAVSDELLGTFVPIAVYWLYSGLYVVLDGLGMDDYRLHPKGEEVRNIVSKWTVVRGVLVQQAFQIAVSLLLFTALGDEDGTVKKQPPALVIALQFIIAMFVMDTWQYFMHRYMHINKFLYKHIHSKHHTLVVPYAFGALYNH

SEQ ID NO: 55058 - protein, 137 aa, Sorghum bicolor
  Clone ID: 15045808.pep
TRVTPTEDTPATVKQPDGEDKKWFNSEERSKTPHQEQSTTDQAEQVLEGANASAAEHEGANASAAEQTVPINAPALTVQEIVNRIRANPGDPRILETQEPLQDLVRGVLKVLSSRTAPLGAKGWRALVAYEKSNKSW

SEQ ID NO: 55059 - protein, 76 aa, Sorghum bicolor
  Clone ID: 15045811.pep
MFSLFYGLWKHVFSKTEFHVLILGVHKSGKTTLLEKLKSIYLKGEGLPHDRIVPTVGLNIGRIEDANVKLVFWDLG

SEQ ID NO: 55060 - protein, 149 aa, Sorghum bicolor
  Clone ID: 15045813.pep
HEARLEVHAASKSLISSRRTNKIEATPAFASWDADFQSANSESAAKNSKQPDLFKSSSEAESFSFPASETAIKPVVGTENKTNTSAILEHHSEDLASASGTLFGDDDLSNQKVAQPIFESNSAPESTESSLRMNFAKRDQLHEMDDTGV

SEQ ID NO: 55061 - protein, 197 aa, Sorghum bicolor
  Clone ID: 15045816.pep
ARGFFFVLFPLFLDSHSQSPFLARRSPFLCRRSFRGLCVVVAVRCRGLLFFPFRGFFLFIFFPLFLESFLGSPEHVSPEFLPESFVVSPEFSRAVRCRGCVLPWLTLLPFPWVLLVHLLPSFLGVLSWLAGACLAGIFAGVLCCLAGVFAGCALSWLCVAVAYSSSLSVGSSCSSSSLFSWSPFLARRDFLLESFVV

SEQ ID NO: 55062 - protein, 137 aa, Sorghum bicolor
  Clone ID: 15045828.pep
HEVITRLRRYASFCRTLASHVGPSSTTGASRNMVTSPTNSSPSPSNNQGNQGGSTTSATGNSQMQEWVQGAIAKISNNSDGAVTATQNQMSTRSSFMPISINTGTFPGTPAVRLIGDCHFLHRLCQLLLFCLLFRRR

SEQ ID NO: 55063 - protein, 185 aa, Sorghum bicolor
  Clone ID: 15045830.pep
HEGQVLATGDVHSALRGLPGLARQLFRWAETTPCGFPRSASAFAAVLVPLARANHIRAAYPVSLRALHLGLLLPLVSLLLSAPLSPAPQSLLSLLLRLSTKYSKECTDRDATPDTCSTLCLSAFHEMASHGVAPDVKDCNRVLRVLSDAARWDDICAVHAEMLQLGIEPSIVTYNTLLDSFLKEG

SEQ ID NO: 55064 - protein, 125 aa, Sorghum bicolor
  Clone ID: 15045846.pep
HEGGLWAELVSNRGFEAGGSNTPSNIDPWLIIGDESNIIVATDRSSCFASNPIALRMEVLCGASGANACPSGGVGIYNPGYWGMNIERTKVYRVTMHIRSSESVKLTVSLTSSDGLQNLASHTIM

SEQ ID NO: 55065 - protein, 139 aa, Sorghum bicolor
  unsure (1)..(139): unsure at all Xaa locations
  Clone ID: 15045850.pep
ARGDNRPSTSSSTSRGMSPRRRLASDGITAVTNGVDFGDNANRPSTSSAVSRGISPRLQLASDGVGTVSKGTGLADELDRPSTSYATPRGMSPRRXVASDASNATSERIKFTEXDSGTVSSSVAPRGVSTLRRLASDGV

SEQ ID NO: 55066 - protein, 142 aa, Sorghum bicolor
  Clone ID: 15045862.pep
ARGLSQRPHLLYDYFKQRFAQVTNPAIDPLREGLVMSLEVNIGKRGNILEVGPENADLVALSSPVLNEGELETLLKDPKLKPKVLSTYFDIRKGLDGSLDKTIQALCEEADAAVRSGSQLLVLSDRSEAPEPTRPAIPILLA

SEQ ID NO: 55067 - protein, 135 aa, Sorghum bicolor
  Clone ID: 15045883.pep
HEVIPYMEQKIRVLNQQVAQTRKGFRNQIKNLWWRKRDDVPEASNGPMYTFTSIESQIRVLGDFAFMLRDYELALSNYRLLATDYKLDKAWKRFAGVQEMSGLCYFILDQSRKDAEYCMENAFSTYLRIGSSGQR

SEQ ID NO: 55068 - protein, 142 aa, Sorghum bicolor
  Clone ID: 15045889.pep
TRGAAAGGIGVAEFLGAKNFLITGGTGFLAKVLIEKILRTNPNVGKIYVLIKAKDGEAALRRLQNEVVDTELFKCLQEIHGEGYDSFIAKKLVPVVGDVREANVGISPDLADEIADQVDVIINSAANTTFDERYDVAMDINT

SEQ ID NO: 55069 - protein, 137 aa, Sorghum bicolor
  Clone ID: 15045892.pep
ARGVDCGVKHAALVMKNGEVFTWGEDSGGRLGHGTREDCVRPRLVESLTVSNVDFVACGEFHTCAVTTTGELYSWGDGTHNVGLLGHGNDVGHWIPKRVSGALEGLQVAYVSCGTWHTALITSMGQLFTFGDGSFGV

SEQ ID NO: 55070 - protein, 126 aa, Sorghum bicolor
  Clone ID: 15045895.pep
TRVAGAARLPFRLPASGQSLPAGLPRLDSPRRIAAAAFGSDDELVDLELRVEISSIAGIEDALLLKPASGKAAETRLRVGWARWLEGKADYLRRDRMLRSNLESLNPRNHPLLQDPDSPGLTSLTK

SEQ ID NO: 55071 - protein, 94 aa, Sorghum bicolor
  Clone ID: 15045916.pep
ESFSTYPRTYDLVHADHFFSKLKSRCKLLPVIAEVDRMLRPEGKLIVRDDKATVEEVQSMVRSLHWEVRMTVSKQGQGLLCVRKTMWRPTEVEA

SEQ ID NO: 55072 - protein, 119 aa, Sorghum bicolor
  Clone ID: 15045922.pep
TRRNLVENDRVLLNRAHRAQQEYERVANYCLKLAGEQEKVVSERWLPELRNAVQEARRCFDDCQRVRGLVDEWYEQPAATIVDWVTIDGQSVGAWINLVKQLHMEISRRTLAMSSVGDD

SEQ ID NO: 55073 - protein, 60 aa, Sorghum bicolor
  Clone ID: 15045948.pep
HSNIYQVLYERKKKLLTRAIVQLCYEVGLGTEKQRHKMLPNSHRCTASQYNISPSLARGR

SEQ ID NO: 55074 - protein, 110 aa, Sorghum bicolor
  Clone ID: 15045957.pep
DHQDAVLCCSFKEKPVFTFGNQMGIDMLETTLIALQDLTLDKIFDLPGRKALHAEVPKLMEQGYAYLPAGVCLSGMGRHVSYEEAVAWKVLGEDGNVHCLAFCFVNWSFV

SEQ ID NO: 55075 - protein, 82 aa, Sorghum bicolor
  Clone ID: 15045958.pep
FQTPEAWTIDGHYRSLIYMRPLAIWAMQWALSPPRSILEAPKVNTMDRAHISPGTFQFLQDSVRKMTPKNGCFGNTVINWDC

SEQ ID NO: 55076 - protein, 56 aa, Sorghum bicolor
  Clone ID: 15045967.pep
NNQYVEENDRLRAILGEWSARAAKLERALEAERASNIELRKNIAKFRGHLYKEQEA

SEQ ID NO: 55077 - protein, 163 aa, Sorghum bicolor
  Clone ID: 15045978.pep
HEAGGVSSPLGTVITPARTTGSAPPPMVGIDRSMLLELAISAMDELVKLAQIDEPLWLPSLNGSPNKELLNFEEYAHSFLPCVGVKPVGYVSEASRESGLVIFDNSLALVETLMDERRWSDMFSCMIAKATVLEEVTSGIAGSTNGGLLLMKAELQVLSPLVP

SEQ ID NO: 55078 - protein, 108 aa, Sorghum bicolor
  Clone ID: 15045983.pep
TRAFPTQAAESSEEKAALAGKNKRKKKQKSKEQGAASGETAAAEEEEETYSHTWKLCNASTGADYIPCLDNEAAIKKLKSNKHYEHRERHCPGDAPSCLVPLPEGYRQ

SEQ ID NO: 55079 - protein, 125 aa, Sorghum bicolor
  Clone ID: 15045988.pep
ARGSQAANAVPKQRASKQAVSTFDWAKRVENPPRQRHQSGVGSWPRAAASAASAAAGIMNRHEILVAEPAHRNGGVSGSARRFRTYAHHLYKAYKARRYPKSERFISPSALPPSSVSTRSPQVQC

SEQ ID NO: 55080 - protein, 194 aa, Sorghum bicolor
  unsure (1)..(194): unsure at all Xaa locations
  Clone ID: 15045992.pep
TRVKRKEPNAEVKSKKRKTSSAVTPVRASPRLAALNVQLDVRIEHEDEIVTINHVEQVQAIKDEIVNVNHVERVRTIEKSAIDQTQKSQSGSVDQIHGNLESTINQLQLSQADTANGMPVIQENTTFHSQPSQLDNLNPTQXKQENSANQLQSVLTDSLLPKQITQECTIDQPSQPNINHIHTDQEFTGNQFRS

SEQ ID NO: 55081 - protein, 53 aa, Sorghum bicolor
  Clone ID: 15046001.pep
VSPIYALFDATGLFSSRLEGRLTNKIRSLSGESIMATVGAALLRSVVTKMDRA

SEQ ID NO: 55082 - protein, 151 aa, Sorghum bicolor
  Clone ID: 15046004.pep
TRHKLISTSDGISVLKIACGQWHTAIISSLGKLYTYGYGTFGVLGHGDTHSVVHPKEVESLRGSRAKSVACGPWHTAAIVETSGTLKSSAPGGKLFTWGDAGGGKLGHTNKKSKLVPTRVESLIDCDFTQVSCGMSLTAVLTITGVVFTIG

SEQ ID NO: 55083 - protein, 170 aa, Sorghum bicolor
  Clone ID: 15046020.pep
ARGFKMRLKQAESAAETASHEHQLSVERVCMLEKELKILQDECNRMELNMQEYKEREGALKARELELLSVEHTQISADRGITDYAISKDQMEALVEKISKLNMLSGESNVQREEATFSSLLDKLFVVIDEFSALQREVETLRYENEDLQLNIESYTRELEQLREVSRNSD

SEQ ID NO: 55084 - protein, 153 aa, Sorghum bicolor
  Clone ID: 15046030.pep
ARGFGIVTISHGGRGVAARACGLVNLEPTKIVEILKDRPSWFRDCRSLEVFTMLPAGNGGTIELVYMQMYAPTTLVPARDFWTLRYTTTMEDGSLVVCERSLSGSGDGQSAATAQQFVRAEMLPSGYLVRQCEGGGSIVRIVDHLDLDAWSVP

SEQ ID NO: 55085 - protein, 137 aa, Sorghum bicolor
  Clone ID: 15046031.pep
TRVTAREMWGTMVQDGSFDRDNFSAGPSMPCLLGDTVCAAVSASTWVEPHGRCTVAFALAWSSPKVKFKKGSTYYRRYTKFYGTSPRSAVNLVEDALMKYKHWEEAIDKWQTPILRDERLPEWYKITLFNELYFLIA

SEQ ID NO: 55086 - protein, 171 aa, Sorghum bicolor
  Clone ID: 15046041.pep
HEGILLVGFAAVAISAPWIFLFAPDMISPLLCSSNAILLVLTGIFQQYWVHQVRKVRLQGYYDFSQKLKRIARLPFATIACGTALMLLIMVWQPLLKILSVSLLLRIAIVVEVTCAGCFMGLYIWHIHKYNSLDGQPDILRSLYSALQPSCTLEDRRYHDARLSDQQMALL

SEQ ID NO: 55087 - protein, 156 aa, Sorghum bicolor
  Clone ID: 15545818.pep
AAVERHRVTYIFGAPPAMIALAKHGGGRRYDLSSLRCIGSGAAPLGKDVMVAMADRFPGADIVQGYGMTETCGIISLEYVQKGRARQFGSTGALVIGVEAKIVDTKTMKHLPANQLGEICVRGPNIMEGYFNNVQATEFTIKQGWLHTGDLGYFDE

SEQ ID NO: 55088 - protein, 104 aa, Sorghum bicolor
  Clone ID: 15545827.pep
MANLFLKQAKQYVATRPVYPPELFDFIASKTPRRDMAWDVGTGNGQAAASLATLYEAVVGTDTSAQQLAYATRLPNVRYVHTPPDLPLEGIHATVAAPASVDLI

SEQ ID NO: 55089 - protein, 184 aa, Sorghum bicolor
  Clone ID: 15545832.pep
HEDSIPMVSLAVLVAAVCARAASSWLRPGLRRLVSLLPVVAFLAAAPLVFSSANIRGLAGFFLGWLGVFKVVLLAVGRGPLDPALPVVPFVFTTALPVKLRGCCGSGTGTGAAGAGAAACSRAKSASLVSCAVKVAVLAAILHAYQYVNQLHLYVRLALYGVHMYCFLDFLLPCIAAAGGALGM

SEQ ID NO: 55090 - protein, 142 aa, Sorghum bicolor
  Clone ID: 15545833.pep
MAGGGGELKLLGLWTSPFVIRARLALNLKGLSYEYVEEDVKNKSQLLLASNPVHKKVPVLIHDGKPVCESQVIVHYIDEVFGATAAAGPSLLPADPYERATARFWAAYVDDKVRSSPLLCLVKFDMDLKRCYFLLWTCIIKS

SEQ ID NO: 55091 - protein, 136 aa, Sorghum bicolor
  Clone ID: 15545842.pep
HEEVIYALTYRFFEGQHSFEAMSWEHPTEGWSWKTLPPPPSAFRSRVNSYVLHPDGCTIFMTTANNGCLGTYSFNTKDSAWRWHGEWALPFVGQAHFDGETNSWVGLRWDGYICSCKVVSPDCLNTAPDWQMTKEK

SEQ ID NO: 55092 - protein, 82 aa, Sorghum bicolor
  Clone ID: 15545844.pep
AVCAGINGDASTGVYGAYSMCDDGAKLDYVLDAYYQSQQKSSSACDFNGQAQVVSAKPASCCSAALASASAINKAAATATCP

SEQ ID NO: 55093 - protein, 80 aa, Sorghum bicolor
  Clone ID: 15545849.pep
HAGKTVLSIESDMKVPLLQRSLSPKFSLGASYLLIGGVGGIGCSIARWMDDQGAKNIIILSRSAGRSEQAVGLIDELSEV

SEQ ID NO: 55094 - protein, 186 aa, Sorghum bicolor
  Clone ID: 15545853.pep
LLRSMRISKVKLYDADPNVLRAFLGTGVEFVVGIGNEYVPAMVSPAAAQAWLQQHVVPHLRAGARITCVTVGNEVFKGNDTALQSAVLPAMQSVHRALGALGLQGRVNVTTAHSLDIMGVSFPPSAGAFHPAAMAHLQPFLSFLSATRAPFLINCYPYFAYKDDPARVPLDYVLFRPNAAGVVDER

SEQ ID NO: 55095 - protein, 64 aa, Sorghum bicolor
  Clone ID: 15545854.pep
TTTTCVQADVLPDLRRLLRQRLRRATQHHRAYIYTQQLIKNYIYIYIYIYIYIYTISIVRTYVC

SEQ ID NO: 55096 - protein, 100 aa, Sorghum bicolor
  Clone ID: 15545858.pep
TRLPQAFCRCAAVKGTLYVLRMPVSALLMDEEKKHFVGARLASGQDILCQQLIIDPSYKIPNLDVPFDGSHSHLPRKVARGICIISKSVKQGSSNVLVIF

SEQ ID NO: 55097 - protein, 102 aa, Sorghum bicolor
  Clone ID: 15545861.pep
MDDEARQALANMDMPRRPINFVPATSGEILKLGHITCRIMEDGSRTDNRIGSAEFTLPPNTAGPPAHWHEMHDETFLVTEGVVRFHAPDGKVIDAHVGDYVT

SEQ ID NO: 55098 - protein, 78 aa, Sorghum bicolor
  Clone ID: 15545864.pep
WGLGLTRLEVGVLRCKSFSLVGISTDKGLRILSQWPSRWGFNYKRVEKMKRGACSEQMHTHTHTQMQMQMQRTQRGAA

SEQ ID NO: 55099 - protein, 171 aa, Sorghum bicolor
  Clone ID: 15545867.pep
MSVQDRAQAHLSQLDKELSKYPALNNFEKQTSVPKAYAVLGLAGLYFFLIFFNIAGEFLVNIAGFVIPGYYSLNALFSASKVDDTQWLTYWVVFAFLTVFESAVSAVYWFPFYYTFKFVLILWMALPQTSGAQIVFRSFLQPVFSRYFSESGSTAADLRAKVDSAGKSHAS

SEQ ID NO: 55100 - protein, 158 aa, Sorghum bicolor
  Clone ID: 15545870.pep
MAGAGGGGGDAGDSFYSDFMVLRPDKGGLYALFHLMWSCKVSENAAVDCPAGTEMADWRRRWAVLVSLVAQVLLLWAKKPMALVGRATEYWMNLVNENGGGVLVLVLRALQGKLKFPDRASPNLRSCLGLLDMRVELDKEIKQGDSNYHAALSIMAAK

SEQ ID NO: 55101 - protein, 131 aa, Sorghum bicolor
  Clone ID: 15545877.pep
LGMASALETLCGQAYGAGHLHLLGVYAQRSVVILAASALLLSPLYLLAAPILRALGQDEAVAAAAGDFTLRTLPQLLSLPLAFPTQKLLQAQGEVGALAWIGAAALAAHVALLALFVPVLGWGLRGAAAAY

SEQ ID NO: 55102 - protein, 212 aa, Sorghum bicolor
  Clone ID: 15545881.pep
TRQKAILVPTNHVEQLWKDYENFENSVSRTLAKGLLSEYQPKFNSAKAVYRERKKFIDDIDWNVLATPPTGSYKEEQQCMAWKRLLVFEKGNPQRIDATTANRRVTFTYEQCLMYLYHHPDIWYDYAMWHAKNGSMDSASKIFQRALKAIPDSEVLKYAFAEMEESRGAIQTAKTIYESLLGENASVTSLANIQFIRFLRRTEGIEAARKYF

SEQ ID NO: 55103 - protein, 200 aa, Sorghum bicolor
  Clone ID: 15545883.pep
HEAHSSRNANSSLPMPSVEDAIVQIEDTLYYFSDVMSSGIPDLERFITENILQVLVFRFLFPSLQRQSTDLDLSVTTSMYLLCCILHIFKNKDMASTVAAALFHQPDGLYDKEQGTPNGFTSEHDNCKFENYCTTSSAVEQSNEDEPNSLSSVSWKRLPNNSPPSDCCQGNTPREHLLSYITEGDDSQALGSLCLFATLL

SEQ ID NO: 55104 - protein, 49 aa, Sorghum bicolor
  Clone ID: 15545886.pep
FTRIASKHPNSTVGVFYCGAPMLAKELKTLSHEMSHKTGTRFHFHKEYF

SEQ ID NO: 55105 - protein, 178 aa, Sorghum bicolor
  Clone ID: 15545888.pep
ARGNSVVDKEVIGAPAPRNTAASAPTPRGPVDTTDVAGEIKAQFIRAADAVRALSPLLEVGRRRYHHRSSVYHVSSSMVSAIALPHSDLGGIELLDCGSEKVLGGRSLSLTLEKLFMWEKKLYDEVKAEEKMRLLLAKNAKRLKYLDLKGAEAQKIDTTRNMVRKLSAKLRISVRVIT

SEQ ID NO: 55106 - protein, 202 aa, Sorghum bicolor
  Clone ID: 15545901.pep
HEGTIAPTADFQHEAQAMQQVVACNDRLNELSTSEFAEPEKMLSAPDAEFNHAIDLGQTTAEKGTAESDGSNIIGSLTSRKRHLEDSLPALESETTERLSSRPHGKRTNDFVPHDDDILASILVGRRTPGFTLDSTPLPPRESTLKRPRLGSKMGTLKRKVQIDDAMVLHADTIRQQLINTEDIRRIRKKAPCTRSEIWMIE

SEQ ID NO: 55107 - protein, 197 aa, Sorghum bicolor
  unsure (1)..(197): unsure at all Xaa locations
  Clone ID: 15545903.pep
HEAAIAAVAGELVSRFISFAFSRYCSSYSYEGLEEKRERLRQLLMRVHTVVEEADARYITNSGMLMQLKLLSEAMYQGYHALDTLTFQLHDDEEDSTNCMVSDSSISLCSATRFKRQRTVLASAKKDKVAALDNLETAVANISEFVALLCGCDERLSRXPYDAYLYIGNFMFGRHAEKQKLLNFLLQQNPSDDLAPP

SEQ ID NO: 55108 - protein, 59 aa, Sorghum bicolor
  Clone ID: 15545915.pep
QQSGVHIDLGEHEADSKLEFTGLESLLLGLSSKPIISMPHAINDSYLASARLQVWTLGE

SEQ ID NO: 55109 - protein, 190 aa, Sorghum bicolor
  Clone ID: 15545916.pep
HEGQGYLNKEQCISLLDELNKYRSLPKTSKEDFELIFAELDRSGDFKVTSEEFADLCNTIAIKFQKEPPPSYLEKYPSFYHSPQCEKLKSFVRSRLFEYIVVFVLLVNLIAVIIETTLDIENSSSQKVWQEVEFVFGWIYVVEMALKIFSLGFGAYWMEGQNKFDFVLTWTIFIGETLTFASPSTLPFLS

SEQ ID NO: 55110 - protein, 131 aa, Sorghum bicolor
  Clone ID: 15545919.pep
HEDPSVSHVQELFEAAKAANDLNAIAAILGKYPYHPESLLTFAELFKYSGDHQSSADAVEKCLFALECAWHPLFSPLQGNYQLKFIHDTNKPLFTALFTHMKNLDRRGCHRSALEVCKFLLSLHSDDPKGA

SEQ ID NO: 55111 - protein, 118 aa, Sorghum bicolor
  Clone ID: 15545928.pep
MSESSRSRHCRGGGGNRLADGARPSASARRLVDAFWQDMDSGLLQGDAAARRSLVLWSGASTEVSKRSRSKSKILEADGKGSRRNGHARWLSADMMSTGSAMEIGTFSQDDVSRCPDK

SEQ ID NO: 55112 - protein, 117 aa, Sorghum bicolor
  Clone ID: 15545939.pep
HEAGLSHGPYLGTTTFCSLASLLILLIKASVYSPAQDIGPELSPSLPDHNLNLKKLWGMPVLFLSSLVFALGHVIVAYRTSCRARRKLLIHRIDPESILAYKNAFSGCYKVPRSPTP

SEQ ID NO: 55113 - protein, 107 aa, Sorghum bicolor
  Clone ID: 15545940.pep
HEDPPPTARDARNASGVVLSREQYNPRPMDFVPDLADVRDAVGRMPHGHGEQLSMPITGGCDVAVRMMCMEQQQDRFLSRTPPEINANGQLGRMHLGEQHTLPILGG

SEQ ID NO: 55114 - protein, 113 aa, Sorghum bicolor
  Clone ID: 15545942.pep
ARGLMRAKGLEPLVWSNDRIINGFCKINRSDEGMAWLAGMLKDNIKPRKQTFDYLVESLSTCGRLDDALLVLNIMFKVGFGLGRFACTILVDKLCTGNVSYSHQLDNILVSSQ

SEQ ID NO: 55115 - protein, 51 aa, Sorghum bicolor
  Clone ID: 15545943.pep
ARGRDLALRRMESVRSSFGAGRDLATASASTRVYHVTDYGADPTGATDATA

SEQ ID NO: 55116 - protein, 174 aa, Sorghum bicolor
  unsure (1)..(174): unsure at all Xaa locations
  Clone ID: 15545946.pep
ARGVSSVAKHVVVGFVGYPNVXGKSSTINALVGEKRTGVTHTPGKTKHFQTLIISEELTLCDCPGLVFPSFSSSRHEMVACGVLPIDRMTKHREAIQVVADRVPRDILEQIYKITLPKPKPYEPQSRPATAAELLRAYCASRGHVNHAGLPDETRAARQILKDYIDGKIPHYEL

SEQ ID NO: 55117 - protein, 55 aa, Sorghum bicolor
  Clone ID: 15545949.pep
IEHHIGPSYYMYKAHIYLVPFKGSEMPINCKEIIYNYTQILQPSVLRFQPSVLVF

SEQ ID NO: 55118 - protein, 121 aa, Sorghum bicolor
  Clone ID: 15545958.pep
ARGQAELYNQVFSYMKSVALAVALDLRIADAIHHHGGAATIFQIAGEIGVNPCKIPRLRRLMRALTVAGIFTIQPSDEQTVKASSAGHEPAAVYKLTTASRILISKSSPSLFPTLSQQLNS

SEQ ID NO: 55119 - protein, 97 aa, Sorghum bicolor
  Clone ID: 15545967.pep
PHRLHSPPVSAPRGGAGTADARRPRPRGPHYGAACGHGAQPERVRPPVRGRNGRGRAGTPCACAPACASACWRRRRDRPWRRARVSRRGGGGRSASC

SEQ ID NO: 55120 - protein, 119 aa, Sorghum bicolor
  Clone ID: 15545968.pep
TRRPCPCGKQIIVRRCADRSTPVTCGRPCEQMLPCKRHRCEKVCHTGSCGDCAVLISARCFCGKKNETLLCGDMMVKGKLSEEDGVFSCNEVCGRTLACGNHACKDLCHPGPCGECELM

SEQ ID NO: 55121 - protein, 141 aa, Sorghum bicolor
  Clone ID: 15545969.pep
MVIPAILLILLQLLLFTALSVDGAASFSFTNACQHPVWVGALHGASSPPLASSGFYLAPSATSRLDAPSSGAWSGTFWARTGCGVDSTTGRFSCATADCGTGDVACQGRGPAPPVSLVEVTLAAPSSGGPDFYDVSLVDGF

SEQ ID NO: 55122 - protein, 99 aa, Sorghum bicolor
  Clone ID: 15724523.pep
HQQSNSLLLVLFAELYSTINSGDSLLLHCIKPPLLPVLRSSELTKATALGGSRDRSATAAARTGATPCSARWRWRCRPASRPASRRGAAARPPLSSSSS

SEQ ID NO: 55123 - protein, 123 aa, Sorghum bicolor
  unsure (1)..(123): unsure at all Xaa locations
  Clone ID: 15724538.pep
HRLENGGVRSDDGEGNASSSFPIFEYMERDPPYGREPLTDKVSTFAHRFPALKTFKSCDLLPSSWMSVAXDCDPPTPACPGFGGINCCTTATGKLLLPTFGLAPYKFRASIWTSDRTQERDRV

SEQ ID NO: 55124 - protein, 138 aa, Sorghum bicolor
  Clone ID: 15724544.pep
KTSKEVATAIRAAIIIAKLSVIPVRRGYWGTNLGQPHSLPCKESGKCGSVTVRLIPAPRGTGLVASPAVKRFLQLAGVEDAYTSSAGSTKTLENTLKATFVAVSNTYGFLTPNLWKETKLIRSPLDEFADTLREGKRY

SEQ ID NO: 55125 - protein, 197 aa, Sorghum bicolor
  Clone ID: 15724562.pep
REKGKSKSVSFYLSDASGVATPTDTNSEMGNIGNSCSDKLTDENLSNSSQQMTEKHSVTEDQYSNDQDHEGEPLDHTVEQQPNSDVGEIASSMKLRCRKKLQKVGTPNHTVDDCFDEDCVEPSLAEEDNDSGDDYTTGNKRKARKKSRDGVEESQQQKVQKNKSKVSSRGRKRTLKDELAAKPEKKKLTHRIRQRTT

SEQ ID NO: 55126 - protein, 115 aa, Sorghum bicolor
  Clone ID: 15724563.pep
GINKAVNYVKETYENRTMILAENGMDQPGDISITQGVHDTIRIRYYRDYITELKKAIADGARVIGYFAWSLLDNFEWRLGYTSRFGLVYVDYKTLKRYPKDSAFWFKHMLSKKRS

SEQ ID NO: 55127 - protein, 120 aa, Sorghum bicolor
  Clone ID: 15724602.pep
ALVSSVRKLLEKQNVEQMEQMIVTRERERWNKILEKKTVEINKEADVLNRKLALVPGRHSRLPSAQTYQEHLLDASSLQSSLQRVVQALESFTSNSLQALEQTLRHAEEERSSRESAKVS

SEQ ID NO: 55128 - protein, 132 aa, Sorghum bicolor
  Clone ID: 15724648.pep
LMKVLSQEMAVVGRLEMVILAGLPLLETVMQSLRRSESSVFSLYFVLCLLSGRYEWPLFDFCWKKQGVFLHERSLLLDTPFFSLVLNTIAFTVEFWVTLVTNFVFISYIPLHLMIPRYFNLSIGLQVNKLIN

SEQ ID NO: 55129 - protein, 166 aa, Sorghum bicolor
  Clone ID: 15724658.pep
FKCLTPDQEKDVDRLITRMVSREEAHLVLMELMKWRSDGLDPLYAQAVQVRQPDPSTGRMKVANKQSSRLVWETCLSELKSLGKVAVRLIFLHATSRSFRCTPSMVRWLCAPGSLASCNDRAHRLAFVAANSKLERRDFSSDEDKDAELLAEGDDDVVNLPGNAEP

SEQ ID NO: 55130 - protein, 56 aa, Sorghum bicolor
  Clone ID: 15724659.pep
EKQKNDRLTSATLFLCARQIIIVMTAIIAPIFLTLLSSQDLVYLVEVICELLVLAL

SEQ ID NO: 55131 - protein, 177 aa, Sorghum bicolor
  Clone ID: 15724668.pep
LATKKNMRFQVSYENNSDQQHPTLQMVSDLLNSVTLALERVGEEKYMLLNKIHDLNELSRKEVDEIIKVCMKQDCISPNDDIRKRRYIAMIDLCCMAGNRDQLITLLLQITECAVTILLIHFQDDASAKGLSSFSDELLPVLERLEHLKEDKVGCNLKLFHRSVTTLKEMTIRTMTL

SEQ ID NO: 55132 - protein, 71 aa, Sorghum bicolor
  Clone ID: 15724680.pep
VSKFPKTSYKCVVDHNILSLIHVLGHLFGHVLGHLFGHPNVLGLRPILPPNLVVGNHLIIAHIEYVVPTPD

SEQ ID NO: 55133 - protein, 148 aa, Sorghum bicolor
  Clone ID: 15724683.pep
QGGSLVTANAFADVLRSNLNAQFWLSILNKCRKVMEKNLFAYGQLPNLLFDQGREVDITDFVWSHAINPIRMLPCTTSRAVAKTELPKVAFGELLLDPSVRPKGEFRLLTWESRLPPYTSFIHLVPNSTQDLPQGHSLSGRKRHIVPF

SEQ ID NO: 55134 - protein, 84 aa, Sorghum bicolor
  Clone ID: 15724685.pep
SHLEGPHMGVQGGIDLMEGIPNLSFGNHFGMDINHQHQVPSHQRMQQNNFIQVQAEPHGFGNQWVYHPMLQDNPVLRTPTRRAG

SEQ ID NO: 55135 - protein, 144 aa, Sorghum bicolor
  Clone ID: 15724692.pep
TRAPRRAPPTTRTTRPSRTSISSSPSTAAAPPRPPSTFPRRRFRCRCSTSSPAPAACGRSASRATAPGTPRSTAAAAAASPAAPAAARGRCGCSWSPPRGPPTRIPSRGGRRPATSSGGTSPRSPRGCGTACAPAAAAPRAVSA

SEQ ID NO: 55136 - protein, 134 aa, Sorghum bicolor
  Clone ID: 15724708.pep
TRPLPPGGSTTTLVAPSVSHLPRPRARTRNSPRQPQVTASPVPLLRFSPRVDMDTSHHYPWLNFSLAHHGDLEEEERGAAAELAAIAGAAPPPKLEDFLGGGVINGESARSGGGVPVAAPEVSAPAEMYDSDLK

SEQ ID NO: 55137 - protein, 121 aa, Sorghum bicolor
  Clone ID: 15724711.pep
MADRGTSRGGGFGSRGGDRGRGRGRGRGRGRGKNEEKEWQPVTKLGRLVKAGKINSMEEIYLHSLPIKEYQIVDNFLPKLKDEVMKIKPVQKQTRAGQRTRFKAIVIIGDSEGHVGLGIKT

SEQ ID NO: 55138 - protein, 202 aa, Sorghum bicolor
  Clone ID: 15724746.pep
HEEQILLLLGESERIAEAAWVFVLGLIPQIFAYAFNFPIQKFLQAQSIVAPSAYISTAALAGHLVLSWLAVYRMGLGLLGASLILSLSWWVIVVAQFVYIVRSQRCRRRTWTGFSCRAFSGLPEFLKLSFASAVMLCLETWYTQITVLVAGLLKDPEIALDSLAVCMSISGWVFMVSVGFNAAASVRVSNELGAGHPMATSF

SEQ ID NO: 55139 - protein, 185 aa, Sorghum bicolor
  unsure (1)..(185): unsure at all Xaa locations
  Clone ID: 15724748.pep
HEDLSSPKQSRYIVLSDGALRDAPWRGAGVAVPVFSIRSVEDLGVGEFLDLKLLVDWAVNSGFHLVQLLPINDTSVHGMWWDSYPYSSLSVFALHPLYLRVQALSDAIPADVKEEIQQAKKQLDKKDVDYEAALSTKLSIARKIFNLXKDKVLNSSSFKQFLSENEEWLKPYAAFCFLRDFFETS

SEQ ID NO: 55140 - protein, 63 aa, Sorghum bicolor
  Clone ID: 15724756.pep
YLFYWVHVHLPGNTLCFYFFFKKNSTKSHLLILVETGLFSVSTVFFLPSVNITFRPDNTLFWS

SEQ ID NO: 55141 - protein, 157 aa, Sorghum bicolor
  Clone ID: 15724785.pep
ARGNHLSLFLCVADHEKLLPGWSHFAQFTIAVGNLDPKKVKYSDTLHKFWKKEHDWGWKKFMELSKIQDGFLVDDVLEIIAQVQVIREKADRPFRCLDRPYRRELLRVYMTNIEQIYRRFVHERRRKLVRLIDDDMRWSSFRAFWLAIDPTTKHRMS

SEQ ID NO: 55142 - protein, 186 aa, Sorghum bicolor
  Clone ID: 15724800.pep
TRLDMAIRCYNQAIVYDPQFVEAYNNMGNALKDAGRVEEAINCYRSCLALQANHPQALTNLGNIYMEWSMISAAASFYKAAISVTSGLSSPLNNLAVIYKQQGNYADAITCYTEVLRIDPTAADALVNRGNTFKEIGRVNEAIQDYVQAATIRPNMAEAHANLASAYKDSGHVETAIVSYKQALRL

SEQ ID NO: 55143 - protein, 129 aa, Sorghum bicolor
  Clone ID: 15724805.pep
ARGFHQCSALWPTQIHTATAYCKQTYHYAASIRDTRSNNGAQRTVSDTHPQTARPPATPVRILRMSCGLHTCTMTLRMLVQQSTLSLCFYTRRQSSFKDLINSRLQRFEATAVFANSSTTLQRRRLQRK

SEQ ID NO: 55144 - protein, 186 aa, Sorghum bicolor
  Clone ID: 15724809.pep
HEDLEGLPPKLGQLTSLQTLTNFVVGTGPDCSSIGELQHLNNLSGSLVLSQLENVTEAIDAKMAHLENKKELTALSLRWTTTEEEKPNCLKVLEGLEAPYGLKALRINDYRGTSFPAWMSMLPNMVELHLYDCKKSKNLQPLWQVPGLQVLCLKGLEELQCLCSSDTLFSFPSLKELVLVGMPAFD

SEQ ID NO: 55145 - protein, 200 aa, Sorghum bicolor
  Clone ID: 15724813.pep
TRVPISSIAPSSPRHHQHHHSNPHHHQQQQQQSGSRKRHTMPPAYTPADPVSHHHHLVVVDPSSVYSPALPALPAAPPPHQSSALVLSGGKDDLGALARLEDSVKRLKSPKASPVALMPKPQADAAVAMLADWFLESSPGVSLSAASHPKLRAFLRHVGLPDLQRADLAGPRLDARFAEARADATARVRDALFFQLAADG

SEQ ID NO: 55146 - protein, 199 aa, Sorghum bicolor
  Clone ID: 15724821.pep
HEAQLLSNLGIESKIEEILRNSATSENGGVYYYSERGDRLIDLDAFHEKLLQMSQELNPQLSESEKAGLKESVHHLLKWAWRYNKNLEEQAAQLHMLTGWSQIVEVAVSRRMSLFEERSQLLFELLDASLNATTSPDCSVKMAYVLTNVSLTCMAKLRDERFICPTGTDSDAVTCLDIILSKQLPNAACNSLLFKLVMA

SEQ ID NO: 55147 - protein, 161 aa, Sorghum bicolor
  Clone ID: 15724833.pep
TRHAETLLSLEFIHCQLYPTIMDKICRSLCQEGSSHGIQRFSIKSSQICETKPLTISSGLLNFLSSGKSLHLLSLNDTKMQSSLAQMIIHTLLESSCDLHTLEISENNIAGWLSKLNKSSTNSLALRSDIFMNSLSILNLRENNLQKDDVVDLHKILIKMP

SEQ ID NO: 55148 - protein, 95 aa, Sorghum bicolor
  Clone ID: 15724837.pep
ARGAASRRRLWHPVPQPSEPPAPPPSEPRDSAAAALCTVISAYTCDSHRGPQSGLSASTRSPQAAPAAEPEVASAARRLASRDLPGVNQIRVQLN

SEQ ID NO: 55149 - protein, 177 aa, Sorghum bicolor
  Clone ID: 15724838.pep
LGATPIVGPRGLPVFGSIFALSRGLPHRTLAAMARAAGPRAKELMAFSVGDTPAVVSSCPATAREVLAHPSFADRPVKRSARELMFARAIGFAPNGEYWRRLRRVASTHLFSPRRVAAHEPGRQGDAEAMLRSVAAEQSASGTVVLRPHLQAAALNNIMGSVFGTRYDVTSGATAGA

SEQ ID NO: 55150 - protein, 32 aa, Sorghum bicolor
  Clone ID: 17886489.pep
GSLQFINFESAFFWFKPLLRGTKIVHPSLFGE

SEQ ID NO: 55151 - protein, 69 aa, Sorghum bicolor
  unsure (1)..(69): unsure at all Xaa locations
  Clone ID: 18051757.pep
PPGGPFDPLGLASDPDQAAILKVKEIKNGRLAMFSMLAFFIQAXVTGEGPVENLAKPLRDPLGNNLLTV

SEQ ID NO: 55152 - protein, 184 aa, Sorghum bicolor
  Clone ID: 18052915.pep
TRIDFSLMQGLQWPALIQALALRPGGPPSLRLTGIGPPSPPGRDDLRDVGVRLADLARSVRVHFSFRGVAANRLDEVRPWMLQVAQGEAVAVNSVLQLHRLLADDASFSADDARPRAPIDAVLDCVASVRPKVLTVVEQEADHNKPGFLDRFTEALFYYSAVFDSLDAASGGAGDAAAEAYLER

SEQ ID NO: 55153 - protein, 205 aa, Sorghum bicolor
  Clone ID: 18059133.pep
TRDESIRRSGSVIAPTKFRDSLRKLSSDFRPGQQEDAHEFLRCLLDNLHKCTLDPKSKGKDSSFDEESIVKEIFGGQLRSHLSCCECGHSSETFEPFLDLSLEIDQVDHLVDALQSFTKVEHIGDSENKLTCESCNAQVCKNKQLTLHRAPDVIAFHLKRFTTLDNSVEKIDKHVVYPLEVDLKPFYSNPDAAGELKYDLYGVVE

SEQ ID NO: 55154 - protein, 148 aa, Sorghum bicolor
  Clone ID: 18059385.pep
ARGYLSLRGCLGIDLLSDSLGNLRQLQTLDIRGTYVKALPKTIIKLQNLQYIHAGRKSDYPQGEIDSLMERCLGGAFDCATCCLPHLLNIDGPSCKALTRRDACTFACCVQFPLNVTGADKRGVMVPRGIRKLKDMHTLREVNVWRGK

SEQ ID NO: 55155 - protein, 186 aa, Sorghum bicolor
  Clone ID: 18059569.pep
HEGHVPCAPQTAEAAKLQSSDASRFLSNARDCALSAPTSRLAVHNSGFTYQSVGFNESIGFSEVLQGQEISRAVPMFQGMMSEACSLKGGYGLHSYMHTPVAVNGLSAPAQECCLTLSTPPGAQVPSLYPDNIFNRTVVPQLGLASKFGGGGTNGQQSGPFDRRREIWTKPQHETPDQMNLDQFET

SEQ ID NO: 55156 - protein, 206 aa, Sorghum bicolor
  Clone ID: 18059727.pep
HEEIVDLNMAMLRLQEKISTMESEEKVQRQALLGTPVKSMSEHLSIPIAPKNLENGYHEVEEHKEPQSAPPAIKEYVNGDPKMRKSCVDRQLENVDALIDCVGKNLGYCAGKPVAAITIYKCLLHWKSFEAEKTSVFDRLIQLIGSAIENEDDNDNLAYWLSNTSSLLFLLQRSLKAAGAPGSVSRKRPPQPTSLFGRMAQGLRSA

SEQ ID NO: 55157 - protein, 140 aa, Sorghum bicolor
  Clone ID: 18059889.pep
TRQMPPRFIHKTTPARFMRRVRSSHNFRQRVGALDAINERRLPKVSEGDDEGGDQKDWQADTVSSRISSARDWNFESDGAYEGSNHSDCAFGDSYGENRPVEVQRMERRIPSSVLKPQGNLVHAKLVAWKDEQIAKLIEK

SEQ ID NO: 55158 - protein, 206 aa, Sorghum bicolor
  Clone ID: 18060762.pep
ARGGHPNVVTLVAHAVLDMGRTREALLLMEFCEKSLVSVLEGRGAGYFDEEKVALIFRDVCNAVFAMHCQTPPLAHRDLKAENVLLAADGAWKLCDFGSVSTNHKCFDKPEEMGIEEDNIRKHTTPAYRAPEMWDLYRREIISEKVDIWALGCLLYRICYFKSAFDGESKLQILNGNYRIPELPKYSSSITTLIRDMLNSSPDARP

SEQ ID NO: 55159 - protein, 98 aa, Sorghum bicolor
  Clone ID: 18061058.pep
SDFTKHFFQNSLASSRKLSMKLFSIKTALLVKLSCAKQALNMPLVTYSDRELVGLLYMCFNGVSRAKSRKLHLLRAVWHSSEPEALLHFEGGLEAAAA

SEQ ID NO: 55160 - protein, 206 aa, Sorghum bicolor
  Clone ID: 18061694.pep
HEGTIYDSSLQTLKVSNGNFTTHTETPLLGFPMTRLWSNVLVECYAKVLVPLLWSRVQVTGQIRLLTKGSICFGLSENPISEFELVAEELLMSDSVIKVYGAFRMYVKVLLMWDSNIQIDGGAKDVVLASMLEARNLVVLRHGSVISSNADLMVYGQGLLNLSGPGDGIKAKRLFLSLFYNVEVGPGSVVQAPLDEAVSSSLDALS

SEQ ID NO: 55161 - protein, 59 aa, Sorghum bicolor
  Clone ID: 18061698.pep
FCKLITVVKTFYVYLVNYVSMVSSLLGYYEDFICVVSVVPKLNKTLDMMESLGFWHWQL

SEQ ID NO: 55162 - protein, 148 aa, Sorghum bicolor
  unsure (1)..(148): unsure at all Xaa locations
  Clone ID: 18061810.pep
ARGVNLSQRIAELTNDTAVRSMIGDRFEKQQEFLENMAXAEGVKVSTGFSLGDLFPSSRLASVIGGMARRAAVNRRKMFELMDYAIKKHEERRAAMAKSAEGEGIVKEDLLDVLLRIQKEGGLEVPLTMGMIKGIIMVSRVIVLNFPL

SEQ ID NO: 55163 - protein, 184 aa, Sorghum bicolor
  Clone ID: 18061872.pep
MFKSGISSFARAARPSFAATASRRAIRPSTFRLPASSRFASTAGVGDGKIYQVIGAVVDVKFDGAKLPAILNALETTNNDQKLVLEVAQHLGENVVRCIAMDGTEGLVRGSPATDTGAPITIPVGPETLGRIMNVTGDPIDERGPIKSSKRLPIHTEPPAFIDQSTTAQVLVTGIKVVDLLAPY

SEQ ID NO: 55164 - protein, 200 aa, Sorghum bicolor
  Clone ID: 18062428.pep
TRQRLSLSEIKELYGTRHIGRDQARNLVGLMDVFCFSEACLIADIVQHFIDAKLEFDPSYVYEDVNQSIQHVHRSGLIHRQILSEPQKFLMKKSQVFRFLKMLKEKGKKLFLLTNSPFYFVDGGMRYLLEDQHFDGNSWRELFDVVIAQANKPTFYNSDHPFRVYDTQKDTLAFTAVDKFLPDQVYYHGCLKSFLQITKW

SEQ ID NO: 55165 - protein, 202 aa, Sorghum bicolor
  Clone ID: 18062432.pep
ARGEKFMQAYDLIEVYCELIVARLSIIDSQKTCPIDLKEAVASVVFASMRCSDVTELADVRKHFKSKYGKEFEAAALEVRPDSGVNRLVIEKLSAGAPDIQTKIKTLSSIAEEHNIKWEPKAFEEKLQQPNENPLYGSATYSGGNISTMGSSTSSMSTPQPTYSGVSAAAVDSATSHVSMGPSPVHVPANRTTYGNASSNTF

SEQ ID NO: 55166 - protein, 204 aa, Sorghum bicolor
  Clone ID: 18063339.pep
HEGDAQSRNDSLDADKGDVPFVSHGFEPRPYKVLSDSNNNCSRTSNGKPKAYQGDMSFLPRGFLGRSSSRGISVKADDGLPFSNGASSSFGNGKSKSSNHSSSIGGLSPGFLTRHRRESIALGTSSDISMDTKSNGAAVMPEGAEEMVSDCTTNGSSFQIRASDHLDENGLAILHTKSNSCGQENDSNGTPSMNHDGSEHGLRR

SEQ ID NO: 55167 - protein, 204 aa, Sorghum bicolor
  Clone ID: 18063385.pep
HEDAYGRKKSTLLADMMFALGSLVMCAAAGPYILIIGRLLVGLGVGVASVTAPVYIAEAAPSEIRGGLVSTNVLMITGGQFFSYLINLGFTEVPGTWRWMLGVAAVPAIVQFVLMLFLPESPRWLYWKDEKAKAIAVLEKIYDSDRLEEEVELLASSSMHEFQSNNAGSYLDVFKSKELRLAFFAGAGLQAFQQFTGINTVMYY

SEQ ID NO: 55168 - protein, 202 aa, Sorghum bicolor
  Clone ID: 18063390.pep
THEKQFTIAREDKKISFLYLSNDILQNSKRKGADYVDEFWRVLPRSLKHVYEKGGEEGKKQVARLILIWDDCKVFGSRIESMKNDILGDDPPILVNNGNSLNPSSNPTSNSKAARKDSGTIVKKLVVGGMPEKIVSAYQSVLDRHFDEDTALNKCKTTVGLLERIDKDINDASINGNQPASSLISDLQEQEMTLKQCIEQLE

SEQ ID NO: 55169 - protein, 125 aa, Sorghum bicolor
  Clone ID: 18064626.pep
LELVQDSLELARFPSIHPRTEAPNLNPPGDRSYYLRDDTCDSLAADGRSGLATTVGAALPVDPSSRPRAAAGGNRCRCVAGGVAPCVDLGYRPRAATGGTPCRCAVSGVTPCIDPGSRPRAAPRA

SEQ ID NO: 55170 - protein, 206 aa, Sorghum bicolor
  Clone ID: 18064636.pep
MELDKTVDSSEGFATSNDAPPDTSADEQLSQKEYCSQFTSLSWAGNIVGFQDGEIEIIWGDGSISKVGPHEIYVVGREDDGASLDDGTASDGASWETLDDNEMDVLDDSAKDDSQNVPENSIERENGSFSSQDGSSIATGPLSVAFGFVTRLASDLFARGRRHLDGSSNSDAMDEVESHRSNEASETGDDIDKINENHVESPEHAA

SEQ ID NO: 55171 - protein, 169 aa, Sorghum bicolor
  Clone ID: 18065081.pep
TRVEARRPDHLGDREFHTLTYDMMLAWEAPDEETDAVFQKTAFSVLRDDADDDDGASIFYSSPTQMAIQVDGRRTVGPEAFAKIAPACPAMAHPITVRNLFDALTNSTGGRLHFLIYHKYLRSLDEAFFSAKRMLGGHKAPALQLSEDEVILDIHGAATTKPVLQHIGT

SEQ ID NO: 55172 - protein, 193 aa, Sorghum bicolor
  Clone ID: 18065348.pep
HEAQFIPSREADIAILEEPEHLNWYHHGKRWTDKFNHVVGVVHTNYLEYIKREKNGALQAFLVKHINNWVTRAYCDKVLRLSAATQDLPKSIVCNVHGVNPKFLKIGEEITANRETGEAPFSKGAYFLGKMVWAKGYRELIDLMAKHKSDLEGFKLDVYGSGEDSQEVQSTARKLDLSLNFFKGRDHADNSLH

SEQ ID NO: 55173 - protein, 186 aa, Sorghum bicolor
  Clone ID: 18065838.pep
GSLNDINVLLRSPLFQRLKSGTSPPVEYFVNGNKYNMGYYLADGIYPSWATFVKSFRNPQGNKKIHFTQAQESVRKDVERAFGVLQSRFAMVRGPCRMWDKDTIWYIMTAAVILHNMIIENEKGAEEEDFDYDQDGGEVLRPEDYHRDPLVLSDFLRIHNEIEDRTIHEQLRDDLMEHLWARHGSS

SEQ ID NO: 55174 - protein, 228 aa, Sorghum bicolor
  Clone ID: 18065867.pep
LGWYWLSRVRGKVQYADLGAENWKPISNLHDMSSSHSKTLGYKRLTKSNPISCQILLYKSRSKGRKNQRSTRTHCHHPSPKIYSASAKEPWILATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAATLLAQNLFTHGYALGKL

SEQ ID NO: 55175 - protein, 102 aa, Sorghum bicolor
  Clone ID: 18065973.pep
FQNIFNHLKFPILNIPPHETGKENTVQPLHQGPKKKQLISIFTDQQRYNTRPILSMNLMPIFKDQTRPARLSLLYSPVPQVHIPKSCRKVHNKEQVHFISAD

SEQ ID NO: 55176 - protein, 119 aa, Sorghum bicolor
  Clone ID: 18066613.pep
QTTKYMVTTNSNIVNQILACQPIRVLSIQLDFFVFVLLQFCHSTVPLLFSKRKNSHYSTIFGLILILLLCLMFQFMPSTCCGYIQHDFTPRTSQQRKRKQVTQMNQLINKSLYCIQFVQ

SEQ ID NO: 55177 - protein, 57 aa, Sorghum bicolor
  Clone ID: 18066869.pep
SANKAYRQLIGHRQVHKACQWLWKSSCQNKRKFFFWLILQDRLSTRALPRRRNKTCT

SEQ ID NO: 55178 - protein, 83 aa, Sorghum bicolor
  Clone ID: 18067419.pep
EADKLPVERARKIQRFLSQPFTVAQVFTGIEGKLVDLKETINSFKAILSGEGDNLPEGAFYMVGDFASAKEKGEKILADLEKN

SEQ ID NO: 55179 - protein, 56 aa, Sorghum bicolor
  Clone ID: 18067459.pep
TDTLLTFRVYLYGLNLLFTVKWKITNQQRKVLQLKFATLLVLYIYSNDHHIFGSVF

SEQ ID NO: 55180 - protein, 105 aa, Sorghum bicolor
  Clone ID: 18067870.pep
LHIGSNATLSGDTKKKKKYIHEQSEKQNMKRLQPSNIYNHLRSPGSSVLILWSICRIMQTETAANSLRLSHHNCRLLPNASTIGGQAGRRVGNNQITAKTLSGKE

SEQ ID NO: 55181 - protein, 63 aa, Sorghum bicolor
  Clone ID: 18068181.pep
PFHVAEVFTGAPGKYVELKESVKSFQGVLDGKYDDLPEQSFYMVGGIEEVIAKAEKIAKESAS

SEQ ID NO: 55182 - protein, 128 aa, Sorghum bicolor
  Clone ID: 18068491.pep
NLFDPYFATMNSSQNIEFVYKMRAPQLQDLKAMNGPLVFIGEWVNEWDVQNASQYEYQKFGSAQLDVYANATFGWSYWTLKNDMIHWDFEWNIQNKYLLFSGSSMLKTPSFLLLLALGWGIHLIIMPR

SEQ ID NO: 55183 - protein, 127 aa, Sorghum bicolor
  Clone ID: 18069055.pep
IQLQQQQKQQMQQMLHQRQHMRASTQNLPMQQQKLHQQQLQHQEQLHLQQQLIQHMQQQQPQYHQHLQQQIQHQQQLIQQIQQLRHQQQHMHQMQPQQQPLPQMVDTELGNDDDAREDWVTEPGQHA

SEQ ID NO: 55184 - protein, 57 aa, Sorghum bicolor
  Clone ID: 18069627.pep
RQVDIALAFQVHTCPCMNNRCKHKIAKGSSSKLLSFCSSYEMHLVLVSNIINSPIFN

SEQ ID NO: 55185 - protein, 82 aa, Sorghum bicolor
  Clone ID: 18070098.pep
SVTRRPEDDVPKSGKGVLKSVAGGITLAGAVFFMIHLRRSKERSFATVIPSLSEKSVRSNSRAKNMDKENVHDVYPGGWLKV

SEQ ID NO: 55186 - protein, 228 aa, Sorghum bicolor
  Clone ID: 18070248.pep
IRDKYASQEFESLSHLVQRISDQDIKPFEPKRAWNKKVSFVDEATSSNSDEEPVIGLAEWVKNKKPMSCPFGQKEPEKFAFDTAKADRIFDFLLQEGQIKLSPNHVIPSAEELKRMRYCKWHNATSHDTNECKVFRQQLQSAIESGRIKFDSSKAQKPMKIDQHPFPTNMLDAKGKAKVLTSETAEKSASVDPQHQVTTADARSKGLVQEGASSGRIPRSGIVITHRR

SEQ ID NO: 55187 - protein, 73 aa, Sorghum bicolor
  Clone ID: 18070506.pep
MLQALASWTLSQSREEIHRSRVMCSSTIHIRCCEEEEKKRGEEFVVQKFAIAQCINLLCLAAYPTGCRRDNES

SEQ ID NO: 55188 - protein, 63 aa, Sorghum bicolor
  Clone ID: 18070513.pep
TLCRNHICNYSLLIKGVEAHVCNKLELALEIWLVWIIPYPRRFLLCLSIKRRDNYVSECLCMY

SEQ ID NO: 55189 - protein, 75 aa, Sorghum bicolor
  Clone ID: 18070536.pep
VATSAALPSNGRPAGKCPRELLLLNLDFENVLYTVHAASVIAVDDRPIDLPGCPRQASWSCELELSVCHVGPTVT

SEQ ID NO: 55190 - protein, 131 aa, Sorghum bicolor
  Clone ID: 18070604.pep
VNEWDPCFSDFIKKLESSKPVIVAGDLNCARESIDIHNPQAKTEAAGFTVEERESFEENFSSEGLIDTFRKQHPNAVAYTFWGENQRITNKGWRLDYFLASESIADKVHDSYTLPDVSLSDHSPIGLVLKL

SEQ ID NO: 55191 - protein, 74 aa, Sorghum bicolor
  Clone ID: 18070636.pep
TVLAAGNPPGYQLNEPLSAICQNGNFLKPTYIFRGCILNTVTLTNLRKPKAHNGTTIKKERKGEQKDSAPRSHA

SEQ ID NO: 55192 - protein, 66 aa, Sorghum bicolor
  Clone ID: 18070657.pep
KRSRRFGSRKQSDTSSGSSSGDMDLSSPSGSFGQPNLVPDEEACKSSGEQPFMGVPVQVPNLVMSR

SEQ ID NO: 55193 - protein, 51 aa, Sorghum bicolor
  unsure (1)..(51): unsure at all Xaa locations
  Clone ID: 2674234.pep
QCECECECLFLNEIHXXGRGSGFSGXXLQVHFTVECXTCPLFTGWLSGFAS

SEQ ID NO: 55194 - protein, 206 aa, Sorghum bicolor
  Clone ID: 30160722.pep
ELCGGTHVQSTAQIQCFKVTAQSSLGSNTRRIEAVAGPAALNFFQQRVKLVDNIAGMLKTEVDTLENKIQTLLDSQKDLKKELKEVRSQLLAGSTKKSDADQSTLKGQYNNMTVTLHNLSCGDDMTLLRQYGDKLRQSDPQSVHVLFSNNNVICCSEKSDARSVMQAIAPLIDGKGGGSKQMCSGKFNKDLTSALPDVYKLLGVAV

SEQ ID NO: 55195 - protein, 168 aa, Sorghum bicolor
  Clone ID: 30160726.pep
PLRRPYSGNPEILDEKEFGESSTSRSEDAQLSAAEELGLMDWPAESQFLYFQFPSSLPLPRQPQSVANPNVVSNERREDMRPSSHIGSRLKEIPEGYMGRILVYRSGKVKMKIGDALFDVSSGSNCMFVQEVAAINTREKHCCTVGEISKRAVIAPDIDYMLGSVYKE

SEQ ID NO: 55196 - protein, 140 aa, Sorghum bicolor
  Clone ID: 30160739.pep
CFLMAVFLGAAVHSSNAKDDEQKLSMKSADIELSSDFSDKAKLLPAPEESKNGDEEDYSASNELKPGTAEFIIQVEERRSIKVLGHRKLLGLSLVFFAGACFSLFSPAINLATNDQWRALRKGVPHLLVYTAFSLKILLE

SEQ ID NO: 55197 - protein, 96 aa, Sorghum bicolor
  Clone ID: 30160740.pep
LVTGRRPIEPKRSIIERVTTKWAMEKFVEGNAIQTLDPNLEATDAINLAVEKLYELALQCLSPTKRNRPSMKRSVEILWSIRKDYRELVVPTSAMN

SEQ ID NO: 55198 - protein, 91 aa, Sorghum bicolor
  Clone ID: 30160741.pep
ADVLHGEEVLDVFTPLVQVLWRLDPFSVYGCDASLATARSRRQQTKSGVTKIQTSDVAIKPIPTSHLIKLVLLYITTTLFIRGKEGKLTFN

SEQ ID NO: 55199 - protein, 35 aa, Sorghum bicolor
  Clone ID: 30160756.pep
SWGLPNFLRLSTRDCLILAIRSAITWISEYHILVS

SEQ ID NO: 55200 - protein, 184 aa, Sorghum bicolor
  Clone ID: 30160769.pep
FGRAVANRTKEILKPGTPLPTIPANAGEESIANFDKLRNANGTTSTADLRLKMQKTMQKHAAVFRTQKTLDEGVKLIEEVNKEFADVKVTDRSLTWNSDLIETLELQNLLSQARQTMLAAQNRTESRGAHAREDFPKRDDTEWMKHTLTYENPSKPVKITYRPVHMNTLDANEMQTIPPKARVY

SEQ ID NO: 55201 - protein, 158 aa, Sorghum bicolor
  Clone ID: 30160775.pep
WAILKAHPRNNAGEVLLQSADPLDMPAITFNYFDTGNGDYSADLQALYEAVELTRSALANQAVNVTEVLPGAGVTSQKDIETYVKDVAWGHHASSTCPIGADDDKMAVLDSKFRVRGVSGLRVVDASVYPRIPGTFTAVSTYMVAEKAADIMLAELEE

SEQ ID NO: 55202 - protein, 219 aa, Sorghum bicolor
  Clone ID: 30160789.pep
MLPSVLRCSVQRRAGSVASRVVARSFHVTARRSAVVANSKPEVTSAKTTLKSYPVIEHEYDAVVVGAGGAGLRAAFGLASQGFKTACISKLFPTRSHTVAAQGGINAALGNMTEDDWRWHAYDTVKGSDWLGDQDAIHYMCREAPAAVRELESYGLPFSRTEDGLIYQRAFGGQPLKFGTGGQAYRCAAAADRTGHAMLHTLYGQLLRHDTTFFIEYFA

SEQ ID NO: 55203 - protein, 182 aa, Sorghum bicolor
  Clone ID: 30160797.pep
MRHAIFAGLLAAPASVCAVALTGYEYIVVGSGAGGGPLAARLALAGHKTLLIEAGDDYASLNYTVPAYSANASEDPEISWNFFVRHYADDERQARDYKTTYDTPNGEYTGLNPPEGAEMKGTLYPRTQALGGCTAHNALIAVYPHQSDFEYIASLTGDDSWSADNMRKYFVKAEDNNYRPAG

SEQ ID NO: 55204 - protein, 225 aa, Sorghum bicolor
  Clone ID: 30160819.pep
TEIDGERYLEIWNLVFMQYENNPQGRNFTPLPVPCIDTGMGLERLASVLQGKTNNYDIDSMALIMNAVRPVISKKTGKSYSADWETSVRVITDHIRSASFLISEGLTPGMSGRGYVLKRIIRRAVRYGHKLGIREPFLAEIVPALIESIGDTYPELAERIEVIQRTLSQEENAFLMNLDRALEILEQTFGKASNNTIPADVVFKLYDTFGVPADLTELIAKERGW

SEQ ID NO: 55205 - protein, 77 aa, Sorghum bicolor
  Clone ID: 30160838.pep
MPLAVEDRGGTVALMPASLFLLGTRPALLTLLERRGRLPQHIYLGYSITNLVVAVLMAVAFGQVGYSRQDFFTQLTQ

SEQ ID NO: 55206 - protein, 217 aa, Sorghum bicolor
  Clone ID: 30160841.pep
RLLVSCKRGSGTEGCPITRCFSPAELDRVNTKRAGLAVTALDRDGVPYALTCKFLQSNNGYRFISEWKQFLVRNGMDLDSQRHKVWTRDVEVELWAFRSRQLPFQPRIDAEGKVVTATTQDEDGNTVTVVQRVSHHLDADGALGLLLLHHENRRRRVKSEEEEDDDDDHDDDWKGPSSVARKKGKQQSGKQGASASALPAPVAEQGEARRSELTFYA

SEQ ID NO: 55207 - protein, 150 aa, Sorghum bicolor
  Clone ID: 30160851.pep
PGYSACFSKQIGKLELVFVFGKFCLEFLTDISYNSVSVLKAPSFSIFVLYVIIFVYSFFFFSFFPLKGTKLRGTRWFYVKKKLGTQICVSEDMNLCGLDIHPHPQPTELGLDPFLVYSFFSYFISFPCFLIPFSICHVACNYIGRCLFKI

SEQ ID NO: 55208 - protein, 168 aa, Sorghum bicolor
  unsure (1)..(168): unsure at all Xaa locations
  Clone ID: 30160861.pep
MSCVAAWSPPSSSALGRRPCRGGRRRRSSSVRLIRPRAAAVEQEWGGXGGGGXRPRLVLHDSLDAVGVATAHARAAREGFVAQVGRLTRVSAGSSIAISRGPDLARAALCVAAEDDSLVSHSSVPLPVDAFIARLDGLSAGFCAGGNFPPSGAPPEVFFDYLDRYLYI

SEQ ID NO: 55209 - protein, 161 aa, Sorghum bicolor
  Clone ID: 30160865.pep
MAATPDRANADLRRRLAVDTPPPPQIAREKQGLDTEIPLSPQWLMKVGENRDPVSQGIRSDLSKTSGTGEDPGYSAKKKDIFRSSVLDGETGRRDRWRDDEREPNSTHRWSRWRETDKEHGDARKVERWSDDTSQHSVDGHRVPQERWGDSNNKEGSYDQR

SEQ ID NO: 55210 - protein, 146 aa, Sorghum bicolor
  unsure (1)..(146): unsure at all Xaa locations
  Clone ID: 30160885.pep
WVLLXAEQYTSAFNVDNSNYGLQYFVAHEVPKGNITNGTYTVKLIDQIWQQIMPNVTNYRYIIQGDCAEDNYIYNETFGLFYPTSNSARNLGFYRFQTLDANGNPVSSTGSLPSLNPMQNASQTVTTTTVDGNPVTTTSGGITAAP

SEQ ID NO: 55211 - protein, 81 aa, Sorghum bicolor
  Clone ID: 30160887.pep
KVLEPPIVWWETSEISWAALVAIRKKTIQNYNTNGVVCALCLSRKRCLCAYIILCAKAVVLLLLKTMLWISICYCQPIGEP

SEQ ID NO: 55212 - protein, 89 aa, Sorghum bicolor
  Clone ID: 30160888.pep
EGRRWPSGSARPRSRPGPGSGRPCSRSTSAAGPRWRSCDQYSSSPMMMNPCNTMMREQVLFFPVSNDDGWMCGMSVTSPGLRRCHSGRT

SEQ ID NO: 55213 - protein, 112 aa, Sorghum bicolor
  Clone ID: 30160893.pep
EIKQKTLVDMAVDRGCYIDQSQSLNVHMEQANFGKLTSLHFHAWSKGLKTGMYYLRTRAAADAIKFTVDTTLLKENGNVVSNGKPPEEDVEAKMAQMVCSLNNREECMACGS

SEQ ID NO: 55214 - protein, 184 aa, Sorghum bicolor
  Clone ID: 30160894.pep
KEITVSKDDGVRDGITAESLGKIRPAFAKDGSIHAGNASQISDGAAAVLLMKRSTAEKLGQKILGKYVCASIVGVKPLLMGQGPWKAIPKALDLAGISKDDVDIWEINEAFASQCLWCANELGIPQEKINPKGGAIAFGHPLGCTGARQVSTLLYELKRTGQKVGATSMCVGTGMGMAAIWVAE

SEQ ID NO: 55215 - protein, 163 aa, Sorghum bicolor
  Clone ID: 30160901.pep
KASGILSIVFDIGGVLGGISAGFLSDAIGARAITSVLFLFLSIPALIVYRTYGSISMHHNIGLMFLSGYFVNGPYSLITTAVATDLGTQDAIKGNSRALATVSAIIDGTGSVGAALGPLLTGYISTRGWNSVFFMLIVSISLAILFLIRLAKNEIVTKLSTRN

SEQ ID NO: 55216 - protein, 139 aa, Sorghum bicolor
  Clone ID: 30160911.pep
RSEAYPLGGQAYLDIEEDTDMPYLSGIKYHAMPPLKRFRDMEHLSGGEKTMAALALLFAIHSYQPSPFFVLDEVDAALDNANVDKIKKYIKDHRGPGMQFIVISLKAGLFQDSDSLVGVYRDQEVNSSRTLTLDLRQYV

SEQ ID NO: 55217 - protein, 198 aa, Sorghum bicolor
  Clone ID: 30160913.pep
RIKQEAAARSAAEAEAAEARANLSEWEEDSEWEGFQSGAEDDKPSTKRPQRKTQAQRNRIKRRKEEERLAKHKAALKAHRRQAQRIQEIAEEIEERDRNKALVLQKDDETDPIDELRAEKLRRKQLGKYKLPERDLELVLPDELESSLRRLKPEGNMLRDRYRSMLVRGKVESRRHIAFHKQAKRKFTEKWTYKDFMI

SEQ ID NO: 55218 - protein, 156 aa, Sorghum bicolor
  Clone ID: 30160921.pep
ASTLSRRPWIRIPETLQKRQHLVTATMKMAMPLNQDHLSKTRHQTLFHGARLLPRRARDRHHRELSRSRQRSRRRLHLYPLLQGVRLNLTMSFELWLMTVRRYSVVYCVLQSLCIYISLLVVARPVLASHYYIHIVNPHSIPRCKTGHEQTSSRLS

SEQ ID NO: 55219 - protein, 107 aa, Sorghum bicolor
  Clone ID: 30160929.pep
CDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKFGRR

SEQ ID NO: 55220 - protein, 178 aa, Sorghum bicolor
  Clone ID: 30160934.pep
LPSQEKRQYSNAPIRYRAPETQFPDVCQPLSFSSDIWSLGCLLWNVVGQRPLFDAWTLSEDDILQDQIDLLGEIPEEWSAYGAKRSEYWVEDVEEEASTKTTTQGGFTWDDRFERCVQQGRKESGMKPMSKDEKEAFIDMMKKIITFRPEDRITAKDLLESRWTKQWALPELKKLATS

SEQ ID NO: 55221 - protein, 172 aa, Sorghum bicolor
  Clone ID: 30160939.pep
CPIHISRDNRCTKVLKGLLQNLLYLGPIYCLAAAGGFPLLAAPFTAVLAWLLGGGLATLLAPSIVGLTWLLDSGIAALLVLFTAALAWLMDGGFTTLLAPFTATPFGLTWLLLDGGFALLAPSATLLVWLLAGTPQLKTVALLVVIWLPFVFMACFRGDAWQQAGTGVAALL

SEQ ID NO: 55222 - protein, 113 aa, Sorghum bicolor
  Clone ID: 30160951.pep
IFLDSSRFVVPPSQRNATHPQSKATHPNPTLSFAHIYPSIHCQIFTLLSVAAFASLFEGHIFLRLVSFPTSLFFHCLVSCCFPVHRLTRPGFCEVYYLVSYFSRQSCPSSCSN

SEQ ID NO: 55223 - protein, 178 aa, Sorghum bicolor
  Clone ID: 30160956.pep
MATCSLKSLRRPSLTLMSGASKRSFRLNGLISKAATRGLATVTAQTTQPAMMMEDHNTRLINMGYNYNHIEHVENLEQYRLGGFHPVSLGETINNRYLVLNKLGHGGYSTVWLSWDILKQKYAALKIVLADFGEDSTEVDVLQRLEAKAGKKHPGRSLIRHVTDNFHFDGPNGRHTCL

SEQ ID NO: 55224 - protein, 154 aa, Sorghum bicolor
  Clone ID: 30160960.pep
MAAVAPAAGKGKRKRQLSEDDVYLLLHRYAPGTILTALQEVAQHAEGRRIDWKAVVGKPATGITSAREYQMLWRHFAYHHDLEDSVDAGDQPLGDDSDLELELEPNPIPTKEALSEASALAKALISGSSREQASGHRINLDPPVLNTQNEKIVR

SEQ ID NO: 55225 - protein, 160 aa, Sorghum bicolor
  Clone ID: 30160967.pep
MSGRPPPPPPYAISPARRQALAGVEHPTPALLGPPPLVDVSVGRGVCLMSTSWRDKQRPDLVNFIATFLATNLYRLNFLSLSPDFLFNNGGLSVAFIFETDWLPEREAAVFSRVNTLKRQFKYLYVVVVVRSAEQNESFNQSYFKYGMELGCPTFVPVCD

SEQ ID NO: 55226 - protein, 83 aa, Sorghum bicolor
  unsure (1)..(83): unsure at all Xaa locations
  Clone ID: 30160976.pep
MSDSNVKWIDGLQFTSLYWPPPQDVEQKQAQILAYVEYFGQFTADSEQFPEDVAQLIQSSYPSXESRLVDEVLATFVLHHPEH

SEQ ID NO: 55227 - protein, 160 aa, Sorghum bicolor
  unsure (1)..(160): unsure at all Xaa locations
  Clone ID: 30160991.pep
MVVGEAAAAAGNEMSLSNMVLGFYEEAEKERWPPEDATAAATTAGDGGSDDDDDEGSSPSGGRAQSAAFWREQRSPLAKTSSAESRIQADTEEAVRQMRATPGGVCSCXDAGYNSAVCRSKWSRTPEIPSGEHSYVDVVVPTRRSGKAVRVVIEPSFRAE

SEQ ID NO: 55228 - protein, 183 aa, Sorghum bicolor
  Clone ID: 30160997.pep
MGVTDRIIQIGGQISGNPTAGGRDKILQKNPDDIVVTAACRSAFTKGGRGGFKDTPAADLMAGVLKAILDRSKINPALVEDLCVGTVLAPGGGATEMRAASLVAGFPESIAVRTLNRQCSSGLQATVDVANQIKTGMIDIGIGAGVESMSLNYGPGAVSEFSEAFESHPEAANCKVPMGVLSE

SEQ ID NO: 55229 - protein, 220 aa, Sorghum bicolor
  Clone ID: 30161003.pep
LRRYVSGSITDEQRKNVLRNSCPGAGACGGMYTANTMASAIETLGMSLPYSSSTPAEDPLKLEECHLAGKYLLELLKMDLKPKDIITEKSLRNAMVIVMALGGSTNAVLHLIAIARSVGLHLTLDDFQKVSDQVPFLADLKPSGKYVMEDLHKIGGTPAVIHYLLEQGLLDGDCMTVTGKTLAENAKIFPPLSEGQQIIRPLDNPIRSTGHIQILYGNLA

SEQ ID NO: 55230 - protein, 209 aa, Sorghum bicolor
  Clone ID: 30161007.pep
PPPFLPCPQTSLPTSIPAAPMEAAAAAPARGLGRHEYAVLALTFASYASFHASRKPPSIVKAVLSADWAPFTGARGPHRLGELDVAFLSSYALAMFAAGHLADRADLRRLLGAAMLASGAACAALGAAYFLDVHALAFFLAAQVASGVVQTAGWPCVVAVVGNWFGHASKRGTIMGVWNSHTSVGNIAGSVLAAAVLEFGWGWSFLVPA

SEQ ID NO: 55231 - protein, 114 aa, Sorghum bicolor
  Clone ID: 30161017.pep
MGKLIRLELFNFKSYKGHHVLLFGDSYFTSIIGPNGSGKSNSMDAISFVLGIKSSHLRSAHLKDLVYRGRVLKTAKINDDGSAQTNGHANGDADGNDKASRGDPKTAWVMAVYE

SEQ ID NO: 55232 - protein, 201 aa, Sorghum bicolor
  Clone ID: 30161019.pep
MPLLQSKNATGGDAPKQFNQPSRKGKKAWRKNVDVTEVQKGLEELNKEIIAGGVIKEKPSEDLFTLDVKGDAALPKKFNKHIKKGLKADEIINARSPVPAVSMRKRPGDKTTNGILPVKRQRTDWVSHKELARLKRVADGEHQNTVQVQDATYDIWDMPVEPQAKDPENFLEEEVKPKAPKTMKKEPLSLLESGKQVPAVL

SEQ ID NO: 55233 - protein, 130 aa, Sorghum bicolor
  Clone ID: 30161023.pep
MSFARRLDPSAYTDNLYIHKFATPSSTFAARRFSSDTQLFRYDPEPYNEYGHMGFTGAPSAAFQNSLCSQQASLKPYHVTNDGRSPSVADTQSNSCSDAAKDSPVVSNVSQQNSQSVSDSQSSEIEVEFD

SEQ ID NO: 55234 - protein, 113 aa, Sorghum bicolor
  Clone ID: 30161027.pep
DIPSTLESCQDRIYSSKRIRALTLDSKPPFLKQASFQRLISSARIPCLTCFFDKEVRTLHQIFFPWRPVIWHHSTGLDLNPGPDYHTSLTGPFLPGPILPNGFSSSSLQVPPE

SEQ ID NO: 55235 - protein, 99 aa, Sorghum bicolor
  Clone ID: 30161039.pep
ESLVHGVPMVAWPLFAEQRLNAVMLAEGVGAAIRLPERKDKETIAAVVRELMAGEGKGAMVRVKVAELQKAAAEGLRDGGAATAALDEVVEKWEADEAN

SEQ ID NO: 55236 - protein, 161 aa, Sorghum bicolor
  Clone ID: 30161058.pep
LKTTTVDRDDTAELTDDVLGEGFLERVQGRGLVTKAWVDQEAVLKHASVGLFLSHSGWNSVTEAAAAGVPLLAWPRGGDHRVNATVVVSGGVGVWMEQWSWDGEDWLVTGEEIGKKVKEVMFDAAVRARATRTGQEAAKAVAEGGTSYRSTQKFISSLKAT

SEQ ID NO: 55237 - protein, 156 aa, Sorghum bicolor
  Clone ID: 30161064.pep
GKTLCARAVANRTDATFIRVIGSELITQLDGFDARGNIKVMFATNRPSTLDPALMRPGRIDRKIEFSLPDLEGRANILRIHAKSMSVERDIRWELISRLCPNATGAELRSVCTEAGMYAIRARRKVASEKDFLSAVDKVIKGNLKFNSTATYMQYN

SEQ ID NO: 55238 - protein, 67 aa, Sorghum bicolor
  Clone ID: 30161067.pep
TEKKGTVILTLGISLKFLKAIPLLGGLFFTFHPSCNLTHPKRKGYSSNKPTLNTGAMNWLKQKKKQA

SEQ ID NO: 55239 - protein, 165 aa, Sorghum bicolor
  Clone ID: 30161076.pep
KTRFKYMDVTKNAYGLTDEDILYADDKALNQFVSLKKIQPYRADEGQVNMQTLRKKKHEVKKTAERNKKGVDKDLAKFEKKEEEMKKAGATKEEIEEFRKQQNALSAKHSNRGSRRGVKLIKEEDVVDDDEEVVDEDNADAEAFEPKKNKKMKIDSSRLKSYGLA

SEQ ID NO: 55240 - protein, 87 aa, Sorghum bicolor
  Clone ID: 30161079.pep
SINTTFEDPTVPVEIKDDQNNLPLSVISIDHLPSMLPREASEAFSEGLKESLLTLKDRKTSRVWADAEKLFHEKVATLPEELRTKNV

SEQ ID NO: 55241 - protein, 128 aa, Sorghum bicolor
  Clone ID: 30161087.pep
TLARRALRLDAAGPYGYYADVASLPLYGSGLYPIGIQAHASTAAHPDQQRREDAGAGAGAELRRPARGLLSPMPFLVADEEMSFGWPGSFRPAIPAAAAAAPAGSAALNSAGGVAMHAREEPDLTLRL

SEQ ID NO: 55242 - protein, 104 aa, Sorghum bicolor
  Clone ID: 30161090.pep
RGLDVPDIKFVINYDFPGQLEDYIHRVGRTGRAGREGVSYTFFTREDWKHAYKLIDILEETRQKAPEDLYRIARRPVPRPGYVPQPRKYEPEVIVKPTHTRLDA

SEQ ID NO: 55243 - protein, 135 aa, Sorghum bicolor
  Clone ID: 30161095.pep
LGTRSCLSRPHSPVPISFQCFMMCFQRLVIAANQPNVINHESEVRSTLVASELELELGRAFRSNDAELAVAEVVAALRLREGVESLNLILAKADLDTADIVGGERNLLTVGNEVSVGENVVLTLLNVVEGLAERT

SEQ ID NO: 55244 - protein, 157 aa, Sorghum bicolor
  Clone ID: 30161100.pep
AATMAVQAGLIYQVENNTASSHAAGIAAAAMLFIFQGAFTIGFQATVWVYPSEILPLRLRQRGSSISTAANWIFNYMIVQITPISINNIGWRTYIIFAVLNTLWVPLIFLFFPETKGLELEDVDQLFGGEEIIRNLDEKNHGTVTMLESVNGDGTGV

SEQ ID NO: 55245 - protein, 102 aa, Sorghum bicolor
  Clone ID: 30161102.pep
DDNDDANRSSDANTVGSGLNPGTSDVKKADNGSVDSDYVYDPSSGYYYSSSTGYYYDPNSGYYGYASMGTWYSYDEQTGTYKEIQDEQTSTAKEELGDAIKE

SEQ ID NO: 55246 - protein, 113 aa, Sorghum bicolor
  Clone ID: 30161115.pep
SNTTVPVGGATLTETPPHTTSPPLPLPHFAPLLSPRTSLSLSPSPPFGEHKGQLVRSFHSHGLSRDCWFLGIVVFFRPDSDGLKRCTEFCFWVVEVRQRNQVTGEKIVAISQR

SEQ ID NO: 55247 - protein, 206 aa, Sorghum bicolor
  Clone ID: 30161118.pep
MYPKLDSGNPAPPPFRSYNHSDNRDRNDSYRSRDDSYRSRDRDGGRDSRSSYYNHSRSSYGNSDKEKQRDSDRDRSFNSRPSSNFSSGGYNSGFNSGSNFQNNGRDKNVIAGASLPKIDWSQMELSPFQKNFYTELDSVKNKPQKEIDDFRNEHQIIIRSTFAPRPIFSFEEANFPPYILEQLTSKFKTPSPIQSQGWPAAMSGLD

SEQ ID NO: 55248 - protein, 225 aa, Sorghum bicolor
  Clone ID: 30161123.pep
PPNSVSHSLSFHPFGSAIITLTMRSFITFAALALSASDLVSAGPCKPRPTTTAAAETSATGIETSATAGVDTTATVGTETTDVASQPTLSPEDGPVTNACTGGGMTSLDPFVVQGDVSINGDDGYTGDDSPDTSCADLKAESTGPTRKRAAGTVAAIGQPLTGLDTKKKYTVQFYYRVSTPPSENTACTIEASIGDVSFYSAGILANGATVSYNHVLVSTSVNAA

SEQ ID NO: 55249 - protein, 75 aa, Sorghum bicolor
  Clone ID: 30161124.pep
KSEMQKSDHHEQKLTSPRGLIHKILRRTNSRRSPTAADQQPSPVSPETSNSSIFSKQKDADDAIKDSEKPSTHTI

SEQ ID NO: 55250 - protein, 191 aa, Sorghum bicolor
  Clone ID: 30161127.pep
MELQGRRLILTVSVLTSLGFMLIGYDNGLMGGLVNTSAFKDTFDSPDADMIGVIVAIFEIGCFFGAIFAAIWGEKLGRRRSILIGCIVLIIGAVLQAASFSRAMMIVGRIVSGLGLGTVNSTVPVMQAEFSPKSSRGIYVCAQLSTLNFGIFLVYWIDYALSSHTGSYAWRVPVILQCVPIIIIICLLTII

SEQ ID NO: 55251 - protein, 218 aa, Sorghum bicolor
  unsure (1)..(218): unsure at all Xaa locations
  Clone ID: 30161129.pep
NGKAPNTYSSSARFVSSRLLPQLKEGDDAKGGAADLKGFEVRYNDGVNFVDDGIRIEPFNLEREREEGYFDENGNFVEYARGNEIKDAWLDSVEVDPTYAAKVQKKGKEKVEEFEDLSSDDIGRLKRQIANLLEPGETIMQALKRLKGTSKDKRGKMAEGTKRIFDELTEAAMKLMENGDYXVYSDDRETFDREAAGYERLARARLGSPEVDGVSEDQ

SEQ ID NO: 55252 - protein, 144 aa, Sorghum bicolor
  unsure (1)..(144): unsure at all Xaa locations
  Clone ID: 30161164.pep
LVLVHHDTTAPQPSVLPWHRRRRRAWESSTAAHARMSCSSQAPAWATSSRSSASSRRSRRTTSSTSPWXPFSRPSLPPRPTTSPASSLPSPASAASTSTSCRSTRRRSSQATTRSCSDGRPCAARRTSSARSSPAPPARASPPS

SEQ ID NO: 55253 - protein, 180 aa, Sorghum bicolor
  Clone ID: 30161172.pep
MPSATGSNWEKYQKNFADDEVEEKKITPLTDEDIQVLKTYGAAPYGTSIKRLEKQIKEKQQSVDEKIGVKESDTGLAPPHLWDVAADRQRMSEEQPFQVARCTKIIADEKGDEAKSKYVINVKQIAKFVVQLGERVSPTDIEEGMRVGVDRNKYQIMLPLPPKIDASVTMMTVEEKPDVT

SEQ ID NO: 55254 - protein, 131 aa, Sorghum bicolor
  Clone ID: 30161176.pep
SFTRLHQPANVLSPPIYLFRRIWKQISSRTPAKAVSVSTHLNVSDNVTVAMPSQKTSNGPGQVSHRLRNFFRMNTGGSTGSASSDKEKEKEKEKGSAATTPDPSKSRHTKFFSNTVGRLRAHTVASEGNQL

SEQ ID NO: 55255 - protein, 215 aa, Sorghum bicolor
  Clone ID: 30161184.pep
QKILWEEDKTQKIDKFNINQKFAKKFDQRKKREELEKAKVKYGRDLNQMLDDESGSSSSSAPEDEVGDLVTGNIGSKFIKTLAKLRTKDPEIYQQNKFFFDEKDFDEVPVKDKKAKENPIYYKDLVRQAVTEDKKKKKTPREVHEEEQEDLKKAFKMAANGGEGDDDLLKVRKKTKKQIEDENTEFNKFLEQENEKSKPEEVDMLQRFWGDESQL

SEQ ID NO: 55256 - protein, 174 aa, Sorghum bicolor
  unsure (1)..(174): unsure at all Xaa locations
  Clone ID: 30161187.pep
MSEYPHILLRAEEKPLEHRSFSPAVIKTLVDAGYPISVERSSTDPKFRRIFEDSEYEAAGARLVDTGVWPNAEPGTIILGLKEIPEEDFPLKNDHITFAHCYKNQGGWEKVLGRWSRGGSTLYDLEFLHDAXGRRVSAFGFHAGFAGAALGIKTLSHQLQDPSSKLPSVETFTD

SEQ ID NO: 55257 - protein, 145 aa, Sorghum bicolor
  Clone ID: 30161213.pep
GYIADYLNREEVKEALGVEVSSYDSCNMDINRNFLFAGDWMQPYHQLVPNVLDKIPVLIYAGDADFICNWLGNQAWTDKLQWSGQKDFSHAKIKNLEHDGKEYGKVKSSGNFTFMQIYGAGHMVPMDQPEASSDFFNRWLSGEWF

SEQ ID NO: 55258 - protein, 129 aa, Sorghum bicolor
  Clone ID: 30161229.pep
LTSYIIYLYKRSCRGPRRQNTCHQGRRRRTLVHRRHPTRRQGNGNARMQMQKVWCSTVASCRHMTGRCLALTPCRDLFYLLAWVCCWMRCLHCIGPMIGPAIRRADPPTCMQCSGRRRALRQRRRWRPW

SEQ ID NO: 55259 - protein, 140 aa, Sorghum bicolor
  Clone ID: 30161236.pep
EKKRKKVVRKKLPQDVIDSIVAKPCKIVYELSDEDLADKSQQFREAYRRAMLVHEKVRSYEQALMEQYRATGSVEDEIEVTDDEDEGTGENVTGDEETSANKVTGSVEDEIEVTDDEDERTGENVTGDEETSHISEQGHR

SEQ ID NO: 55260 - protein, 71 aa, Sorghum bicolor
  Clone ID: 30161250.pep
LASCNQFITLQQSNRRTYNNNNNTTAPSGNGNGVPAALICANMERIMMTQIHHEAPSEKRVIRQEGAGNGR

SEQ ID NO: 55261 - protein, 146 aa, Sorghum bicolor
  Clone ID: 30161261.pep
LKDNLVEKEDNGNNLDEAQDNNASGSVNPPQPDEKEVHGNNLVEAQDNSANGSVNSQSDDEWPFEVVDNEIVLTAQTTTSAEVRQASPSMKCETTAMAEAPTAPVPPYDTSSPINPRSENRVSPTGRILEAWGELMISCCSGLCPP

SEQ ID NO: 55262 - protein, 157 aa, Sorghum bicolor
  unsure (1)..(157): unsure at all Xaa locations
  Clone ID: 30161274.pep
MVNFGKKLMADQIPEWKGYYINYKLMKKKVKQYGQQLQQGEKDRRRDLKDFSKMLDDQTLASLWIFNLLIVASTXIEKIVLFLLEQQGMLASRIEKLGKQRAILQEQPDISGIAELREAYREVGIDLIKLLKFVDLNATGIRKILKKFDKRFGYRFT

SEQ ID NO: 55263 - protein, 160 aa, Sorghum bicolor
  Clone ID: 30161278.pep
MTLGAAADDMEAAGGERISGRRARFTEDWCCCACAGLFLGPNPMMARYMYALIFLVTNLLAWTLRDYGDSALAELQRLKVCQGARYCLGAEGVLRVSLGCFLFFFVMFLSTVNTRKVHECRNSWHSEWWPVKLVLWLGLTVVTFLAPSPLVQLYGKVAHF

SEQ ID NO: 55264 - protein, 153 aa, Sorghum bicolor
  Clone ID: 30161281.pep
MVAPAVPEITEEILHESIDARTESLSGLRELGPPDLVHLLKHAVRNPAKQTGVYHHVTGVDASSSASLAAYINTLTYKESGPNATNKIVEGVYCCYNAFSRLDMRVHVSIPGTVESYCVDERGEKRKASEELWLETYLCSVLRAYSYADDGSG

SEQ ID NO: 55265 - protein, 222 aa, Sorghum bicolor
  Clone ID: 30161286.pep
SGGESKAHGDAAMSSTTAGTYPAESVSSCHPPTPPPPPYPASASAIHGGAPLRRRFDFADASSGGDPEEEEEEEEEEEEDDDDFIRVVEYIERAQPCVCGRGRCAVERDEQRGRWVYVCPSQPKCNYVSVCEEVGLDPRSQPAVRSHPSPSNNCVISISSNHVAEPRTPINNVNLRGAGATTPNIISPQATIYIPKTPLNSTFQSAGTSTPLHVSPKGPSAT

SEQ ID NO: 55266 - protein, 73 aa, Sorghum bicolor
  Clone ID: 30161306.pep
MSSSAEAERGGAKKQSWPEVVGLSVEEAKKVILKDKPDADIFVLPVGSPVTRDFRPNRVRLFVDTVAETPRVG

SEQ ID NO: 55267 - protein, 194 aa, Sorghum bicolor
  Clone ID: 30161315.pep
MMNYVILGVLLFVLGAVCGLRPSPAAADVFCDNLKQVAATLPQNTSSSPVQFATSIVGQAPDVVYALAFCQGDYNATACGECVAKAFNTTPPPDQQCWGGFFLYNACPVFYSGDDIIHPSNATQAYDDPFVRWNIKNVTGDDADDVRLVTGLIHELVVDTVERAASTAPRRFATGVMDSGTTFPTVYSMAQCTP

SEQ ID NO: 55268 - protein, 224 aa, Sorghum bicolor
  unsure (1)..(224): unsure at all Xaa locations
  Clone ID: 30161322.pep
FNATILNGMGVIGYVKDQPLWQPSEDIGNLLSVHFTYSDVIWPWTGYLALHLQVKDEGSQFSGIISGNVTLTIYTPAAHGESSPRSSTCVLHLKIKVVPTPVRSKRILWDQYHNIKYPSGYVPRDSLNVHNDILDWHGDHLHTNFHILFNMLRDAGYYIETLGSPLTCFDASNYGTLLMVDLEDEYFDEEIQKLRDDVIHKGLGIAVFAEWYHVDXMVKMTFFD

SEQ ID NO: 55269 - protein, 193 aa, Sorghum bicolor
  Clone ID: 30161324.pep
MRLSTSALVLGAASSAVGLQEQQVLSGDSKPLVDINVNAWTKPLEKFFGEISSEAKAVWDEVTLLAPDAVEAFKKQVLTQPKKANRRPDAHWDHIVKGADVQSLWVEKDGEKHREVGGKLDNFNLRAKKVDPSKLGVDKVKQYSGYLDNEEEDKHLFYWFFESRNDPKNDPVVLWLNGGPGCSSLTGLFLELG

SEQ ID NO: 55270 - protein, 219 aa, Sorghum bicolor
  Clone ID: 30161331.pep
IWKELYPEEPFKLEFTKTSDVVMDVNPGVAEDITYDLVSAVKRQSSFYYQVGTPTMHDSRFLQEALARYKAFLYLIKMNQEKGLQRFRVPTYDVDLLWHTHQLHPVTYRNDMVKLLGKVLEHDDTDADRSEGKKLDVGFTETTEQFENTFGVRYWKAGCMYRGNMPSPVTSTPQIFSTEVGTGSDICKAQKDLNALDITAVELYLQIVDINNLPSAVRK

SEQ ID NO: 55271 - protein, 186 aa, Sorghum bicolor
  unsure (1)..(186): unsure at all Xaa locations
  Clone ID: 30161339.pep
MASTSPRRSSGGDPPSPSTPLISSPTSPASGPSGGGPLGRLTSLRGAARFXAEHLEERQTDWAYSKPVVVLDMLWNLPFVAVAAAVLAASTGESPAVPLRVWIAGYVLQCLLHILCVTVEYRRRSRDADQEGAGDEDFKLSVVKHLESANTMFSFIWWIVGFYWVSAGGQALSHDAPQLYWLSIVF

SEQ ID NO: 55272 - protein, 147 aa, Sorghum bicolor
  Clone ID: 30161340.pep
MAFLLAVACIYIVVSLLTLLVLLVVSRRRTTAVTAGKTGGATTEQDHNKLPPGSLGLPIIGETLQLYTQNPKDFFASRLKRYGEVFKTHVLGCPCVILASPEAARMVLVSQAHLFKPTYPPSKERMIGAQALFFHQGDYHRRLRRLV

SEQ ID NO: 55273 - protein, 120 aa, Sorghum bicolor
  Clone ID: 30161348.pep
NLDLLSLFLLPAFIFIHVRYTPSRRTTDAQRGAPAATTSPRLPSGPDAPAASAARWGSCTARLRRRLHRRPASLLELLLGLQVTAKYWHDVNLLAHKRDHEYSFAKRTRLYIRGGVWCVA

SEQ ID NO: 55274 - protein, 59 aa, Sorghum bicolor
  Clone ID: 30161358.pep
TIQSAIQSYFRDHFAIEPSETISPLKFCSVRRDQGHREVDVVCLEIVGSVLMGSSSSCL

SEQ ID NO: 55275 - protein, 136 aa, Sorghum bicolor
  Clone ID: 30161391.pep
PPDGAARLHSTRVLGTFGYHAPEYAMTGVLTHKSDVYSFGVILLELLTGRKPVDHTMPKGQQSLVTWATPRLSEDKVSQCVDPKLGDDYPPKAVAKMAAVAALCVQYESDFRPNMTIVVKALQPLVKAAAATAGGA

SEQ ID NO: 55276 - protein, 81 aa, Sorghum bicolor
  Clone ID: 30161393.pep
AKVSRSVCMLSNTTALGSVFARIDAKFDLMYAKRAFVHWYVGEGMEEGEFSEAREDLAALEKDYEEISGSDQPEGEAAEDF

SEQ ID NO: 55277 - protein, 88 aa, Sorghum bicolor
  Clone ID: 30161404.pep
RWWAQAEAACWDGVRAQARGHQEAGGHDDKLAVPARQPRRAHALRGLPGGLLILQVEGHRSIHQQQQQMQEFCHAAFSSRHELSLTQY

SEQ ID NO: 55278 - protein, 199 aa, Sorghum bicolor
  Clone ID: 30161441.pep
ALLQVLRSKLGYNQETLNKLSFFKDLGTNVGIISGLVQQVAPTWVVLLIGAGMNLAGYLMIYLALTGRTAAPPVWLMCFYICFGANALTFSNTGALVACVKNFPESRGIVIGLLKAFVGLSGAIYTQLYLAIYGDDAASLVLLVAWLPAAFNIFTVYTIRVLPYARRADDGGKPYNTPFYHFLYLSLALAAYLLVMIVV

SEQ ID NO: 55279 - protein, 96 aa, Sorghum bicolor
  Clone ID: 30161500.pep
MMAECQGGGGGDFLIKLFGKTIPVPESGDAKDLQQSSSSSSSTEQDHQDAHALDQENPHPDSSDPSPQPEVVDAEDPKSSPETTHQKPGQGNGSGD

SEQ ID NO: 55280 - protein, 181 aa, Sorghum bicolor
  Clone ID: 30161503.pep
MALRTLASKKALSFALGGAARPLAASARGVTTVTLPDLSYDFGALEPAISGEIMRLHHQKHHATYVANYNKALEQLDAAVAKSDASAVVQLQGAIKFNGGVLVVVQESVLFGWLLLLELQLLMFRPIKWFHGMSSHLCTMSYIYLSCSSIPLTCLRLWLYCTPCVPNCHVNHSIFWKNLKP

SEQ ID NO: 55281 - protein, 190 aa, Sorghum bicolor
  Clone ID: 30161505.pep
MSQVHAPHVVMLTSPGVGHVAPVAELAGRLAAHHGFTSTIVTYTNLSSPTNSSALASLPPGVVPTTALPEVPIDDLPADAHIVTRILVVVQRTLPHLRALLRSLLDAPAGITVFLTDMLCPAALAVAQDLGVPRYVFYTSSLMSLSSLLDTPELARTTTCEFRDLPEPVVIPGCLPLRGADLVEPLQDRA

SEQ ID NO: 55282 - protein, 164 aa, Sorghum bicolor
  Clone ID: 30161508.pep
MEALRAWRASSNLIGFAASRAAASRTLGLRIRCCSAAAATTNPPAQPQDRRRRSASSSASTSDRDSIRAIRLKKVEELRAKGHEPYAYKWDRTHTTKELQEQYAHLVNGEVCEDVSVSVAGRIVARRAFGKLVFMTVRDDSGTMQLYCEKDSLTEDQFEQLKAF

SEQ ID NO: 55283 - protein, 158 aa, Sorghum bicolor
  Clone ID: 30161509.pep
MAGSSSEEKAVAAVQNKKVVLRRHVTGFPTEDDMEITVDTTELRVPAGLTAVLLKNLYLSCDPWMRGRMTKHEDGASVPASDFAIGEAMVNYGVGKVMDSTHPEFTAGDLVWGMSGWEEYTLITQPESLNKINHADLPLSYYTGVLGMPGLTAYAGFT

SEQ ID NO: 55284 - protein, 120 aa, Sorghum bicolor
  Clone ID: 30161515.pep
ALNQLEKGHFKAMQQKVETMEKWHFKVIQQKVETMEKGHFKTTQQKEMETMCRDICDDHKLCPQFVHHTQIISYSLPVYISISEHVRLSEEPWLKGSSLGKIRLLLVEHCVIAMDAHKHL

SEQ ID NO: 55285 - protein, 144 aa, Sorghum bicolor
  Clone ID: 30161531.pep
RKQMESGQAGDNVGMLLRSLQRDEVFRGQIICKPGSLNVHQKFQANIYILKEEEGGRKKPFVSGYRPQCSIRTADVAVDINLPESVKMALPGDNLVVDMKLDVPLAIVQGLRFALREGGKTVASGVITQLLKDDEEAAEEPKKK

SEQ ID NO: 55286 - protein, 113 aa, Sorghum bicolor
  Clone ID: 30161533.pep
SMLTYKQAFPEILRGVPVQPHVRRYTPPFNEFEVDCCLVPPGELLVISPVPGPSVFLVMTGEGEIQLDSMSGGEKAKEGDVFFVPAYTEVKISACGPESVLLYRAGVNSRFFS

SEQ ID NO: 55287 - protein, 208 aa, Sorghum bicolor
  Clone ID: 30161534.pep
PKAEPAGDLQVGACLASIKRLFQQLVHVRTIISSFSGKLPSDAWFNHVKHLTSDAEESLEHLHYQMMLAKLGVGVGTHLEKVMPKVSGTRSKTTAISFMHLLASQELVILPVTDKLEGLRHGSPGLSGVVLGNYSDMLSLSSSVIRCILLCRGILGIINMVNMEGKDKSLELPVFAFDDLTYAGLNKGIGMNAHSVPAHMTDPIYLLP

SEQ ID NO: 55288 - protein, 127 aa, Sorghum bicolor
  Clone ID: 30161535.pep
LKMVTDPTPYNDKVLVMPNLYGDILSDMCAGLIGGLGLTPSGNIGDECSIFEAVHGSAPDIAGKNLANPTALLLSSIMMVGHMGLTEHASRIETAIFDTLAEGKALTGDLGGKAKTKEYAAAIISRL

SEQ ID NO: 55289 - protein, 186 aa, Sorghum bicolor
  Clone ID: 30161547.pep
SLIAMCSSTEAIAYMITFGFSAAVSTRVSNEIGAGNVERAKNAVSVTMKLSVFLAVTFVLLLAFGHGPWARLFSGSATIVSAFGAIAPLMVVSIVLDSAQGVLSGVARGCGWQHLAAVTNLVAFYFVGMPLAVLFAFKLDLRARGLWAGLICGLTCQASTLLVITVRTKWSKLAEAMQEKKASYVA

SEQ ID NO: 55290 - protein, 37 aa, Sorghum bicolor
  Clone ID: 30161550.pep
LFVGTRAKRENADAQRCRRGQRSSQRKTNMNTTIRTK

SEQ ID NO: 55291 - protein, 160 aa, Sorghum bicolor
  Clone ID: 30161572.pep
VMKTAKEKGVKIHLPVDIVCAENPESKDTKIVSVEEGIPKNLKGFDFGPKTIEQNSKIIERAKTIVWNGPLGLFEQPQFATSSIAVLDAMERATKKGALTIAGGGDTGALIQKQNGESKISHLSTGGGASLELLEGKKLPGVEYLTNLDDLKDVKQQVKA

SEQ ID NO: 55292 - protein, 126 aa, Sorghum bicolor
  Clone ID: 30161583.pep
HLLTVYMHPSSSDDLKAKAKKGLKAILQMCLYLPALEPLISEAPNEILQYVLAQFAKILPNDNVAKKTFVMSEGLAKIQRIRAEPGTKLALYVQEINSLYPPEVVQYYSPDYADTLLKKLDEYNPE

SEQ ID NO: 55293 - protein, 210 aa, Sorghum bicolor
  Clone ID: 30161594.pep
MSMLKKVGIENILNLIPNRRVLLRADFNVPVKEGKITDTKRIDATIPTIKKTLESGAKSVVIMSHLGRPDGKKNPKHSLRPVVPALEQALGKKVTFLEDCIGADIESACRNAPEGSVILLENLRFYPEEEGSYKDNQGNKVKIEKSRMKTFGESLTKLGDIYINDAFGTAHRAHSSITGINLPIRAAGYLLKKELDYFGKALEDPEKPFL

SEQ ID NO: 55294 - protein, 204 aa, Sorghum bicolor
  Clone ID: 30161606.pep
MSRAVLQPFEVYQKARVQFVQTVAELATKPQNIEALQNAGVMALLRPLLLDNVPSIQQSAALALGRLASYSDDLAESVVNSQILPQLVYSLAEQNRFYKKAAAFVLRAVASHSASLAQAVVDSAALEALVVCLEEFDPSVKEAAAWALSYISKHTPELAQSVVDAGAVPLLVLCIQEPEITLKRIAASALGEICKHSPELAQSV

SEQ ID NO: 55295 - protein, 222 aa, Sorghum bicolor
  unsure (1)..(222): unsure at all Xaa locations
  Clone ID: 30161617.pep
SSFISCSQFSTPGRPKPPKPSSPSGGRRPSPKPNAPTAERCRCRSRSRRAASCRRSSRSRTRTSPRPRLPAVSAARTRSSRRRRRPRPPRGPCASRSRSPRWRRPASRSTTGSSRSSRARRPTSPRRRSSPATRSTPTAAPRPSPAPPSSPRSSARAASRTSSRCTASRSRXRRPAHRRHARALPLRARCAPPRRRRAPPPPPPRPPRFPRAALPDGLPRRR

SEQ ID NO: 55296 - protein, 47 aa, Sorghum bicolor
  Clone ID: 30161618.pep
ASAINSTHLVILQVAYFIASELAMKLEALACVYTQSASKPIYINKSL

SEQ ID NO: 55297 - protein, 61 aa, Sorghum bicolor
  Clone ID: 30161622.pep
AGEGARRRRREGEDVNVAGPVALPWPSPLSLPCPPPTARDRLPARHLNSEMERPGLRSPHR

SEQ ID NO: 55298 - protein, 208 aa, Sorghum bicolor
  Clone ID: 30161632.pep
MFKNILRLNQAPKAFQPSIYNVPSFNFAKFVRDRPHLNVGTIGHIDHGKTTLTSAITKVLSKQGNAQFVDYGNIDKAPEEKARGITINTATVEYQTKTRHYGHVDCPGHADYVKNMITGAAKMDAGILVVSATDGAMPQTREHILLCRQVGVQKILVFINKCDVANDPELQELVEMEVRELLSKYDYDGDGAKVVKGSALCAMNDTEP

SEQ ID NO: 55299 - protein, 206 aa, Sorghum bicolor
  Clone ID: 30161636.pep
MEDPPALAPPEPEPEPEPEASPAPPQRLLRLRCAVQHYEWGQHGAASLVARLADQNPDPARPYAELWMGTHPSGPSTLLGDGALLRDWLARNPDALGPAVAARWGGDLPFLFKVLSVAKALSIQAHPDKKLAEVLHALRPSTYKDDNHKPEMAIAFTEFRALCGFAPIEELKDVLRTVPEIEGLIGHEDTGKLMNMKEYDGVSEVK

SEQ ID NO: 55300 - protein, 164 aa, Sorghum bicolor
  Clone ID: 30161637.pep
LLVSTLKNPRVIVLALLMTPRHELIPRHALITRSASSMRTPAEPSPPRSPRTTSNYFPPAGTSPTFVSRTSLTSLVTSGRRGDQEEAEQRANSGGGAATLRQRRRGAQAAWPPGRRRSSDPTADAAQRPGDFVAHFAGEENHQVCQSLLFPSCCVKRSTQTLFS

SEQ ID NO: 55301 - protein, 183 aa, Sorghum bicolor
  Clone ID: 30161639.pep
MLAIRALRTPASRQALRAATPRAAIFYNRCYSTSGERVAKYNGTKDANGNFLVSLIEGDGIGPEISQSVKDIFAAAKTPIAWEPVDVTPIIKDGKTAIPDAAIENIQKNKIALKGPLATPVGKGHVSLNLTLRRTFNLFANLRPCRSVAGYETPYDNVDTVLIRENTEGEYSGIEHVVVDGVV

SEQ ID NO: 55302 - protein, 218 aa, Sorghum bicolor
  Clone ID: 30161648.pep
MLIAESHLHAIIPRGRLRQRDRGRAHDISTTAAPRFLVGSRRSAAAAGSRRLLTGGHRRRPFAASSGGTLQPAGGASGPSSDGGGSMPSSAPLLGAEEAGGGEPAPAPRPSSWSWVERVVDTAEARAQLRFAVPMVVTSMAYYGIPLVSVMFSGHLGDDVHLAGATLGNSWATVTGYAFVTGLSGALETLCGQAYGAGLYRMLGLYLQSSLIMSAAVS

SEQ ID NO: 55303 - protein, 169 aa, Sorghum bicolor
  Clone ID: 30161651.pep
MPKDTNLHKAAYKGDVNVVIELLEQGDDVNCRGAQMRTPLHRAVGKGHNACVEVLVKHNADLNLVDGGGLTPLHWAALFGLVETGKILVNAHADLNIVTKAGETPLHLCAEKGKVDFVKFLLASGARTDIKDKSMNGGLTAYDAAKKAGQKEVMLLLQPESPKGCCTVM

SEQ ID NO: 55304 - protein, 208 aa, Sorghum bicolor
  Clone ID: 30161665.pep
MLFRSLTKNFVRNFAKQAKGARTQTASTESVEETTRSEETQTQARESTGVVSAGKISQVIGAVVDVQFEENLPPILNALEVQGVQSRLVLEVAQHLGDSRVRTIALDSTDGLVRGQEVRDTGNPIMVPVGPETLGRILNVIGEPIDERGPVGSKKFYPIHRDAPAFEDQGSGADVLITGIKVVDLLAPYARGGKIGLFGGAGVGKTVL

SEQ ID NO: 55305 - protein, 102 aa, Sorghum bicolor
  Clone ID: 30161670.pep
MGVYLSTPKTDKLSENGENDRLKFGLSSMQGWRATMEDAHSALLDLDSETAFFGVFDGHGGRVVAKFCAKYLHGQVLKSEAYSAGDLGAAVHRAFFRMDEMM

SEQ ID NO: 55306 - protein, 63 aa, Sorghum bicolor
  Clone ID: 30161677.pep
GNCCLKIKSNQIFSQKFYYQQIFYTQQHFLQKVSQVSQMFVHSEWFKLEFLCFVYNYMSKSVC

SEQ ID NO: 55307 - protein, 102 aa, Sorghum bicolor
  Clone ID: 30161680.pep
SNEDKPNGINAAEGATPAFTVETSPESSASCSQPALAAHAATADASNTTTNSLQGKEIQNLNYRRTRKGQSATRATPPAEKSRGVSIVSRINSKAERIEAWR

SEQ ID NO: 55308 - protein, 57 aa, Sorghum bicolor
  Clone ID: 30161686.pep
STAKPLSMTYEKSSAMVNGHNGDPLICWDGGVSFNRIGMNSTCDIVNFFETLQSDGK

SEQ ID NO: 55309 - protein, 77 aa, Sorghum bicolor
  Clone ID: 30161696.pep
IGDKSWGVTVCQQWFGSKENGGAIGGENTLHVGDQFLSAGSNDFKARSVGTTAWIASPAETVELLDELADLMQKKLS

SEQ ID NO: 55310 - protein, 119 aa, Sorghum bicolor
  Clone ID: 30161701.pep
MLKVQTKNSEYFVDWIPNNVQTSVCFVPPRGLPMAATFVGNSTAIQEIFKRVDDQFSAMFRRKAFLHWYTSEGMDEMEFTEAQSNLHDLVSEYQQYQDAEIDDEVEEYEGEGEPEEYEG

SEQ ID NO: 55311 - protein, 99 aa, Sorghum bicolor
  Clone ID: 30161706.pep
KVILQMRKTLQLGSFFTVGPDEVRQWTIRTGTKAPQAAGVIHTDFEKTFIQALVFNYNTLKELGDESEVKAKGKIMTKGKEYVVEDGDILHIKAGAAKS

SEQ ID NO: 55312 - protein, 90 aa, Sorghum bicolor
  Clone ID: 30161713.pep
FLRTPPRLGFYWNTFDDYAVFLKRILSSAPMYQAAPKKFSLLQSAQDQSVRLTLHWMAINRKQRLDFPCVLQRSVCKGRMFFFFLFMKNI

SEQ ID NO: 55313 - protein, 128 aa, Sorghum bicolor
  Clone ID: 30161717.pep
AAPGRRGWREAQGDDDEPGRVRRRDDDHHSCWPPPSLAAAQEAQRRLAGHDVARARRRPQPSHASSVLDTPFLLVADFVGGMHISSMHTTPSTDMHDGSSKELLATCGDMENKGIELVGYWMGLIGGH

SEQ ID NO: 55314 - protein, 156 aa, Sorghum bicolor
  Clone ID: 30161732.pep
GCPAVTPLTICRLRRGVPLHHSRRLLAVAAAAPEAPAPPPAISQSPPSPVPPRKGYFPKRGETVELTCEALAFKGKGVCKVAGSTFVLLCDGALPGERLVARVSRLRRGAFAEAAKLRTLEPHHDAVEAPCPLAADCGGCKTQSLAYAAQIRHKHL

SEQ ID NO: 55315 - protein, 174 aa, Sorghum bicolor
  Clone ID: 30161744.pep
MAAPLAKDEEDHKKHGEGCSHSHFLVVAYSMQGHVNPARTLAHRLAQVSGCTATLSIPLSGHRRMFPSSSSDDDKEAAIVSDGLISYLPFSDGVDDGTWPIEEEDRARRRDANFRTLSAIITRLAASGGRPPVTTVVCTLSMPVVGEVARAHGLPLAIYWIQPATVLATYYHYF

SEQ ID NO: 55316 - protein, 125 aa, Sorghum bicolor
  Clone ID: 30161752.pep
AAEQNRLQRCIAVEVDPAAGAAAADEQGKHQETGHDQAHASGGHQLLRPPPPPRRRRHQMMMSIVVVVTALLWILMRRRRRRYRLTMFMLRHQRRPLLLVALLLQALLHGWIGWMVELGCLLCFK

SEQ ID NO: 55317 - protein, 224 aa, Sorghum bicolor
  Clone ID: 30161755.pep
FTEMLKDNDCSVNYPAVQISKSLEGILSLPHGNVSTPRSSLRGKDYLDPSPGETDVCIACEVEREECTQERNQSQKDLGSIVLCTSAAVDDQVTVREGYYTNEAQKGPRHADDEPSTLYTEGIDKLICGENVCNERSIPAEQSIDDVCQETLEEIKQGKEHVKVSPTSAEGIVEKLGQQEPETPEPRAATKLISDGSPEQSDEKQERPSPVSVLESFFEDIGSP

SEQ ID NO: 55318 - protein, 57 aa, Sorghum bicolor
  Clone ID: 30161760.pep
TLNTVSFFKDLGANLGVFSGLINEVTPPWVVLAMGAGMNLFGYLMVYLAVSGRTSRP

SEQ ID NO: 55319 - protein, 88 aa, Sorghum bicolor
  Clone ID: 30161764.pep
IMKNLSSNFNFNLFKFKFKLSRHQLTLIPKRTNLSSLLLLKDHLPKEMILGPQPLELLIQQNQMLVQEKASDLPRPTSSLLIPKNPNL

SEQ ID NO: 55320 - protein, 111 aa, Sorghum bicolor
  Clone ID: 30161770.pep
GAMTEVALPRGPANLASPASRASSSSSLRYLASADSDVLPGSGSPERSAGSTGSRGIRQAGGSEEEEEEEERWSFLALLFELLRKSLLGCSVVGGGGEGEGRGCGMEIGLP

SEQ ID NO: 55321 - protein, 201 aa, Sorghum bicolor
  Clone ID: 30161776.pep
MAANSYPSQVKCTMDDPELNAPPKNDPEEEPKQATNRILKRTSSFAQGTIATATGFLTAAFSVRKDALLHRHILVAGGCFLVIAYLSALLLVYLKLFLSGHRQLHKGHIRFIQFLCIISGAALVATNSLLLLLISEDSILLSLNLLPIQGLIGILAYHATPTEDSMRDEAFEAGIKSGRKVALFATATAFAVQTTLLFGYL

SEQ ID NO: 55322 - protein, 180 aa, Sorghum bicolor
  Clone ID: 30161780.pep
MAEPPSTPPPSQPQLKLFNSMTKAKEPFQPRVEGKVGMYVCGVTPYDFSHVGHARAYVAFDVLYRYLKFLGYEVEYVRNFTDIDDKIIRRANEAGETHASLSSRFINEFLLDMAALQCLPPTREPRVTEHIEHIIELITKIIQNGHGYAIEGDVYFSVDSFPEYLLLSGRKLDQNRAGER

SEQ ID NO: 55323 - protein, 177 aa, Sorghum bicolor
  Clone ID: 30161790.pep
MTTRYRVEYALKTHRRDQFIEWVKGLLAVPFVLYSQPTGVFGDGPSVTQMAEEAHRRYAEIMRDVELMIDDHISRQQDDTMLPSKLRMLIPTAGPFFTRLPLEAAFKYQDRKRHISSRRFVAPSFNDVRQILNSAQSMAVTNGSLQLATFDGDVTLYDDGFNLEPSSPVIPRLLDLL

SEQ ID NO: 55324 - protein, 205 aa, Sorghum bicolor
  Clone ID: 30161806.pep
MAIEIETPQEHYPTRHALSCVLMRAGTSKGLFIHRKDLPEKESEWGPHLISALGSRNNDAKQVDGVGGGSSTTSKVAVISLSNREDADVDFTFVQVAVGKESVDFSGNCGNMSSGVGPFAVQERLVTPKPGQTEIDVRIFNTNTSRIIVETVELDRNGDFKEDGDFIIPGVKSPGSEIKCSFVDPAGSMAGSLFPSGQKQQWLHV

SEQ ID NO: 55325 - protein, 131 aa, Sorghum bicolor
  Clone ID: 30161824.pep
NYPAIVLPDLGGTVTVKRTVTNVGANRDAVYRVVSVASPQGARAEVWPRELVFSSRHGGGGEQASYYVTVTPAKLSRGRFDFGEVVWSDGFHRVRTPLVVRVTNLPDDGVQVQTANATADVHGADGLHAAA

SEQ ID NO: 55326 - protein, 110 aa, Sorghum bicolor
  Clone ID: 30161827.pep
VEDDNNPRNAKKPRPDASSMASLLDKYRREFSVVPFAINHNSNQQDYCSTTNEADTNKSVEFYDFLQVNANSSDTKCGSSIEEQEENRDDQAEGQVQFIDFLEVGASHRQ

SEQ ID NO: 55327 - protein, 98 aa, Sorghum bicolor
  Clone ID: 30161831.pep
PLRVRALGFAVGVASNRVTSGVISMTFLSLSKAITIGGSFFLYSGIAALAWVFFFTYLPETRGRTLEEMGKLFGMEDTDMAETENTAAKEKVVEMATS

SEQ ID NO: 55328 - protein, 108 aa, Sorghum bicolor
  Clone ID: 30161850.pep
YISLGLVDEEAIPKYELTVEDGRRLAKEYSRVLMRRHRARQTAESTLLTLKKEAIAALPEKLRAAAMVPDMTPFPANRYMATLTPPIEGYIEKVREAAKKHSVKEKLR

SEQ ID NO: 55329 - protein, 127 aa, Sorghum bicolor
  Clone ID: 30161853.pep
VVATEMKNNSCKLARWTVQSILASADVMKLGFVSRLTPRSNDKHVVLGVIGWKPRDFANQMNLSLSNGWGIVRTIADMCLSSESQDAKFVLVKDPNKSILRLYEVPTGSFDDDEEEEVEEPQGEEEQ

SEQ ID NO: 55330 - protein, 106 aa, Sorghum bicolor
  Clone ID: 30161866.pep
HKQAHRDTHVCTMHFFFHDPQVAVVFTLVQHLLTSSCTHVHAPCSTCVPSQFLSEASGFAGRTRAYLCLADGLYVVLCYAGYHMCVLACCIRYQPHAFPFFGDFEM

SEQ ID NO: 55331 - protein, 103 aa, Sorghum bicolor
  Clone ID: 30161869.pep
DVLEMIAGVWIEMLCYPARHCTEVSHAKQLSSGGELVTAMGMLVEYTARYDLHSDGHGSEDDRPLSGTSMENGEPSGAAAEVSVDLDSISEGAGRIGGEICEE

SEQ ID NO: 55332 - protein, 130 aa, Sorghum bicolor
  Clone ID: 30161871.pep
LNVAEAEVVPASGEAVTPLEQRVMEYVRWMVTHHSGFVPAFMSSIRFAPLTDQHEAWAKLSKRAPGTTAILLARSDEIIDLESYRRDALSLVGGEHHVRWRILPGSHDFVMTHAGDILSEIEDMFNTNKV

SEQ ID NO: 55333 - protein, 94 aa, Sorghum bicolor
  Clone ID: 30161887.pep
DKSEIDGWHTIQFAGGKNSPTKFQLTLYWSTKASQREAKAAAEDPFLIKLRTDVNRVTPQVGRVLEKLPRWCTPFGKSTSPYTLAFLTALRVNI

SEQ ID NO: 55334 - protein, 217 aa, Sorghum bicolor
  Clone ID: 30161889.pep
PVSIFRNITMAALSAKSAASGVVSRPSAQRVANVRVSAPKVTARRAVISHVAAPIKEQWHGTVHAPTEKSNRVGLPQLITKEQVQALESELDQGESIVALRRFNDALKALPADRWADILRPVFSELTYNLESFNPAFTACLLQVQRTIGVSDYVRRDMALKNLIQPLAGEYGMHNNQPQLKTHRELFAEFYQSLFQEPIENLLAQGTQPAAATLLWA

SEQ ID NO: 55335 - protein, 103 aa, Sorghum bicolor
  unsure (1)..(103): unsure at all Xaa locations
  Clone ID: 30161891.pep
TFGRNGRSKCWCYLISFTLQLILLILARIRRRKGSALLRILLWLAYLMADSTAIXHLSLRARSSENQLVAFWAPLLLLHLGGPDTITAYAFEDNQLWLRHLLN

SEQ ID NO: 55336 - protein, 223 aa, Sorghum bicolor
  Clone ID: 30161893.pep
YLSFYFLSLSITGFLFKKRKELSCAEHFRFITVAAPLTLACYTPYQPTHTDLINQSHRVAEQVFTLSLHQPAHQLLALLTIQYPTNMSPQDTSTALVVTTTVFSTVAFLAIARALLYPVRPKFIRNPLKAGVYDKANADKLKNLVYQPDQFPGARDVETPYGSIRVYEFGPENGEKVFFVHGISTPCITLGPIALGLVKRGYRVMLFDLFGRGFSDGVADIPH

SEQ ID NO: 55337 - protein, 175 aa, Sorghum bicolor
  Clone ID: 30161898.pep
MRSSVSERSLIIESDDDDNDDRPQSQPSAAAARSRRRHHQHEEGSGSGSGSGSDSDSGSSSSSCATPRGHAQATASSYTQQWPQSYRQSINILSSVQSPNLSFLGTPTLSRLSNSFITNSFRGKTPEIISNLVKPLLRPTTSDDLQQQHEERKSSQYLLPSRKPSLQQIPEDQKP

SEQ ID NO: 55338 - protein, 110 aa, Sorghum bicolor
  Clone ID: 30161908.pep
MPRGQGSSVSTSEKPKVDQAIDSNDNRRKHRRGAYLLLGLLIIFLHGSWSVYQIQFGSLPLPLDAEKAGKRGFSEASALKHVKYLTGLGPHPVGSDSLDRAIQYVYAVAE

SEQ ID NO: 55339 - protein, 196 aa, Sorghum bicolor
  Clone ID: 30161923.pep
LSTTNPCGHSKPTVHVSPSKTVVGETPAPAVAYFSSRGPSTVSPKILKPDVTAPGVNILAAWPPKSSPTVIPLDKRSTEWNFDSGTSMSCPHVSGIAAVIKSVHPTWSPAAVKSALMTTAYMYDDTSDVMQAGGTVKAADAFDVGAGHVDPLRALDPGLVYDAGARDHVLFLCSLGYTESAIRSMVLPWPALDTSC

SEQ ID NO: 55340 - protein, 97 aa, Sorghum bicolor
  Clone ID: 30161926.pep
LGDRSIEDVYEGPLETVGGREAERARCAVRAAQLERHRREASREIRSVLLHAYMIIIIKTIYDQSLIDSIYICQVFFLVGFGKLCRPKLANSFSLVH

SEQ ID NO: 55341 - protein, 195 aa, Sorghum bicolor
  Clone ID: 30161929.pep
MADAPVELPSRLAILPFRNKVLLPGAIVRIRCTNPSSVKLVEQELWQKEEKGLIGVLPVRDSEATAVGSLLSPGVGSDSGEGGSKAGGSAGESSRQDTKNGKDPIHWHSKGVAARALHLSRGVEKPSGRVTYIVVLEGLCRFNVQELSARGPYHVARVSRLDMTKIELDQAEQDPDLIALSRQFKATAMELISVL

SEQ ID NO: 55342 - protein, 177 aa, Sorghum bicolor
  Clone ID: 30161938.pep
RAPRRRRRQARRSSSSCRPPPPMATAVASQPRHLPLGAGGEPRCTASTSKVHTLEKVYGFRFLCRSVVDVKSHKFHSRISKRKCYLRNSPSECDRTIHSARWLEFRRHKGLFQRTRRMVHIIPLASDDDGNRVSVNGAPQVGSTSNIDEIRLKLNKALQSEDISNGLVQSVHDAARS

SEQ ID NO: 55343 - protein, 175 aa, Sorghum bicolor
  Clone ID: 30161953.pep
MADSLDYVKICESCPAGDGWGPTVTTETTLNGVPYAPFSKGDKLGRMADWTAEGKDRERGGRAQYNRNFRDQQVYGSSHAITFNAPPAEDESTFSVVSNVRDSTKSRYGRGAVFTRGRGQRGGQAGARGGRTQLQRGGAGAAGRQGYDRGGRSNAGRGGRRFGWKDYDKPARNRD

SEQ ID NO: 55344 - protein, 42 aa, Sorghum bicolor
  unsure (1)..(42): unsure at all Xaa locations
  Clone ID: 30161994.pep
EGLXFVLVFVMRRGKTLHPTSSHLDAHYNMSFGNIGIKPAMT

SEQ ID NO: 55345 - protein, 161 aa, Sorghum bicolor
  Clone ID: 30162022.pep
SRYAVTPMLKTPMLYQVRLEAIAVAGQRLDVPPTVFAAGAALDSRTVITRLPPTAYQALRSAFRDKMSMYRPAAANGQLDTCYDFTGVSSIMLPTISLVFDRTGAGVQLDPSGVLFGSCLAFASTAGDDRATGIIGFLQLQAIEVLYNVAGGSVGFRRGAC

SEQ ID NO: 55346 - protein, 120 aa, Sorghum bicolor
  Clone ID: 30162029.pep
VRGCGRQKIGAFINLAAFYIVGIPVAAIFAFVCHLGGMGLWFGILIGVAVQMVLLLCITLYTNWNKEVLKANDRVFSCPLPVDDTITSGCSEQGNRCNFVGNKQDDANGAIERTNGLNKG

SEQ ID NO: 55347 - protein, 83 aa, Sorghum bicolor
  Clone ID: 30162030.pep
HTYRFRLRYQDLIYKQQGKTEMCEAHHDPYRAMATARMAAAMPMPLRAAPAVTGTPVAVGAGRPPVPTAGLPVMRVPPAPGAS

SEQ ID NO: 55348 - protein, 166 aa, Sorghum bicolor
  unsure (1)..(166): unsure at all Xaa locations
  Clone ID: 30162047.pep
QLRLAAPLAAGFLLQKVIQTISIMFVGRLGELPLAGASLATSFASVTGFSLLTRXGMASSLDTLCGQAFGAGQHHLLGIYKQRAMLVLAAVSVPVSLVWAYTGDILVWFRQDRXIAAGAGSYIRCMVPALFLFGQLQCHVRFLQPQNVVVPVMLSSGATVAVHVAV

SEQ ID NO: 55349 - protein, 192 aa, Sorghum bicolor
  Clone ID: 30162048.pep
LHFLIFCSAYNTLATHTTSYYPLPANSFTMKANFALLALTASLGEVSAHWGKWKEAPKYTPPTAIDNKCQENQKKGWYWDDLQVGQFEKYNDFDFKGWTCGTDKSKRDLTGRHFGKSISAECGPVKEAAPSFGCGAGSKEKSFSLKKFHVRPEFDCRLEFHYDMPDGSTCKHQADCSKDGTDVYNSQCGGAK

SEQ ID NO: 55350 - protein, 77 aa, Sorghum bicolor
  unsure (1)..(77): unsure at all Xaa locations
  Clone ID: 30162056.pep
MAKLAALGRSVLRFPNGSMRPVMVTVIGAVLGFFIGISFPSVSITKLHFPASFVSYIEDXNSGLTTQAILNHAWTSA

SEQ ID NO: 55351 - protein, 222 aa, Sorghum bicolor
  Clone ID: 30162065.pep
VPKRSLIVEGNMSVGFVLASAGCDTPLQGSIIESFSQFDKHDHTATVEPKSRRQKSPNLPHCADEGADDGGSSNQSSKVSSHEGLSAHATVTPGFDRISDVLPTDASEPGHLPECITAQDTTMISQPVCRKAHLSALQHERGEKVNQDLEDVSASTRPLEEDHVHGDLTLQSPSALLSVSCNGANQGSKSGTNLQPGTATEDSMAFEEQNADKSCLEFTGAN

SEQ ID NO: 55352 - protein, 183 aa, Sorghum bicolor
  unsure (1)..(183): unsure at all Xaa locations
  Clone ID: 30162081.pep
MHASKIIASIGLVASAHATVIRYERDLEANAPALEKRAEPTAAWVTVDDEMQPATTYTPSYTTVDGTTSLIDAPPHDLTASVYTYTSWGKIHTSTGEPPNPQATGKHGEGVFARCYNKDGDNAPFCSPYANSTLDVKNTYFVTXDPDYFNKTKSSDNSTLLVTARLDLYNRTSESWVKYEFTD

SEQ ID NO: 55353 - protein, 210 aa, Sorghum bicolor
  Clone ID: 30162103.pep
MALLDEYSSDELLQAQLQLWHQALGFFKSVALAVALDLGIPDAIHRLGGAATLPQILAEAGVNPCKLRNLRRIMHVLTLSGIFSIKQAATAASDGEGPVYKLTTASRLLVKDESLTRSQQLPPVLYTHLMLTPCRESTAGMGINAWFRQEQDQPQPAAGPFALEYNGQTVWERAEHDATTFPFDDAMASDTAFLMPIVLKECSEVFHGLT

SEQ ID NO: 55354 - protein, 176 aa, Sorghum bicolor
  Clone ID: 30162108.pep
MATKAAGHAGREAALEVSSVEAGNRADAAAARLDDDDGRPRRTGTMWTASAHIITAVIGAGVLSLAWAMAQLGWAAGTAMMLLFAGISYYTSTLLAECYRCGDSGNGKRNYTYTEAVRNILGGAKVRLCGVIQYANLVGIAIGYTIAAAISMRAIKRADCFHVRGHHNNKKNPCRS

SEQ ID NO: 55355 - protein, 64 aa, Sorghum bicolor
  Clone ID: 30162129.pep
YENQLNHRSSSPKAPTYCSSPQRPATAMDFALVHRLPSITNHHPQNNQYITRTKEHLTLMMHDA

SEQ ID NO: 55356 - protein, 59 aa, Sorghum bicolor
  Clone ID: 30162131.pep
CLYLMMLSKSMKRIVIDSYPVLSYFIYLSIIESLLAYLLLDTLFCLLHITYDILRFVII

SEQ ID NO: 55357 - protein, 128 aa, Sorghum bicolor
  Clone ID: 30162136.pep
AAECNKWGPLGWVMNDGAHPIIDFYSQGSDDMVDVCAEMLFDVLGCQNNFLRIQADMLEGDLLLMDCATDDNMKALIEVGSKVLEQKVAKVNLETGLYEHVPDGPTNDKALEEFAKKLSQERKMRACK

SEQ ID NO: 55358 - protein, 133 aa, Sorghum bicolor
  Clone ID: 30162152.pep
RHDRSLNFPQRSSTITTCLYGNLQHNFPCSSQQASAAAQHYSAQLFRPPPPRNPPAANQRRSSERRRSRFLELSPPLPGGASCSSSPLLLCCLPRDEACSRRRSCRRRCSSLQLLLSWPRPPRAVSSCCRQSA

SEQ ID NO: 55359 - protein, 98 aa, Sorghum bicolor
  Clone ID: 30162167.pep
SLMWSRLLQSLIESATSMSITIISFGHTNQNLSLEPSTHVSKVWYAKRMSKHDATPKCNLPNTTMRAPNYASPFRWQVVAANVAQTHNQGHGTAAILC

SEQ ID NO: 55360 - protein, 63 aa, Sorghum bicolor
  Clone ID: 30162175.pep
LLPLLLQCLLLYLFSSSFCFYPCLSSSLTSLFQIFFNFWVSPSGAPFIHNIESEYSLFFPTTP

SEQ ID NO: 55361 - protein, 103 aa, Sorghum bicolor
  Clone ID: 30162177.pep
ASKCSCNGLSSPLCILNNVLTRGRKTSISTRKSRTRSTTDNEWSTSLDTIEQTSLIQSCAEASSSSSSEGFHGVLGVDLVEQGEVGREPLLAETDALQRLHHL

SEQ ID NO: 55362 - protein, 188 aa, Sorghum bicolor
  unsure (1)..(188): unsure at all Xaa locations
  Clone ID: 30162196.pep
MRPRLVLFGDSITEQSFASGGWGAALTDRFARQADVVLRGLSGYNTRWALKVLPRAMEGAAGAGADPAAVTVFFGANDATLPDQVQAHQHVPLQEYQSNLRAISAYFKERWPSTAIILITPPPIYEPARIRDVYGEDDPSRXPERSNEAAGAYAQACIAVATELNHPVIDIWTKMQEFPDWQTSALSD

SEQ ID NO: 55363 - protein, 93 aa, Sorghum bicolor
  unsure (1)..(93): unsure at all Xaa locations
  Clone ID: 30162203.pep
PHVAVSRPFLCNRESVPVLRFLKSDGSLQLCIFSPVNMNQNVLVISDEVSWQFTYSQSCRHEPGYTWTAARKHXVGRAIPLSKVSSDRFTLPL

SEQ ID NO: 55364 - protein, 209 aa, Sorghum bicolor
  unsure (1)..(209): unsure at all Xaa locations
  Clone ID: 30162204.pep
MSYRNYVKILTYTWSKDSHGLFDYESSHLFTGKFKITGQAHFYRNNNQIQMNEGNNLVDQIENDRNSLLFSIHEHKDQKDKYYLSLGTNLNPSQSLGLAVRGIKKDSHPAGYELKVGDHVKIGRVRFIVREIKDAEGNVNKLQTAQQINYXKKGDIQEETENPSQNVCRICLTEDGYTDPIENTLIGPCKCKGSCEYVHLXCLKQWIDS

SEQ ID NO: 55365 - protein, 170 aa, Sorghum bicolor
  Clone ID: 30162225.pep
MQSGVSFLGGMAEECPTAGGAELWLPDEFLDDDFFSEEEKAAVAAKSESDEEEGVDGLSRRVAGLVVGNGKGGGDGSPAKAEVLAGSPQSILCGLHASGEDSPNGVASQVSSPPSSPLEQAPADPWDLLSEAAGQVARLRTTSIPVPTNAAANQGDPVMAPPAKKLSAPT

SEQ ID NO: 55366 - protein, 183 aa, Sorghum bicolor
  Clone ID: 30162226.pep
MISSHAFLLSLHGLAMVSTLITNTEGQAFCPSFSCGHLQDIRSPFRMQGDPQGCGFPEYELVCIDSKAIIHINSGRYFVTNISYTDSTFWVVDANLDNSSCPIPASNQHPYINGLQSEGSTLLDPDTVTWAAFITCSEMLSDVTSLFSRCCSGIYRPVNCRSTKNSFDYVFTTTFFPMVGYIK

SEQ ID NO: 55367 - protein, 189 aa, Sorghum bicolor
  Clone ID: 30162234.pep
MESNTVLMALPPAQQGRVLTVLSIDGGGIRGIIPATILARLETLLQRIDGQDARIADYFDFIAGTSTGGLITAMLSAPGKDKRPLFAAKEINQFYLDNGGHIFPRAHGWWFDNIREKVMDMWKKIKGGPQYNGEFLHDKINKLIKDTKLADTLSNVVIPAFDVSRMQPVVFNSLEAERDAGKNARLADV

SEQ ID NO: 55368 - protein, 128 aa, Sorghum bicolor
  Clone ID: 30162281.pep
QDHRVVGHRGRRQDSLQPRVLALAVLHVRTQQQQLQVSLICRTRLACSLAIAALHKVKTEDSGCLVSLGIYNPSGRIHTMIDIESHGMAIGDCYKQKQNSCLLRFLKILSTKVYRKRRGCLVQWFILH

SEQ ID NO: 55369 - protein, 75 aa, Sorghum bicolor
  Clone ID: 30162292.pep
GRTSLMRLEAKTEWRSTRHQQGNTQVTGRGSRLSFSSCFLSCSIAFTSPTFFFESFAGPADTTTASNLRLCSSRT

SEQ ID NO: 55370 - protein, 155 aa, Sorghum bicolor
  Clone ID: 30162309.pep
VRETYACCIMNTGIMQGSRAASSRFQNSHMLPKNPRITYWELIQRPRNACFKVHGCSSVNRAFEATRYDVIRATQNALMHNECPVRVNATRDVNAGLGFKTTPPPVPVDPAVAAGIRRLHKRSVPWPNTINPRMEFHIPEHTPNMQHHYTHQFQM

SEQ ID NO: 55371 - protein, 76 aa, Sorghum bicolor
  Clone ID: 30162312.pep
WYAACAAYCGGIFGYVCYDLTHYFLHHQDLPLWYKELKKYHLAHHFLDYELGFGVTSKFWDSVFGTELIYNTKKTK

SEQ ID NO: 55372 - protein, 190 aa, Sorghum bicolor
  Clone ID: 30162313.pep
YLHNFNIDHKSCLINNFIVHKSYRRYDKSSLVSNIALVDLQVIKVGFVAEVIIEVSSVLDQVSQGSDALGQDTNDGINDQEFQGQTNEEGGNPVVGGSVILFRVQFTHVPDAERPQNNSAQEDAEVETEDSVLGLLLPGFFSSLVVLVLSNVVASQHGTNDVNEGPINKHGVNGINDDVGLSEGLVGSSV

SEQ ID NO: 55373 - protein, 184 aa, Sorghum bicolor
  Clone ID: 30162320.pep
DMVSHKDPTRQFDKADYYAHPEHYAPVFHERIAPYASVIVNCMYWEKRLPPLLSMDQLQQLMETGCPLVGVCDITCDIGGSIEFVNKSTSIERPFFRYDPSNNSYHDDMEGAGVICLAVDILPTEFSKEASQHFGNILSKLVPSLASVKQLAELPSYLRRACIAHAGRLTPLYEYIPRMRNTMM

SEQ ID NO: 55374 - protein, 97 aa, Sorghum bicolor
  Clone ID: 30162328.pep
DEIEKMVNDAEQFKSNDDAFQKKFEAKQQLESYIGRVEEIVSDPTLSLKLKRGQKEKIESTISDAMAALELNESSAEDLKKQELALKRLVTKAMSSR

SEQ ID NO: 55375 - protein, 155 aa, Sorghum bicolor
  Clone ID: 30162333.pep
MPGRTLPTFTRAEVEAHNSGDSCYVTIGNKVYDITDFVEDHPGGPEYILEYAGRDIEDILKDSDSHTHSDSAYEILDENLVGFLVSEKAVNGHANGKANGNGHAKLPNGEANGHANGSVHPRTGMSCAEDLSKDTDYNLDYKKNKFLDLNRPLFP

SEQ ID NO: 55376 - protein, 193 aa, Sorghum bicolor
  Clone ID: 30162348.pep
MADEVYDGAIGIDLGTTYSCVATYEGTNVEIIANEQGSFTTPSFVSFTDKERLIGEAAKNNAAMNPRNTVFDAKRLIGRRFDDPTVKKDIESWPFQIVDDNGSPKIEVEYLGETKQFSAQEISSMVLTKMKEIAETKLGKKVEKAVITVPAYFNDNQRQATKDAGSIAGLNVLRIINEPTAAAIAYGLGAGKS

SEQ ID NO: 55377 - protein, 198 aa, Sorghum bicolor
  Clone ID: 30162358.pep
MQTLQSRSTSVRCNALFKKQGTQTTKPAGTAKNQRKAAGTVTKKAVGYRKYDGEALWLPNTERPEWLDGSLPGDRGFDPLGLARPSELVQIGLDGQDQNLAQNLKGGVEAVFTPDRDEVAPTPLAPYSEVFGLQRFREAELIHGRWAMLATLGAVVGEASTGVSWVDAGKVELDGATYLGLSLPFSLTQLIWIEVILV

SEQ ID NO: 55378 - protein, 216 aa, Sorghum bicolor
  Clone ID: 30162371.pep
MAPASAMELEAPPPASASAAAKEIKSPEVLPEPSSLSALQRKKLGAHFLESDERRFSRGCRTPLGGGYDEPPSSAAGAGGTTPVNIRGEPIRDLSRTGGWVAAFFIFGNEMAERMAYFGLSVNMVIFMFKVMHRPFTSSANAVNNFLGISQASSVLGGFLADAYLGRYWTIAIFTTMYLLGLIALTVSASVPALVPTQEGCDKLAMLLGACAPAAP

SEQ ID NO: 55379 - protein, 103 aa, Sorghum bicolor
  Clone ID: 30162380.pep
MADRASPLSSSSRDRNQGQFPLLAVAAAAAVEGACRGARGLAGSRPTPRWLSCACLFHSFCYAMIATVRAQKCKHLQLPCEATPQRHWPLHIPPLHCKFLSHF

SEQ ID NO: 55380 - protein, 184 aa, Sorghum bicolor
  Clone ID: 30162398.pep
MDPSQPAYAAASYLDFINEDAASSLFADLLDPQTLNAVCTIEQTLPRPEEVASTRKRLAEHDSDSDDEDFKDGKNKRGKGDGSASTTAARKASREKARREKINERFAELASLIDPGNEPKTDKPTILADAIKYIQQTRVENHQLKQLNKFLEERVSQYERERGQALYQQMLSNQMMPGFGGAGV

SEQ ID NO: 55381 - protein, 130 aa, Sorghum bicolor
  Clone ID: 30162406.pep
THEKGLFPPLRRAILLKKSGKKELAEASFIKFQENFSQRNKEDHPCFFYYVIGKAYEKYLDDDSYAIFHYDKGSRAESSNVSEYLVMFNEYWRFRCEKRKEKLIRRSKLRKLAAGVSTGKIATAAPATTP

SEQ ID NO: 55382 - protein, 165 aa, Sorghum bicolor
  Clone ID: 30162409.pep
LEGIKNWLDKMDIIFSEAAVNFDWNKIMSEVRTQLRNNPQKFLEDGGWDFLQPSGSEGGEGGEGLEEGDSAFSVSSEEFEEESESEFSDEEDEDDEDESDFEGDSDLEEEGLSWDEMEEMAEKEDLRKQMNRDSKDAKNPKIPMKGNSKPPMKAMSKQPPKKMKR

SEQ ID NO: 55383 - protein, 201 aa, Sorghum bicolor
  Clone ID: 30162432.pep
KISQSLRSLNAQTGLFTKHMKIIHQDPELRVQRVAAIKKTKGTAVARKRASEIQKAFFSDPENRLKRSIAMKGVKFYCSKCGQEGHRSFYCPTVRKGSTRLRFRCRLCGGEGHNSRTCGKPKSEKEHQQQPRHCSQCGERGHNRRNCPTSTDVGIGASGYVVNKVNGSNSAVYSCSICLEKGHNKRTCPKRKATLVNEKCE

SEQ ID NO: 55384 - protein, 155 aa, Sorghum bicolor
  unsure (1)..(155): unsure at all Xaa locations
  Clone ID: 30162442.pep
MLVTCGQPAASAVARRLRLPGRARPAPRLRRRCVAASASDGAGTPSSPLHCNPLADLLGPDVEPSGSRSQSTAPITEKGKLRSWVGPNGQYYRELPCPSCRGRGYTPCKECGIDRSSLDCPMCNGKGIXMCLQCSGERVIWQESVDEQPWEKVRS

SEQ ID NO: 55385 - protein, 81 aa, Sorghum bicolor
  Clone ID: 30162443.pep
LTGLNVRTQYTVQFFYLVFTPPQATTSCVLEAFIGSQKFFTTGIFSNGASVSYNEVLVSTSAPATQGFLNIQTTCSAGGSA

SEQ ID NO: 55386 - protein, 214 aa, Sorghum bicolor
  Clone ID: 30162457.pep
WKKNKKFENKQLNFSAKYHFFPMSCFDLKTWLTEFYPLMNWKHDFAAFIGPDVLEKSASEDNGLTLFIRALNAEFTEKDYTKALELYHEGAKYIDPLCLFRLHEISLGNKFFGTEFDEVKSIAYLLWSAQFVLDINLKGPISPIKKLVKFLIGFDKNGEYSVNLILLYEDPHLAPSRELVKSLFLRNYFNNTDKKQNEEHLIAAVNSLSSKTPI

SEQ ID NO: 55387 - protein, 118 aa, Sorghum bicolor
  Clone ID: 30162459.pep
QYRLPKISLFYFSRFGRCSAGEGNKSLRRDSCGDELGARTTHKFRPARSFRSAPCCASAAALRFCSGHPCVVAGAQSRRSEFLDLVGVSISPVVNLFLSKVEFFHPEDFVISCRLALI

SEQ ID NO: 55388 - protein, 206 aa, Sorghum bicolor
  Clone ID: 30162461.pep
MSAKPQVSAQNFFRRVKSLYTHWKDTNKEFSDIDAICVQNGKDEESMKIKTTAVYVWLFGYEFLDSWLFFTKNGVIFLASQKHISYIEHFNTEKGDFNLNLDLIVKDETDNSRNFETIKAKLEAESDLSSLKIGKLVKEKQVSAFSNEVEGFLQKLSPSYVEIGPLVQECLCVKESDELELVRKAGKVAVWFEDVIMEVENIIDNE

SEQ ID NO: 55389 - protein, 67 aa, Sorghum bicolor
  Clone ID: 30162513.pep
LTFEFCAREASQIFGGLSYSRGGQGAKVERLYRDVRAYAIPGGSEEIMLVLSMRQSLRVAKAVGMKL

SEQ ID NO: 55390 - protein, 111 aa, Sorghum bicolor
  Clone ID: 30162524.pep
KGRVGERYLLTGENASFVQIFNIAANLTNTKPPKFHIPLRLLAIYGWISVFVARITGKPPLISYPGVDCLRHQWAYSCDKAKRELGYSPRSLSEGLAETLLWLKNANLIKF

SEQ ID NO: 55391 - protein, 127 aa, Sorghum bicolor
  Clone ID: 30162546.pep
LAPGLVVVVRHLPPPPVPALYTCPHPSSPSIYPLRPSSSTALFFPLFLTPLFPICADCCARRPDGCPASSLQFPLPHLTTPPLALARHFHLHARELPPLLPRAHLLRSGHLSIILPKQQQPSLLQAS

SEQ ID NO: 55392 - protein, 165 aa, Sorghum bicolor
  Clone ID: 30162556.pep
IGLSGHRITGDAREAPEADHTGGRAHGRRVGGAAASRGTPCVGARAACCCPSPPSTSGTGGRPANRGRASKPDGRGPRASRRYSELIVTANSGFFSNLHRVWVRDIGLLTRTPPSPSPPQDQCNASEVRQHLRRVVDQRSMLRRWAAARDGATRARRAGVLTLLS

SEQ ID NO: 55393 - protein, 57 aa, Sorghum bicolor
  Clone ID: 30162567.pep
INYTSRQLPCLPNSSINPSLSPETFLSGKTSKWAPLTPSLVSLKPSKRIPLPIKSGS

SEQ ID NO: 55394 - protein, 158 aa, Sorghum bicolor
  Clone ID: 30162568.pep
MGASSSTGNPSPEAHEQREQETLASAALSLPLLRVAFSRSAAAANANALPDALAPPPASYRLPGSPPLPPHFHGILSGLGPTIASQFFGHGAAATPEGDAGWVPFLRGFNRCCARVPASRSLALLLRVYAAACAGAGAPCGVLLHPDEGGDEDGKVVG

SEQ ID NO: 55395 - protein, 194 aa, Sorghum bicolor
  Clone ID: 30162590.pep
WVQVFTTSDVASHKKPDDLYIIVDGDVYDVTKFQDDHPGGKKILQRVGGKDASKQFWKYHNEGILKKYKKQLQVGSLDSKPAAPKPKPEANAAPVPAAPTPKAVKTTQKEVAAKEEDAEALEPFGDQIPFADPAWYQSYHSPYFNESHAALRAEIREWVEKDIEPYVTDWDEAKEVPEEIYKEMGRRGYLAGLL

SEQ ID NO: 55396 - protein, 131 aa, Sorghum bicolor
  Clone ID: 30162602.pep
MRVVVTGATGFMGGRLCAALADAGHDVRAFALPGVDVSGLPAAVEVAYGDVTDEESLAAAFSGCDAVFHAAAAVEAWLPDPYVFHTVNVGGLENVLKAAKRTPALKKIVYTSSYFAIGPTDGYVANEKQIH

SEQ ID NO: 55397 - protein, 38 aa, Sorghum bicolor
  Clone ID: 30162619.pep
SQLVQEKSIDECVRAACYAANVIIQRSGCTYPEKPDFN

SEQ ID NO: 55398 - protein, 83 aa, Sorghum bicolor
  Clone ID: 30162635.pep
LTKVQLPLPKEDETDQPIQLSITRLVTSSTTIHLNPKSPIVCDPSSGLGYIDSACSQTNQDSSKFLSRTRRQINMTNLSNMFP

SEQ ID NO: 55399 - protein, 91 aa, Sorghum bicolor
  Clone ID: 30162637.pep
ETYVYQVKSAVVDDSNMADKMNADEKEKVEEAVREANEWIEVNSDADKEDYEEKLKELEDVCSPVISSVYQRSGGGAPADDTYDEDDHDEL

SEQ ID NO: 55400 - protein, 85 aa, Sorghum bicolor
  Clone ID: 30162650.pep
EYCAFHQGGRVCTTTTRLPLPCFSIYLAVAPGKRSPESNPPVESSHRICVDQVNTPELWAFLPLPLRHLTGSPLPAIGRLLPLLL

SEQ ID NO: 55401 - protein, 72 aa, Sorghum bicolor
  Clone ID: 30162657.pep
METYTTDDALTAMGFGKFQALVLVYAGTGWLADSMELMLLSFVGPLVRQQWNVSPQHESLLSSVVFTGMLLG

SEQ ID NO: 55402 - protein, 107 aa, Sorghum bicolor
  Clone ID: 30162677.pep
EFSGRRRPVPPSVVPVAELARRHTISLAPPTPRSASAREEEMASSGYEGILLGMGNPLLDISAVVDEGFLAKYDVKPGNAILAEDKHLPMYDELASKSNVEYIAGGA

SEQ ID NO: 55403 - protein, 70 aa, Sorghum bicolor
  Clone ID: 30162679.pep
WKFLPPSATATDSAPATLKAAPAMDGPRWTEEVDDLVDAGDVDAAIALLESVVSGLSTSAAAPATDLRLA

SEQ ID NO: 55404 - protein, 45 aa, Sorghum bicolor
  Clone ID: 30162697.pep
LTKIIIEKLLPQRLNPHCSELPTNSCEEKGMRPIQVTFSILALIL

SEQ ID NO: 55405 - protein, 74 aa, Sorghum bicolor
  Clone ID: 30162714.pep
KVVGQSADLFTLQRFINRTKPQLSKDQQQTLTRWAVLFAASLLKNNKAAHEALMPGMSQKASVLGCIEAIENAS

SEQ ID NO: 55406 - protein, 171 aa, Sorghum bicolor
  Clone ID: 30162728.pep
EEAKDFVDKLVEHLQYYIRDVNLYGVGCEPMMKQSSSYRSSRAESFSSHEKTKVKAVYAEEMLTPAESFSEHARQASGKSKHFAQFQGDKMNIVEMLKIQQEQQAVLEEMSKGVVYIFGESEVVARPHSSLIKKIAVNYLYSFLRKNSRNGEKMLSIPRRQILKVGISYEI

SEQ ID NO: 55407 - protein, 81 aa, Sorghum bicolor
  Clone ID: 30162732.pep
CFTKLSLYLSQLVFPSVVLCLFNWKRWSQKAEKKKTVVGNYQFYMPHSKRKTQRLVSRIFALIILFCNLNIYYIIMRKTLF

SEQ ID NO: 55408 - protein, 83 aa, Sorghum bicolor
  Clone ID: 30162733.pep
KVEAKYGKRWFRIWEYFLAYSTIISRQGSATCFQITLVKNINSTHRVEGIETQFAITGALDNCRANLQSWAEKNNVKTPSEYL

SEQ ID NO: 55409 - protein, 87 aa, Sorghum bicolor
  Clone ID: 30162759.pep
MDFSTFSNIINGQPTGTAATRHGINPSTCKALPDCPVSDQTDIEDAIQIARSAFQSWKTTPIEVRKEKIKALADAILAHKAEFARLL

SEQ ID NO: 55410 - protein, 167 aa, Sorghum bicolor
  Clone ID: 30162779.pep
MKRLPVLAVPVLLLLVSLSFFLFRPTTPPVFSSRQAFEPDRRLRVYVADLPRALNYGLLDSYWSLRAADSRIQASSDPDHPPRHDHPPYPENPFFATLSAEMELGWGTKGAFRKKDGNEDYRRQREVVDRVTSHPAWRRSGGRDHVFVLTDPVAMWHVRAEIAPAIL

SEQ ID NO: 55411 - protein, 152 aa, Sorghum bicolor
  Clone ID: 30162793.pep
RQVVACCSSRLVLVVSAAASVLLAVVLFGTGATAAAAASVPPRYCAVGKAIPHSPLSGCAWYVATRSCDMAVSMLPVLKETCCGQLEQIPAECRCRALRVMMEAPLVVGADTGAQRRCRAAQARFAPAVVAAGECGLRTVHGRPFCNKLDAE

SEQ ID NO: 55412 - protein, 130 aa, Sorghum bicolor
  Clone ID: 30162804.pep
MASQQAADYRGSREEIVIVDLESEEAAVDDVDLPPATMQRQDSLYVAATRAAGANHHGQDSWARTLRLAFQCVGILYGDIGTSPLFVYSSTFRDGVGHPDDLLGALSLIIYSFLLFTVIKYVYIALRAND

SEQ ID NO: 55413 - protein, 191 aa, Sorghum bicolor
  unsure (1)..(191): unsure at all Xaa locations
  Clone ID: 30162807.pep
MAEKSGVTGADFEFVKTPAYPKPDFDKLEDVGVPTTRYPAIKNAPLPADGSGADTFNNYVLISILVAVPWLLSRKVGGGLKTTIFFALVVDLPLLAAWWLVISSISPRKNEKVRLPNRGVEHYLEFKKEADRLKYRGSNKIPMETFHETYFDGDVDFKGDCLEVMEYRHDWASFRFTXGLIKFFPFGMIPE

SEQ ID NO: 55414 - protein, 108 aa, Sorghum bicolor
  Clone ID: 30162818.pep
KRGMQSTIYVELASGVTPRDLFEHLKYTYEDEEFVKLLHGSSAPHTSHVVGSNYCFMNVYEDRIPGRAIIISVIDNLVKGASGQALQNLNLMMGLPENMGLQYPPLFP

SEQ ID NO: 55415 - protein, 45 aa, Sorghum bicolor
  Clone ID: 30162823.pep
PETKGLPIEEVEKMLERRELRLRFWAPPRHDVDGNGNDSGKNTGV

SEQ ID NO: 55416 - protein, 54 aa, Sorghum bicolor
  Clone ID: 30162836.pep
SNALKAGTVWVKCYNMLHHQLPFGGYKESGIGRDLGEAALANYTQNKSVAIKLY

SEQ ID NO: 55417 - protein, 115 aa, Sorghum bicolor
  Clone ID: 30162866.pep
FLFEFIRKLNPMPQQQVQTIWIPPTTSKTIVFPLNQQSNTFYTEFYEPEMTKDKVSLEEINQFISEINAEYEVYKKKVAGEKPKHECFSLLLIVTMGLDLGLFSSHYEFIKSFTN

SEQ ID NO: 55418 - protein, 95 aa, Sorghum bicolor
  Clone ID: 30162881.pep
MDGGNGEAWRGAVSPAARYAESGGASLTWENLTAVLPGGGGRVTKKLVQGLYGYAVPGRVVAIMGPSGSGKSTLLDSLSGRLARNVVLTGKVLLN

SEQ ID NO: 55419 - protein, 61 aa, Sorghum bicolor
  Clone ID: 30162883.pep
AAVPAHGGGRVSGAGAGASPAEAQHMQHREVAADGKGSVSRVFCLQKWEEGKGCSRPIAGI

SEQ ID NO: 55420 - protein, 124 aa, Sorghum bicolor
  unsure (1)..(124): unsure at all Xaa locations
  Clone ID: 30162899.pep
MALTVELSTPVTGTYQQPIGLFIDGKWVEGVDKGKFQVINPSTDEVITSDCEGTEKDIDLAVAAARKAFXGEWRKTAPQTRGNLLLKLADLAEKNLDLLAAVEYLDNGKSITNARGDVGAVVGC

SEQ ID NO: 55421 - protein, 102 aa, Sorghum bicolor
  unsure (1)..(102): unsure at all Xaa locations
  Clone ID: 30162909.pep
SVFEDMILAGAQPDGVTFTVVLSTCSRGGLVDIGIKHFNSMTNLFDVSPQKSHYTWFLDMLGRAGRFTEVAHTIEAMPVQPDXINLQDPAGILQAPQCTGGW

SEQ ID NO: 55422 - protein, 127 aa, Sorghum bicolor
  Clone ID: 30162913.pep
MWTPMMQTLPQSTKHLRSLFTLEIGDWDNNLKQLPDVIQHLTSLEVLYLTRFPALTELPEWIGQLTALRSLYIQNCHALECLPQSIQRVTSLQSLYINSCPGLKTRYKRGMGPDWHLVSHIPDVRGV

SEQ ID NO: 55423 - protein, 97 aa, Sorghum bicolor
  Clone ID: 30162919.pep
ILIYYYLLRLINYLWSDSCSDLEHGEESLLGGSRLGGILEEFLALVGEVLEVVLDFLDGGSGGVLLGVLGLNDFLLGFLEEGDKSAQGGVSGGLNSL

SEQ ID NO: 55424 - protein, 65 aa, Sorghum bicolor
  Clone ID: 30162953.pep
MSAAATLPTGHGQEPHAVCVPFPAQGHITPMLKLAKILHARGFRGTFVNTEYNHRRLVRSRGADA

SEQ ID NO: 55425 - protein, 217 aa, Sorghum bicolor
  Clone ID: 30162957.pep
MPWQPSPLFAVFRQQRLASSWAAAVAGHARSGRHAAALTVFRRVLRAHPAVATSDHFAYAALLRCRDRRLAYQIHAQVCRRGLAASNPVLACSLLVFYADCEDWSSATRVFAEMPRPDAVSYTAMISALLRAGDCHGALALYPCMLPLCAPTQHTFSKLLAPCASMRLHRHGTQLHAQLLRWGCWGPHLGLVLKTALLHMYATCGAMVSARAVLHAT

SEQ ID NO: 55426 - protein, 135 aa, Sorghum bicolor
  unsure (1)..(135): unsure at all Xaa locations
  Clone ID: 30163003.pep
QKDPADVARWDKLRVKFVDAKTLLDQAELDLGDIPAEFEDPIMGDLMKDPVLLPSKHIVDRSTIVQHLLSDPKDPFTRQAMTTDDAIPQTELKERIEQWREERXASCQGQVEERCHGHHRGLRSCEGMCLKRVII

SEQ ID NO: 55427 - protein, 176 aa, Sorghum bicolor
  Clone ID: 30163007.pep
AQIGAVGVFTGECDMLIEQYGEQIINLLVKGVDPSQVCAQIGLCPSGSYCSLCTTVLTYAEYLLSNNATDQVILKALETVCNYLPSPNGEATVDCSVIPSLPNLVITVSGQQLIMSPKQYIVQLSQLGQTTCLSAFIGIDLPPQIGPLWILGDPFLGAFYTKFDYGKQRLGFAPSK

SEQ ID NO: 55428 - protein, 130 aa, Sorghum bicolor
  Clone ID: 30163010.pep
IEKGRYIVREIRPAIDQYDQEYYGLKGLIDPKIRDSAKLIGFRRFVQLAMECVEESAVDRPTMNDVVKELEIIIQNEGARLLNSASLSVEQFGNKKSQDPYAEHLPMNDESSSNTFDYNSVYSYSAVQPK

SEQ ID NO: 55429 - protein, 165 aa, Sorghum bicolor
  Clone ID: 30163013.pep
ITYDELWTVTMATQLSLDVTTAECHAPSSSFVDEPFQCLIMGRDVDGRVTGDSSMAKNFKVVVTNSANSTINTAEVMYFGSAFHFAFRVNTTGEYKVSITYLDDVLPKASSLTVNAECPSMYWGSTCSVNGWWVIGPVIGVVVLVAIIVTVVVVRKRKAGYQPLN

SEQ ID NO: 55430 - protein, 133 aa, Sorghum bicolor
  Clone ID: 30163025.pep
LTLHYITLHYITLHYITSMDMHDLLLLTYTQKKKKNVQHRNNPTRAACLYQSSQQPKQRGLKDLGSSHASRYVCTHVHAKSVGTYCRTAYVHIYKACTLNCTLHIPRSHACTPSNATRQRKESIYCKAPYVTY

SEQ ID NO: 55431 - protein, 107 aa, Sorghum bicolor
  Clone ID: 30163030.pep
MAALAPKLPGLAYSVADSFGLTQATFADPMGLGFVSSDSPCCGSGRLGAQGECTSTAMLCAARDSYIFWDSVHPSQRAAMLSAQAYFDGPAQYTSPISFKQLANMMS

SEQ ID NO: 55432 - protein, 88 aa, Sorghum bicolor
  Clone ID: 30163035.pep
KFSSFKIHPRAELWGDIVSNRFGSFMLASDVLFDLKLEAAERCFCQMVESKIPAMLHKDTYAACQAGPQEEFYCQVTSKDGTIWLTGP

SEQ ID NO: 55433 - protein, 154 aa, Sorghum bicolor
  Clone ID: 30163043.pep
SLTYFPTLTSGQASQYWGISVSGFTYGSTSLGSGTGIVDTGTTLIYVPTSVYNKFLSAAGGSTDSSTGLAAFTKKPTSNFGIKFGFTTYTLTPAQYLIPTAQYSNFGLSSGKYYSWIGDGGSSGVNIIIGQKFLENYYSVYDTTNSRIGFATAA

SEQ ID NO: 55434 - protein, 80 aa, Sorghum bicolor
  Clone ID: 30163044.pep
WAEIAKTFPTRTEGSVKKHWYKDMHYAEFAEDESQALLNAIKEYENNKWKSIGQKVNKPAKACEQYAKEHFPDLFPNSKR

SEQ ID NO: 55435 - protein, 100 aa, Sorghum bicolor
  Clone ID: 30163058.pep
RSKMPIVSILRLKVTKMFLFFQMEYEKSIRRLFCHADEVTKSLLLYYYYTPLLKSDALLQASLIIDQWKSGCPVEVRHRCHIRLFGSTNLVDLMTSGIGK

SEQ ID NO: 55436 - protein, 145 aa, Sorghum bicolor
  Clone ID: 30163063.pep
MDPANGSAGAELDDAAEWRTRAPGGTEYSWLRAVPGGTGTTLLALHLSRGDVAQAALHSLRNAHPVLRARLRTSPSGPTLAFPDPAAPPPSPPLPLATLYELPPATGGAALFVRIHTVACDRSAANALARELVALLAGGEEGGER

SEQ ID NO: 55437 - protein, 174 aa, Sorghum bicolor
  Clone ID: 30163065.pep
MLFAVTLTLAAAAAVSASPLEPRAKTAVLPLKHVVKASSIKAIVQKGQARIRKVNGEDSFHVDAVSSGSVTNEDVSYVAPVVIGGKTWNLIVDTGSSNTWCGAQTKCEPTSTGKSTGGSVSVSYGSGSFSGTEYKDKVSFGGLSVAAQSIGAASSASGFSGVDGIIGFGPVDLT

SEQ ID NO: 55438 - protein, 123 aa, Sorghum bicolor
  Clone ID: 30163066.pep
TRSLYLLNDSILHPSSSISPVASHRIYLPAHCLVTTTFLRFCSLRTSHHSRLIADTLRVCPPVLSLSGLLAFSCLVIAPAPINLFSLTSVCLVSNHPPKTTGHSLPMYSTYLRRDAREKQHSI

SEQ ID NO: 55439 - protein, 177 aa, Sorghum bicolor
  Clone ID: 30163082.pep
MALAPMDYAGSISSGQKYLGRFGVPTSSRLRWVGYDTKSRTYQLVARAISVDQPQLDFSNPDWKKQFQEDFNKRFSLPHLRDVIDVEPRPTTFSLKSRTPLENVNGTMQESWNGYVNDDDRALLKVIKFASPTSAGADCIDPDCSWVEQWVHRAGPRKQIYFEPQYVKAGIVSCGGL

SEQ ID NO: 55440 - protein, 196 aa, Sorghum bicolor
  Clone ID: 30163112.pep
MDPNEQPSWAGGDAPDKEKMEQIRARRLAKLGTSTPVSAKSDENKAPDSESSNPSRTSTPKPQPQPQPASAESRPKINVTPAAPPASSSPNPFDKLGVKAEPSSSTADRPSPKPSTTQPESDESYADRTLSQIFRITVDPHNMVNTSGQRLTFLPNLNEELSESGEPLKLSVNTLDQALMEAASSYPHDKPLMNYF

SEQ ID NO: 55441 - protein, 193 aa, Sorghum bicolor
  Clone ID: 30163115.pep
MTRTRTVTTLLVILCVALLSEAIIKVPLTKLAQPAKIKRPARAAGPINVPLLTYANTQYYGTVTIGNPPQSFQVLMDTGSSNLWVPSSKCPWYSIACDLHNKYDSSKSSTYVKNGTAFNILYGSGGVQGFLSQDNINIAGVTIKNQVFAEINSESGLSFLFSQFDGVMGLAFDSISVDHVTPVWYNMLQQGLV

SEQ ID NO: 55442 - protein, 210 aa, Sorghum bicolor
  Clone ID: 30163121.pep
LTLQITNMKHVCILLALSLSLVSLALTTYTTPWTLLKPSGRTPAARQYHASIYNNGVWIYGGMSNQTQTGLQLFCDLQTYDVSSNSWRLVDNCTQSKDYKGPGKLYDSAYAQWRDCFLIFGGTNDKGVRITDTWCYNFTSGHWSELVVKMDDFHQSYLQQTGLSAVVYQDNFIISSNQAIFVLNLTAEPKTWSMVSSGDSNSQTLVAANN

SEQ ID NO: 55443 - protein, 173 aa, Sorghum bicolor
  Clone ID: 30163141.pep
MPPKPAPRLFQYISNKSRKPPPPPAATSASHDGPASDADADAGEVYRIVTSAATPSAMESALAASAVPLSSPLLDAVMRRFRFAHGDPLRALSLLSLAADRGGVAPSPYAIDTALYVLGRARRFPHMWDLPATTRRICPDAVTSRGCSTPSTRPASSTRCSARSARRRACPTW

SEQ ID NO: 55444 - protein, 141 aa, Sorghum bicolor
  Clone ID: 30163148.pep
ASQTPKGGVPTPTGTQTSTSTSTSTSSSSTGTSCPTATSVAVTFQEVVTTNFGDTIKIVGNIAALGNWDTSKAVALSASDYTASNPVWKATISLTAGQSIQYKYINVKKDGSLTWEKDPNRTYAVPKTCATTATKSDKWQS

SEQ ID NO: 55445 - protein, 102 aa, Sorghum bicolor
  Clone ID: 30163171.pep
IMNDKKKSGVLYCIHAIGQEYRMFNNKVILKKKKKKGVDRKQFTATVTDIRTKASYSRVCKIYGTGRPHRIRMWSVITGGCGGCNKKTSRVEDWRVGKGPLK

SEQ ID NO: 55446 - protein, 148 aa, Sorghum bicolor
  unsure (1)..(148): unsure at all Xaa locations
  Clone ID: 30163172.pep
ESVKDIDGARMEDNKFCVSVHYRNVAEDDYKKVFHRVSAVLEDYPCLRLTHGRKVXEVRPVIDWNKGKAVEFLLESLGLNESEDVLPIYVGDDRTDEDAFKVLKASNRGFGILVSSIPKESDAFYSLRDPAEVMEFLRMLAAWKEQST

SEQ ID NO: 55447 - protein, 139 aa, Sorghum bicolor
  Clone ID: 30163176.pep
NFRKEFVVDGETYKLAIADTDGALECIPVVEKYCQMSHGFYMVYSVTSKESFRRLDEYMSIIVRVKGTEFPLIIVGTKCDLESERQVTQEEGRRYAQKYGAEWMEISAKTKHNIEESFNTLVRLISDANYDRTFSPSFT

SEQ ID NO: 55448 - protein, 128 aa, Sorghum bicolor
  Clone ID: 30163180.pep
VEEIVDALESEAASSNEEWCTLALKRLKEASPLALKVSLRSIREGRYQTLDECLVREYRMSMNGISKQFSHEFCEGVRARLVEKDFTPKWDPPALEYVTNDMVDAYFAPLGDLEPELKLPTESREAFV

SEQ ID NO: 55449 - protein, 46 aa, Sorghum bicolor
  Clone ID: 30163183.pep
PPPPPCIYRSHSIIPLSLLAQYGKALSLSPVPKDQLLSTELHEMRE

SEQ ID NO: 55450 - protein, 73 aa, Sorghum bicolor
  Clone ID: 30163190.pep
GFFLVQYAHLWQDHLDKLFDLYASGKLKVSLDPKKFVGVASVPDAVEYLHSGKSVGKVVVCIDPSYSQIVAKL

SEQ ID NO: 55451 - protein, 121 aa, Sorghum bicolor
  Clone ID: 30163191.pep
VGHMEFLYDQAPESMRSTAAALFWLAGAFGNYLGTVLVTVVQRTTRARGNDWLQDNINRGRIDNYYWLVTCLMVLNLGYFLICFRFYTMKPLEMADEQDDHDGECELSTLQKNDTGAGGVV

SEQ ID NO: 55452 - protein, 177 aa, Sorghum bicolor
  Clone ID: 30163196.pep
PPITQSGGDMPLSGYWTFPRDHSIVSVFSMCPYISIHVEVDTRLKRLPSTSRIPRCKIILTQNPPSITVDLNRLALLLALLSLSTVLELLGLMLSSVNTEHLGTLLSMVGTTENSIHVLKGDTLGFRDKEKHENAEQDVDGEEEEEALEAGLGEECREELLENGVGHILALRGHTDG

SEQ ID NO: 55453 - protein, 154 aa, Sorghum bicolor
  Clone ID: 30163209.pep
DEIDAIATKRFDAQTGADREVQRILLELLNQMDGFDQTTTIKVIMATNRADTLDPALLRPGRLDRKIEFPLPDRRQKRLVFQVITSKMNLSEEVDLEDYVSRPDKISNADITAICQEAGMQAVRKNRYVILPKDFDKGYKSNVKATGDEFEFYK

SEQ ID NO: 55454 - protein, 109 aa, Sorghum bicolor
  Clone ID: 30163214.pep
SGGLCIALCGPDHRVIGGSVGGVLTAAGTVQVIVGSFMYGGSKKNKAKAEADIEPEEANAGDEEVAPAMALADHSSMAPPPEMSGGWASGMMRQIDSRTPNIDINSIRE

SEQ ID NO: 55455 - protein, 59 aa, Sorghum bicolor
  Clone ID: 30163219.pep
ITRLKLSNINFFLPPRVSGVLAVQILSHDDSGFHANWYWCHGLIVLILLILLVWILLMA

SEQ ID NO: 55456 - protein, 168 aa, Sorghum bicolor
  Clone ID: 30163229.pep
WAELREAVRRCSNALRAAGLKPNDVVAGFVSNHVEALVAMLAAASVGAIWTGISPDNGVSAVLDRLNQIAPKVLFADNGTVYNGKEWSSVAKTTEIVAALKDKGLARVVVINNISSGGLGLEELQKHGVLAVDYAKMLESASEDPLKFEQLPPAHPLYVLYSSGTTGL

SEQ ID NO: 55457 - protein, 176 aa, Sorghum bicolor
  unsure (1)..(176): unsure at all Xaa locations
  Clone ID: 30163233.pep
MEEIGLTRPKKQEKKDVAEKTKEKEFHKYRVTKDNDLDVSDHYARLKLLERKLKFLEIQEEYIKDEVKNLKRELLRAQEEVKRIQSVPLVIGQFLEMIDEHTAIVGSTTGSNYHVRILSTIDRELLKPSASVALHRHSXALVDVLPPESDSSISLLAASERPDVNYQDIGGLDMQK

SEQ ID NO: 55458 - protein, 175 aa, Sorghum bicolor
  Clone ID: 30163238.pep
EWAAPPPTDAQAGASLVARNGTKVATLSHCWRSDAPERYWSEQMDARISNSEDLALPQGTLAQNRSCLWWRDEARSDRGTRDLKKAVGFVETDGMEREAWMRGKNTIFATNGRSEKRRGFVARLSVETDPLRRRVAAPEGWVARAGICSAADEKGAIRSGMAMRKWGAKTLEMGG

SEQ ID NO: 55459 - protein, 143 aa, Sorghum bicolor
  Clone ID: 30163242.pep
MAISSFLSVRGRPIVVVVAVTLFIFLSSLFLFFSPGPSALPLFSSSSSHVSSQVSIPDSSTASSPETASPIAGSSSTSVDRVSADASPPVTGTAIASDAVNNSTADPLRTDVTAAAGAGDAEAGVPQPDHGMPSAATEAIASG

SEQ ID NO: 55460 - protein, 209 aa, Sorghum bicolor
  Clone ID: 30163245.pep
MAFSPRSPWSRPKRNDVYSTFVVHGDDDEDDARGSRRGRGPSTRAEEDEEEDPSSLPPLLQRLPKDFGGPSFDEDEDAYSSDPDDASLSATVVFKSGAPASVRSPFLDLRRSSPRATDDDPYSTFVVHSTARSGGTSSSPRGSASGTFIRRSGGSSSPHESVSGTFIRRTSTPSSPRDSVSGTFIRRPGSPSGPRGSFSGTFIRHTSGG

SEQ ID NO: 55461 - protein, 192 aa, Sorghum bicolor
  Clone ID: 30163250.pep
MYFVSSAFLLGSFVLQNVLGRPTFDERSLLQERQSSVDSFIKSESSIAIEQLLCNIGSDGCNSKNVATGIVIASPDTQDPDYFYTWTRDAALVFKYVVDRFINQYDAGLQRKIQEYIASQAKLQGVSNPSGSLSDGSGLGEAKFNVDMSAFTGGWGRPQRDGPALRATAMITYANWLIANGYTSTANDIVWP

SEQ ID NO: 55462 - protein, 151 aa, Sorghum bicolor
  Clone ID: 30163260.pep
MLQVEEALAAVLSAAAGHAAPRAVPLHDALGLVLAEDVRTPDPLPPFRASIKDGYAVVASDGPGEYPVVTESRAGDDALGVVVAPGTVAYVTTGGPIPDGADAVVQVEDTEQVTSGADGAKRVRILARAAEGQDIRNVGCDIEKDSLVLNS

SEQ ID NO: 55463 - protein, 166 aa, Sorghum bicolor
  Clone ID: 30163278.pep
MRRRLLLACLALLVPLLAAPRAAVAREYAAVFSFGDSLSDTGNLCVDGIPDYLATARSPYGMTYFGYPTGRVSDGRVVIDFIAQELGLPLLPPSKAKNATFHRGANFAITGATALGMDFFEEHGLARAVWSSGSLHTQIGWFRDMKPSICSSPQECRELFRRSLFV

SEQ ID NO: 55464 - protein, 142 aa, Sorghum bicolor
  unsure (1)..(142): unsure at all Xaa locations
  Clone ID: 30163279.pep
MDLKTGLNSPVIADHLPTLASPAAVMTFTTPTSFPSPGLCLNTTKKIPLPGKIEEVRATGWLDLMKASSPTRXRQTKDVICDTQSDDLDLQYRNWTVNYPSALTSFEEISDLAGNKRLALFLDYDGTLSPIVDNPENALMSD

SEQ ID NO: 55465 - protein, 89 aa, Sorghum bicolor
  unsure (1)..(89): unsure at all Xaa locations
  Clone ID: 30163282.pep
INFRVTTMENNEPELNTRPSFGDISNSDWQWKQIQQSDPPSPRHLHSLVYYHAYDSLYLIGGLGDDDXYXNDGTSTWRYSLDRQQWEQR

SEQ ID NO: 55466 - protein, 171 aa, Sorghum bicolor
  Clone ID: 30163288.pep
SLSDAYGAEGELGIVLSERFMEHDAYSMFDGLMDGGSGVVRMAEFFSTSKVGSSSSLAPVIEASSSLFHLLSIVEPSLHSHFIELDVEPQYFALRWLRVLFGREFCLNDLLVVWDEVFACSNDMLLGENEEYSFKILCSTRGAFIAAMAVSMILHLRSSLLATEINTSCLQ

SEQ ID NO: 55467 - protein, 146 aa, Sorghum bicolor
  Clone ID: 30163295.pep
MELKPGMSALVTGGASGIGKALCIAFARRGLFVTVVDFSEENGREVATLVQKENGKFHGDLRVPSCLFVKCDVSNADNLAACFEKHVHTYGGLDICINCAGIANKTLVYNDTSDGTRTWRHAVNVNLVAVVDGTRIASQIMRDQKK

SEQ ID NO: 55468 - protein, 153 aa, Sorghum bicolor
  Clone ID: 30163296.pep
MATTTAVGRNGEGEQKRREKGGFKTMPFILGNDICDRFATAGFGANLITYLTKQLHLPLVEASNLLTNFGGTSSLTTILGALAADSFAGRFWTIVAGSVFYQLGMLGLVVSALLPWLRPSPCSAPPGGPECHRASGLQLAVLYLSLLCTAFGS

SEQ ID NO: 55469 - protein, 164 aa, Sorghum bicolor
  Clone ID: 30163300.pep
MPSKTRVYNWFIAMVAASCMTLYGFDSSVFNALQASENWLNWFNLDLKSDSYTVGLINTCYTIGAIVSGFFIGGPLADWLGRRAGMGIGCFITIIAAIIQAFAPKGKLGVFILGRVLIGIGQGTALTAGPVYIGEVAPAEIRGQVMTFWQLFYSVGAFIAYWIN

SEQ ID NO: 55470 - protein, 77 aa, Sorghum bicolor
  Clone ID: 30163332.pep
EIEKEPKAIKSGDAAIVTTVPSKPMCVETFTDYPPLGRFPVRDMRQTVAVGIIKSVAKKEATSAKVTKAAVKAGAKK

SEQ ID NO: 55471 - protein, 105 aa, Sorghum bicolor
  Clone ID: 30163335.pep
IDRNRDIGTFLITLLAGLPETPTADAVEALNQVFDIYADEGYSYDKEVFWNNNFLKHLDETVPKVRTMIKSIDKRANSELRLRADEAVLNLNRFLAYKRKNKPQA

SEQ ID NO: 55472 - protein, 95 aa, Sorghum bicolor
  Clone ID: 30163357.pep
SIMKCDVDVRKDLYGNIVMSGGTTMYPGLSDRMQKEITALAPSSMKVKIIAPPERKYSVWIGGSILASLSTFQQMWISKQEYDESGPSIVHRKCF

SEQ ID NO: 55473 - protein, 116 aa, Sorghum bicolor
  Clone ID: 30163364.pep
EGEWEMVAEEAEPTTAAASTDAPSQEPMAREVMRTTGEAGAAADSNLDTRKVMEMVAALCEQNAQQCAVIRALAERVDTLERAVRRVEDAERRRRRGKKRKEGKGSKGNNSKCYSD

SEQ ID NO: 55474 - protein, 84 aa, Sorghum bicolor
  Clone ID: 30163374.pep
PSRTLQVHDGAQGHGLAGWTFTGFLIQRGFLGNYDVFLAVKFQPLSKLVFEPYVQANMLLQMFSSPSCLLCGNQIRAFSSNSFR

SEQ ID NO: 55475 - protein, 87 aa, Sorghum bicolor
  unsure (1)..(87): unsure at all Xaa locations
  Clone ID: 30163376.pep
MQHNRITMLSSSETCQLGSSSSNPVMDQQNLLPNNSXVDEQILLPNALEHEDYPHYLLNSHEVGMPSGSLIGQQNTSLSLWEPAGSS

SEQ ID NO: 55476 - protein, 193 aa, Sorghum bicolor
  unsure (1)..(193): unsure at all Xaa locations
  Clone ID: 30163385.pep
RHIHRTTRTRIAAPTKXARRPSSNGVSPLLLLRPLRLLLHLPVPLLLPVLPVPAPGSVTRRQRVLPGRRAGGGEGGPAAQGRVVEASLYSRPLRRVXPGAGAPGYGKDAGGVGGAEEAGAVGGGGGGEAAGRGARVHGEEVGARCSRGGARGGGGWREGCPRGGSAARGREGADRRRGVADEVAAAARRGARR

SEQ ID NO: 55477 - protein, 120 aa, Sorghum bicolor
  Clone ID: 30163394.pep
MALSASAASAGRGSRAEKVRRIFERFDTNGDGGLDRNEMAALVVAVNPRVKFSEDQISAILDEVFRTYAEFILPDGRGLSLPGLLRTYDDGAGDVDRDFLALSLPVVDSDASSPEIAAGD

SEQ ID NO: 55478 - protein, 184 aa, Sorghum bicolor
  Clone ID: 30163398.pep
IISHPQSDRNNMTTSSLSQNLSFTPATPKIRRPIFPIKANWRCLVPSDITSINKYKPKMVRTVEISQLNHDKLKGQSFRELRRALVDNKTASSIKIHDQKWQNLTLVVPHISSLFNCSNHYKKLEFPCFDNRSLQVPTQNAIKALTRLGRSKDLQSLKIKFDCQGRTRNRVIKRLSPQLQGLTK

SEQ ID NO: 55479 - protein, 119 aa, Sorghum bicolor
  Clone ID: 30163404.pep
MEEAVEDIVIAGAGLAGLATALGLHRKGVRCLVLESSPTLRASGFAFNTWTNAFRALDALGVGDKIREHHLLYERMIAFSAATGEAAAEVSLKIQGKSGPHEIRCVKRDFLLQTLANEL

SEQ ID NO: 55480 - protein, 179 aa, Sorghum bicolor
  Clone ID: 30163405.pep
MTQLYKTPVVFQDLRPAEAYMQLFDALDHVNKLSDDIFGKISARVQQEKTRLDAIKNRIDSAKEKVKKISGTTKAITIISPNKYTAPERLPDFKPLFCDTPAQLDIKHSKFKLDPQTNPFAPPEPISNSGGEVNIDIKSVDQRIEAAAEGLGRLPEYLPSIADLLLFNTSYNPYRAYVS

SEQ ID NO: 55481 - protein, 130 aa, Sorghum bicolor
  Clone ID: 30163414.pep
MPSVLHLLLLLLAASAAAAATAGAGAGAGTSGDPRAYEALFDAWCAEHGKAYATPEERAARLAVFADNAAFVAAHNARVNAAGGGGAPPSYTLALNAFADLTHEEFRAARLGRIAAGAAALRSPAAPVYR

SEQ ID NO: 55482 - protein, 197 aa, Sorghum bicolor
  unsure (1)..(197): unsure at all Xaa locations
  Clone ID: 30163445.pep
PIIFYHPSIDSQDQLSLRTHLQRSQSIFILRESEGIFTFAKNFQTSFILIISKKDEEAQNVREKLKNVQDIFMRRLADFEEKEILKATPYKKTEPLEAHVLYTRQDFEKEDIKGIMRELKTAEAARGFREEFLYWENPQRDGVFQESEGCDKYLGEEVYKECQRICKATLXSLVKTKGKEKTKMIFYVNLAESCKEF

SEQ ID NO: 55483 - protein, 113 aa, Sorghum bicolor
  Clone ID: 30163454.pep
NKNSRIIKPLILDSRSCEMVPRNCTVKNKIAKIPSKIMSSCAFTLSLVLLVLLKGLLDPGLGVGMVLLHEVLGKIPHSLSSLKETVSVVNYSLDNVHLALTGVGNPGHFARQV

SEQ ID NO: 55484 - protein, 73 aa, Sorghum bicolor
  Clone ID: 30163462.pep
AESERSVQDALDRVMVNRTTVIVAHRLSTIQGADVIAVVKDGVIVEKGRHDTLIKIEGGAYASLVALHSAAPS

SEQ ID NO: 55485 - protein, 78 aa, Sorghum bicolor
  Clone ID: 30163479.pep
LKRSDDRPEYASIQAVLFGPFLLAGLTTGEWDAKTGAAAAAATDWITPVPPGSNSQLVTLAQESGGKAFVLSAVNGSL

SEQ ID NO: 55486 - protein, 152 aa, Sorghum bicolor
  Clone ID: 30163481.pep
PDQPPVIFDYTADASDTAMLQYTPKSTKVKTLRYNETVEMVLQNTRLIAKESHPMHLHGYNFFVLAQGFGNYDEATATPQFNLVNPQERNTVAVPTGGWAVIRFLANNPGMWFMHCHFDAHLDLGLGMVFEVQDGPTAETSVPPPPADLPHC

SEQ ID NO: 55487 - protein, 68 aa, Sorghum bicolor
  Clone ID: 30163484.pep
TQIKSWDHAVGVICVQEAGGQTSDWSGKPLDLAADLTSRRIIYPSGGVLVTNGVLHDRLVEMISANNE

SEQ ID NO: 55488 - protein, 127 aa, Sorghum bicolor
  Clone ID: 30163490.pep
SDGGGDEYMNCLAVPATAPGVPRQHQIGSILNGGGVSVTGSSFFREGVHGQQFQGQWLNRFPAPAAIEQKPQLLDSSAMTIAFHQNDQSVAAAAMTNDQCYKDGYWDEIAKFMEVNDPTVLYDCRYA

SEQ ID NO: 55489 - protein, 93 aa, Sorghum bicolor
  Clone ID: 30163492.pep
TPRVHDSVNISYACVEAYQGTGTCRFNMAQMQTTAAWCTEAYSPAPLRAPTLRGRKLKQPQPFLVITTLSEQTIISLAAGPQTYSTPSHSIHV

SEQ ID NO: 55490 - protein, 174 aa, Sorghum bicolor
  Clone ID: 30163508.pep
NEFTPSHHKERKRSCARQDREHPQRKRANARKRTKERSGSAVTQLRVQFVRLLFLRRVFRVLLLLCVFCVFVGFELIGIGVLILIRVGDDGVDPGFGGQKVKGPRAHVHRVNGRDVRALDVNGRVRVLTADRGRIDVRNRAEVTGQIRERCVNVHEQRPVSHIRVIAMTEGKSG

SEQ ID NO: 55491 - protein, 140 aa, Sorghum bicolor
  Clone ID: 30163516.pep
AGFGNVHGVYKPGNVKLHPELLGKHQAHVKEALKSDNDKPVFFVFHGGSGSSKKEYLDAIGFGVVKVNVDTDMQFAYCSGIRDYMINKREYVNTTVGNPDGEDKPNKKYFDPRVWVREGEKTMSKRVAEALQDFNTANQL

SEQ ID NO: 55492 - protein, 93 aa, Sorghum bicolor
  Clone ID: 30163517.pep
DHPVTNPFGPGSPALGAVAFPRFLVVSAGRDILHERVLRYAARLQEMEKPVEVVVLEEQEHAFFSRQPWSDGTSEMIRVVKRFVSEEIGAECK

SEQ ID NO: 55493 - protein, 201 aa, Sorghum bicolor
  Clone ID: 30163530.pep
SEKSYLLYTLSVSAAAMAKAKQFVCICAAMALAFVATFANATVCNIMILTDLNAWDHEQRMGADIMVSALDLHADTDYRVVYGGSALTGGELTQTATAVAEKIAACHAAGRKILIDWHSAQSTRSIIKKMGPLLWQTLRRAAAGGDANHLRNAVHAAVPRPVINMFSCSPFDFGDYDFMRDSVNSINVANWGGVAGSGAAA

SEQ ID NO: 55494 - protein, 125 aa, Sorghum bicolor
  Clone ID: 30163544.pep
RSFGCFSVESVSNRNAVSIKAAGHVVIDWWLVCLLVKYVESRQAFDAAAAAVVIVVVPPHRRVTSADPAGAAARGPRRVHRAVWPLGSGHGPLCRVDSPAIKRSNPEILLLFLVKGAAFFCCRGL

SEQ ID NO: 55495 - protein, 112 aa, Sorghum bicolor
  Clone ID: 30163549.pep
CFDISLLQHPSIKLNRSFNLAKQSSKRKQRNNSQQWPSLYLGDFIRCSGSQSFLHSLSSLSSSAKTHGHQFLDLLTAGRFLSPPMMASSPHGWVTPRRHPQRTPTTLCALCS

SEQ ID NO: 55496 - protein, 170 aa, Sorghum bicolor
  Clone ID: 30163557.pep
MASAEARRLAVVPQLEIEQILKEAQHRWLRPAEICEILKNYRNFRIAPEPPNRPPSGSLFLFDRKVLRYFRKDGHNWRKKNDQKTVKEAHERLKSGSIDVLHCYYAHGEENINFQRRTYWMLEEDYMHIVLVHYLETKGGKSSRARGNNNIIQGTAVDSPVSQLPSQTME

SEQ ID NO: 55497 - protein, 95 aa, Sorghum bicolor
  Clone ID: 30163565.pep
MDQSRRAVESYWRSRMVDGVTADDDKVAPVYKLEEICELLRASDASIVKEVADFVLKRLDNKSPLVKQKALRLIKYAVGKSGTDFKREMQRHSVA

SEQ ID NO: 55498 - protein, 106 aa, Sorghum bicolor
  Clone ID: 30163568.pep
SSIEIEGRKESSSPSPGWRSSLRPLPALRRGKPDTEVCTVLSIAANVLWYTPQLAVNKIMTGNLTQCHDKIKHEADINGNIKIFTEVEIERITRNFSTLIGKGGFG

SEQ ID NO: 55499 - protein, 214 aa, Sorghum bicolor
  unsure (1)..(214): unsure at all Xaa locations
  Clone ID: 30163577.pep
NYYSWRKIYCTYTSRKDRSIMVAKEFGREAVISMEKVKRDGEALIAARAGDEEEDDVVLPGFRFHPTDEELVTFYLRRKVARKPLSMEIIKEMDIYKHDPWDLPKASTVGGEKEWYFFCLRGRKYRNSIRPNRVTGSGFWKATGIDRPIYSAAAAGAATANSGESIGLKKSLVYYRGSAGXGTKTDWMMHEFRLPPAAAAATATDASPSMQEAE

SEQ ID NO: 55500 - protein, 216 aa, Sorghum bicolor
  Clone ID: 30163579.pep
LLVPHVILVERKSVITMVSASHAYSLETSLGRAKPSNTNWQSRQTRGKCIILCRRTVQGGKDKTSVGGKTKPKNTKVNVSTTQAPSATTRRVPKESSIQKFVKQTPLLNRFSDGTLLLGDIVMVAATEASSGRIRYEDMPLLAGVSVVCWCVAGVALGDYRGVPPQSDNWYINLLGPVFLAIVDSTLTWALSVTLALAVYSVLVSSFLMDSAPLFD

SEQ ID NO: 55501 - protein, 127 aa, Sorghum bicolor
  Clone ID: 30163590.pep
CWCSCSTGCGGGATLRTDAHAPRCSPDGDAGTLKATEYRGVSVASAVLAAAAGEPEARPPSTKEARAGGSGSGSRSGSGNGRALLAPWAIPAIWTLSLVDMAAWSLVRIAQLASPEEEEEEVRTTYT

SEQ ID NO: 55502 - protein, 62 aa, Sorghum bicolor
  Clone ID: 30163611.pep
KILLLHLIKSSYRSCQKTNGYSGFGRYHYFNEQTVGAPRFTRLCASDSSWFRPYRECRNLPL

SEQ ID NO: 55503 - protein, 62 aa, Sorghum bicolor
  Clone ID: 30163626.pep
VYNVCVHLFCMVNAHHVPSYDDLACPHQVVKKAMVVFRLARIDRLLFSIIIRVCFMYGSYLV

SEQ ID NO: 55504 - protein, 167 aa, Sorghum bicolor
  Clone ID: 30163627.pep
GWGAACRAIVVYDGMSWQGMTSCDAKHAMSMAIQFRPSPSFRIEVQNSRRSAVKPYPRGRPKRKRLKFSRLRRRFSYSEVAFTFPVMARSSFDKEKVTRTYATPGSWFPGLTARARARGPPRKRNHQRWLARGRLVALPSASCRVRSTRPFQTRRLPLQSSNHPRRA

SEQ ID NO: 55505 - protein, 76 aa, Sorghum bicolor
  Clone ID: 30163640.pep
ILWFPILRALRLPLGCVVLCGLVSDCGSVVVRRLSRSLRGFGASLPVTWSHPTFVRYKASYPLFAVSYPCSFDLLS

SEQ ID NO: 55506 - protein, 105 aa, Sorghum bicolor
  Clone ID: 30163643.pep
CLLQAEVVYLGMLKHPHLVKLIGYGCQDEQRMLVYEYMARGSLEHHLFKNLLSTLPWCTRLKIAVGAAKGLAFLHEADTPVIYRDFKASNILLDSVSTSWLMRAF

SEQ ID NO: 55507 - protein, 174 aa, Sorghum bicolor
  unsure (1)..(174): unsure at all Xaa locations
  Clone ID: 30163670.pep
MSAEGKGAPGGPKEVKPAAAAPAPSASASSNKDQKKSVTMAPGTVDNTKPATDKAAAAAAAAAASSNTTATPDDEEFSTANCRMYESKYPEADDLVIVQVKNVAEMGAYVSLLEYNGIEGMILLSELSRRRIRSINKLIRVGRTEVVVVLRVDXEKGYIDLSKRRVSXEDIVRC

SEQ ID NO: 55508 - protein, 154 aa, Sorghum bicolor
  Clone ID: 30163676.pep
KHRGPAVPPADQRSQNNRAWRKEAPPPPRQSSGAGAAPAPTPSGFSRGSITASSAFSAPPHPKPAAARPSLPARSRDRGSPRASGRRMKSRSRTSRHGAPMPPPPTLPLPLPLPLPRRPWRASTGRTGTASSTSMTAACAWTPRAGTPRPRSPS

SEQ ID NO: 55509 - protein, 164 aa, Sorghum bicolor
  unsure (1)..(164): unsure at all Xaa locations
  Clone ID: 30163682.pep
QSQSAPDPSPRQEHARTPADLGLSTFLSAAHDPPSPSYIPKTALRLDPRKKKEGIHTHTHTHTHTHTHTQLLHSISPMASSAQQRSSSAVISDDGCAIASRLNASAEAAMGNTEHAAQWAAARPRPRSRVDYDYERPASXSPKKKYDVFINHRGVDTKHNVARL

SEQ ID NO: 55510 - protein, 128 aa, Sorghum bicolor
  Clone ID: 30163688.pep
RGTRPRPQPERERERERAACAYLPACLPACPAACSRLMIRARAQEYKAISARPGAAPSGCRCFLSRGATRDSLVLLLSPSSALRGAGGPRRSHRNSRPTETQAGPLPRLPATTDSSLFSFLLPFMMFR

SEQ ID NO: 55511 - protein, 167 aa, Sorghum bicolor
  Clone ID: 30163712.pep
MAAGSSSSAAMPTFAFGFLPPVSEKLTRANYNMWHAQVSSTIKGAQMGDYIKTGAAPPPALLDGVVDATTGKKGDPVPNPAYQTWMIQDQQVLSYLFSSLSKEIFAQVSSATTAAAIHAQHASQSRARIISTRMALATASKGTSSVADYYTKMKGLADDMASAGKKL

SEQ ID NO: 55512 - protein, 124 aa, Sorghum bicolor
  Clone ID: 30163724.pep
GSNFIEVDVDIGSSIVANAIVHLAFGYITTLTVDLAFLIESQNESELPERLLGAVRFFELNPGSAGLFEKRSEEHQESTQSRPVGFWQGFSQLLNNQGNPREPSPTLQNTNGSLHKEEANENSK

SEQ ID NO: 55513 - protein, 223 aa, Sorghum bicolor
  Clone ID: 30163730.pep
KFVEDVNIPDGTEVPPGTKFTKIWKFLNDGSVDWPAGSCLLNVGGDKLGDSFESKIPQAIKPGESCDVAVEMVAPQAPRRYSSYWRLHTPDNVRFGDRVWVDIIVPVPAPLPQNTQPLPSAPIPVGVPNALPLPQQPFGVPQSHPQPLPVAQFLPNPVPQPLPQQPQPLPGVPMPPLQPNDPQADALKMLADMGFHDTERNRQLLIQFNGDMIRIVQKLLGVF

SEQ ID NO: 55514 - protein, 113 aa, Sorghum bicolor
  Clone ID: 30163740.pep
ALDSVGKQCSVRFISFGTYFPASAYTADPPHTVILDNFRRDLIVKQGVTALWLYRHSGFRSSRFKRRLEPRVLSSPSTNELGQLSDEARPGKRRLASLVQSPAKCQSCSQCTA

SEQ ID NO: 55515 - protein, 68 aa, Sorghum bicolor
  Clone ID: 30163741.pep
MIYQAKTTTEMEEVMLKGLNRLSWERVDVSFKKSRQRIFAHSTIQVKTYFLNSDGADVIFHMIDHFIY

SEQ ID NO: 55516 - protein, 178 aa, Sorghum bicolor
  Clone ID: 30163744.pep
ERPQQYNIGPHGQIVITANVKVSSTENGIIFGSIVYDIAGAVQSERRNCVVLNEIHIDVIDYIAPGQCQDSEFRAMWADFEWENKIAVNAAFSDLQAFLTHLIKSTNMRPLTSHEHMPDDCGFLSVNLYARSVFGEDALANVSVEQIGEKIVGFVRIRSKTQGIAISIGDKISQSLKK

SEQ ID NO: 55517 - protein, 60 aa, Sorghum bicolor
  Clone ID: 30163749.pep
LTPPDVFEMILQHLIFLFFNLFFWISCNQGRRWRSRLVLCFIFLKHTSNIAFPLHVSIIR

SEQ ID NO: 55518 - protein, 119 aa, Sorghum bicolor
  Clone ID: 30163755.pep
DEEEEHEGRHARLAVLVGHTGPVKCVAVAADGDDDCYAYDADGERRFVVYSGSLDGSVKVWRLSEERALEPPPAVEATTAPFMAALRESEAWMPRRRTAQLPASPLQAWAPELKGVAAA

SEQ ID NO: 55519 - protein, 183 aa, Sorghum bicolor
  Clone ID: 30163760.pep
SGYFAKVDDFWRVPVRALWLQGGVMALIGILYTFASTVLEAILSVSTIALTVSYGMPILTLLLVGRDKLPPGEFSLGRFGSVINWVSVVYCAVTTVFFFFPGAPNPSVSDMNYAIAVFGIMLVITLVFWVVKGRITYLETEEAQGNIIYAQRAERANYIDVDAQTKADTEARRASQTGGPSAS

SEQ ID NO: 55520 - protein, 184 aa, Sorghum bicolor
  Clone ID: 30163777.pep
PQAFGQCTAFISTYLKGVEIFEVSSTSKAAEIASKDTTGTWAAISSELAAKLHGLDFLGKSIEDREDNTTRFFVIGKHAAGPKDLEKTEKAVAEKGSKSLVSFTVPHTSPGALADVLSCFRTFDINLTSINTLPSLVKPFQYIFFIEFEGHKYVDPQGRVNGALDKISRVAESWRWLGSWERYI

SEQ ID NO: 55521 - protein, 122 aa, Sorghum bicolor
  Clone ID: 30163785.pep
TGNGRERNNMPSIERSEEYLDRGGYDRKGKHQPSGSMQNVGSTSNMNAGGVVNTGGNLPNGSSNRRDDKGDKNGGQRTSHKSASPAPDKLLRKEGKFALLSAIKIYGGTKKDKPPMPKKLPS

SEQ ID NO: 55522 - protein, 169 aa, Sorghum bicolor
  Clone ID: 30163807.pep
MDKRLLEVCSKGSMVSRSDDPGNDGSRQLLGVQPPLNDPQSNRNSHQPKGRDEDEESNILVAVRVRPMISREVNLGDFDIIRTEDNLIIVMDPVELQHGMQNKQVTDILHRSKEQKYAFDKIFTNESQEQIYNETCKSLIHPVLTGYNACMFAYGTTGAGKTYTMLGYQ

SEQ ID NO: 55523 - protein, 132 aa, Sorghum bicolor
  Clone ID: 30163815.pep
RNFIYHSRSIPNMTQISCFNGGGREWILTEQIQQRAKNLKSFVQKTGKLVCSANRNQRCSKISQNLFVLFFSLYKHLTEQEIQSSSQKISHKNGRSTTQLKNKRGGLPVHPEQDIACYSLAMAARRHGLART

SEQ ID NO: 55524 - protein, 114 aa, Sorghum bicolor
  Clone ID: 30163819.pep
MDGGEDRTFKANFTGEGVTMLQDRVKEKLRELMGDYSDDTLAEYVVVLLRNGRRKDEAAKELQVFLGDDNDAFVSWLWDHLSTNLHLYVQPKAASSKDDARSTRSAARGLPVRD

SEQ ID NO: 55525 - protein, 48 aa, Sorghum bicolor
  Clone ID: 30163824.pep
LTTIISTIGCHYNLHPSTTIEIPTSRFLCNLVKPCHQGLAGLHGVCYH

SEQ ID NO: 55526 - protein, 126 aa, Sorghum bicolor
  unsure (1)..(126): unsure at all Xaa locations
  Clone ID: 30163835.pep
LFFYQHNNTMSLVVKIQFGQDTRRVSVSSGLPNFQALADLLLRLFPNLNLHDYAIRYTDPENDLITVSSDIELREAIDLCTSERAPLRLLITPKDQISGFPSLMMSSNLNASXSQSQLFPNNNNSP

SEQ ID NO: 55527 - protein, 146 aa, Sorghum bicolor
  unsure (1)..(146): unsure at all Xaa locations
  Clone ID: 30163845.pep
MLSYEPTPMSIKTPTKPTTIALPPTTSSPMTVAPPSINSATINGHKAQGQQHIXLVTGPAGCGKTTVAGYLAQSLGLPYIEGDSFHPPANIDKMRNGIPLTDANRWDWLTALREESIKRLNSGSNGVVLTCSALKRKYRDVIRVAG

SEQ ID NO: 55528 - protein, 126 aa, Sorghum bicolor
  Clone ID: 30163848.pep
MADKPCTLLVHSIGLEPPQIQQLKNQFENGTDQEKIETLKKVILLVLNGESLPQLIMHVIRFVMPTKNHTIKKLLLIYWEIVNKKSADGKLLHEMILVCNGLMQDLQHPNEYIRGSTLRFLCKLKE

SEQ ID NO: 55529 - protein, 135 aa, Sorghum bicolor
  Clone ID: 30163853.pep
LPSPPPSSIVRCCCHSPFCSSDPAEGRHKRGRDREPRERRSRRGVDVQGHEAAGGGRAAAGHAAGRQGSCPRMGSWWQQAAERRGKLQSGHRQTVGAARRPEVGLRRGARRRVVGGDQRRGVVGGEQRRGGVLCF

SEQ ID NO: 55530 - protein, 91 aa, Sorghum bicolor
  Clone ID: 30163860.pep
RPRRRGRRGALEGGGGVAVVVGEGGVGGEGPRGGSSGDRGRRRRPVDAEEVHELLAVAHGWKWVAVRVYVLALCAWRGRSRRKEEVALMAR

SEQ ID NO: 55531 - protein, 116 aa, Sorghum bicolor
  Clone ID: 30163864.pep
MTNDVETNSALKRSDTTNQAIRDAEDLAIFGHDQCLTRKFSMWSMFALAFSVLGTWSTFAQGIDSGLTSGGPIAILWGLVLVFVCNICVAVSLGEMCSSMPTALGQAYWISRLWPT

SEQ ID NO: 55532 - protein, 158 aa, Sorghum bicolor
  Clone ID: 30163879.pep
MNSAFLEQKSEVIGDSEENISPPEVTSNVAPDVKHADNLKVDAFIPFAELSLCRHLLSEGMGEDAACSAFDSEKITLEKFRDMKQSLMRNNKLVVRIAGRYFPWDAAAPIVLGMISFSEEQVFEPKGMIKVERVEQSEAPGGSWRIWPFSFRRTRTIS

SEQ ID NO: 55533 - protein, 103 aa, Sorghum bicolor
  unsure (1)..(103): unsure at all Xaa locations
  Clone ID: 30163881.pep
MRRQTEFWCSVTEISAPSLRVYPHTKNGWAFENVVLQMQMSCLRMRLSPSCENWEEMQSIGSVTKLLWLFRLCSSVGVFDSRFCLSLTQLNTKEGVGDVVLMX

SEQ ID NO: 55534 - protein, 167 aa, Sorghum bicolor
  Clone ID: 30163885.pep
MEVSAMEDALPKATARRKGGLRTIPFIISNEIFEKVATFGLTANMILYLIERYLMSSAVATEVLYFWNAISNFLPIFGGVLADVRLGRFRVIALGSCVSLCGMCLLCLTAILPVYKKTPECAAGSGCVVLPWQLPLLFTSFALMSLGSGGIRPCTLAFGADQLDKRD

SEQ ID NO: 55535 - protein, 54 aa, Sorghum bicolor
  Clone ID: 30163890.pep
EYIYEIYPSTYLPIYSRFEFSSMIINNILRISLLCLFFFSRRKNIYSIYYHNKR

SEQ ID NO: 55536 - protein, 47 aa, Sorghum bicolor
  Clone ID: 30163893.pep
YLSILRGRLNRTFCYLLSPVHGVHVKIKILSILKINTPVLSLECPST

SEQ ID NO: 55537 - protein, 105 aa, Sorghum bicolor
  Clone ID: 30163899.pep
LKMRCPCPSSNGQMDPTVVPQDPVTPATFDNQYYKNVLAHKGLFVSDNTLLDNPWTAGMVHFNAAVEKAWQVKFAKAMVKMGKVQVLTGDEGEIREKCFVVNPHY

SEQ ID NO: 55538 - protein, 119 aa, Sorghum bicolor
  Clone ID: 30163906.pep
ELPSSRLRQRTIVLARNAYNIVGVAYTNIIGLYSLNPTAWNWGAKSAFFWAGNCALCFLWAYFRLPEPKDRSYAELDMLFDQGVSARKFATTYVNPYEVTERRGDHDSDIKEKSMSHVE

SEQ ID NO: 55539 - protein, 173 aa, Sorghum bicolor
  Clone ID: 30163934.pep
DIKSNNILLDENFEAHVGDFGLAKVIDMPYSKSMSAIAGSYGYIAPEYAYTMKVTEKCDIYSYGVVLLELLTGRAPVQPLELGGDLVTWVKNYIRDNSLGPGILDQNLDLQDQSVVDHMIEVLKIALVCTSLSPYERPPMRHVVVMLSESKDRTRVSSAFSPASDDSSKKDNS

SEQ ID NO: 55540 - protein, 169 aa, Sorghum bicolor
  Clone ID: 30163939.pep
DPSICKRSLTQLFAHFKQQGVDYNQIWNQIKKMIILTCLPMTTLEPKTPHDNCFEVLGFDVMLDDKYNPWLIEVNYSPALSIGGLMDQSIKEPLIEDTVNILNLDADVQHEFTAHRVSRVNPPHSTLGNYEQIFPFNKATRDAAANISADKRPQENVARIVQEVGQMYP

SEQ ID NO: 55541 - protein, 131 aa, Sorghum bicolor
  Clone ID: 30163944.pep
RHPCTLPTGRVGIITPPTGTAGTTLPTGTAGTTLLPTGTLGTTTKAGVAVATRRLLTAVVGQGGSDRFRRIGCQKGAMVEAPGRAAVATTGKSGGFRSALWVVTDRPTGKMDVHTGCCDGGVWPLQLPWYG

SEQ ID NO: 55542 - protein, 182 aa, Sorghum bicolor
  Clone ID: 30163950.pep
ELQRPPSSVLLSTALGLCKRHPAAALEAVLFPLVLRKGGLNVPQCDVLTRIIKECMHPLHVTAFCHRLLSGEDQERKPVCMPQHQESIGTNLVWTESLFTLFYNILSQDICLTPSTVGELISVIDDQASKFLRSLKFGNFLKCFVSKCWHECKHQRGLLKRAAERADTFLTKAVLAKLHPAS

SEQ ID NO: 55543 - protein, 155 aa, Sorghum bicolor
  Clone ID: 30163953.pep
LISGFLLGFVFFIRPQFAWLTQHRRVSAAAQPDGQPPAAAPTPPPVVSVKRKHKTYQYVLWLAAAVLLVVGFTVATVLLFRGYNANEHCPWCHYLSCVPTKRWKCDASPTTCTGTLQENTLTVVCAGGKNQTYVVASAADASQDRINDLCNQLCT

SEQ ID NO: 55544 - protein, 65 aa, Sorghum bicolor
  Clone ID: 30163958.pep
GDHGMDQQGLNLDIDLIDDSYLHAPLTKSPHLQFVGSQPTSKCSFKKFGEWTLSPNASFLPRKKF

SEQ ID NO: 55545 - protein, 215 aa, Sorghum bicolor
  unsure (1)..(215): unsure at all Xaa locations
  Clone ID: 30163963.pep
MHAESQQGPQAGHPQQPPAGYAQPQQAAPRSSAPPAQQQQDPALRGDPKLLVSSMFETTNPFEIPKDLYEIVPNLKIFDKLLQCEKNIDKLLAKKRIDIQEQLSKPLCRTKRILRIHIFNNHANQGNMVNSENPPYWIVRIQAKLLNQTQGTYPRKFSYFVQRLXVGFDKADYPTFEDVNWKXSSQSAELDGFEIKRFGNKETTLKIVLHPFNFP

SEQ ID NO: 55546 - protein, 153 aa, Sorghum bicolor
  Clone ID: 30163964.pep
MGVFQQGDATMSVMMRPVLHLMVGLVLYGVAEEMTVPALVDKVTAALCPADDRSCPEALYLTGLQSSVGGIFRTIGFTLMGQLADEYGRKPLILLTASTSIIPFAVLAWNNSRTAVYVYLVLRTLSFMIGQGTIFCLAIAYTADAVEPSGRAA

SEQ ID NO: 55547 - protein, 106 aa, Sorghum bicolor
  Clone ID: 30163973.pep
DARRGGVGRPRRGVGQCGAAQGDCGAAPFPFLVLLAGDSLAISFILVLSPSSSNPVPTCSIWPPPVPTCSSNPVSARPSSLSLLSPRAACDGLFTCGFGEESSPFV

SEQ ID NO: 55548 - protein, 122 aa, Sorghum bicolor
  unsure (1)..(122): unsure at all Xaa locations
  Clone ID: 30163977.pep
LTCAAALLPPLLRLPSFFPFLSFQQAGRQGYRSIRVIRVLPPHALPAPPPFPFSNAGQPAAQFHPSIVLFLPSPTINHQSQPAIXPSIISAQLTTNRSVHHRRPALPAAVARLTHHRPPPTH

SEQ ID NO: 55549 - protein, 176 aa, Sorghum bicolor
  Clone ID: 30163983.pep
LNSQSMGDRRAWSEIEDKAIKELVEKYGIRKWTVVAQKMEEIYCLKGRSGKQCRERWHNHLDPKINKKPWTEREEQIIFGAHKKFGNKWAEIAKLLPGRTDNSMKNHFYSTLRRSLRRINKSLGDKNSTAQVKDIKPGVLPKIMNITEEANSSTGQDENLKRLITVAKGLEETLLD

SEQ ID NO: 55550 - protein, 106 aa, Sorghum bicolor
  Clone ID: 30163994.pep
QEEEAKSGAMRIHGDGAGKGGSASASSLLASAAILRGMDAAMARSQGGKDGSELRPFCAELRERRGRRRRGVRWTGGTRGESGWERLDEGRRAKRCGRLSYECFVV

SEQ ID NO: 55551 - protein, 91 aa, Sorghum bicolor
  Clone ID: 30164000.pep
LHLLLTISNSQSRSKAKAASKPRVRVASDRPIYIQLIVHHRHEVDVVSNCLCLGGARRRLLIGGTRTGLTGGTGGRFLQALVPTGRVHRAR

SEQ ID NO: 55552 - protein, 164 aa, Sorghum bicolor
  Clone ID: 30164005.pep
MAFNNGPDEKGVAHMDDRRESIAAQHIHEVNDSAELRGILTAAENAAAAEHNMTFMEGLRAYPKAMGWSIALSTCIIMEGYDTILIGNLYAMKPFNEYYGHPDGKGGYSISAAWQSGLTNGASVGEIIGLYVSGWLADRYGYKKVLAAALVMMTAFIFIQFFSV

SEQ ID NO: 55553 - protein, 66 aa, Sorghum bicolor
  Clone ID: 30164009.pep
LDAPNCDHGNWDPVSSCLFMHSRLCRCPGKKARAGYIAIQPTKIEATRLASSSRGGDHAGGAEIGT

SEQ ID NO: 55554 - protein, 157 aa, Sorghum bicolor
  Clone ID: 30164025.pep
MSIPRLLVAVLFATLAAAASTPAHAAGAGSCAAEKFSDNRVFAACADLTRLGASLHWSYDATTSSLSVAFLASPPSGGWVAWGLNPKAQTMDGTQALVAVPKANGGGYEVQTYSISGTTLDNPGPLPNYQTSNLAAEVAGDGRVTIFGTLKLQNGTG

SEQ ID NO: 55555 - protein, 194 aa, Sorghum bicolor
  unsure (1)..(194): unsure at all Xaa locations
  Clone ID: 30164036.pep
HKLTGEIPTTFVNLSSLLELNVSYNYLSGALPPIPLFDNMSVTCFIGNKGLCGGQLGRCGPRSSSSSQSSNSVSPPLGKIIAIVAAVIGGISLILIAIIVHHIRKPMETVAPLQDKQLFPAGSNMHVSSKGAYTFQELLIAXNNFDESCVIGRGACGTVYRAILKAGQTIAVKKLASNREGSNTDXSFRAEILT

SEQ ID NO: 55556 - protein, 57 aa, Sorghum bicolor
  Clone ID: 30164040.pep
RMVRLQIKNLGVQEKWMYRSSYKIGKRLVGDHPMVHVYKIKGILRSPAGCLSNWGEL

SEQ ID NO: 55557 - protein, 108 aa, Sorghum bicolor
  Clone ID: 30164047.pep
GDCDHLQLCTAERQHWGLQHHRQLNRESLWICGNLNRSIVGNLKSQQRFSLPLILQNVNPHPISVSLLVFIFNPASTRTNRGSLICHLASTGLKTFLVYPVMLSQPHL

SEQ ID NO: 55558 - protein, 73 aa, Sorghum bicolor
  Clone ID: 30164061.pep
GSNSRSPNTSQGGGWMGMNSTPKVIPDPINDTKMKSKGQNYKKYSDLFRKQKEMSEIANNFLKEEIKGKIQRK

SEQ ID NO: 55559 - protein, 140 aa, Sorghum bicolor
  Clone ID: 30164064.pep
DGGRTVTMLKINPSTETVELVPEAPTPSGITDLTKAISSTEPRFTFYRYTHTHDGAESSPVLFFYTCPATPGNKSIKFRMMYPLMKRSVLEVAESQAGLKLEKKFEVEDPSEITEQSVLEDLHPKAAARQGFSRPKRPGR

SEQ ID NO: 55560 - protein, 133 aa, Sorghum bicolor
  Clone ID: 30164073.pep
SIRPNLALRLAVQAFKREEDSAKSLKRRRDRLELDKCGDDDPNRTDLASRGKGVQFPFAVFDRVIIKGNKRTPERFVGRQAVVTAQCLNGWYVVKTSDNAESVKLQYRSLAKVADGNGPSGLVSSNTQSSSWL

SEQ ID NO: 55561 - protein, 90 aa, Sorghum bicolor
  Clone ID: 30164075.pep
SFNAAFEDAHRVQSGWCVPDNQLREELRISIAEKLLPAYRSFLGRFRHHIENGKHPELYIKYSVEDLEIAVGDFFEGVPPSPHNRRRSHG

SEQ ID NO: 55562 - protein, 160 aa, Sorghum bicolor
  Clone ID: 30164078.pep
ENKFLVRAILDQGDTEVYFSDFIEKISSWNARQKRILLITEKALYTFDASTFELKRRIRIAAIDCVHLSKDASDMFVVHVNGEHDHLYCAPKRPEIMYHLMRLYQALHPAHEHLTTRFGERMVVDDKGNWRRDVLVPQSQTVSFGTRSIFEAQKKFQQKS

SEQ ID NO: 55563 - protein, 77 aa, Sorghum bicolor
  Clone ID: 30164087.pep
YSAPFAIYHQYLDPLAKCMHSLQVSKMAIGLQLSEPWLREYQVLPSRTHPHMQMNAFGGYILSGIRIHNTDCMIANK

SEQ ID NO: 55564 - protein, 44 aa, Sorghum bicolor
  unsure (1)..(44): unsure at all Xaa locations
  Clone ID: 30164094.pep
RFSYGTHXFDTRNKSIHGTNTITLLSLQIYRQETPVLGIAKHNG

SEQ ID NO: 55565 - protein, 86 aa, Sorghum bicolor
  Clone ID: 30164108.pep
QHRLVRAGARRGRVPPHHHPLRRLQLRGRSVHGWQAGLTPRLHHHHLLFFLSLDPKLAWLAGWLCRGGANPGSRTCGRARVGVRDG

SEQ ID NO: 55566 - protein, 165 aa, Sorghum bicolor
  Clone ID: 30164110.pep
PQSFVMASTTSAILAVGLALQASLGQAASGTAQDFKSRSLLSTAKTTTNIKLSVQDSLNKFNALDSSVNTGVTGVNTGKVTVSTFNDAQQNGNIGSGNTITNGGSGIVVIPLRRLSSTSTTTTSNIKLSVKDSLNKFNALDSSVNTGVTGVNTGKVTVTTFNDAQ

SEQ ID NO: 55567 - protein, 195 aa, Sorghum bicolor
  unsure (1)..(195): unsure at all Xaa locations
  Clone ID: 30164116.pep
KRKELFTLYFKKAETEGAVMDAKHSLGARSGTPGPFGGGTTPVQTPTPTAAAAGRPGSAASTTTTTTTTLTLTTKPVDAPTPTPTSLAGTTGTTMGATGLLGAATGTALPKKKRSTREKLAALEALLRQFDAQFLLTDTSTHPVRTYYPEWAVPHAAKIXAQIERLLTKAKGAELDGAAAELGHRERAEGEQHTG

SEQ ID NO: 55568 - protein, 155 aa, Sorghum bicolor
  Clone ID: 30164124.pep
MAFAMKSASLKAITVRQTKSGRLAPVRVSVEWYGPDRPKYLGPFSENDTPEYLTGEFPGDYGWDTAGLSADPETFKRYRELELIHARWALLGALGIVTPELLSTYAGVSFGEPVWFKAGAQIFADGGLNYLGNENLVHAQSIIATLAVQVVLMGL

SEQ ID NO: 55569 - protein, 205 aa, Sorghum bicolor
  Clone ID: 30164126.pep
PPPPIRREAWEGCSVLLDINDGDRLAFFRLTPGATAKIGNKTCSLQPLVGRPFGSLFRLGAGGLVPCAAGDATSRDHNTRDGADGQTQDETRDNRSLVDNNTAQNLSSDDIEAMKRDGATGDEIVEALIANSSTFGNKTVFSQEKYKLKKQKKYAPKVLLRRPSARSICETYFKKTPARIGFMRVDTLSLLLSMANIGAYSDVLV

SEQ ID NO: 55570 - protein, 114 aa, Sorghum bicolor
  Clone ID: 30164131.pep
ECILFTCCLIMDNTQNQPLPPGVGTWPQAPPSHPPQCHADPQSYHLQFDTRPDNASANSSGSAANIESAVQEAVLHAQDIETQQVIQNQRHANTTSEPTTYGEDLLSNRRDPSA

SEQ ID NO: 55571 - protein, 67 aa, Sorghum bicolor
  Clone ID: 30164139.pep
MGNCCRSPAAAAREDVKSSHFPASAGGGKKKPHQARNGAGGGGGAGEKKRLSVLGEEGGDVGAGIEE

SEQ ID NO: 55572 - protein, 59 aa, Sorghum bicolor
  Clone ID: 30164145.pep
MVLVLALGDLHIPHRAPDLPAKFKSMLVPGKIQRIICTGNLCIKEVHDYLKSLCPDLHI

SEQ ID NO: 55573 - protein, 178 aa, Sorghum bicolor
  Clone ID: 30164148.pep
MQSGISASQELQNEFNSLLSNDTFGLLATIEKESMVPITTIPSKSSSFSDNLSGLEPHLKTDTALYIILRRHEDAPRFIAITYVPDSAKVRQKMLFASTRLTFVRELGTEHFRETIFVTTPEELSAKGFEKHDAHNKMAAPLTEEEQQLGEVKRAEQEAGSGTNKKEIHLSKNFAMPV

SEQ ID NO: 55574 - protein, 80 aa, Sorghum bicolor
  Clone ID: 30164175.pep
HTIIICYTYTIWAILLSHQLNFQKNPIRIIGAHLGALPQPCANKAPEITGSSNRNRPPITTHVLDTARGSPASGIEIHLE

SEQ ID NO: 55575 - protein, 186 aa, Sorghum bicolor
  Clone ID: 30164185.pep
ALWARKPSLLTAALGTEQEYILKSAAADGHDDVVDYKDWSMTLTRRFRSLKLWLVLRCYGVEGLRDHVRAHVGMAASFENMVASDARFEVVVPRLFALVCFRLLSPEKLGGEKTANELNRRLLEEVNATSSGPYMSSAMVGGIYMLRCAIGSTLTEERHVQEAWKVVQDRAASLLRKMEIIYSVLA

SEQ ID NO: 55576 - protein, 188 aa, Sorghum bicolor
  Clone ID: 30164186.pep
ERDVIMPLVAHHQVYLYQIDNYQKDSFWFQIKNAAAVLQASFRYLEFYEEADQTIFKRVNESRILLPGKVLIHDSAEIDKTAKIGPNVTIGAGAKIGAGVRISNAIILDGAEVMPSTYISNSIIGWNSVIGRWARIVGLSGSEKAPSENEGITILGVGVTVEAEVFISNCIVLPYKNLAENHHGEILL

SEQ ID NO: 55577 - protein, 63 aa, Sorghum bicolor
  Clone ID: 30164191.pep
AETLEDLEVKKRRVLEAGAAQDEVRICGVCNVVVNSQKVFEFHIAGQKHQAMIQKQQALHFVT

SEQ ID NO: 55578 - protein, 48 aa, Sorghum bicolor
  Clone ID: 30164197.pep
PSNGLCPRQICSRPPSFASIKTKRGSQPFDALPMIYLLPLAFVTTPLF

SEQ ID NO: 55579 - protein, 81 aa, Sorghum bicolor
  Clone ID: 30164199.pep
QSGGTSTPRQADTDRGDIWSHRRIGQGCDVPSLDAPCMSIYCTVLVSLSCGKLNSAPFCFFFLPTELESGKWTIYCRRPKS

SEQ ID NO: 55580 - protein, 202 aa, Sorghum bicolor
  Clone ID: 30164209.pep
QAEAAARSVVYISLGSLAVISHEQFTEFLHGLVASGYPFLWVLRPDMLGASQDAALQEAVAAVGSGRARVVPWAPQRDVLRHRAVGCFLTHSGWNSTLEGIVEGVPMVCWPFFADQQINSRFVGAVWRNGLDMKDVCDRGVVERTVREAMESAEIRRSAHALAERVKRDVADGGASALEFERLVSFVRELSTSAAQTPISNV

SEQ ID NO: 55581 - protein, 93 aa, Sorghum bicolor
  Clone ID: 30164219.pep
GNKTDLVDKRKVTTGEGEAKAQEHGAMFIETSAKAGFNVKPLFRKIAGSLPGLDALSSAKHEDMVDINLRPASGSSASGAVAQLEQKSGGCSC

SEQ ID NO: 55582 - protein, 60 aa, Sorghum bicolor
  Clone ID: 30164225.pep
LFKVSHFSHLNNKFRKWNTSNTCRNEKGSVLITIYSPGNNIYNKFKHKVGALCMAKKENA

SEQ ID NO: 55583 - protein, 162 aa, Sorghum bicolor
  Clone ID: 30164229.pep
MAKAEAAAAAHVLVFPAPAQGHLNSFLHLSTGLLRAGLHVTFLQTDHNLRRLGAAVAEATAAAPRLRFLSVPDGLPDDDPRAVDGLPRLVEALCTKASASYRALMLASLSPRADGGGGAADGFPPVTCVVGDGILPFVVDVAEELGVPAISYRTVSACAVLA

SEQ ID NO: 55584 - protein, 42 aa, Sorghum bicolor
  Clone ID: 30164240.pep
MAVVSALAKYKLVFLGDQAVGKTAIITRFMYDKFDDTYLVGP

SEQ ID NO: 55585 - protein, 83 aa, Sorghum bicolor
  Clone ID: 30164252.pep
QPRRPRRELPRDAPRHLLLRRPVHGSSSQGLRRPPPAWDRAGGGGGNPREEVVLDCWWDARGGWVLLGIWGRMIGRGRCCLCY

SEQ ID NO: 55586 - protein, 180 aa, Sorghum bicolor
  unsure (1)..(180): unsure at all Xaa locations
  Clone ID: 30164253.pep
ILNGLDNANEILDEQAFNTSEWKVIGEYVYDGEGGRHHAFLAPTXPTDVLGSKIMPHERVWIEQSLKYSEEEKTKLWKLAGLTDMGRWTRGDEYGLHLFPNSSMPFSLIPSLYAAKPLPTVHDWKALWXAWDVVTKDMIADEELQEKPIKLRNACIFYLGHIPTFLDIQLTKTTGQPPTD

SEQ ID NO: 55587 - protein, 184 aa, Sorghum bicolor
  unsure (1)..(184): unsure at all Xaa locations
  Clone ID: 30164256.pep
WPLLRVMRGIFEGGLDATGRADLEEDDEAAGADWGDEDLDIVDASEVVANGDGFDVEEGEPNEEDGEEGGWDLEDLELPPETDTPKSVGNARSAVFVAPTXXIPVSXIWTQRSSLAGEQAAAGNFDTAMRLLSRQLGIKNFVPLKPLFLDLHMGRHTYLRALAAAPVISVAVEKGWNESASPNV

SEQ ID NO: 55588 - protein, 115 aa, Sorghum bicolor
  Clone ID: 30164257.pep
QSALDQQGEAAGLLVREMNTNNKTNSRSGGGTTGRRSRSRSNSNNASTGTATTPPVLLRRRRCRRRWWRCGTATTGPAWRWCSSAACGGRSSCTRWPPCWKRKAPRSSAPTSPST

SEQ ID NO: 55589 - protein, 63 aa, Sorghum bicolor
  Clone ID: 30164266.pep
NIKCCMVIVSANLFHFTRKIACFTVEISGCLDVFRTSSCYGAFVLTSMLFDKTQKYQVMVELD

SEQ ID NO: 55590 - protein, 222 aa, Sorghum bicolor
  Clone ID: 30164271.pep
MSESYKGVILVGGPSKGTQFRPLSLDVPKPLLPVGGVEMIGHQVHALSKIPNMAEIIIIGFYGESSFQTFTQVIEETYNIPCKYFQEKKALGTAGGIFEFKDKIFDAKTTNIFVLHCDICCHFPLTEMLKFHLSHGKICTVMSVEVPVNESKNYGCFIKAKDSNELIHYAEKPESSIGNLINCGIYIFTSDLFKQLKEAKEHKLEVHWEFLIYFNHLFTGNL

SEQ ID NO: 55591 - protein, 136 aa, Sorghum bicolor
  Clone ID: 30164272.pep
KIPIYFLSLNSSSLHPSFMFGQPMNNFGYANNSFGDANNQNQMGFQNPSMMGSNQADSFGMQGQSMNSFPMNSNNNMMQNQFMMGQGQDSHQMQFNNGFNSNNMDSMGGQMQQNNMGMTNQQNIPAEPDASVYTTY

SEQ ID NO: 55592 - protein, 160 aa, Sorghum bicolor
  unsure (1)..(160): unsure at all Xaa locations
  Clone ID: 30164274.pep
MRSYTLLALAGPLAVSAASGSGHSTRYWDCCKPSCSWSGKAAXNAPALTCDKNDNPISNTNAXNXXEGGGSAYACTNYSPWAVNDELAYGFAATKLSGGSEASWCCACYALTFTTGPVKGKKMIVQSTNTGGDLGDNHFDLMMPGGGVGIFDGCTSEFGK

SEQ ID NO: 55593 - protein, 105 aa, Sorghum bicolor
  Clone ID: 30164278.pep
MDYAAAATNAPAPAPAPGTDHAHYPHPYASYSYPYGAYHQPAPATYASVAAAASSSYYYPVPAAVPSTAVQYDPYSGYQHYSPPEGRGAAGAGLVGYYFTVGEAP

SEQ ID NO: 55594 - protein, 201 aa, Sorghum bicolor
  unsure (1)..(201): unsure at all Xaa locations
  Clone ID: 30164285.pep
MRKLLFVAAIVLLSMTVSAGGGGSEHNAEAEIPGVVDLNPTNFETVVGQDKAVLVEFYAPWCGHCKNLVPEYTRLGAAVLAAGSDAPVVVAKVNADAHNALGSRFGVTGFPTIKFFPAKSTTPEDYKGARDAXAFVDFLNKETGAQLFVPREVTSVTVLDASNFDKIALDTTKDVLVEFYAPWCGHCKQLAPTYEKVALTY

SEQ ID NO: 55595 - protein, 97 aa, Sorghum bicolor
  Clone ID: 30164290.pep
MSTADAASPALAPDGDAPAGEGLALAQFAAGCFWSVELAYQRLPGVARTEVGYSQGHRHAPTYRDVCGGGTGHAEVVRVHYDPDACPYAVLLDVFWA

SEQ ID NO: 55596 - protein, 111 aa, Sorghum bicolor
  Clone ID: 30164298.pep
MSVKLGINGFGKIGKLAFRAALKNPKVEVTAINDPLMSLDYLVYQLKYDSVHGRFQGDITHEGNNIIVDGKKIRVFTEKDVKAIDWTQSSSDGILECSGVNLTQEKAQAHL

SEQ ID NO: 55597 - protein, 49 aa, Sorghum bicolor
  Clone ID: 30164306.pep
IYIYMCLMMCALVILHIYWFTYIVRILLGMLSKKKEYNIFDKKTTAKTN

SEQ ID NO: 55598 - protein, 87 aa, Sorghum bicolor
  Clone ID: 30164324.pep
RKKFGSVLDIVPLADSVTKLTARCELCGHRAFFTLRKTQETKTELIGGADVYMPVCRQHYMDGQIVIEATRIVLDLDRSTTAAKALK

SEQ ID NO: 55599 - protein, 170 aa, Sorghum bicolor
  Clone ID: 30164325.pep
TDNISTRQTIIRKLISPPGFPSKGYDQDKVRRVLEAFEWLGLISDTEEVAHVNTPMDALCAQLLKKLNFEPNDRDIVILHHIFGIKWQDGRRETRTSTLVVYGEPGGETAMSKTVGLPVAIAADLILKGEIKGAGVVGPIRKDIYKPMLEGLKNEGIVPVTKSSVFNVNL

SEQ ID NO: 55600 - protein, 122 aa, Sorghum bicolor
  Clone ID: 30164326.pep
TPFLHELEMAYAASDVVISRAGAMTCTEILATGKPSILIPLPTILDHHQTRNAYIMADIMGAKVITEDELDSSSLTSAVDEIFGDEKLMADMSQKALTAARPNASADIIRHICSLIGSPYPS

SEQ ID NO: 55601 - protein, 61 aa, Sorghum bicolor
  Clone ID: 30164337.pep
PSFRLLSGFYINLFGTTFVLLELNKAIKLYNAWLWIPNIALIVVYAAFTLLGIEKLSYEKY

SEQ ID NO: 55602 - protein, 106 aa, Sorghum bicolor
  Clone ID: 30164340.pep
ELATVVVMASEGYPGPYKKGTVIKNIDEAEQVSPAVKIFHAGTAFDTDGNFVAAGGRVLGVTAKGKDIEEARAKVYDALDVVDWPEGFYRHDIGWRALKYCHLAAH

SEQ ID NO: 55603 - protein, 171 aa, Sorghum bicolor
  Clone ID: 30164346.pep
ETDNSQIHRSIGYVLLVLSFGEVAAGLSVGRLADIHDKIKLFTITIFLNEAALLLTFLACLFNSYSLALLGGLFFGYGDTAIQTMINSLIGSMFGGRPELFSAYRFFQSIGLTYAALLTVFVPAGNPLLYIILIGGSMLTFHTLYNRYKPHDQDSTNVSYDKRPLLELKNL

SEQ ID NO: 55604 - protein, 99 aa, Sorghum bicolor
  Clone ID: 30164349.pep
ILANPAGSFIFSELIVSNFYEHEAEKQAHQHQMSALLSPRLLRNTGFLADGPLKCEGPACFFFSSLIMSVFCAVAAGLSLLVVHRTKQVYPRLYSSVRT

SEQ ID NO: 55605 - protein, 86 aa, Sorghum bicolor
  Clone ID: 30164351.pep
ASGPSEEGSCVKDPTGVMVLSDIKKAIAANQAPVELDSEAMQKVATWGSNQWIGYDDADTLALKMTWADGLCLGGGVFWALDINGG

SEQ ID NO: 55606 - protein, 78 aa, Sorghum bicolor
  Clone ID: 30164359.pep
LRIATAQGGSIVSSRLTFSGSGESLIRSQEQDKNKTVRQVSLPVGQAASSFPTNGRGQGGLVMWSLNYILYIEESPKR

SEQ ID NO: 55607 - protein, 84 aa, Sorghum bicolor
  Clone ID: 30164368.pep
MAMGKLGEKVRAFWRNRWLVFVGAMWMQSMAGTTYIFGAISPVVKARLGYDQRQVAALGVAKNLRGCLGLLAGTLSATWPPWAL

SEQ ID NO: 55608 - protein, 41 aa, Sorghum bicolor
  Clone ID: 30164389.pep
PPMARRPRRRQRSGGSAAGDARARAARQLPIIEAGCAGAGG

SEQ ID NO: 55609 - protein, 82 aa, Sorghum bicolor
  unsure (1)..(82): unsure at all Xaa locations
  Clone ID: 30164397.pep
KKKKNSSKFFNPXLHMQQAPQPVPSDKMAKAKKESKFDVNFILKEIIEFKGWEIIFQALLYGFVIYGIYALYLVYRXHHDPY

SEQ ID NO: 55610 - protein, 152 aa, Sorghum bicolor
  Clone ID: 30164413.pep
STSGRAVATSVFPSLRKGKNPSKNHRPNPNPPRSLHSTSLPKFQTSNRSYHVRAPTYPTLIGRTSPTSPPTQFFLPKNSKNYSIPPLSRPPYKSRQHAFHLRHALAARRCRCCRLRPQRTPRQRFPVAAAAPLPTFPPGSCSSCQEHAWRGE

SEQ ID NO: 55611 - protein, 146 aa, Sorghum bicolor
  Clone ID: 30164414.pep
DEHLLAPKHVAELVKKGIKVLVQPSTVRTYADKKYEEAGAIIREDLSEADLIVAVKQVPSDLLLPDKTYMFFSHVIKAQPESMKMLDAILQKNIRLLDYEKITDNEGKRLVRFGKFAGYAGMLDTLHALGDRLLALGFSTPFLHLG

SEQ ID NO: 55612 - protein, 216 aa, Sorghum bicolor
  Clone ID: 30164415.pep
TPTPTSPALTTSDPDRDPDHESESESEDILRFAFACGGAGAGGRVYSAIALADELHASLPSSRSLILGAPAPSLESSAAAAASYPFAPVPLRCLPGGILAAALHLCRFRPHVLVATGGAPALPACLAALMLRLPFVIQDQDASPAPATRLLAPFARRVFLAFNAPVRLLPKRRCAVYGNPIRMSILKCSASKIEALARFFPRAGLLGEHDAQVVLV

SEQ ID NO: 55613 - protein, 100 aa, Sorghum bicolor
  unsure (1)..(100): unsure at all Xaa locations
  Clone ID: 30164419.pep
MGQALVYLQTLLLLGLLGIASSXAQLNLSPIFGSIPSAVTHTTALKAACFIGWAGHLMLRMVLPMSTSQLLPVIALNIPAIQFLLGTFTDRLGSWWGSSH

SEQ ID NO: 55614 - protein, 99 aa, Sorghum bicolor
  unsure (1)..(99): unsure at all Xaa locations
  Clone ID: 30164420.pep
MFVSFPQVVGHLALVLGLLPNLVLAQCGPDNDGARCPLNVCCSSAGYCGTSSVYCGDGCXSTYGSCSVPTVPSCSSDGKTATNGRRVGYWRVQQAWDRS

SEQ ID NO: 55615 - protein, 213 aa, Sorghum bicolor
  Clone ID: 30164426.pep
MGLGIDHFFENFGGQVGVPGDQIKMVFCLLISYPFGFIFRAISNPTLRHVLGTALGFGFQFLIYKADIIYPLAMALMVYFVMKFMGRNKAVLIFILSMSFLSIFHIYRMWVDWGGYKMDVTSVLMINVCKGTTLAWCYQDGGKDPSKLSASQNKYKVTKLPSLLEYLSFMYFYANTLVGPACEYNDHDNFINKRETYSKPPSTFLASLGYLIT

SEQ ID NO: 55616 - protein, 149 aa, Sorghum bicolor
  Clone ID: 30164430.pep
MAMACFSASTKVSLKFGAKAFAKNRLPGYLDSVVSFPVSRTLDGGLCSPIRVENENRAYGSNVIVGALKGRHLNTTLSSTNGHVKVPERVTVLVIGGGGREHALCYALERSPSCDAVFCAPGNSGIAQSGDATCIPDMDITNSENVISF

SEQ ID NO: 55617 - protein, 137 aa, Sorghum bicolor
  Clone ID: 30164436.pep
MRTSTKLPMAPHLLAVAVAVSAIIAAVSLLAPGAAGYPWPFCGTSNDFKPNSTYQANLNLLAATLPKNVSASPTLYATAVVGAVPEQVWAMGLCRGDTNASSCLACLTQAFQDLPNDCSYNKDATIYYDPWILHYSD

SEQ ID NO: 55618 - protein, 170 aa, Sorghum bicolor
  Clone ID: 30164438.pep
FLFFKAMNLEPIQKENLKKVLYTGACFTTLFTAYVAAQNLVSQIYSQLGYPRLGQVCLFTYFAFFASMSVFAPHLKKKLSTKAGLITGAGCHIAFVFAGALTTFCNKYDFHGGFCNASFIPFFNILSAVCLGSGAALIWNCQATYVDECADESTKGLFNGSFLVNLSDLS

SEQ ID NO: 55619 - protein, 87 aa, Sorghum bicolor
  Clone ID: 30164442.pep
RDVGGAAQVLALHEEGRLVPLLPVVPPSPCAGGDTKLPGAGGKRGCDACGGLRFVVCGECDGSRKVFDGGRCRGCNENGLVMCPLCL

SEQ ID NO: 55620 - protein, 81 aa, Sorghum bicolor
  Clone ID: 30164451.pep
LQYISLLILQGGYENWMWQLIRGAILARWNLHGGNIHQCTPTIDQERPHKKNLHVLSSTLTNSPTNRYTFIRAVPHFHGGR

SEQ ID NO: 55621 - protein, 141 aa, Sorghum bicolor
  Clone ID: 30164455.pep
PFLHVGDCVVKELKAANLKPVEYGSNVRVGVLSTDNTLATNCYLDKLESQGFEVLCPDKASMERTVLPSVDAFRKGDMEGARNLLRVSLQVLLVRAVNKIILASDDLVGILPDDDPLLKKCIDPLDALVREAIVCARAPRP

SEQ ID NO: 55622 - protein, 156 aa, Sorghum bicolor
  Clone ID: 30164461.pep
WADLVVGYMGVPKYAGVSMTQHPQYITVRNDRGREMLSLVDALLESTPTISSGSRQPFVMETVKADDAAKLGKGPSKPAPRFVGDILAFLLNLVGPKGLEFARYSLDYHTIRNYLHVRRVWGKQRAEQHIPGYAKKIVEAYDKDGRIEAMVTQSSD

SEQ ID NO: 55623 - protein, 115 aa, Sorghum bicolor
  Clone ID: 30164487.pep
SYLQINFVHFVRLIIEHRSTLKEVDLQSIYGWCDPFSSTDIDWDLIFKLMREKLEVLETVRINGRFSDNVGWYQIFFRNDVPAVDTIVRLMGEKSERLERYTLEGGEYPQPLWRI

SEQ ID NO: 55624 - protein, 44 aa, Sorghum bicolor
  Clone ID: 30164502.pep
YFKYIIMLYINKLCLFLLCKAVWILSKSYCMYQLMGKISNFYFP

SEQ ID NO: 55625 - protein, 199 aa, Sorghum bicolor
  Clone ID: 30164522.pep
METRPERHRHDHVHEQQAQEGEEDDAAAAVMEHGAALSLQRGATLFGRRRQHDEEADRRRRGEIREVDFFSRDSGARGQDDGGGRGVPGGGRDDVNIGLDLLTTATAATTSAAGEEMMAVKNQKIEASAVEVELRRVVEENRRLRGMLEELNRSYGALYQQLLQVTQHRQHPADLMINRSSLAHTHLTTTAASHNTSST

SEQ ID NO: 55626 - protein, 194 aa, Sorghum bicolor
  unsure (1)..(194): unsure at all Xaa locations
  Clone ID: 30164524.pep
MSFQKIKVDNPVVDLDGDEMTRVIWKLIKEKLIFPYLDIDIKYFDLGMEYRDKTDDQVTVDAAKAIQXYNVGIKCAVITFDEARVKEFSLKKMWLSPNGIIRNILGGTVFREPIICKNVPRLVPGWTRPIVIGRHAFGDQYKATDLVVDRPGKFEITFTPADGSEPKHIEVFNFKNRGVLMGMYNTDESIEAFV

SEQ ID NO: 55627 - protein, 149 aa, Sorghum bicolor
  Clone ID: 30164525.pep
MIIKTLKARILRALKAAGHDGAAGSPPPSPTKPAAHQYQYQYQYHGSDALSDDASFFDAREPDTPPTKAHHHRRRPSAAEPLDAWELVDDDQDDGGCASPAAPDADPLLGFPARCPPGGESVVVLYTTTLRGVRRTFEDCNVLRSLLEN

SEQ ID NO: 55628 - protein, 138 aa, Sorghum bicolor
  unsure (1)..(138): unsure at all Xaa locations
  Clone ID: 30164545.pep
VLIACRSPARPADYQPPLVGTALHAPALRAAPPPPTPPAPPPAPXPPLRSPPRSRPRPQPSGPRLRLPLCTLPPTTPRSSTSPSTSPRTGGSSPPTPPPASSSPSASPPRPTPSSSPSXSPPPPPQPAPEALAEPASC

SEQ ID NO: 55629 - protein, 199 aa, Sorghum bicolor
  Clone ID: 30164569.pep
AKTLIMRFSTGMLLAAASSVMGQRFTNSSIPATESATTTSDVAPTGSAVAAQPIDLSGAKLGPGASVVTRSDGSVAIALVAGPNGVASFTIGVPEDIFSSFPAGNLFIILFEIFVELIETQKRAETACSLDVTADGESIFSEDLSTGSGSKSSDSQASTGKSPTIEFVQSCGAGSARLEVSNLAAGPPGSSNPGGGGGG

SEQ ID NO: 55630 - protein, 93 aa, Sorghum bicolor
  unsure (1)..(93): unsure at all Xaa locations
  Clone ID: 30164571.pep
KGQFFNSVGKQYNCTVSSNLKEIRSSAVLFFVSIDPALTSLHQKDWGQKTVNNNQELVTYLSTICYPAEAHXWLPWVEARDLCRSQIHAVTCV

SEQ ID NO: 55631 - protein, 140 aa, Sorghum bicolor
  Clone ID: 30164572.pep
LLKKKKKKKKNNHVGVFLSSRDLKNLRLSCKTIAECTKPLLALPSFDGVPWRKDGERLNHLSLVPSCARRIYSVKFNMARLVEEEVEYATSRIINANELNRAWGPYLETQDIFLEPIELPLDLVVPAIMRVPNLDSLCLT

SEQ ID NO: 55632 - protein, 80 aa, Sorghum bicolor
  Clone ID: 30164575.pep
DGAEKWNLQVPLPSQWLARPIAPPAFECVTTYRLYRNRAARQPPQISHRPSWRSSEKTAVLGMVSVSKGLRPEKGPEENM

SEQ ID NO: 55633 - protein, 141 aa, Sorghum bicolor
  Clone ID: 30164579.pep
RRRLGSVCRPQHASSMRPNLTNHYIQARRILIKLQKMTTYRMSFPASRIPEGFVAGGAFGAALGGGALASRINCFPVEAFVVPAALAPMMGMFPVSAFKPSCWGAAGNAAAAVATLAIMYLVQACLTFSMNLAGSSCPAPR

SEQ ID NO: 55634 - protein, 127 aa, Sorghum bicolor
  Clone ID: 30164621.pep
MRLWKAIELSAQGIIRKGLEYKQQAKELKEYIALLQKETANLQSMERSILFTFKAMEQLPSCDQIEDVIVASIIKRLPKPNPPGWGKIPSAIKEELTAMSGGANKDELEVMLELAPLINPTLGEEDE

SEQ ID NO: 55635 - protein, 143 aa, Sorghum bicolor
  Clone ID: 30164630.pep
KEGKKKEDVSKKPYTVKYGLNHVVGLIENKKASLVLIPNDVEPIELVVFLPSLCKKMGIPYAIVKGKARLGTVVHKKTAAVLAITEVRSEDKNELSKLVSAVKDGYLEKHDQARRQWGGGIMGAKAQMKIIKKQKALEAATKI

SEQ ID NO: 55636 - protein, 128 aa, Sorghum bicolor
  Clone ID: 30164637.pep
FDAVGAPGAPPTPIPPLDFPYICNMTVKTPLRRRGIGKQLLKACEDLVFKMNARRRVYLHCRIIDQVPFNMYRKAGYIIVQTDSILVWLSLQKRKYLMSKELPQASVVSETSTKNFDDNIDKLNVLRD

SEQ ID NO: 55637 - protein, 70 aa, Sorghum bicolor
  Clone ID: 30164654.pep
QPPKSGKKVAAAPFPQGKAGKKAAKNPLLEKRPRNFGIGQDIQPKRNVSRMVKWPEYVRLQRQKKILQMR

SEQ ID NO: 55638 - protein, 75 aa, Sorghum bicolor
  Clone ID: 30164655.pep
CHDCAPEGRRDSSEILNKNHPIQLMYHPFHKSIASKGICHAVLNTMTLYFSFSKLTCTRSDNIIVIQSNLKKKKK

SEQ ID NO: 55639 - protein, 181 aa, Sorghum bicolor
  Clone ID: 30164676.pep
MQTASILRKGAISGAAHVSKRNVTAKVGGFGVQPSGPAAAANKLAVNHDPDDLFKGIPVKSGIIDRRMMTKQMEVDKEFAAAMATASDDLKKEQLLRRQARRPPANNQELVEYFLNTVTEDLEYEVARYRPRLTPDFFAYVDNVLGQLRFLPDPDEEQQETLAELDLLRQYLSEASEAVDK

SEQ ID NO: 55640 - protein, 163 aa, Sorghum bicolor
  Clone ID: 30164688.pep
LANSPETLTASDKECNETGGSTEAPMENSALIDALGGRQIGKLYVSNKEIGRGSNGTVVFEGSYDGRQVAVKRLLRSHNDIAEKETQNLIISDRDPNIVRLYGCDHDSDFVYISLERCHCSLADLIQKHSYLSSGESISNNEVSISIKSKIPNVKGIDVELWT

SEQ ID NO: 55641 - protein, 87 aa, Sorghum bicolor
  Clone ID: 30164714.pep
MDASAAGSRGGPALRFLCPKISLLSPPSHSLLRWLVGAPRVLPPFTVAAVLRPTHGDHAAPDLPREADEIRGLLPRGFDIIGALLVG

SEQ ID NO: 55642 - protein, 165 aa, Sorghum bicolor
  Clone ID: 30164720.pep
NCKTTKKMFPVLDNVQKMRDAVALIHAHINAQPFYEKQDESKRYTFFNYKFQNSYVFPGLDSTEDDKIKEALKITRECRGICFSLQSGACVSRGFHKFFNVNEKPETMDNNIDLNQDHVILDKVDGSMIVAMFVSDDSLVAQQNPIGTIRFRSKMGWNTDVSKHC

SEQ ID NO: 55643 - protein, 177 aa, Sorghum bicolor
  Clone ID: 30164722.pep
AYKLFTGSSSVILSRKFIEYCIVGMDNLPRTLLMYYTNMPLPHRKYFQTVLCNSPEFNETAVNHDLHYSTWDARSKNEPRLLTIDDLENMTDSGAAFGTRFPKDDHVLDHIDAEILHRLPGDPVTGGWCIGVGHDSPCDISGNPDVLRPGPKAVKLAKFLAERLSYQNFYGHQCIWD

SEQ ID NO: 55644 - protein, 173 aa, Sorghum bicolor
  Clone ID: 30164738.pep
DNLRSIMNSEFKRMTYDDAIKVCIEHDTAGKVNFINKLEWGVDMSSEHERYLVEKVYKQPVIVYNHPKSFKAFYMRLNDDQKTVASMDVLVPGVGELIGGSQREERLDILDARLEEMKLDKEVYWWYRDLRKFGTVPHAGFGLGFERLVMFITGIDNIRDTIPFPRWPGHAEF

SEQ ID NO: 55645 - protein, 75 aa, Sorghum bicolor
  Clone ID: 30164739.pep
DCVTVLCVPISHFIKVRRMNTVNPTINFLQGHSYSSSEGERGTSSAHPLHMWIVDFSPCEIILAIHLAPFTCSTT

SEQ ID NO: 55646 - protein, 126 aa, Sorghum bicolor
  Clone ID: 30164747.pep
VPVGGGRKNRRGAKGGSAKASASAAAAATNVLGVGGADTFPDFLRQQLLQFQPGAAVGGGGYAIDLGAWQQMSAATAPPPPPGTGGDVSTLGAAGTAAAEAEANCAALQYWSEWQQDGMPGLDGAC

SEQ ID NO: 55647 - protein, 74 aa, Sorghum bicolor
  Clone ID: 30164751.pep
TATTPERASQQYSLRDEIPTKIVEDDEEDFEENRSDNGGVAHETSVVSKHQLQHQQSLMHRPSGARISALGGTR

SEQ ID NO: 55648 - protein, 91 aa, Sorghum bicolor
  Clone ID: 30164756.pep
SEQFSVESVSQINSGKALFVWSGLDPGTVSVHRESIQPGMIPGTQLPASAISSVISQISDLDAKEDDNLRRWRWPLFRISTSSGIRILHPC

SEQ ID NO: 55649 - protein, 156 aa, Sorghum bicolor
  Clone ID: 30164760.pep
EAKNGGTVFDWLLALSGLAFLFVWGTICLAHARMRSGFKAQGINLDLVPYKTPFGVWGSYLGAFLNVIALIATFYSCLYAADGSPPDAESFFMGFLAAPIILVLYLGYKIYSRDWKLYVRAIDMDLQTGIVLLDEPEPETPWSWKTAPRRLLSAII

SEQ ID NO: 55650 - protein, 69 aa, Sorghum bicolor
  Clone ID: 30164762.pep
LVFIENIKRADYPVLAAYYLLWLVYVYVILGLEKTQPDIVPVQCVHVLLLTSLYMHLYLSPKIVHGFDV

SEQ ID NO: 55651 - protein, 121 aa, Sorghum bicolor
  Clone ID: 30164765.pep
NKGYFIKPTIFSNVGPDMKIMQEEIFGPVCAISKFKDEEEVIDLAHDTAYGLAAAVHTKNLNTALRVSNALKAGTVWVNCYNMLHHQLPFGGYKESGIGRELGEAALANYTQNKSVAIKLY

SEQ ID NO: 55652 - protein, 89 aa, Sorghum bicolor
  Clone ID: 30164772.pep
YIILKDPFSARNVVGILIAVFGMGLYSYYSVVESRKKTEAATSLPVAAQMSEKDSSPLLGAKSSPRTENKSEETFDYMPRTAKSAFTGR

SEQ ID NO: 55653 - protein, 46 aa, Sorghum bicolor
  Clone ID: 30164774.pep
FRKHALLTSVNIVHSNANIYMCFCVSERVLKINCKLISCHGGKQRQ

SEQ ID NO: 55654 - protein, 182 aa, Sorghum bicolor
  Clone ID: 30164783.pep
KNSGILKITEKSSTYARHEVNHVHRNYNGDAQLRINNNGTIDIIGSNNQLLWRPYEPHPVSDTLNVGNRLLLSDVLVSKNGIYSLILREDCDPVLYKHSMPIWTSGAISSATKGQCEARLTQQGSLVINSLNQSFTVVPQHPSYQGKTSLLVTDDGALVIKGEDQELWNSGKEMELIREALY

SEQ ID NO: 55655 - protein, 125 aa, Sorghum bicolor
  Clone ID: 30164792.pep
PCQNFQRSVSHRTSNHSETIMITGNNIANHIAHEVVFLRLQKFQMLSVSSNHHDHVIHRSACSPFLQEFQEHMYRAQQHRHHVQMYSKLNVKQSYGCLLQLEIWNSACTHRTSTWMASPEKNEKL

SEQ ID NO: 55656 - protein, 69 aa, Sorghum bicolor
  unsure (1)..(69): unsure at all Xaa locations
  Clone ID: 30164799.pep
SPPPKAPPPXSPPPQAPPPPRXAPRARPPAQRPPRRQPPRAAPPGQGLPPPQAPPSPWAPPPRPPPARR

SEQ ID NO: 55657 - protein, 185 aa, Sorghum bicolor
  Clone ID: 30164800.pep
MQSLLAFCSICLQLSNLGVQKSELLIKRDEACTLCLTELLQPSNNNIINGNGKPYREILNDGLYFNNPLLQEALKLKLEQQLLVEPEEAKREVAKKEEDIPDPFSRMLTQGQIEELFENLVQTVQKISSAEMNLKEEWTKQKNLAYQAINKKVQLLHVMYKKASLDLPNKPSLPDRLKNRSSDLE

SEQ ID NO: 55658 - protein, 116 aa, Sorghum bicolor
  Clone ID: 30164804.pep
PVPAAALASSAGTDAAAAAATALATSPFLPPLSDSSDRGLSRPSPPRTRRSGNRWAAAVAPRGPKKEEDEEATPTWREARPRVAARVQEEAPETEVVPAAAAPRCIIIFAAALSLF

SEQ ID NO: 55659 - protein, 148 aa, Sorghum bicolor
  Clone ID: 30164810.pep
TCAHACPAISSMRFSASNNEKMQSRCSALTPKSSNRASSGLQGLVLHAPRDRLCKVTCGAQHKDDHVELAVSRRGLLQAASLLSSGQLVLDRVQPAQAATIKPEVLDAFRQALSVRGEFQEKDDAWTKVIKLAPESSAAWSNRGTLRL

SEQ ID NO: 55660 - protein, 166 aa, Sorghum bicolor
  Clone ID: 30164811.pep
MQSAAAAAPSALPHSVFPKDSRPLPCLLLTSLLLLLTLHLLSSSSPAPSPPPPQQPRLAPLPSAASAGPAPPSLAFLLTGSAGDADRLQRLLLATFHPRNVYLLLLDRAASADDRARLARSARSAPGRDNVHVVGDPGFANPRGASALAATLHGAALLLRVDQGWD

SEQ ID NO: 55661 - protein, 170 aa, Sorghum bicolor
  Clone ID: 30164821.pep
MAAGAAAEVDDPSLAATLEKFRLYETRARFYVIGSSREKRWFRVLKIDRSEPSELNVSEDPVWYSLQEVKSLLQRIDEGNRSTGGLTFVTKAYGIAGCIKFLESYYLILVTKRRQIGCICGHAIYCIDESQMITIPHSSVQTDVATSKNELRYKKLLASVDLTKDFFYSY

SEQ ID NO: 55662 - protein, 203 aa, Sorghum bicolor
  Clone ID: 30164829.pep
MVDTKPDYKSPHVEERFYAKAVPKHGIGEILRIEHIVKNAEKYYDQVGVVAGWARTLRNAGGNTIIFIELNDGSALDSLQVVVNQAMPNFEEVSKNTAGASFRIKGRFIKSPAQGQAIEVQVDDAENHYVKVVGPVLESETYPMAKKGHTLEYLREIAHLRPRSKYVSAMIRIRNSLAQATHIFFQSNGFLNIHTPIVTASDC

SEQ ID NO: 55663 - protein, 134 aa, Sorghum bicolor
  Clone ID: 30164830.pep
ALSVSLSLVWMLFSVKKEKKSFASPVAAATTGRRLRGRRMEGSEGHRDASSSRLRPRALAATRSPTLVLCLIALARRFNAANAAGHDHAVTTSNPQRVVHWLRRRQGYRGTGTSEQTRSRAERRRPTRFCLNRS

SEQ ID NO: 55664 - protein, 129 aa, Sorghum bicolor
  unsure (1)..(129): unsure at all Xaa locations
  Clone ID: 30164831.pep
MASVASSRCSGLLLPPSFAGVRCSSRPSSSLRLRPRWGLRRPRTLACVAPPDSAEPQTDEQAVKAESVKEEAPTSAPEDPGLPALPNKDLNRRVALLSTLGAVALFAXQRLNLSEASLKDLAANAMPYE

SEQ ID NO: 55665 - protein, 113 aa, Sorghum bicolor
  Clone ID: 30164838.pep
RSSTWRSRGRGRITGPAPTCAERHRGTPTAASSAHRSTTPPSPPPTSCPGRRRDAPPAMPSSFLTSPSSSASSHLSYLIPASARPPPPLAMGQGYGGATGGISVVPTGGVVAT

SEQ ID NO: 55666 - protein, 107 aa, Sorghum bicolor
  Clone ID: 30164843.pep
MPPSLNTHPSFTRPRTSDRDGRPSTRDQGADQNLLIPSRTSSLHSRITQPIPSTLNMKPQQRTPKTLTHAYMVCGVGREPSQWVKAPAPAQGKIGHMKGAVGQFWLP

SEQ ID NO: 55667 - protein, 148 aa, Sorghum bicolor
  Clone ID: 30164850.pep
MLPLLLVLLTGATPAVSASGDGCRAGCPLALAAYYFSAESNLTFIASLFGIADYTKLLPYNPDIADPNYIVTGYRVIVPFPCSCLGLPADPASTFLAGSLSYTVSGGGETYGDVASQFANLTTASWLAATNAYPAGKLPAAGKIDVNV

SEQ ID NO: 55668 - protein, 170 aa, Sorghum bicolor
  Clone ID: 30164853.pep
MSSPPHKDEVNYETKDETTVTVPHDEEQGTTSGEGQLKRDLRGRHTQMIAIGGAIGAGLFVGSGSALHKGGPASLVIGYLIIGVMLLCTNLALAEMAVLYPVNGAFYTYIVRFVDPSWGFACGWEYALSWLTVLPFELIAASKTIEFWRTDIHMAVWVTVFLVALTIVQI

SEQ ID NO: 55669 - protein, 157 aa, Sorghum bicolor
  Clone ID: 30164855.pep
VYGQGPVPQCSSKHEDSDAASKLSTDGPQNPTQEIKQDLSNSVESQLVLYAGGNQQLTRRTHSISSPEADRRILNAFERSLKEQTRSNELKEFEISLSMRKLQLKQSQLELNSYSHMLDKIKLSLGFQKASFQTEKFKTQMQDTRHAQIMRTLIDFL

SEQ ID NO: 55670 - protein, 89 aa, Sorghum bicolor
  Clone ID: 30164856.pep
MAPVYAGELAGTNGSGSGLTLNPVARRALSRGASTSTLGTPKSPPPAYGSIVTVLSIDGGGVRGIIPGTILGFLEEKLQELDGPDARMA

SEQ ID NO: 55671 - protein, 122 aa, Sorghum bicolor
  Clone ID: 30164859.pep
MAPLTVELSTPVTGTYQQPIGLFIDGKWTEGVDKQKFEVINPSTEEVITSVCEGTEKDIDLAVTAARKAFDGEWKNTSPQARGNYLLKLADLAEKNLDLLAAVESLDNGESITNARGDVGAV

SEQ ID NO: 55672 - protein, 37 aa, Sorghum bicolor
  Clone ID: 30164872.pep
GYNALHTPMVWRIMCIYLVYFVIRTCLTYVLHLVLDF

SEQ ID NO: 55673 - protein, 105 aa, Sorghum bicolor
  Clone ID: 30164874.pep
KSLLELWTGLCFVSSFIGVFGRMGLSQTICTGFESWRLIKWMEINYIANTGGSLSAFRGSQAHSVNRSRGVFRWDYNSGLEATSNQTLQSLSGGDDFRLANSSFK

SEQ ID NO: 55674 - protein, 106 aa, Sorghum bicolor
  Clone ID: 30164887.pep
ERAERANEGKLGFEQELRRWRAEHVQRRKAHEAAAQHGVSPVRTPPRMFVQQKGFYQEENELLTDPKLQNSTGSKDQFVSDEKMRKKKLFLPQMSTLLFRKAQTQT

SEQ ID NO: 55675 - protein, 168 aa, Sorghum bicolor
  unsure (1)..(168): unsure at all Xaa locations
  Clone ID: 30164903.pep
QQERDETYNKAVTAENLTKMEELHCLIKETLRMYHPAPITXDREALEDHKLGDLEVPKGTWVKQDFFAVSHNEKYWDEPFKFKPERFKADAKKIDPYAYVPFGGGPRNCIGQHLSIIEAKVIISEFLERFHCKLIEGYELKMAFKFLYEPLNELTFEISPKHQQTVLA

SEQ ID NO: 55676 - protein, 57 aa, Sorghum bicolor
  Clone ID: 30164925.pep
SRNQRGELICVTVHWSTTKKSVSWSEELRGPGQGVGINRVSMLLAIFHHQALQLASL

SEQ ID NO: 55677 - protein, 123 aa, Sorghum bicolor
  Clone ID: 30164947.pep
PRSGGTRGRTRVAARRQRWQASAARRRSAGVRRRRMAWRMTSVRSATVVVVVFTTGAGANAGGRGKAAAEDARVWSSPPRQLLWGAMIDETSHESPRQLLVEGRTGERTEHAAKDKELQVTLG

SEQ ID NO: 55678 - protein, 114 aa, Sorghum bicolor
  Clone ID: 30164966.pep
MQPPSNLEDIPVAVDDASSLILAHSSTVLEMATSVIASAASMASSTAASATFIASGPPQSSDEDDSNGECSLLGSFALLVQGALGALALLSLVYKRWRERPQRPLKIWFFDVSK

SEQ ID NO: 55679 - protein, 215 aa, Sorghum bicolor
  unsure (1)..(215): unsure at all Xaa locations
  Clone ID: 30164999.pep
MLPFFTLFKFFGLTLLTVLAYFFLSFVLLPVLRINSYKRKGFSTFFFPILGYLRYWDLGLKSNEDAFMNFKTSSQDFPNKKVLITNLGNKTLFLLRDPTLIKDFLHSQHKYHKVGSVNNMKPLLGNGLATAEGSFWRNHRRIISNSFHYELLKSHVPIIQETTKEFLDKIKPEEYGNFKIIDXVQEITGEVVGRVFFGNNLSHYQLDGMPLTLYL

SEQ ID NO: 55680 - protein, 181 aa, Sorghum bicolor
  unsure (1)..(181): unsure at all Xaa locations
  Clone ID: 30165009.pep
APHTHTVGRSRGEQQHGQHHHAPACPRARFDRRRRRRSGRTHARSLGRVRVRACEWPAGRRWILQWRQRRRTAAGTTSRSPWRRSTTRSAAXADTTTTCSRGSSTRRSSISRSSSASWSCWAPGAVSPAASTSRSSVSVGTTATTPSTAPGATGAATARSRARTSMRGAATATSSSSSTRW

SEQ ID NO: 55681 - protein, 132 aa, Sorghum bicolor
  Clone ID: 30165010.pep
MALTRLLMMASRPPCSLPSPSYKTSRCCCCHRARRLLRSAMRVGACKDLSTVTPTPRQQSMAAQLERGSLLVGGRELLVRAPPNVTLRPAGEAAAADDSGAAFLGATAAAASSRHVFSVGNLASGWRWMSLF

SEQ ID NO: 55682 - protein, 163 aa, Sorghum bicolor
  Clone ID: 30165012.pep
SDPIVASPGFKAGGSASASTRRSTSDASFSTQLAASRPTARHARTPLKVTSSGWKPLTQPVAMNEERKCASLTINPTAKRSRVASSRAVKDSINHLASKANSNIPSGKKYRDEEIVSLGDQSDGAVLPSPTKKLQICKGLSDAPSIRKSTIRILGVKGAALPP

SEQ ID NO: 55683 - protein, 49 aa, Sorghum bicolor
  Clone ID: 30165027.pep
LNAMLPIVSFVCRIQGFCSLHGCMFQYEICLLNAWTERSGYCLLIKFVY

SEQ ID NO: 55684 - protein, 53 aa, Sorghum bicolor
  Clone ID: 30165031.pep
MTSEKISSLKPHSKNIQNLFHRNCFLFLISMQKELCLLFCFFDEPRVSCLKLG

SEQ ID NO: 55685 - protein, 42 aa, Sorghum bicolor
  Clone ID: 30165039.pep
GEKMTDEEVEQMIREADPDGDGQVNYDEFVLMMKNAERKIFG

SEQ ID NO: 55686 - protein, 158 aa, Sorghum bicolor
  Clone ID: 30165048.pep
FIDEIDAIGTKRYDSTSGGEREVQRTMLELLNQLDGFDDRGDVKVIMATNKIDTLDPALIRPGRIDRKILFENPDQNTKRKIFTLHTSKMNLNDDVDLEEFISQKDDLSGADIKAICSEAGLLALRERRMRVQMADFRSARERVLRTKQEGEPEGLYL

SEQ ID NO: 55687 - protein, 106 aa, Sorghum bicolor
  Clone ID: 30165049.pep
CGWNSTLEAVVNGVPMVAIPHWADQPTISKYMESIWGLGVRVRKDEKGLVTRDEVGRCIKDVMDGDRKDNYRMNATMWMQKAKEAMQNGGSSDKNVCEFVAKYSSN

SEQ ID NO: 55688 - protein, 83 aa, Sorghum bicolor
  Clone ID: 30165080.pep
DKKVPLNKRLERAQALVLIGDVFVRAERSPEEEGDYLVFEQLVAEAAMKKDKEEAHKKKKDRKSFHSHRDKEQKDKEPAASTP

SEQ ID NO: 55689 - protein, 51 aa, Sorghum bicolor
  Clone ID: 30165083.pep
VKIGKELGLRGSYSGIGARLFMVGTLTAGQFAIYGDLKKAMGATGGVEIAA

SEQ ID NO: 55690 - protein, 62 aa, Sorghum bicolor
  Clone ID: 30165097.pep
SAFWRRRGREPSWRETSRNMASTSRMPHMMPPDRGRKGETRAAIKQLLALCGREGDETRRWV

SEQ ID NO: 55691 - protein, 144 aa, Sorghum bicolor
  unsure (1)..(144): unsure at all Xaa locations
  Clone ID: 30165098.pep
MPPKVVAVAAGEAHTLALTGDGQVYSWGRGPFGRLGTGREDDELVPTAVAPAVSAGGTPRPRFVAVAAGAYHSLALDDEGSLWSWGYNLYGQLGYGDQNSLXFPCLVEQFQDLGSPETLNDEDQNTRDQTCLKLSSVKAGGMMS

SEQ ID NO: 55692 - protein, 192 aa, Sorghum bicolor
  Clone ID: 30165101.pep
PGCTGATGYTPLSRALRTPRRNPSAARRPPPTLAALPLLTVASGLRPRTRHCPEAVAYGGFTSIRRHLASSSISRALVRARGFFRPGLVPLQEPLRPPCFLPKGPITTASSRLMAGSSRTAKSLVALDLQPRQRQVALMVVGLVRVQDKGLLHSMEGLMRQCMARNRLVDLVAKVQLLQVFLACQLVQLRSP

SEQ ID NO: 55693 - protein, 133 aa, Sorghum bicolor
  unsure (1)..(133): unsure at all Xaa locations
  Clone ID: 30165105.pep
SSSKPSNGAFVITSFNYNIXGGNPNNGPSVGGPSLIDVRPLNKGDDDLSPLLNDAIKYVVADAQKNGELPKSKYTLSHVYNAYLEDSGFPPQYVFLVKLVNSKGQTYRVEITATENEDGEDQVNPEYVVYPNA

SEQ ID NO: 55694 - protein, 169 aa, Sorghum bicolor
  Clone ID: 30165108.pep
MAASTGSTKVDAVVQNIKAETPEKKTGLALYSRFALAGAVCCSVTHGGLTPVDVVKTRIQLDPATYNRGLIGGFRQVVQNEGAGALLTGAGPTFAGYFLQGALKFGGYEFFKQQWIDALGYETASKNRTAVYLASSATAEFFADIALCPLEATRIRLVSEPTYASGLVS

SEQ ID NO: 55695 - protein, 172 aa, Sorghum bicolor
  unsure (1)..(172): unsure at all Xaa locations
  Clone ID: 30165148.pep
MGQGQSGMGEGGRDEKDKKKDKPKYEPPPRPTTRVGRKKRKAGGTSAAQKLPAVYPTSRCKLRLLRMQRIHDHLLLEEEYIENQERLRKAKAAKEGQSAGTDADVDRLADERGRVDDMRGSPMGVGTLEELIDDDHAIVSSTXGPEYYVSIMSFVDXDLLEPGASVLLHHKS

SEQ ID NO: 55696 - protein, 182 aa, Sorghum bicolor
  unsure (1)..(182): unsure at all Xaa locations
  Clone ID: 30165153.pep
KDADSSSEDIILKVEEILLSCKEIKPLGRDGKRTTRPELCSKWLALLTMEKACLSAVALEDTSDMVLKLGGNFKETLRQLGGLDNIFNVMVNCHSELEKLVKDASTTAVEGKEGAPLQSTALLLKCFKILENATFXSDNNKTHLLSMTRXLGPKCPSLPFVGVILNIIELLSALSLLQKPST

SEQ ID NO: 55697 - protein, 130 aa, Sorghum bicolor
  Clone ID: 30165156.pep
MLLLFLSLLVLLPLPPLPHASADADICIVGGGISGASTAFFLTNYTTSLAGAQLRVFERRHKVGGRLGTVTLAGDSFEAGGSIIHPRNLHARRFTDLLGLAAKAGGDDNDGLGIWDGKSFIFQTLRPPPT

SEQ ID NO: 55698 - protein, 145 aa, Sorghum bicolor
  Clone ID: 30165161.pep
MVVDTAYYDTLGVQPTATELEIKKAYRKKAIVHHPDKNPDDPTAHEKFQAIGEAYQVLSDSDLRAAYDKFGKESARPQEGFADPAEFFSSIFGGEAFVDWIGEISLMKDLTATMDITMQEEEAAAAEAAAEEAAAAEAAGEDFPG

SEQ ID NO: 55699 - protein, 51 aa, Sorghum bicolor
  Clone ID: 30165171.pep
SEKELFTLYFKQCVRSVFCSVSRRPWRLRRSRRPRIHGSCRRRHPTTCTTR

SEQ ID NO: 55700 - protein, 102 aa, Sorghum bicolor
  Clone ID: 30165186.pep
VSPIYYVMFTTLTIVASGIMFKDWAGQSFSSIASELCGLITILSGTILLHTAEEGANNSAALLPWPLDKGSISWCISLSSDNLLKNVEEDYFAALQSSPAPV

SEQ ID NO: 55701 - protein, 132 aa, Sorghum bicolor
  Clone ID: 30165187.pep
SASKYFIFLFILGFGFSLGSVTWIYISEILPDIGVGVATLLSWVSCVIVAQAFPYLMDGIGSNPTWLILACIVFAGFLFILRFVPETQGKEPHEIAALFSGKEKYGLEYADPEAQKVNENQAAKPEEVDQKA

SEQ ID NO: 55702 - protein, 171 aa, Sorghum bicolor
  Clone ID: 30165195.pep
DLEMIQGLSQRLETVAKLAKRNMDLQTLLEQQGQRHKRETAVLIAAIENSATEPQAHPAMLPLEARVEYSRATMSASPRKAIPMAQLPKSQRLPAVRIWKRSSKDGTPLSSVAPPKAPSTARPLQPALRGGWQPTSRPDSGASSVEDPSRAQERSKPVAGSGEELYFSGYL

SEQ ID NO: 55703 - protein, 175 aa, Sorghum bicolor
  Clone ID: 30165240.pep
WFSMYCFAAATLCFVALEGASSTGGFPGSFPWLAATAGLLDLSLGWNFWNQLLAESIATHNGIISGTRQASYRDQSSRNGTAVEKVQVTQSAPNWIRYPNQQLSVETDAGDDTLYLGSGAAAGARGADLARGGADWSKSGGAALATRFFPFLSPSPSLPALRLSFRGRGEARQTV

SEQ ID NO: 55704 - protein, 215 aa, Sorghum bicolor
  unsure (1)..(215): unsure at all Xaa locations
  Clone ID: 30165253.pep
VQQLEGMGYRDGETLYAAPYDFRYAVAPPDHPSAVGDRYFRDLGRLIQAGRLNHGRPAIVVAHSFGCALTYQLLLSRPLAWRRRYVKHVVLLGPALGGFAAGMYALSAGMDFGLPNVTRPTMLRLARSQQSALXRLPTPLVFGDRPLAVTRTATYSARNMSEFLEAIGFAEGVRPYLTRVLPMWEALPAPMVPVTSVIGFGVRTPETYVFGADGF

SEQ ID NO: 55705 - protein, 127 aa, Sorghum bicolor
  unsure (1)..(127): unsure at all Xaa locations
  Clone ID: 30165258.pep
ALSPRSTATRPLPARSRSLPPPSAAPGGTTTPPRAASPPSPPRRPPPSSSTKTPPRPRRRPPSRAGNAGLGRRRSPPPPPRRRTARTTSRWRRRRRRRRRRTRRKGRXRTRPAPRRAPGHWWPASTT

SEQ ID NO: 55706 - protein, 183 aa, Sorghum bicolor
  Clone ID: 30165284.pep
MSSTYNPAYVYAIAMTGALGSIFFGYINSIMNPLQDYIQDNVYTTMSDSLMTLTSSLVPAGAAIDAFISTDLAKKVGRRNAMFVTDAVSVLGVIITLIGSQYALLVGRLISGVCVGFNSSLVPLYIAEISPAEARGVTGSFTQLSVSIGILIAYLFGLHVPTGQDYSTTKWVVEIHAWVRNYH

SEQ ID NO: 55707 - protein, 171 aa, Sorghum bicolor
  Clone ID: 30165285.pep
LKRVAMPGSYGTAAFKSSARKPLVNESGVEVGRIYSTRGIADEVRDSHRLGAAAALRQKAPRFKEQTSKSDTPSAASYTPPGVADKPLNPGRAAVAFRQREARFIDPTFPVRVTGALDAATPVPGLADEIRKKRQGSAAFRATPRFKPPPGAPSVTSPETLTWYVPPPLGQ

SEQ ID NO: 55708 - protein, 204 aa, Sorghum bicolor
  Clone ID: 30165293.pep
MAAAHLLAASAAASSSSTAFRPPLRLRSPLHPPHLRFNRTGRRPFPVVRAAETDAKDAKANAKVPEKAPAADGSSFNQLLGIKGAKQESDIWKIRLQLTKPVTWPPLVWGVLCGAAASGNFHWTVEDVAKSIVCMIMSGPCLTGYTQTLNDWYDRDIDAINEPYRPIPSGAISENEVITQIWVLLLGGLGLGALLDVWAGHDFP

SEQ ID NO: 55709 - protein, 181 aa, Sorghum bicolor
  unsure (1)..(181): unsure at all Xaa locations
  Clone ID: 30165295.pep
EGKGGKEKKTQHDEPSRTAAAAENGHVRGPAPVHVRRLGSTLSYAEQQDEISRTFLRSQASEVLTPRSNSSGIGFHQQNTAPRTNSVACQSSMGNGHYGLCELLFQQPPGTVVTADHAYERRLLMQQFDHRQIDLLGEERYNRVQIFLQHRDWMDLMWKVFCKTIPXVTAQQRLLIEQRDY

SEQ ID NO: 55710 - protein, 121 aa, Sorghum bicolor
  Clone ID: 30165296.pep
MDASSHEDNQSERAVKMNQNSRDNKMIKICDKLIGVFLVDKPTPTDWRKLLAFSREWDNIRPHFFKRCQEKADTELNPEMKHNLLRLGRKLKEIDEDVQRHNELLEVVKSTPSDELGSIVA

SEQ ID NO: 55711 - protein, 181 aa, Sorghum bicolor
  unsure (1)..(181): unsure at all Xaa locations
  Clone ID: 30165299.pep
LLEAHPASPSPSHRIPRLGSPPPPPNEVAIHPNPHPNPSQSAXSRPPPPTPPRPIRRRRTKPRPRPLLHPPPRPSAPPGSTPPPTAPPSWTPTTGPRSPTPPRVSSSPTPRLHRLRPSPPRRPSPTPPVRRSTAPITAATSPPGAVGGGGEHSPRDHHDRSAASGWDHAGAAGGEGCPEEP

SEQ ID NO: 55712 - protein, 77 aa, Sorghum bicolor
  Clone ID: 30165330.pep
QKHVVFCKQGYTYTPIQYLGSERSSIKLTSNTQRQPQHWKPGEFTTTASASEQIPLIFAASKAVMGLGDMLPNSKGH

SEQ ID NO: 55713 - protein, 118 aa, Sorghum bicolor
  Clone ID: 30165335.pep
GSSTRSLSLSAVRTLLVLATNNRLIGLVGLNVMRVDLKLVVLSGGLRRISIRGLFLGLFLGVLLVVVSLALAETNVCATRSGGDGNVSQSTAAFNAVSLANFSVFDQLGQIFAVEFNV

SEQ ID NO: 55714 - protein, 156 aa, Sorghum bicolor
  Clone ID: 30165342.pep
DASESGNVTDLKDMQVGVGRRFRGLKLWMVMRTYGAAKLQEHIRSDVAMAKMFEDAVRGDDRFEVVVPRNFALVCFRIRPHGGGMTEEDAEEVNRELMERLNRTGKAYLAHTVVGDRFVLRFAVGSSLQEERHVRSAWELINKTTTEIMQEQIDAE

SEQ ID NO: 55715 - protein, 59 aa, Sorghum bicolor
  Clone ID: 30165354.pep
QAVLRGNLRFPPRAFPAVSPEAKDLMRRMLCKDVWRRLSAEQVLSHPWIVTRGGSVAVA

SEQ ID NO: 55716 - protein, 100 aa, Sorghum bicolor
  Clone ID: 30165355.pep
MNELDLTDTPNSFKIFPTTKLAQFCWCTLQHRIASLTTCLTSYYGWVVYPAMGPCLTTFYLGYFSVPHAFSPPFYSGALGEASIWISGVATDCRALQGWT

SEQ ID NO: 55717 - protein, 122 aa, Sorghum bicolor
  Clone ID: 30165366.pep
SGEKPVVPPTPVPVPSNPGNPEQCVPSQSVTAITKEYTTVLTSVEYSTIQVPCATGTTPGNPSNPGQPESPTGPAVPPPATTPIGGGNQTVPTPPAVTAGAATFAGSAFFAAVAGLAAFILV

SEQ ID NO: 55718 - protein, 153 aa, Sorghum bicolor
  Clone ID: 30165379.pep
MRYSTAAAALLASGAMATEVSKVYETKRVTITSCGPEVTNCPARSTVTSNTVYPVPPQVTSAEQGSETTKEVPEVPETTEAPLTTSTIYSTNIRTITSCAPEVPDCPARSGTPVVVTETIAVSTTICPVEPTGGSEKPGKPEQPGKPEKPSSP

SEQ ID NO: 55719 - protein, 129 aa, Sorghum bicolor
  Clone ID: 30165400.pep
MGSLDTNPTAFSAIGDAAATGFQPLNPDDVRSYLHKAVDFISDYYKSVDSLPVLPDVKPGYLRDQLRSAPPTSSAPFDVTMKELTVSVVPGMTHWASPNFFAFFPATNSAAAIAGDLIASAMNTVGFTW

SEQ ID NO: 55720 - protein, 207 aa, Sorghum bicolor
  Clone ID: 30165402.pep
MGSQLTPATAPWDAVSAQEQLFVLITGANSGIGLSIGERLIDEFLATRSLRSHLILIPTTRSKSKSLQTIKALRDYARKAAQTSKSLQSRVGSSYRWEDTVARVHVLSLQVDLCDLRGVYAFANALVHEPVSNPEGLEGEYLRNVRIPRLDTVVFNAAYGGWSGVNYPKAIWVILTEGLVQSVTWPSYKMALPTARLNDKSNYNYPK

SEQ ID NO: 55721 - protein, 109 aa, Sorghum bicolor
  Clone ID: 30165415.pep
RCSRRKSSSLGLDLVHERLAHFCGGCIKFQVLRSEEVRLSPCICKGDQFGSLGEIRGRGEGGWLRNGGVEDVEIKFPGIRTAINAVRFRFVPSENVSSRGIVCLVLSLN

SEQ ID NO: 55722 - protein, 69 aa, Sorghum bicolor
  Clone ID: 30165416.pep
PSIVRRPILCSEEQTDSDVVIKDIMCGDECGAARTMLQISYPMENGIVKKWDDMEHLWDYTFYEKLKVD

SEQ ID NO: 55723 - protein, 79 aa, Sorghum bicolor
  Clone ID: 30165419.pep
KSGQAAQRRGSRGGEDYRSLLLNCTMGVGCVTIVDLLQAPGLQVVRSAMLQRDGNTSTVVSSHQQQHPKCRMLHHENEL

SEQ ID NO: 55724 - protein, 156 aa, Sorghum bicolor
  Clone ID: 30165422.pep
SVEDKILRKIRDKEAEVETINKRNSELEDQIKHLGVEVGAWQQRAKYNESMINALKYNLEQVCAHQSKDFKEGCGDSEVDDTASCRNGGAVNLQLTPKENRQQKDLTACRVCKSSEACMLLLPCRHLCLCKECESKLSFCPLCQSSKILGMEIYYA

SEQ ID NO: 55725 - protein, 99 aa, Sorghum bicolor
  Clone ID: 30165442.pep
DQEEYQIRRLTALMIEKLFQKIEVKMSLFSEIEQVVLRTREYTEKTRKKLLMERNAIIAARMGALPSRPNQPGVAGNRLPPGYSNPPVRPPNAMPRPTS

SEQ ID NO: 55726 - protein, 146 aa, Sorghum bicolor
  unsure (1)..(146): unsure at all Xaa locations
  Clone ID: 30165449.pep
LIKIRTHGPAHHAVLPHRWFRAMCVSGAVVGAVSVSPVPERCRGEPGYVLARAYWXTAAVRRALRDVFADLETKGQQRVEAMVDVGNPASQRVAEMAGFLREGVLRRHYWHKGRARDMHNSLSLTEFIINIINIYVSKLIYNKCIL

SEQ ID NO: 55727 - protein, 133 aa, Sorghum bicolor
  Clone ID: 30165451.pep
PFSAMNVELYYAFSAIWGHKMYTMYGMVFMMFIMMLNMTACISITLTYFQLNALDYRWWWRSFFYGGSSGIFVFLYAIYFYLTKTQMHGFLQVMYFFGYSGLFSLAVFLMMGSVGFLSSSAFVRHIYVRSKTD

SEQ ID NO: 55728 - protein, 150 aa, Sorghum bicolor
  Clone ID: 30165464.pep
IKSLSTPTLIVNSAYDSWQVRFVVAPDGSSPDESWRSCRADVRRCNSSQIQVLNAFRKEMVDDLEAADDNTNNSWFIDSCFTHCQTIFDDSGWNKQVAPRIGNKTLKEVMGDWYFGRSPSPVVRQVGCEYPCNPTGCQLAQQSSSARTKE

SEQ ID NO: 55729 - protein, 216 aa, Sorghum bicolor
  unsure (1)..(216): unsure at all Xaa locations
  Clone ID: 30165467.pep
MKYLLFAILLVFATATTEPEFKKDEPIRIMVNKISPYSNPTESYRYYDLPFCSPQDPFEEPQSIGEKLSGDRKMSSLYTANFESAVKKRPLCNQKLTAEQVEKFREAIKQNYIFEMFVEDFPVGNYIGVYRDGKTYLANHLTFNILYNXDLGKIIKVSVDYEDPSDTVEITETTKSYDINFTYSVNWAPTALTNPHINKGADSFFIDEVHWFSFLN

SEQ ID NO: 55730 - protein, 48 aa, Sorghum bicolor
  Clone ID: 30165474.pep
FSSPPCAEEFAADVEPKNVPAVFRDVAKGWAASSRWDPLHGGLDYLLE

SEQ ID NO: 55731 - protein, 163 aa, Sorghum bicolor
  unsure (1)..(163): unsure at all Xaa locations
  Clone ID: 30165480.pep
MATTELRSPLLPLPPPPQRQRRISARAAALAVSATVVVLLLPFLIASFGGTTSTSRRHPPRHRSSSSSSNLVELTLLTAAQDKGAVCLDGSPPGYHLQAGTGAGSSSWLIHLMGGGWCDTVRSCSDRSKGYLXSSLYMEKLMDFSGILSNDPAQNPDFYSWNR

SEQ ID NO: 55732 - protein, 130 aa, Sorghum bicolor
  Clone ID: 30165484.pep
MQHALPIAASHVDSHGNQRAGAELLARVQELENGNTELERENKMLLSKIAEKEVEKDALVNRLNDLERNVVPSLKKTLNDISLEKDAAVVAKEDALAQLMSMKKRLKEAEEEQYRVFIETCSLLVEWSLC

SEQ ID NO: 55733 - protein, 104 aa, Sorghum bicolor
  unsure (1)..(104): unsure at all Xaa locations
  Clone ID: 30165507.pep
RCGGTWKEAFRSLACRLDGVXEDPADLRLPPPPRRRGASTAGASPCAAEDGLGSMPRRWLRFPYSRQTNRGGGLGRGARRVCRLPVAVLFFFFFYLCSPTSAVR

SEQ ID NO: 55734 - protein, 65 aa, Sorghum bicolor
  Clone ID: 30165516.pep
MEQEAAAQQGSVAAVTLRRFELADVDAMMEWASDPEVTAFMTWDAYTSREALLAFLRDAVLPHPW

SEQ ID NO: 55735 - protein, 200 aa, Sorghum bicolor
  unsure (1)..(200): unsure at all Xaa locations
  Clone ID: 30165518.pep
RALSVRGAFVTFVTTPLNLPRLGRAASDDALPIRFLPLRFPSADAGLPEGCESLDALPGLGLLGNFNDACAMLRGPLVARLMEGDTPPASCVVADACHPWTGGVARELGVPRLSFDGFCAFSSFCMRXMNLHRIFDGVDDDRRAVRVPGFPIDVEISRARSPAGNFTGPGMKEFGEEIMAESARADGLVVNSFAELEPVF

SEQ ID NO: 55736 - protein, 100 aa, Sorghum bicolor
  Clone ID: 30165523.pep
FNPVPLTYPLCLVIYFLFFFFLAFKEAAVASVLLTSSFSSAFCFSVYSYALSHCISSIFFNKAFFSSSTFSILARSSASFSSLVLATSSSFSSTIFLALL

SEQ ID NO: 55737 - protein, 82 aa, Sorghum bicolor
  Clone ID: 30165532.pep
LFWLHCAAKLLAAYQVAICTCVVVQLGHFGGTCGVCVSASNDILQFKQYGLMNVPSYQVAICTCVVVQLGHFDGTSGVCVSA

SEQ ID NO: 55738 - protein, 183 aa, Sorghum bicolor
  Clone ID: 30165543.pep
TIYERAGRVFGKPGSITQIPILTMPNDDITHPIPDLTGYITEGQLFVDRQLHNRQIYPPINVLPSLSRLMKSAIGEGMPRKDHGAVSNQLYANIAMGKEALAMKAVVGEEALTFEDKRYLEFLEKYEKEFLSQGFNESRSIFQSLDITWELLRKFPKEMLTRIDDQTKGEFYHRQAPSAEPKK

SEQ ID NO: 55739 - protein, 89 aa, Sorghum bicolor
  Clone ID: 30165548.pep
FLCTYILNLEYLQFFLPLGVNENIIRVNAYRFYSCLLLLGGFFRFALHCIFLHLFLPRSIGFSCFLPSLPIYSVVCILESPMRVGVCCL

SEQ ID NO: 55740 - protein, 138 aa, Sorghum bicolor
  Clone ID: 30165551.pep
VRYDHDSSEEIVPLRKVCRRPDTDYRLQILHAARVAATNADIHTPPKEIKVELTSNDKSPTEQKPQKQHKMMDVNTDEVTMVSPLEQDETQGKTVAPLPSSTVETRNSSSDAVMKDAEASSVVEDDDEVQVVDKMKEG

SEQ ID NO: 55741 - protein, 151 aa, Sorghum bicolor
  Clone ID: 30165576.pep
GDDAHKPSNLTHATLDLYTYLPQRRHSQSLLPLLYHPLSSLLLLLLLPQPAASFCFGLGASFPLLYCSPTFACFVTHTKSSCLYLLGPYLRPRSGIWWELRCLPLAFLCSIGVTARARGRNSGSCAVPVPLGDCGTLAADLCVIPGAPEMN

SEQ ID NO: 55742 - protein, 194 aa, Sorghum bicolor
  Clone ID: 30165582.pep
IHMDASITLQRPRPQNLFVSNPNTTSDLKCSTAALKPISGEWSSISLRSIKPITSATLKKAPGIDCEPKSATALAQEYKDQIAAILLQKKHQTPKASAPQVIEVPSEGESEGSRVLSPGNSSSETKNSADFSRREFDMMLDKSKSDVDDIENKKTSELLNEKIATLNKELEDSSKLITEKDKEILALKAKIEII

SEQ ID NO: 55743 - protein, 170 aa, Sorghum bicolor
  Clone ID: 30165606.pep
LAPDVHRRRRAGATREPSHERRALLSCTSSLRGRRNRRLRLRRCHEQHAASQVDVAAPAVPASAHGGRLPRRHVRGGRQRLLPPRSDLRDTAGRRRGPGPRPDADNLRDLDCGDLLARGPPALAAHVLPHLTERRRRRLASLGRFLFFLSRSPRLRGAACAAAACALDSI

SEQ ID NO: 55744 - protein, 51 aa, Sorghum bicolor
  Clone ID: 30165608.pep
NPRNLQPILEDHHQLAYHSIENSANILRTGIFKTSPVNSTRVNFTSIQKYL

SEQ ID NO: 55745 - protein, 99 aa, Sorghum bicolor
  Clone ID: 30931907.pep
MPPGMEAISDLELPVLLENDGNIEKAEACRKELEDICILLKRKHAEAKELAVRAIVNNNTMLMLNHPMIEEKICSIQKFTNNLISKKYLFEEVGTINTH

SEQ ID NO: 55746 - protein, 130 aa, Sorghum bicolor
  Clone ID: 30931920.pep
EFFSTAKSQPNMNPLVAPATNPAPVQTGPLGVTITPQPTLDMMTHNFNSQLNLNAGTSQQRMSVGPTVPSATSNGNMFFPSVGFTPAMNQVPPPFTSNPFLVQGTGATNVAATSPQKPTQQPFTYNPFLN

SEQ ID NO: 55747 - protein, 64 aa, Sorghum bicolor
  Clone ID: 30931932.pep
FNNCFFLTDIKELKLREESLAKELEDLKVRLSEIERLAKGRGLTGILNLKRVHGPEVGKAATPA

SEQ ID NO: 55748 - protein, 49 aa, Sorghum bicolor
  Clone ID: 30931949.pep
EEPHVVVCCKRPSQQGHESTGRLCWVMSPRACLPLGWACLQSWAYKNTR

SEQ ID NO: 55749 - protein, 119 aa, Sorghum bicolor
  Clone ID: 30931976.pep
ATDDVVGLQICKDKNAHPQVWEYVAPVKGGFIVNLGDMLERWSNSIFRSTLHRVVLDGRERYSIAYFVEPSHDCVVECLPTCKSESNPPKFPPITCFAYLSQRYKDTHTDLNSYNNSKA

SEQ ID NO: 55750 - protein, 47 aa, Sorghum bicolor
  Clone ID: 30932000.pep
RASMSHTSKKRVCIHTTLQKDYMVYTILRSICVKVYCGNSIYNIDAN

SEQ ID NO: 55751 - protein, 129 aa, Sorghum bicolor
  Clone ID: 30932036.pep
SFPTRSSRRRRRLFLFLPPPDLQALPEQLAPPSSSRGCRPCRTESSSTPSNHLHAKVQAPPLLSGLRTPEPKIRPLPSSSRRSPTSPRHSRSRVACIVLASTAPPSSFLLDPAAPTSGMDLVGQATASS

SEQ ID NO: 55752 - protein, 144 aa, Sorghum bicolor
  unsure (1)..(144): unsure at all Xaa locations
  Clone ID: 30932040.pep
MGCASSKAGDDVAVADVYRPPPTSVSLFDITAVEEPWLIAKQSKAADDDDDXEDEETTTDDEEEDDDEKLQPAAKTVVPLPLLDKLEGYELAPASWSEVSKALEDMKPVLDSKPPPAPVALKKKKKNKTKKKKKKQQQPQQPTT

SEQ ID NO: 55753 - protein, 141 aa, Sorghum bicolor
  Clone ID: 30932046.pep
MASNMQAPGPPQPPRPPMMGSSAQPQNLGPPMPMQFRPVVPSQQPPQFMPPAAQQFRPVGQPMPGANIGMPGQMPHFPQPGQHLPHSNQGPPASQGVPMVYQPARPMSSAPMQPQQQTAYPGGHLPTMGAPMQPPTYTYQP

SEQ ID NO: 55754 - protein, 86 aa, Sorghum bicolor
  Clone ID: 30932078.pep
RFPVHSTPPLPGGSRPQQITPQGAGAALRSGTNPRRSRGNRARANPIARGPEPRRRRRRIGVGMDWGVRGECGGVGNSAIYCRFLI

SEQ ID NO: 55755 - protein, 221 aa, Sorghum bicolor
  Clone ID: 30932082.pep
KKKKKEIYPTKAAVNLPSQDFSCSAISSEDPTQGLADPVNSKDAPIVNSGKVHVSRESNDDERSNGLRSRDTSIISPNVSRRPVGQFNSRNEVLEESVSLNEGSQDNQSFSGAPKKFLKKTSHGSGTKNTEEEISGPKSLSCSMQREIRSVEPALTKERGSFSLLSKSVHMKATRVELASETALNQLSSASKVIKKMATHPTDLKREHMQANAVPDKSKTA

SEQ ID NO: 55756 - protein, 196 aa, Sorghum bicolor
  Clone ID: 30932101.pep
MSSKSSRKSIKSAVKKATRTSWSPPKEKHVKRLVLATFARESIEDIITQLHRRFTKNNWVVILKTLMVFHKIMREGDQFFMESLKNKAHALFALRNFTGNPSNVYVIFVRKYAKYLDEKVSVFRLLNLQFEKNHEAFKNASVDALLKQVPKLQSQFNALLNCRLRAQYIGGNTLIIAALMMMLRDSLTVYPMLNSG

SEQ ID NO: 55757 - protein, 61 aa, Sorghum bicolor
  Clone ID: 30932114.pep
YSTVIANETQQEQNPLFRFQLKPFFFFYAFYGLNSLPSPLRAPALNSSSSSSLRFDRIGGI

SEQ ID NO: 55758 - protein, 221 aa, Sorghum bicolor
  Clone ID: 30932116.pep
PLSPPPINPTRRRPWRLWRRRLAVPREGSRRHPRARNRRLKQTSRRCQRRAHLIPVLLEPAETYPSSKIRHLWRSAPLNLDVGDLFTIDVVSPINRDGGELGTIGVVSRILSAHRGPCRRFRFAAKHLQDHPATVDAWLRSPALDNLQEIDCWMRLFSPVVLQPPPPPASAFRFSSCLCVATLSHCHLSDDVAQALQFPKLKKLALQCVSISEDSLHSIIA

SEQ ID NO: 55759 - protein, 89 aa, Sorghum bicolor
  Clone ID: 30932118.pep
LLFLLQGFEGYVGFLLLRTAHTGVVPEWQVVVCGILLVAMAIGNFANTVDTLMTKSRFKAKMKKSKGKRDLDTCPSPTGSLPTDSTTKA

SEQ ID NO: 55760 - protein, 155 aa, Sorghum bicolor
  Clone ID: 30932149.pep
MRLPVLFALQLVAVAAAASVAEAAATLSSRMVHRLSDEARLEAGPRAGWWPQRGSGQYYRALVRSDPQRQKRRLAGKYQLLSLSKGGSTFSPGNDLGWLYYAWVDVGTPTTSFLVALDTGSDLFWVPCDCIECAPLAGYRGNLVLRHKWSIYYAG

SEQ ID NO: 55761 - protein, 98 aa, Sorghum bicolor
  Clone ID: 30932162.pep
RSALVKMPALRMKRMFDVDDFANEFNTRNVKSVKVSHFYVSGLEQSAVLNSSDKAPHDESDPTIQLADQDIRATEPSGLHDPIGGQSMLKDLTSDEVI

SEQ ID NO: 55762 - protein, 143 aa, Sorghum bicolor
  Clone ID: 30932166.pep
EVLKDGILSRASKDGYTVNQKADPKTVHIKKEAIMTDVPPIEVTKHNNGDLLYMKALYHALPMDYVTIAKLQGKLDGEASQNIVRKLIDKMVQDGYVKNSANRRLGKAVIHSESTNRRLLEIKKILQANKGEQMAIDTNTEHA

SEQ ID NO: 55763 - protein, 173 aa, Sorghum bicolor
  Clone ID: 30932178.pep
MAGGDGDRHRGPKRHKSSAPSKAALVDESAEFDYADDFDDDAHDADMEVKKRDFTKLELKVDHASRPLWACADGRIFLETFSPLYKQAYDFLIAIAEPVCRPESMHEYNLTPHSLYAAVSVGLETSTIISVLSKLSKTKLPREIIDFIHASTANYGKVKLVLKKNRYFVESPF

SEQ ID NO: 55764 - protein, 80 aa, Sorghum bicolor
  Clone ID: 30932199.pep
FSIQQNWYHSHFAKYFGTKQGLGILWETATSSFHRFSTISKEICGTDLPVAICQPKWFQRWGFFFPIYLSDVLSERALTQ

SEQ ID NO: 55765 - protein, 98 aa, Sorghum bicolor
  Clone ID: 30932205.pep
FARPAQGGQPLRVLGMEFDDGTVLAALCGVTVIAMLFTSVGWNVVGSVMIGGALVSAHAALRTTDDLFLTEQEAAGDGLVAAGMSAAGPILPTYVRIG

SEQ ID NO: 55766 - protein, 144 aa, Sorghum bicolor
  Clone ID: 30932212.pep
SQNVELMLQETSTHPDGGSLVVFATVDVDAIQVTMSGEDPSYIPLLPLGFAIFPATNPSPAATSTSSGNGESSPGNTDEPTSGCLLTVGMQVLASAVPSAKLNLSSITAINSHVCNAIHQITTALKGQGAGVSGVEPVAAAGSD

SEQ ID NO: 55767 - protein, 179 aa, Sorghum bicolor
  Clone ID: 30932279.pep
VMNAETSVAKVGFFGNTYQKLWCLTHIETLSVWDWIDGARELNIEDARSLATDRWNLDHVDYFVDCHYSMPDDRLWLIGGTAAGTLGYFPVRNDHAGAIGSAEAILEGGHTGVVRSVYPSAGIHESLGQNRGIFGWTGGEDGCLCCWRSDEIAEINKSWISSSLVCKQQKKTKNRHQPY

SEQ ID NO: 55768 - protein, 96 aa, Sorghum bicolor
  Clone ID: 30932285.pep
VDSVLSIAQAVLGGTVTVPTLTGNVTVKVRQGTQPGEKVVLRGKGIKARNSPVFGNQYVHFNIRVPTEVTQRQRELIEEFDKEECTDREKLAAASG

SEQ ID NO: 55769 - protein, 99 aa, Sorghum bicolor
  Clone ID: 30932301.pep
RENERSCCSKRKSTASYLQGSRAQVDCSVSSPYIGLGQMGALNGRNSSTVLDGLYGVQLGDRPSQPVQTEDEALRTTLVESSACEHHKSGTTQQRLLIR

SEQ ID NO: 55770 - protein, 69 aa, Sorghum bicolor
  Clone ID: 30932311.pep
LSLQNYNLKPTYAKKNKSHYMDVYRSLFGRTPSTLILYRGVGSGETTKYSFFGLLIYFVRIEERTLIYE

SEQ ID NO: 55771 - protein, 166 aa, Sorghum bicolor
  unsure (1)..(166): unsure at all Xaa locations
  Clone ID: 30932341.pep
MVFTDDEDDFLEQWWEEEESDDDDLVAXAGSMPGRQTVPRDMHAGNLRIVADYFADPPIYNDKFFRRRFRMSKPLFLRIVQGVEAHDHYFRQRPNAVGLLGATALQKVVGAFRMLAYDVPADSMDEVVRIAESTMIEAFKHFVQAVVDVFSEQYLRAPICIFQLLF

SEQ ID NO: 55772 - protein, 182 aa, Sorghum bicolor
  Clone ID: 30932343.pep
AGPEASRAERCRAIALAAGPSFRSTCPGKSHTPGRCSSASSSSRSASAAPRPHLPSAAASTSSTRSSSSMASPTSASSSRSSSPSPPPPPTSPAQSRSSSSPYPTPRRPPPSPTFSSAPPPRQAPRPAPCSRSSPASWAATGCGPTHSLSPPSSLLSPPRAPERSPTAAPSTSARSRAGCSP

SEQ ID NO: 55773 - protein, 58 aa, Sorghum bicolor
  Clone ID: 30932345.pep
MALSSEIRFGHQIPLSHSDTDDSYEEEEEEEEEEEEEEEEEEFEGEEEEMDEVTVSSP

SEQ ID NO: 55774 - protein, 189 aa, Sorghum bicolor
  Clone ID: 30932347.pep
MALHSAAALSALLLLSFSGLTLSDETPSTPVSPSAACNATTDPTFCRSVLPPRGKGDLYTYGRFSVAGSLAGARKFAAVVDRYLARHRHLSSSAIGALRDCQLMAELNVDFLTAAGATIKSTDTLLDPQADDVHTLLSAILTNQQTCFDGLQAASGSWSDRGGLDAPIANGTKLYSLSLSLFTRAWVPT

SEQ ID NO: 55775 - protein, 203 aa, Sorghum bicolor
  Clone ID: 30932349.pep
YNASLKRRVLSRVECFLSSDPINNGWLKPRRSENFTSLESACVQPEYKLPVRKRADCKAEQYEITGSPLSSSNVPADVPWWQEFPRRWTIVLLCFFAFLLCNMDRVNMSIAILPMSSEFSWNPATVGLIQSSFFWGYLLTQILGGIWADRFGGKVVLGFGVVWWSLATVLTPLAAKIGLPCLLTVRAFMGIGEGVAMPGFLTS

SEQ ID NO: 55776 - protein, 150 aa, Sorghum bicolor
  Clone ID: 30932361.pep
MATAEGDADWSLPSPTDLDDNGFPDLPCSPAASSSCFAEDFYSSGTDWSSLRAPPPLRPPGRAPGVKEKEMGGGSLVQSSLLQAWGIEKPRREAGDSSLVQRSLFQAWGIERPPREGLGAGHSSPSPSRSGSWLGRKRRRGSTEEERVAP

SEQ ID NO: 55777 - protein, 183 aa, Sorghum bicolor
  Clone ID: 30932376.pep
MAAATAIAAALLRRSNSTTHHRLILPLLSHLHRPLPQPPSSPWLPPQHRFFSTGDTAGGNPTRKPPPSLDPKQLWRELSAWDPAAGSSRLPKATWDAVVGLVRGFAKSPAMSDQALALYVPSSAFPSYARRFRAFLLPRLSRESAAHLLSLPAEDAHELLLPAFAEFCVANFADELRQHRSVM

SEQ ID NO: 55778 - protein, 163 aa, Sorghum bicolor
  unsure (1)..(163): unsure at all Xaa locations
  Clone ID: 30932385.pep
LRTARRAARTCCFADATASLARWHRSSSATDASISASTAPLQCALDSACASRPPPWRWSRTSSSMRPYASPSRTASDDDDDGAGADADAAASDRIRCSSSSTSCTRACGLTGRLVDRSCWHAMIFRCFLTRHRTSSTTRAACCAPRALHCCDAPAGACXEVST

SEQ ID NO: 55779 - protein, 105 aa, Sorghum bicolor
  Clone ID: 30932407.pep
LLASVWRNTGIRPARDDESKRRRGFCISFFPLSVDLLAGRGRKEGRKEGRMFGATRWVSLLQRQCERLASELARNIADLGVIRTPEARTNMMKLSQRMITTFSAN

SEQ ID NO: 55780 - protein, 182 aa, Sorghum bicolor
  Clone ID: 30932415.pep
AAMGQREKANEPRESRVLCYTDTDTRIGIGRIRIRGYVNFSLEVDPDPAGSGWRLGVGDGDWRVASRGGRADSARLLGRVLACSGGQGRLASGEQAGDERTGALPAGGRRARKPGRVAPSLRGCSSDGSREAGGWDGCLPAQAAARRRRADGGVAEGARASRDSRAEEAARRGWGFFFFFFF

SEQ ID NO: 55781 - protein, 151 aa, Sorghum bicolor
  Clone ID: 30932421.pep
MAHAAVAALALLVFFSAQARDAGVHVVDAAAATLSQGQSLGAGDKLVSAGGTFELAFFTPTGAADPSRRYLGVMYAQSNEQTVPWVANRDAPVSAGSSYSATVTDAGELQVLEGERVVWRTNSATTASFSSPANVTLTLLDTGNLQLTAGA

SEQ ID NO: 55782 - protein, 105 aa, Sorghum bicolor
  unsure (1)..(105): unsure at all Xaa locations
  Clone ID: 30932431.pep
QNQSTRIIHTQPKRIRRMAVGPDSAGSAAXIPDDILFCKILILLPVKCLVRFQSVCKSWRRTILSTHFTRCHLEHSRTRLSMVVVPRGYQKDYRNSSIEGVSFYS

SEQ ID NO: 55783 - protein, 147 aa, Sorghum bicolor
  Clone ID: 30932439.pep
RLKGVQASTSKSNGSLAPCLLTNFPTVEKNLKIHWNPREGLVELGFGLKGNATTCLCWLAKASGRARRVEGGGRHGWPCRRRAGHAGYLPHRHCSGWHGARPSSRGLTPARHMYQWQARRLGEEESRCRGEEKEAAERGVLAAALRC

SEQ ID NO: 55784 - protein, 203 aa, Sorghum bicolor
  Clone ID: 30932445.pep
DIKVAAVKAFSFGEQKTQCLDDIAIMTGGTLVRDDMGHELEMAGKEVLGFASKVVITKDSTLIVTDGSNRQAVEERVTMIKGQIENSKERYNKKILGERIARLCGAIAIIQVGAQTIIEMKDKKLRIEDALNATRAAIEEGVVVGGGCSLLRLSEKIDAIKESSLDNIEQEVGADIFKQALSYPTSLIANNAGVNGDFVIKKV

SEQ ID NO: 55785 - protein, 175 aa, Sorghum bicolor
  Clone ID: 30932472.pep
KKKPSQARTADAPTPPHASPPISRLRSCLLLPATGVPPPASLILLGASPAARSLAPSPLARPLLPRPQSPGPTASSPQGGRADRRPRPHPDPDALAARASAAGVPAEAQSSEARRARPGLSAFGLSLRGRGCEAARGRGFWEREVCSSYGSTSRGDHYLLPAWVGLCDGCSRRGG

SEQ ID NO: 55786 - protein, 131 aa, Sorghum bicolor
  Clone ID: 30932480.pep
PLHLRCQRELFARHLAGAAASAWTAPSRLPEPGRERRSPSWWCPSRSFHATRRVYARDFYDVLGVSKDASAPDIKKAYYALAKKFHPDTNKDDADAEKKFQEVNRAYEVLKDDDKREIYDQLGPEAYERQA

SEQ ID NO: 55787 - protein, 66 aa, Sorghum bicolor
  Clone ID: 30932496.pep
VLSISLQLPHFSHAVNRTLEHSEEIYFWEQKKTNTINLIVFPLIQRKIVTARWQHVKRRIKEKTIN

SEQ ID NO: 55788 - protein, 106 aa, Sorghum bicolor
  Clone ID: 30932498.pep
EKIFVFICWDKITIRDSRKTLDSLKYTLPIYMTYLLVIPSLISLNCDGPTAPLFPRATRACHGGYVNAAVLLKNSFGFTSSLCCYLGKKNQSQAYNHVTLDKSSQI

SEQ ID NO: 55789 - protein, 39 aa, Sorghum bicolor
  Clone ID: 30932508.pep
PLVVPIPVMFLGLFTSGIQALIFATLAAAYIGESMEGHH

SEQ ID NO: 55790 - protein, 120 aa, Sorghum bicolor
  Clone ID: 30932516.pep
FGGKLHMGYMLIRERLSELQEEKNKKRKLDQAEYDRRSRERSGERARASSRDRYRGDHSSSRDRDYDRRRSHDRYHDRERERDSGRSRSYDSRSHRRSRSPRGSSRDYDRSGRYERRDRY

SEQ ID NO: 55791 - protein, 68 aa, Sorghum bicolor
  Clone ID: 30932520.pep
PGVPLLPIISVFFNMVLFAQLHEEAWYRFVILSFIALGVYAGYGQYNAVPSSSENFIIGYHGIPIEAP

SEQ ID NO: 55792 - protein, 185 aa, Sorghum bicolor
  Clone ID: 30932542.pep
KSFVVASSSNDRTIKTWDLQTGFCKSTIMSASNPNSLAFIDGDIICSGHRDGNLRLWDVRSGKCTTQIAAHLDVTSVCVSRSKNFILTSGRDNVHNLFDVRTLEICGTFRAMGNKVVGSWSKPCISPDENCIAAGSSDGSVYIWSRLKNGTPTILEGHSSPVLASAWCGLGPLATSDRNHIYLWS

SEQ ID NO: 55793 - protein, 147 aa, Sorghum bicolor
  Clone ID: 30932564.pep
SVVHDKKYSSGLWAVKAKLIEVTGKALDAVGYGTVVLPASSRVHLLKTWLPYIQMTKPLLDENSKDETSLQMDSDMCQNIESAIVSMVLALPSDDQADILSEWMKNAEQFRYPDLTEAFEVWCYRTKTAKRRLVGGLNGSSNPTVSL

SEQ ID NO: 55794 - protein, 87 aa, Sorghum bicolor
  Clone ID: 30932607.pep
CVSQNQSNSWLCNLSLNVCFVDDMSDCLNRVDASRVVTFGSRVPKPNGLCPPTRGGSAQQSTAPVPFRGLVRCSTEANQLLDLLLPR

SEQ ID NO: 55795 - protein, 177 aa, Sorghum bicolor
  Clone ID: 30932625.pep
KVVRLTRALSNVKTLAVTSYYINLDTVIELMKCFPCLEKLYLYIKSCISGKMNRNRWCWNRNISGEMNWWRRKHRDFIKSSDIHLKKIVMTYRGIRSQINFASFFLLNARELELMRLEVVASDYNDAFFAEQHRMLQMEKRASRGARLHFTNKICTHGIHVNHVRDLSVADPFECRW

SEQ ID NO: 55796 - protein, 143 aa, Sorghum bicolor
  Clone ID: 30932639.pep
PTCKDFKPASKKMELWQAPPVLVVHLKRFAFSGMWRSKLDDAIDFPLRGLDLSGYVQDHNVLQLSAEAALHEVPPIYDLFAVANHYGGMGGGHYTAMAYHSELGQWYHYDDASVQPIALEDVNKSVVSPAAYILFYKRREMHD

SEQ ID NO: 55797 - protein, 66 aa, Sorghum bicolor
  Clone ID: 30932647.pep
RDLGFCIHLPQTILSYMGDTTLLQLTANKTHPKHSTNRAARQTKGNCPKSSPPAGLPAIPITNCSD

SEQ ID NO: 55798 - protein, 59 aa, Sorghum bicolor
  Clone ID: 30932649.pep
MLLSGMKGICGLYERKIRNINPMVGNLTYDISDLYNFIDGLTDISALVYEDSLHAFLPY

SEQ ID NO: 55799 - protein, 194 aa, Sorghum bicolor
  Clone ID: 30932688.pep
SCWNTTALVHNTSTVIYTHPLYTDMVTRTALHIALWVLVVSHAVLNKTLTQITLIDDVKRGTEHVIELGDQSAPSEHVIEQNNSTQLNATVLGNLTSLCIRCSPGAYSTANCTNTRLIKSAARVEGTCAAGYCMMPLNCSLCPLGTYNNQYNASACLACSAGSYADRAGSLNCTECRAGSYESRGGSARCQSCG

SEQ ID NO: 55800 - protein, 184 aa, Sorghum bicolor
  Clone ID: 30932698.pep
MGRAFVYVILGGGVAAGYAVLEFARRGGYSRGELCIISEEAVAPYERPALSKGYLLPEGAARLPGFHTCVGANDELLTTKWYKEQGIELVLGTKVISADVRRKTLLTGTGETISYKTLIIATGARALKLQEFGIQGSDASNLCYLRNIDDADKLVSAMKSCPGGNAVVIGGGYIGMECAAALVT

SEQ ID NO: 55801 - protein, 174 aa, Sorghum bicolor
  Clone ID: 30932725.pep
MDAIRKQLDQLMGANRNGDVREVSRKYYDRDVCRLYLAGLCPHDLFQLTKMDMGPCPKLHSLQLRKEYEEAKAKGTDNYDRELEETIERLIVECERKIQRALKRLEEEDAKAAIAISVTEVTQTKEVMELSKQIRQKMKDIDAFDLEGNTEGKIRANEELDKLKEQRAEEQAKM

SEQ ID NO: 55802 - protein, 228 aa, Sorghum bicolor
  Clone ID: 30932730.pep
VATPPAPHLLRRHGGSPRPQALFHRRPPLPLWPLRRDAGPGVTISFVLAGAACVLNALCYAELASRFPAVVGGAYLYTYAAFNEITAFLVFTQLMVDYHIGAASIARSLASYFIQFLELIPFLKGQIPSWIGHGEEFFGGVISINILAPILLIILTAILCRGVKESSAVNTFMTTLKIIIVIVVVFAGVFEVDVSNWSPFMPNGFKSVVTGATVVFFAYVGFDAVANS

SEQ ID NO: 55803 - protein, 111 aa, Sorghum bicolor
  Clone ID: 30932745.pep
MKLLPREADKLALHNAGFLAQKRLARGLRLNYTEAVALIAAQILELIRDGDKTVTDLMDLGKQLLGRRQVLPAVPYLLHTVQVEGTFVDGTKLVTVHDPISLDDGNLELAL

SEQ ID NO: 55804 - protein, 168 aa, Sorghum bicolor
  Clone ID: 30932777.pep
MATGGGQQGKAAGYYQYPASYSYAGAAAAAAEEERRWWPWLVPTVLVACIAVFAAEMFVNDCPRHGSALGGGAGSGCVAAGLLRRFSFQPLRENPLFGPSSATLEKMGALNWAKVVHEHQGWRLISCIWLHAGLVHLVVNMLSLLFIGIRLEQQFGFVRIGVIYLISG

SEQ ID NO: 55805 - protein, 163 aa, Sorghum bicolor
  Clone ID: 30932813.pep
TARRHRSQPPTVPRPASLSVSAASSPSRSHHHGGAPSPAGRQRRCSARGRRYESLPLPARARPLADPQIDPCHSWVLAAAWAGRGGDAAHLHLRQRKRFKGLLFYWAVGQYRYHKNNAIHETVLSCLSLLIDVLQVSVDMAYPTQDRLLNLKSGTDDDNSVQF

SEQ ID NO: 55806 - protein, 129 aa, Sorghum bicolor
  Clone ID: 30932853.pep
TFRERFQVANGSMTPIDGSMNADYANELIQACAAANGAAAAATAVDCDSGSAAVFDNRYFANLLDGRGLLRTDAVLVQNATTRAKVAEFAQSQDGFFASWASSYARLTGLGVKTGADGEIRRTCSSVNG

SEQ ID NO: 55807 - protein, 124 aa, Sorghum bicolor
  Clone ID: 30932861.pep
PRLKTAYELLKVSLDLEQNLLHQVSLPFLIVHGGADKVTDPSVSELLYRSAASQDKTLKLYPGMWHALTSGESPDNIHTVFQDIIAWLDHRSSDDTDQQELLSEVEQKARHDEQHHQQQDGGNK

SEQ ID NO: 55808 - protein, 76 aa, Sorghum bicolor
  Clone ID: 30932893.pep
RQSKGCGKAKRKTISILNHIEHRQSHSHSPRFTGEVLECAPAPAALWMIIWEQKPLQTLPKLYMIIKIAHRCKTQH

SEQ ID NO: 55809 - protein, 153 aa, Sorghum bicolor
  Clone ID: 30932906.pep
PLPAEQQEWAHKQYVAKHQQWASQQWGNFYYYRMHNISDIYFIGGFGTVAWIDVKEYETIQPDKIAVDGGDLQSLKELNAIFSKPLREVLSSEGEVDDAALISVDSKGIDIRVRQGAQFNIQRLAFDVPHKVETLEEAKKALHKIIKDKQQIK

SEQ ID NO: 55810 - protein, 28 aa, Sorghum bicolor
  Clone ID: 30932916.pep
RHKILISPCWPTMDGYICYLTPMPQGFN

SEQ ID NO: 55811 - protein, 76 aa, Sorghum bicolor
  Clone ID: 30932945.pep
LLTTSLCVTVEYNFLDTCTVTVIYRPRCFILLWYKIVLGAVCISLYKGTRTHVSIQFTLWFLIYSMRYMMDCVLRI

SEQ ID NO: 55812 - protein, 101 aa, Sorghum bicolor
  Clone ID: 30932949.pep
AALFKGGIISFLRPPPKILGDVTSDLEAHHMSQCGALCRDKVFSRDAFAFNCDHHSVSFLCNDLCFSKPGCKRTNCMENLGRMSLLILEALSYESPVRWTL

SEQ ID NO: 55813 - protein, 95 aa, Sorghum bicolor
  Clone ID: 30932971.pep
IAFCFCERLWLCKAWEVEKVRPFRQGDKVRIRPGLVSPRWGWGMETYASKGEVVGVDANGKLRIKFRWRDRLWIGDPADIVLDDAHLLTEASNGF

SEQ ID NO: 55814 - protein, 97 aa, Sorghum bicolor
  Clone ID: 30932987.pep
PLDLHGAEKYFDELPDAMKDKRTYGSLLNVYAQAMMKEKTEDTFEQMRKKGFASDTLPCNVLMNFYVDSGEPNEVLAIIDEMKERNVSFDVCTYNIW

SEQ ID NO: 55815 - protein, 66 aa, Sorghum bicolor
  Clone ID: 30932991.pep
VIEHDPANLESHSWTYQKQGYKILKLLVKGNSAFLVVHAEFRCVLPYVPCLPSPHLVKGIHHLTLV

SEQ ID NO: 55816 - protein, 234 aa, Sorghum bicolor
  Clone ID: 30932995.pep
CKAKDEVKELIKKAHEKQLEAEPGRTMMESFENRVNQVLNKARDDAGSSAQKSLSESNNLKAMVTAGSKGSFINISQMTACVGQQNVEGKRIPFGFIDRTLPHFTKDDYGPESRGFVENSYLRGLTPQEFFFHAMGGREGLIDTAVKTSETGYIQRRLVKAMEDIMVKYDGTVRNSLGDVIQFLYGEDGMDAVWIESQKLDSLKMKKPEFDNLFRYELDDENWRPNYMLPEHVD

SEQ ID NO: 55817 - protein, 255 aa, Sorghum bicolor
  Clone ID: 30933001.pep
DLSLLSSSFSSSGDGANGNSNSNSSSSSRLQLLAATARALELGYAAVALDHPHRGLLADSHRCLTEPFAPLSSLPLPSSAALHRRRLASPASEPFRQYTRITLSLDSAAATASALAPSASRLLRTYDLVAARPLTQAAFDHLCQAPLSAQHLDLISIDFSSHGKLPFRIKAPMLKLALQKGLHFEIAYSALISTDANAKRNLIAEVKLLVDWTKGKNLIISSAAHTASQIRGPYDVINLSAYLLGIPIDRAKAAM

SEQ ID NO: 55818 - protein, 241 aa, Sorghum bicolor
  Clone ID: 30933021.pep
CEGDAAGVRDLLAKAASERNGSLIRSLLEAQNTDGLTALHLACRRGSGELVEAIVAYQENVDILDKDEDPPIVFALAAGSPRCVRALVGRSASINSRLREGLGPTLAHVCAHHGQPECMQELLMAGADPNAVDGEGESVLHIAVARRYTDCAIVILENGGCRSMGISNSQHKTPLHLCIETWNTAVVRRWVEIASLEDIAEAIDVPSPVGTALCMAAALKKEHEKEGRELVRILLAAGADP

SEQ ID NO: 55819 - protein, 96 aa, Sorghum bicolor
  Clone ID: 30933060.pep
RRGLRRGVGRKSIASAGAGLALALRARARGTPPRATTRGSGTSCCGGSTASVVKTAPWQAYAATLLVASSTTATTAPPTFSPPPPTNSDVGSKYRH

SEQ ID NO: 55820 - protein, 186 aa, Sorghum bicolor
  Clone ID: 30933062.pep
MATAASAFPGAFGVKTPAPAPARGLSAHPALTPSPAFARPPPRTPACGRCRASLHLGGVGAASSSSSAAAAASGNGTGLHVPPTIAPLAVPKMAGSMKTHKNVLLFYCEEMRDLARQVVARNDDIELRSISWRKFPDGYPNLFISNAHNIRGQHVAFLASFSSPSVIFEQLSVIYNLPKLFISSFT

SEQ ID NO: 55821 - protein, 128 aa, Sorghum bicolor
  Clone ID: 30933070.pep
MGRSSSSSSSNGGGGADDGGEVLLDHEYKEEYVRNSRGMNLFACTWLPAGKRKTPKALVFLCHGYAVECGVTMRGTGERLARAGYAVYGLDYEGHGRSDGLQGYVPDFELLVQDCDEYFTSVVRSQSI

SEQ ID NO: 55822 - protein, 132 aa, Sorghum bicolor
  Clone ID: 30933078.pep
EVEAFALRADDLKFVATQFRRLHSKQLQHTFRFYSQQWRTWAACFIQAAWHRYCRKKLEEALYEKEKRLQAAIVSDGTTSLSLGAALYASRFAGNMMRILRRNATRKARLQERVPARLLQKPAEPNFFAEDS

SEQ ID NO: 55823 - protein, 170 aa, Sorghum bicolor
  Clone ID: 30933080.pep
NWYKATFPMIHNLGYQELLSALVRIGDIEGAELLYEEWASKSSSFDPKTMNILLAWYAKEGLITKAEQTLNRFVEKGGNPKPNTWEILATAYMKDDKISEALSCMEKATAITSANKWKPRPTNVESLLASFKEKNDAESADRLVSVLTSRGCAEDEEYKSLINTYAFAGT

SEQ ID NO: 55824 - protein, 201 aa, Sorghum bicolor
  Clone ID: 30933106.pep
NHHSLDKFLKRIGNVGPQPVKLCALPCLCHPLPLQLRLQPRRRVVTDAPERPLQRPVAAPRINRLRLRGEARVQLGQLVKPPWVLARVGRTGLLLHLPLARVRPDELGEPVDGEVAILRGDYAAFEADSGVAVPRAKREQPLGYLLGGEALLREDAAPQRGGELIGRRKSPVLLPVRRDGLKERDLVGVRPRALWRAGFLQ

SEQ ID NO: 55825 - protein, 152 aa, Sorghum bicolor
  Clone ID: 30933118.pep
MEALAGSASSSILPARYPPSRVAAQSLALRPSRCGPLRAAGAGGGKDDAQAAPAANGSPVLKLRSNSSQNGVLPITADKSQKASSTSVSTDSSGSRAGLFRTPISGGVQSATFAHGLPLPALAVRNLMEQARFAHLCSVMSGMHHRRTGYPF

SEQ ID NO: 55826 - protein, 94 aa, Sorghum bicolor
  Clone ID: 30933130.pep
RGREVPEKEPCWAMSPSLTHSCSPNPEVIFSCDFVALAARARSGLELWSSIAHLASFLQVSRGSLLAAPCLICRRHVHEQLEARGGRRRRRGWQ

SEQ ID NO: 55827 - protein, 131 aa, Sorghum bicolor
  Clone ID: 30933150.pep
SHPTPWTGVFCSDLYQRTAGCQCSLVQLSHWQWHPYLQCHSPFYGFLVDENSDFFFCHCQTLSVTDLCNPTARGGSAFSEGLGARSWVLGSKEDGGGNEAFFLSASAAEETRRQWRGGENREQPLPPLSSN

SEQ ID NO: 55828 - protein, 230 aa, Sorghum bicolor
  unsure (1)..(230): unsure at all Xaa locations
  Clone ID: 30933184.pep
GESSRVKNLDLEFIREVNCVSYAITKLPSIVPHLEILTLHSGRERVNTPMVANKFLHLKYLDISLADDDVDGTAFGAYDYLSLVSFLDASPVLDTFILSVDQLSMHHDSVTGDDASYLRQIPEHKHDRLKKVQINGFRSAKSMXTCHILENSSALENLTLDSIFSQLEDADDIVRCSGRKTGECFSKSREMIVEAHKALKVIERYILERVPSTVKLNIRRPCIRCHVIDV

SEQ ID NO: 55829 - protein, 94 aa, Sorghum bicolor
  Clone ID: 30933196.pep
LTGASSQKGAENLVNCLCYQGMVHSYAVMELGATFRRGQFSLNLSSSYIFCILQSVLSVAGQPHCIGITFLPHFLHIPIVTLEQLNYCLHLSTW

SEQ ID NO: 55830 - protein, 67 aa, Sorghum bicolor
  Clone ID: 30933202.pep
VFLPDTSAIHEKTGYSWDNLQHTPIFSCWTGILTNGGSLTTILQNFLIPFRVSYQGVDFDLYPGVGC

SEQ ID NO: 55831 - protein, 128 aa, Sorghum bicolor
  Clone ID: 30933230.pep
FAVPIDSVIKIVENFKKNGRVVRPWLGLKMLDLNPMIIAQLKEKSSTFPDVRKGVLVPMVTPASPAEQAGFRPGDVVVEFGGKPVESIKEIIDIMGDKVGVPFKVLVKRASNVTVTLTVIPEEADASR

SEQ ID NO: 55832 - protein, 70 aa, Sorghum bicolor
  Clone ID: 30933240.pep
LIKQQGSDWSPYKILLKSMVIHWGHPLPLFDMGVIELSYIFCFSFYCHHFVLACQILRPTCPVFTVGILL

SEQ ID NO: 55833 - protein, 142 aa, Sorghum bicolor
  Clone ID: 30933244.pep
VIFPRECTYVAFEIPNLRRNGENSTTPLWLRGKEQYQFNDAMEWNHSNPIFLLFIPVMLHSSHGIESMNESNRFASLVILKLKSRIDCPAVEPDLPGGTRERGDVAEPDHGRGEVRREGVGVGAVEPDQRVERLVVEELLVR

SEQ ID NO: 55834 - protein, 137 aa, Sorghum bicolor
  Clone ID: 30933258.pep
GNQRPPYNITKPFGQKDQRSKVALPYHEPLVHFALVCGTKSGPALRCYSPGDIDKELMEAARDFLRNGGLIVDPEAKIASASKILKWYSTDFGKNETEVLKHAANYLAPAESEQLLELLASTQLKVMYQNYDWSINI

SEQ ID NO: 55835 - protein, 156 aa, Sorghum bicolor
  Clone ID: 30933262.pep
DDSPRTRVLNTIRKLNPHLFVHGIVNGTYNAPFFVTRFKEAMFFFSSIFDMLEANASRMDEHRLLIEREFFGREAINVIACEGTERIERPETYKQWQMRNLRAGFRQLPLDREIMARARYKVSKTYPRDFLVDEDNKWMLQGWKGRVIYALSAWST

SEQ ID NO: 55836 - protein, 74 aa, Sorghum bicolor
  Clone ID: 30933270.pep
VYRCAALCKSKPRSMANLRPPERTCPFNTSCANDIPKTYRLFSNPCTLLAWYFKVFKLMCILGLWCTGRLVRKM

SEQ ID NO: 55837 - protein, 91 aa, Sorghum bicolor
  Clone ID: 30933272.pep
QGLYQYGPFLIQLEDCTFVRDTFTTINQGYCPGLERYSKWVYVGLVMVSSAVMLSLIFWVIYARERRHRVYSKQHQPYPLEDKPAPTVPGT

SEQ ID NO: 55838 - protein, 112 aa, Sorghum bicolor
  Clone ID: 30933274.pep
TGSHEKSAASIKRFKEPIYGSAVIDIPRIIVSHCIERDLLKRAREHSVGVKHILNNYDRTEVIKGTRHVFSLYPQAVASSFEANKVWPALRMTKRLPIPSIYNYVSPYRMQK

SEQ ID NO: 55839 - protein, 66 aa, Sorghum bicolor
  Clone ID: 30933294.pep
KGGTPTKVCSKKYSHDQHQNFLIVGLDLHLGAHTSYMVPLLTLGYKDMFVIALLYWWSGIVVLQLH

SEQ ID NO: 55840 - protein, 122 aa, Sorghum bicolor
  Clone ID: 30933304.pep
SISGTSVPSNTGSSDLSSGRISFVISFELAYSKTSELVLSFICPFKPFSESSSPSWICTSDSLFNLSFEEFGASTFNISVFLDKSPSSSQFCPGLEASSMTGIVLSSLSVLSMIQNSLQQGT

SEQ ID NO: 55841 - protein, 154 aa, Sorghum bicolor
  Clone ID: 30933306.pep
MEWLRSGFAEAQKKASEAAGNARVLALQASVRAKELAEQAREQAKVLAEKAVEEASQVQTKLKSGASAAQPSREELVKFGITDGLLECTGGLTYSMFSDLKSEMFPSPGQKDGNLTAWQERHAVLVLGQAPHLQGLRFALSPRHMSDYQFWVIY

SEQ ID NO: 55842 - protein, 147 aa, Sorghum bicolor
  Clone ID: 30933311.pep
QTERCSSGPGPARENSFALGILLPLPPNRRRFLPSLCKVPRITIGDLGWRAPRLLGAATREAAAIDDHRNSSEHLKQIRKHSSATGDAGQRLAHYFADGLEARLAGTGSSIYRSLAAKRTSTGDMLKAFNLYVKACPFRIISHYVCN

SEQ ID NO: 55843 - protein, 187 aa, Sorghum bicolor
  Clone ID: 30933319.pep
MTTLLRRLLRAAPPPVPASLSSHLPLSTRSRRTPHRFRRRHRGTNPAPPSPDAIKRLATADLYADFDRTCALSFSLLPSLSSPGPLLRNALYFYCQFGRLGKAFHVYTLMRASADPAARPSADTYHALFTALLSRGGGDTLVHYMYMDNVTALFKQMLEEGIPPDTRTLNVLIRGYAQSLHLNDALR

SEQ ID NO: 55844 - protein, 58 aa, Sorghum bicolor
  Clone ID: 30933323.pep
STTCDFSNYSFSIATSNYFPLNIATSKYLTLKIGTTIYITLKIHKPVLTDCLTHQILC

SEQ ID NO: 55845 - protein, 123 aa, Sorghum bicolor
  Clone ID: 30933339.pep
MAGTYNAGDGRSSSTEEMSDQQDHSENTLSEWRSSQQVENGIPSTSPAYLDTDDDDDDDYGPRPSELYGNFTWRIDHFSQINRSELRSNSFDVGGYKWYILIYPQGCDVCNHLSLFLCVANHD

SEQ ID NO: 55846 - protein, 68 aa, Sorghum bicolor
  Clone ID: 30933365.pep
MDRSWVNSRPFSKAHLDGVTEFMNFVSDKLGDNQEILCPCRKCLNRIHRHKGDVEDHLLIHGMTNTYT

SEQ ID NO: 55847 - protein, 165 aa, Sorghum bicolor
  Clone ID: 30933375.pep
LCVGPSYVNREEDFFIVLHGILAQTEDVTELQPVPDAHVPVMKFKFHGISIDLLYASVSLLVVPADLDISQGSVLYDVDEATVRSLNGCRVADQIIRLVPNIENFRTTLRCLKYWAKRRGVYSNVTGFLGGVNWALLVARVCQLYPNAVPRMLVSRFFRVFTQWQ

SEQ ID NO: 55848 - protein, 206 aa, Sorghum bicolor
  Clone ID: 30933381.pep
CRQVLLHPAASEKSEQICLLRVSNEPSATNHVRQYRIIAEVVDLSCEEGVDHAKESKVPLPRTTSSPATHHLDILASARGGDSDGRSMLATTADRRNRRPTAPPTKAATGAAEAAFEGFGGVGGRGNRLRACGREGEGANWVRAAKAPQRHSQGRRRDCRSSGQGLWRRRRRRGGGDELGAWGGGGQLSSYDGRSGELGRTVVSSP

SEQ ID NO: 55849 - protein, 107 aa, Sorghum bicolor
  Clone ID: 30933389.pep
HPHEPGIEVTTHKGGRPTSAPPNCLCVARVFGCMRPLIYLSVQPSVSRSPHIGFEAVRPYIGFEAETTQDDEEGAREEIELAPPARGARVQGGEERGSREQSELQGP

SEQ ID NO: 55850 - protein, 108 aa, Sorghum bicolor
  Clone ID: 30933399.pep
MPPGTSPEAAEAEAWTWENAAAGAAAGFATVAALHPLDVVRTRFQVSGGRGWSEVPPYRNTAHAVYTITRSEGLRGLYAGFYPAVLGSTVSWGLYFFLAKQRYLQRKD

SEQ ID NO: 55851 - protein, 107 aa, Sorghum bicolor
  Clone ID: 30933407.pep
PPALHAAPTAIITNSGPEGSSSTRLLTHRSCSIAFCNSAIMDAYQHPSLTIIKGEENIKMKIALLRCYIIAIFPKKKEPTYVSIHSIAPHDFLRNYLQFRHRWYDLM

SEQ ID NO: 55852 - protein, 60 aa, Sorghum bicolor
  Clone ID: 30933460.pep
NSKFSVLSFMTDSKKGTSIMFDGGRSKHRNNIEEQKKKSTMQNQKLARIPSPEASAYLPA

SEQ ID NO: 55853 - protein, 203 aa, Sorghum bicolor
  unsure (1)..(203): unsure at all Xaa locations
  Clone ID: 30933462.pep
MKQLHKSSPTHAPSSAHAPAPKAAKPARPGPRSWIGYVLREQRLLFVLLGALIASTFFLLRPYLSLSPSSHLPDARPLFSFAARSGVPAGFRPPPRRVVVTGGAGFVGSHLVDRLLEQGDSVIVVDNFFTGRKENVAHHLRNPRFELLRHDVVEPILLEVDRIYHLACPASPVHYKYNPIKTIKTNVMGTLNMXLGLAKRIGA

SEQ ID NO: 55854 - protein, 200 aa, Sorghum bicolor
  Clone ID: 30933464.pep
MARRLLLLPALLVAAALAGGAGAQLSAGFYSSTCPTVESVVRQAMSQAVTNNTRTGAAMLRLFFHDCFVNGCDASLLLDDTPTTPGEKGAGANAGASTSGFDLIDTIKTQVEAACPATVSCADILALAARDAVNLLGGPSWAVPLGRRDATFPNSTGAGTDLPGPDSDLDGLVAGFAAKGLTSRDLAALSGAHTVGMARC

SEQ ID NO: 55855 - protein, 165 aa, Sorghum bicolor
  Clone ID: 30933468.pep
MNPNKFTHKTNEALALAHNIASEAGHAQITPLHLAAALIADRPGVLRQAIAHASGGNDVAAADSFERVLASTLKRLPSQSPPPDTVPASTALVKVIRRAQSAQKVRGDSHLAVDQLLVGLLEDPQVWDALKEAGVVAARVKAEVDKLRGGDNRRVESASGDTSFQ

SEQ ID NO: 55856 - protein, 104 aa, Sorghum bicolor
  Clone ID: 30933494.pep
SMEDPGLLSAFLDNLVSRLFSLAEEKYKLYKGFDGDLAFLKSELKMITSAIDEQLLGQDGQILRLSVEELRQLAHEMEDCIDHIMYDASWEQQQPWYCKMVNTG

SEQ ID NO: 55857 - protein, 167 aa, Sorghum bicolor
  Clone ID: 30933509.pep
EGYENIPAEIVDPEAKKPEDWDDELDGEWEAPMIPNPEFKGEWKPRRIPNPAYKGEWVHPKIANPDYKPNAELYAYDSFKTVAVEIWQVKAGSIFDNIIITDSEEEAREFAKETLEKTKKGEKEMKDKQDEQEKKEREERMEKEKKEAEAAAPEEAEAAAPEDKDEL

SEQ ID NO: 55858 - protein, 161 aa, Sorghum bicolor
  Clone ID: 30933513.pep
RHVRPRLLHVRRRPRRAPRRHAVRQGQGAHRPAARPALGALPEAPARRAWRRRRPATVSACRCRRRARPGPCTRSSGRHRTCLTCPVAPASVAVFVSYLRWRRAAPHHGTPRSKADEKGCAAPATVLFSDSTLVSTTIAFAVTFFSNYTGISYMYIELYII

SEQ ID NO: 55859 - protein, 208 aa, Sorghum bicolor
  Clone ID: 30933517.pep
HEQCNPKIIHRDVKAANILLDESFEAIVGDFGLAKLLDRQESHVTTAVRGTIGHIAPEYLSTGQSSEKTDVYGFGILLLELITGPKTLSNGHGQSQKGMILDWVRELKEEKKLDKLVDRDLRDSFDILELECSVDVIIQCTLTNPILRPKMSEVLHALEANVTLAESSVELNREPLPSGLPYSFSIRHEDPHDSSSFIIEPIELSGPR

SEQ ID NO: 55860 - protein, 145 aa, Sorghum bicolor
  Clone ID: 30933521.pep
GTFRSLTAEGFSYLMKRIKEIIEAQATVHRCTAVIDFMEEELRPYPATVNDEGMYHHAREVAETMLGQENVRVGAQLMGAEDFSFYAQNFAGAFFFIGVHNKSMKAMYPLHSPYFVIDEDVLPVGAAFHAAVAMEYLIKHTAAAN

SEQ ID NO: 55861 - protein, 61 aa, Sorghum bicolor
  Clone ID: 30933535.pep
YVFMDTLLVKANIIWKNNISRRISLPVGICIGLVSQTPLIDQGIEACVFILRKIIKDSIYY

SEQ ID NO: 55862 - protein, 128 aa, Sorghum bicolor
  Clone ID: 30933539.pep
KMGLIMACNTNISTQLQSRANYLAVSIHEFCKFATLLLLSSLSELAVRRLDMVGTAVAARHHQQPRGAVERRRCWCWCWLCLKGEIQQRAELQLMDRSHSKERDQIHGVTEVGMCTTSRWKSRRECFC

SEQ ID NO: 55863 - protein, 116 aa, Sorghum bicolor
  Clone ID: 30933554.pep
SKSEDDENDVKIDWLEDPISKAKIIRWKVQSISVDMEKVSTSFATGISDVAEAYAAAMQSALAGKQDDLPNQKSLQEKVKSISIHLNSDQTSAVSKLQDALQYLAYVVVCASMPSV

SEQ ID NO: 55864 - protein, 187 aa, Sorghum bicolor
  Clone ID: 30933556.pep
GKELNKRLHQSFMNFDTLLKQKAPLQRPALSPLFLEHFNSPLLCYTTNLGRFTSKFLKVVPPSSKSSLFLSPSVECSISVISFLAALSMVAFSCMLPWVPALVLLLWAIAGWLMTSRSIHPSLSVSFCFSEDMLSCLSMGNTSPSLSIFSSLIMLEVAPSLKFINFSNFSGLFSILFSINSISSFCF

SEQ ID NO: 55865 - protein, 91 aa, Sorghum bicolor
  Clone ID: 30933563.pep
SSSPRAKASSTARPINHAANTRPSAALIRLRGLRPATFAHASLTKLMAFFNLGLHRDRETGRRPCGRPQPRSVSAPVPRHLRRCQFALGYC

SEQ ID NO: 55866 - protein, 45 aa, Sorghum bicolor
  Clone ID: 30933575.pep
IFGEQKSMDNLVDLSYGYVYHIYKAIKPALITRPTYIYALMHACR

SEQ ID NO: 55867 - protein, 99 aa, Sorghum bicolor
  Clone ID: 30933601.pep
SRDAARKIKERSKIFHRPPLPSPVRGGSASPRTLSPAAQKFVRNAISKSAKSTNTIDESLRASYRGSTPSASTPKTRFSRDPGLASRSPSTRQGSTPPW

SEQ ID NO: 55868 - protein, 81 aa, Sorghum bicolor
  Clone ID: 30933619.pep
QNRSCPVPHKRINIRSYPKATGMDFSSQVAEREKKDQVQRCGRNLGASSCPACGPAQQVWPARCDRRGKGRGGHPQPLSDN

SEQ ID NO: 55869 - protein, 233 aa, Sorghum bicolor
  Clone ID: 30933629.pep
NPCNDGSLRECPGSCYEEVEDEISSEGELNHIQDSICSPSMFTNSKSILNLRDPSYPSPFQSHDDPSNPSRRSNHRSHKDHEDDMSSNVIEGELSHIENSNTSPFLITSSKWLECVEWMDKEEALMDSDFGSISNGEFLTPFEDEIHPTTEEDTVETNPGETLNIQIGDEDNINEHGIYLIATSFTPCSYATSSQYIGLSNITTFEISNPLFLSIYKNFKRTVVDAYVYNKYC

SEQ ID NO: 55870 - protein, 132 aa, Sorghum bicolor
  Clone ID: 30933631.pep
DGKYAAHPVFDHGIAPPPPPSATRLQDPADFLGLIHHDVMVGSQGPHAHLHLHPRNGGDELSGLVGGASVTVTGAGGCKGTYSSTRPLLERNRRNPSAGGSTATTTTAPVAAATAGMRTQAGVVDSWVCTSD

SEQ ID NO: 55871 - protein, 158 aa, Sorghum bicolor
  Clone ID: 30933687.pep
MDSGNSGSLQSSSGGDDEFDSRCGADSSPLSALLRQPPLPSVPGFGGGSLIYGLQELRTPPLSQSHWCSTTTAPLPLTVTAGAEASGSDSPPSLPGHGAAMAASAAVDQADAAPAPPPRGSRKRARRASRRAPTTVLTTDTSNFRAMVQEFTGIPAPP

SEQ ID NO: 55872 - protein, 194 aa, Sorghum bicolor
  unsure (1)..(194): unsure at all Xaa locations
  Clone ID: 30933693.pep
MAMAKKGASSLLLLSLSSYLLCVAHAATSLSFSYNFSDAGVLTGADLTYMSNATAASDRIDLTKDTTWSTGRVAYGQPVPLWNNSSTGNSMVASFTSNFTFAITPHNSTFGQGDGMAFFVAPYPPSLPQDSNGGFLGLFNNPNNTANAYFPPTVAVEFDAFRNTXDPESTVNHVGVDVNSIVSAAYAALPDASF

SEQ ID NO: 55873 - protein, 70 aa, Sorghum bicolor
  Clone ID: 30933695.pep
KSINQSINTGCVRVYSMITAITYTLWHLVHCRLARAQKKHVCFQTGWIRPLGSFHVLKAKTFRFPVTGDD

SEQ ID NO: 55874 - protein, 211 aa, Sorghum bicolor
  Clone ID: 30933706.pep
TITDDATLNIDLSVIRSLIVFGEAGKTMLNFNKYQLLRVLDLEDCTDLQNDHLREICNLLLLKYLSLGENVTILPKEIKQLKLLETLNLRRTNIKILPTEVIQLPHIIHLFGKFKLPDKTINDELQKFLTSAKCKVQTLAGFLVDESDGFAELMGHMKKLRKVKIWCESSATSSKLTILQKAIQEFIHDDKDASNDPRSLSLHLDGCSEDF

SEQ ID NO: 55875 - protein, 118 aa, Sorghum bicolor
  Clone ID: 30933714.pep
GVAAVELPCSSGSEPHRLTAQTPVWRTGAGAGPRPEEPPPPATLPQCRSAPAQLQMLAAQHSCLPWYCPRPAPRSHALGPLADRCPRGPRTRRAAPRRMPEHDALPLVAVLSVELTRP

SEQ ID NO: 55876 - protein, 229 aa, Sorghum bicolor
  Clone ID: 30933716.pep
LDLKNSHLLGAPPREMGPIASEASSSSANSATSSSDADAPGSPSPSPSRRAAPTLLLLAFLAGLLILSTGDDATAQQLNGVSLESPEVSFVPSPLDGQFCERILLSGVPRLHLDSYASQIRVKMNVSQSIPEKFHWKIEVCFHRNASMDLCQCETGEWQGFQDGMWTALNSPYGNKYVDVKLADKKPARFTLSIQEEFQKWRLACLGIGFVLLFLSPIVSKWAPFYYSS

SEQ ID NO: 55877 - protein, 210 aa, Sorghum bicolor
  Clone ID: 30933722.pep
TSPITMRLASIFAIFVCVVAFASAHVYFKETFDGKWEDRWTESEWKEAGTRGKFAVTAGKFYNDEEADKGLQTTEDYRYYTISADHEEFSNKGKTLVLQYSLKNQQKLDCGGGYLKFFPAGVDKKTLNGDSKYNIMFGPDICGTTTRKVHVIFEHEGKNHLVKKEIPCETDEFTHLYTLIVRPDNTFEVLVDGVSKATGSLEADFDILPP

SEQ ID NO: 55878 - protein, 183 aa, Sorghum bicolor
  Clone ID: 30933727.pep
MKPRPPAPGPSSASAAPARLRPHLARLASFLIVFAVGYSLGLLSSSTRPSPRPSQTTIIRPHAAHLTDASPAAASNGTAGAAAVSSSSYPPRSPPHDLFRFKEECGEPVPSDAVVRTLLDKLFDGESPYAGFPPNHTAALLHPAAARPRGWGSTGAVFKELIEAVRPEVIVELGAFLGASALH

SEQ ID NO: 55879 - protein, 226 aa, Sorghum bicolor
  Clone ID: 30933733.pep
IARVVMDLNASFAAPFKDRVAALVADKESGGVDCVITDAVWFSAQAAAQELGVPSLGLFTNSAASFRTFMAYPTLIEKGYLPVQESKKDDPVPELPPFRVKDLERIDTSSLYDFASMVGNVVARARQASGLILNSFDAIEANNVNKIREELSIPVFAVGPLNKLSPSVVKTNLMPGGRECLDWLDTQAPGSVLYVSFGSIAAMDAPDFVELAWGLADSKRPFVWAV

SEQ ID NO: 55880 - protein, 201 aa, Sorghum bicolor
  Clone ID: 30933735.pep
MAAAPRRLTPLAAAAVAAWMLAAAATAGVEAGDPPLSPKGINYKVAALMAVKSRLRDERGVMAHWDIYSVDPCTWSMVACSPDKFVVSLQMANNGLSGALSPSIGNLSHLQTMSLQNNRISGEIPPEIGKLINLNALDLSSNEFIGDMPSSLGQLTRLNYLRLDRNNLSGPIPADVARLPGLTFLDLSFNNLSGQVPKIYA

SEQ ID NO: 55881 - protein, 99 aa, Sorghum bicolor
  Clone ID: 30933743.pep
NLGSLTNDGANLAKMPSCRRLCKPDRACKVTRKESARAWRLPIFILCQVQMPISLEMAYFYPLHFVMEVCKQQQMPSQFAKAFGDALCLMGPLIFSILF

SEQ ID NO: 55882 - protein, 55 aa, Sorghum bicolor
  Clone ID: 30933757.pep
LYKLVEFYETDLSNLINLLLNTNCYSNTYNTDKLIRFNKFISRFLNRFCNFFLVR

SEQ ID NO: 55883 - protein, 91 aa, Sorghum bicolor
  Clone ID: 30933762.pep
YSRALMIYSQYMRICRTLEVGEARKSATSCSRRCVGPTQYSPYLSRAYPTELTTSVSPQHSLDTAHLDGILPSTQAIPPEGNTSPRQQGSP

SEQ ID NO: 55884 - protein, 123 aa, Sorghum bicolor
  Clone ID: 30933782.pep
MAAATATATLRWVLQLHRDVPRAARFYAEGLDFSVNVCTLRWAELQSGPLKLALMHTNDRCGYCCLLPRSPRSIIHSSYDFGLLLDSNSELFEGMRWREATVVLRAARLMCSMKCVCGALGFI

SEQ ID NO: 55885 - protein, 118 aa, Sorghum bicolor
  Clone ID: 30933788.pep
NKGGWIAEGKEYIESSQIHGQDWGEELAQVDMLMEGTGVVMMRGEIKTASTKVRIVFISILKEVMFVQDLVASMLEIIRGQSTGLDLGVSSIQMRKGVDIRVAKEGMKLTEEGQANIG

SEQ ID NO: 55886 - protein, 186 aa, Sorghum bicolor
  Clone ID: 30933794.pep
IHDGSGSALEDGARTDGGARGRTAAGRDGARADGSWPRSQRSRSGHGRRSRTRLARTAAVADGSARTTGSRLRCRRGLVTGAPSRRCGGVRAWMSTTKERIDLNRGAARRASGGRDGRARRKGGIREVRGEAARRIAPSGGGDGNNRGEEGLGELRGGYRAQRGSGRRVSWWSWTGEEGRCGKGSA

SEQ ID NO: 55887 - protein, 210 aa, Sorghum bicolor
  Clone ID: 30933812.pep
EPVAVLLPDVTHLVLSALVSAGAVADDAGVWGWDISSGGKGLKVQEFTSWVLSTPVGLGNCLSRYVRDRFRALAADSVEESSVSTVNTTFDTSDVYLLTRGRAWAIALSLRNKLSEKLLSASVIGMDTEDLLYRSSVHGKGLSRFWSCVEGYKGPMLILLSAFSKSAGENVDSDRRWVIGVLTEEGFESKDTFYGSSGILCAAHPIFRML

SEQ ID NO: 55888 - protein, 184 aa, Sorghum bicolor
  Clone ID: 30933814.pep
MMTVPMDSASVAPSSVRDLAERLLIRNNELEDQLRKSAQSKVPSDPNIWLQMRDNFEKIILLDHDLSEQKEVEYLLWQLHYKRIEDFRRNISAASSVASSGKSNANPDRVKRIKSAFKSFLSEATGFYHDLMLKIKSNWGLPLSYFPEGLDNANNSVRDDKKTVQLKKGLISCHRCLIYLGDLA

SEQ ID NO: 55889 - protein, 109 aa, Sorghum bicolor
  Clone ID: 30933832.pep
VFRPDRRCILYFYTFLYFSDRWQLLNKITLPEEWGYRFRGIIGAAEGYLFIKLDDPKENLNDQIERHVEYFSLDVKTMQLGSFCRTTLFTVTDAYLYCGFPPSLSLPSI

SEQ ID NO: 55890 - protein, 47 aa, Sorghum bicolor
  Clone ID: 30933834.pep
YKEELTTLPMRHMHTLDISYLYRAELQLVYDVILALILASNEIHGVV

SEQ ID NO: 55891 - protein, 82 aa, Sorghum bicolor
  unsure (1)..(82): unsure at all Xaa locations
  Clone ID: 30933844.pep
DATTQMQPSVPELMQYQMQHMAPVYGSMGLPGMPVAAVPGNAASSIXGSRDEKGNEGFTFKATPLDRSANFYSSAGNLVMGP

SEQ ID NO: 55892 - protein, 147 aa, Sorghum bicolor
  Clone ID: 30933864.pep
EAATLARWVCQSYHYHLGLELLNQSDEAGEALLKMLWHHPDAVLCCSFKEKPMFTFANKAGLDMLETSLIALQDLTLDKIFDESGRKAIFSDISKLMEQGYAYLPSGVCMSGMGRHVSFDQAVAWKVLGEDSNVHCLAFCFVNWSFV

SEQ ID NO: 55893 - protein, 95 aa, Sorghum bicolor
  Clone ID: 30933932.pep
EPVNKEGASCVVPCKADSGNISRHPCQTPNLQDDIEYPFDNAFDNADLDDGLDPAMREEIDREVADFAMKLNLAWSERMILGQDQRMESHVDTRW

SEQ ID NO: 55894 - protein, 54 aa, Sorghum bicolor
  Clone ID: 30933947.pep
GEGRLMCLECDGTGEPNIEPQFLEWVGEDTKCPYCEGLGSILCDVCDGKKVMAS

SEQ ID NO: 55895 - protein, 76 aa, Sorghum bicolor
  unsure (1)..(76): unsure at all Xaa locations
  Clone ID: 30933951.pep
KVKKRCELLPVIVEVDRVLRPEGRLIVRDNIETXSXXXXIVKSLHWEVHMSYSQDKEGLLFVQKTTWRPNETEDKL

SEQ ID NO: 55896 - protein, 115 aa, Sorghum bicolor
  unsure (1)..(115): unsure at all Xaa locations
  Clone ID: 30933977.pep
MSESELAVIKPEALKTYIWLQCFDGSIQQVEEEVAMFCPMICREIMKNGTGSSKNHAIVLPERVNPASLSLILDYCRFHQVAGRSNKERKSFDEKFVRIDTEXLCKLASAALGLQ

SEQ ID NO: 55897 - protein, 216 aa, Sorghum bicolor
  Clone ID: 30933985.pep
KVPKGGALSVNTQSTANSSTSSSPAGPQEDMCQWPTLPAWEILEAVPFVLEAVLTSCAHGRLSSRDLVTGLRDLAGFLPASLAAIVSYFSAEVTRGIWKPVMLNGMDWPSPAATLPVVESETKEVLAFAGVHINICPRPRFVMPMLPLPIAALISLSITVKMDEFSHLHGIIGQGIEICTTSSSWPTAQIIGALWSQKVRRWHDFIILACSQSPFT

SEQ ID NO: 55898 - protein, 227 aa, Sorghum bicolor
  Clone ID: 30933991.pep
IISTAGHLPHAATYLIGSKASRSSRSRRGKYQPPRPRISTASLLAPAHPADHLAVVSVDAVVASPAPAPPAAVPAPQPRPALVEEVEVRKEVVVVEEKKVAVAAKAEAGSGAGDSSKSRRTLRAGAEGEGVRAMQEALLKLGFYSGEEDMEYSSFSSGTERAVKTWQTYYPAHYITLMLRDDTMIRTLFQSTVGTSENGVMTSELLEWLFSGKTGEDAKTKDGTNGA

SEQ ID NO: 55899 - protein, 183 aa, Sorghum bicolor
  Clone ID: 30933996.pep
MAFGHTRLDVRRAPQSSYFSCSTTTVAVFVALCLVAVWVASSMLVTPTEFSPFQPKVRPLPPQDSPPDTGSLTSAGQDDGIREMERDVPVDPPPVTQQLPPVTDSMDSEDQQEDAKEQVRTPDRQRTSEQPEVFPDGSQAELFNETTTERGPWQTKAAQSNKDAEQTLTSSSPVSFTWALCNV

SEQ ID NO: 55900 - protein, 245 aa, Sorghum bicolor
  Clone ID: 30934037.pep
TDDVLAEILLRVPSPRDLGRASASCCSFRRVISDPHFLRRFVALHAAPPLGVFCCYPAWGGGVGGSQFHAALPSHPSGALARALDTSADFCFNFLPPATSDWLVRDCRDGRFLLDRVRDGSTAFTEVAICDPLFRRYRLLPPIPNDLAASVENPYVQRGGDGQLQSRSSEIFLVSRSDDSVSEEDTAFTVIWMACCRGKLVAFFYSSESQQWSALSPPEHYALSTRRVMGVRLGQRNHAHGCFYW

SEQ ID NO: 55901 - protein, 196 aa, Sorghum bicolor
  Clone ID: 30934039.pep
RASETTRRTAPPQARRPRGCELVALWPSCRRGLRWPRASRCRPRRRRPRAAAGVSRGGTTGGRTRRRSSASPTRTCSWTRTATSPSPTSTSPPSPTTPRPPPTPPHRPRRFRSSSSSSRRPRPPPQRLARPAAGPTRGASPSTPPSSRAYRFRDPARAGAGAPGVGPGTRGAAPWMGPPRRSRASPRSPAACRTTP

SEQ ID NO: 55902 - protein, 174 aa, Sorghum bicolor
  Clone ID: 30934054.pep
MADPPNPSAGDLPAGAGGSTEKPVLADRRVAALAGAGARYKAMSPARLPISREPCLTIPAGFSPGALLESPVLLNNFKVEPSPTTGTLSMAAIINKSTHRDILPSPRDSSAGSGQEDGGSRDFEFKPHLNSQLAAPAVNNQNRHDTPMQNHSSNHASPSSNLMTENKPLCSRES

SEQ ID NO: 55903 - protein, 238 aa, Sorghum bicolor
  Clone ID: 30934062.pep
KSITILTLYFTNHHTISMGCRSSKNINPLPLIDSNFPETQRPELDSFFQKATGILERIEILRNQIHTTKQKGAALAGTSNLGSDYPYFRAVEVLFWSISAAKEGNINSANIVITEQFPPFIAMNTQDYCKETLELFQTLQQYFSILLETPESLSSIVQQLQKLKDEQIEIKRNINVKGNPAKAAKTIDDNMKKLTDGINTSAKVLSQVPDEQQNALELTRKIQKIISTADEMGARAFN

SEQ ID NO: 55904 - protein, 43 aa, Sorghum bicolor
  Clone ID: 30934098.pep
FFFFFFFFFFFFFFFFFFFFFFFFFFFFFEEQVHLIKQGKHLP

SEQ ID NO: 55905 - protein, 194 aa, Sorghum bicolor
  unsure (1)..(194): unsure at all Xaa locations
  Clone ID: 30934123.pep
MIGASRRSLSAAAAAAAARSRVAASAASAVSADADASSVPPRPVSNGAPGVPQQQKRLLSVLAAPKVAGTSNVVSLKLMDGALIGRRYESSAAAVDSTDLPAEKHEYQAEVNRLMDLIVHSLYSNKEVFLRELVSNASDALDKLRYLSVTDPELLKDGPQLDIRIXTDXDNGIITITDSGIGMTKQELIDSLGT

SEQ ID NO: 55906 - protein, 169 aa, Sorghum bicolor
  Clone ID: 30934125.pep
MSSTAGPVAFVGADELSVELAASFLRSGARVRSFVPEAERSPPAALAELNGLLRCGSPVEAARDAALVVVLSDAGAVDELFFGVEGIAKGLRAGSIILIRSTLLPSQLEKLEQKLTDEKKDIFLLDGYIFSGLSDELKQQIVIVASGRQYIAEGARKFFHSLDNTIYFA

SEQ ID NO: 55907 - protein, 79 aa, Sorghum bicolor
  Clone ID: 30934167.pep
GKDLCLNIILAQDWKAHCKCFACWMSVFPKLCGGVASSFVHRSNTYNFYEVQQQAMVVADTWALELLNCRSCPFSFNAC

SEQ ID NO: 55908 - protein, 89 aa, Sorghum bicolor
  Clone ID: 30934169.pep
IVILSGRVDHRFVPIGKILKPLINECVTPVTCYWSLALLLRDEEELLLVFQRSRPPVKMLVPVWKALCTLTNSEHPSPSQICNRDSSET

SEQ ID NO: 55909 - protein, 62 aa, Sorghum bicolor
  Clone ID: 30934175.pep
KYCSFSLKLSTFGLGQYFPRNTKTIILLHSSTYKTKTFAWTKHNLYDLLGQLNLLSLTKIAP

SEQ ID NO: 55910 - protein, 66 aa, Sorghum bicolor
  Clone ID: 30934219.pep
TSGSYTLQGDLTSKLFTNVGILVRTSTRNRAVLFIEGLNLLTLHAPEQISGHPQVPDPVTPEQQQS

SEQ ID NO: 55911 - protein, 125 aa, Sorghum bicolor
  Clone ID: 30934323.pep
MQSGRLTEVITFAVKNTKRKRRSFQNESEDSLLVSEEASSGSGGSASTSVKVNSEDAASDDQISGAPRSAVLQACTLTSGLLVAGGLLLRQASHLAALNGWPITDPSDVSFNFETWHLELIAGLV

SEQ ID NO: 55912 - protein, 156 aa, Sorghum bicolor
  Clone ID: 30934332.pep
RWIHRGQPHGQNSAISSSSVVSKGKDCNYTVVLPSMLWSITPMIHFQNSALVLSCKVLCDLYNFWVQIFLCSLQHGLYLQVSTVAGRSRSSEVDWICRLSSLRICRAVVVAGSAGASTGTRATPTRWRGDWTPGERNQDADVGGLPAGLLPPAMRP

SEQ ID NO: 55913 - protein, 190 aa, Sorghum bicolor
  Clone ID: 30934336.pep
MATRRCSSSNVPPAGLLAVPCLLLLLLAGVSNGQLQVGFYSNSCPGAESTVASVVRQSGSADPTILPALIRLQFHDCFVRGCDASVLIKGGAGGNNAEVDNSKHQGLRGVEIIEGAKTQLEALCPGVVSCADIVVLAARDAISFTGGPSFDVPTGRLDGKVSNLRDADALPDVHDGIDALRSKFRANGLD

SEQ ID NO: 55914 - protein, 173 aa, Sorghum bicolor
  Clone ID: 30934343.pep
MEVPPEMLDALAGWFAQSLSPDAAARRAAEQSISSAASSPGFALAVLALAASPHHNLQARQAASVQFKNLLRRRWPKPDADADDAADHLPASDCAMIKAHLLQLLLTAPPLIQAQLSEALAAAAASDFPARWESLLPSIVSSLGTAVNAGDIAATNSLLAALVSLFSRFRNAF

SEQ ID NO: 55915 - protein, 160 aa, Sorghum bicolor
  unsure (1)..(160): unsure at all Xaa locations
  Clone ID: 30934364.pep
MPSPTIRRLDVASPVPADIDIANAVEPLPIADIAAELGLRPDHYDLYGKYKAKVLLSVLXDLKAQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAID

SEQ ID NO: 55916 - protein, 119 aa, Sorghum bicolor
  Clone ID: 30934373.pep
MAKLPVLARSAIRKPNESMRLIVVTIVGAVFGFFIGISLPTVSITKLHFPSSIVSYIEDKNSGLSAQAILNHAWTTARNARGNGSEPISSDNFKIYVPTNPRGAESLAPGIVVPESDFH

SEQ ID NO: 55917 - protein, 56 aa, Sorghum bicolor
  Clone ID: 30934379.pep
LILAYIIATRSHWKSVPQQLLAEIVLPIKFYVESDIVYNSFKVWIVQRLCNCYHEI

SEQ ID NO: 55918 - protein, 151 aa, Sorghum bicolor
  Clone ID: 30934425.pep
MAILSEVATEVLIPLAAAVGIAFAVAQWVLVSRVKLAPSSGRDKDVLAESLIEEEEGLNDHNVVVRCAEIQCAIAEGATSFLFAEYRYVGAFMCVFAAVIFVFLGSVDGFSTQSRPCAYSEGKQCKPALFNAVFSTVAFLLGAATSVVSGF

SEQ ID NO: 55919 - protein, 159 aa, Sorghum bicolor
  unsure (1)..(159): unsure at all Xaa locations
  Clone ID: 30934435.pep
SQHFKAKETLKPLKQSTEAAAISEKYKILRQKNVHNHCLGTVGYEGKLKQWEMEDATLASKGISNPWQEFPEGRHTRFMRGRSKLDISENKAEIIWTQDATKKISEDIXVKHSAAEASGITWVRENDLLTACLGPEQPGRVRAVSSYTSWKHGWPECSG

SEQ ID NO: 55920 - protein, 165 aa, Sorghum bicolor
  Clone ID: 30934439.pep
MTGAAAAAVVDPPAAPLPRRLTVLPLIALIFYDVSGGPFGIEDSVRAGGGALLPILGFLILPVLWSLPEALVTAELASAFPTNAGYVAWVSAAFGPAAAFLVGFSKWASGTLDNALYPVLFLDYLRSGGGVALPHPVRSLAVLALTAALTYLNYRGLHIVGLSAL

SEQ ID NO: 55921 - protein, 218 aa, Sorghum bicolor
  unsure (1)..(218): unsure at all Xaa locations
  Clone ID: 30934443.pep
KAHRIRCSSGSSSSTCTRDWANLVDGPAGLIAEIALASDVADYVRFRAVCKPWRQCSPDPRAGGGLDARFLPRRWIMLDKALAGSSHHRFLNVSTGECIRMGLPELLEGEHRFLKVTPEGLLLLFHKSTKIARLLNPLTRQLIDLPPLTAFVQGGDCDERKQRGPFVQTVGLTEYSTVAVSCCYPMKLAFAKPGDDXWTVVNEGYIDSALPFAGRFYC

SEQ ID NO: 55922 - protein, 49 aa, Sorghum bicolor
  Clone ID: 30934507.pep
EDFPETETDFRPWHGLVLLLRKYPEHFVINIRKGGGLSTEFVSLVSLQS

SEQ ID NO: 55923 - protein, 55 aa, Sorghum bicolor
  Clone ID: 30934509.pep
PLAIYFPVEMYFIQRNVPRWSARWVVLQTFSVVCLLVSAFALVGSIEGLITQKLG

SEQ ID NO: 55924 - protein, 94 aa, Sorghum bicolor
  Clone ID: 30934512.pep
KSEVAKESKSLGSTEDLNLTMVKSAERTDCQKEPSCIIGSSKCLNASLKRLYRSRNIPVPRPLPPLVRLLESSKRVKMQPNANYNSLNSRHSLP

SEQ ID NO: 55925 - protein, 106 aa, Sorghum bicolor
  Clone ID: 30934544.pep
KSSRPKNSEICKKDAVETVNARSSNVRLSVGTYSTVESGIQEIGLSPPSVEQWSSPDSMNIQFNRGFKGCIEYPRTSQKHSLKAKLMEARMESQKVQLRQVLKQKI

SEQ ID NO: 55926 - protein, 111 aa, Sorghum bicolor
  Clone ID: 30934548.pep
ISCCAFGGELGTVTKYFERNLRLPFTPLWSPFSVLHNPSANQEHGSSRSSLYLSMSMGFVMGLWTVFCIMLFLKTWRIAYFQLLDQSCEKIYVQLAIFKVAFLRKCGNKDI

SEQ ID NO: 55927 - protein, 189 aa, Sorghum bicolor
  Clone ID: 30934576.pep
NPKPGHGDLHSAAVRIQNKFRGWKGRKEFMIIRQKIVKIQAHVRGHQVRKNYRKVVWSVGIVEKVILRWRRKRRGLRGFQPEKQLEGPSWQIQPAKAEAEDEYDFLKDGRKQAEGRLQRALARVHSMNQYPEARDQYRRLQACVNSLQESQAMQDRMLADSAGTDGGDFMAELEELCRDDGDAPMSTIS

SEQ ID NO: 55928 - protein, 127 aa, Sorghum bicolor
  Clone ID: 30934582.pep
ERKQFGAPLAAFQLNQEKLVRMLGNVQAMLLVGWRLCKLYEAGKLTPGQSSLGKAWTSRKAREVVSLGRELLGGNGILADFLVAKAFCDLEPIFSYEGTYDINSLVAGREITGIASFKPAMVAKSRM

SEQ ID NO: 55929 - protein, 163 aa, Sorghum bicolor
  Clone ID: 30934586.pep
GKDLAALYKSYSEKYPIVSIEDPFDQDDFESYNHLTSDIGANVQIVGDDLLVTNPKRIHMAIEKKACNALLLKVNQIGSVTEAIDACLLSQKQGWGVMVSHRSGETEDTFIADLVVGLATGQIKTGAPCRSERLAKYNQLLRIEEELGANAKYAGAHFRFPQL

SEQ ID NO: 55930 - protein, 87 aa, Sorghum bicolor
  Clone ID: 30934593.pep
QRTNCDELQHVMLQHLSLAIGFHIFSLSCRNLQFFTPSPRPEILDQSIIKLSQAFALTSELQIPSSTRNLQVLHFYSRTKTRTSSEN

SEQ ID NO: 55931 - protein, 183 aa, Sorghum bicolor
  Clone ID: 30934595.pep
RDLDHLKLLYDAALRDGKLPGPSWRPQGGIRFGEIAGAHRTLTARIQLLRGRVAAGEGCSVDYYALLGVRRGCTRSELERAHLVLTLKLKPDRSVSFAERLELVDEHRDLEAVRDQARMSALFLYRMLQKGYSFIMSAVLDEEAAERQRAKDAAAAAAAAAAADLAAMAESEPKQEEEEEEEE

SEQ ID NO: 55932 - protein, 170 aa, Sorghum bicolor
  Clone ID: 30934614.pep
LNLKFSEKAMDLLSVCVTLIPKNRFASFNASEVCKMVEKYYPADFNQQERLGLESQLNHFVIDASSHEELKNITTIAELCRCLVDTGRHVTHNLIDRLLWLLLTLPVSTASAERVFSILKIIKTRLRNSMEDEFLANSMLVHIEGEIARAYSYEDIISDFQDLKKRRVDF

SEQ ID NO: 55933 - protein, 172 aa, Sorghum bicolor
  unsure (1)..(172): unsure at all Xaa locations
  Clone ID: 30934620.pep
MAEIRKYAMSNQPPDIPQILLEAQNRWLRPTEICQILSNYKKFSIAPEPPNRPQSGSLFLFDRKILRYFRKDGHNWRKKKDGKTVKEAHEKLKVGSVDVLHCYYAHGEENENFQRRTYWLLEESFMNIVLVHYLEIKGXNKVSIVLKKLKRMQDYLMLIVLHVQTLSLVRAR

SEQ ID NO: 55934 - protein, 206 aa, Sorghum bicolor
  Clone ID: 30934634.pep
MSIKAVHARQIFDSRGNPTIEVDVTTEKGLFRAAVPSGASTGIHEALELRDNDKSKYLGKGVSKAVNNVNNDIAPKLLGQDVTKQKEIDHLMIQLDGTDNKGKLGANAILGVSLAVAKAGAAQKGLPLYRYLAELAGKKDVILPVPAFNVINGGSHAGNRLPFQEFMILPVGASTFTEAMRMGAEVYQHLKLVIKEQYGIDATNVG

SEQ ID NO: 55935 - protein, 85 aa, Sorghum bicolor
  Clone ID: 30934636.pep
LSPDLSRNRQGGGAASHGRCLSPGTAATLPLAWYLLQNPICHLSAFPSVHAIHISLPCLMLHIFLMLWLTLRSNEIRFRDAGSSL

SEQ ID NO: 55936 - protein, 86 aa, Sorghum bicolor
  Clone ID: 30934642.pep
FDTQAQSLKDDFFRRLKDIRNKLKNTGNELLEKVVSSCKHVLNAPMDEDTLMRKCQAALISSDELNKTYGNNFVLGFPQNQQTTMA

SEQ ID NO: 55937 - protein, 209 aa, Sorghum bicolor
  Clone ID: 30934643.pep
MRERDAMAPPSPSSAPAKKRIKWLRRNNKKVIDTYLGEARAALAAAAQDTDDGDDAAVAALALVNAALEMSPRAEAALELRARALLALRRYRDVADMLRDYIPSCAKSCSADDATTSSSSGSGAELLSPDRDRFDAGATRFLCCLDMSDLKRRLVASFSRSSGTEAYQWRYLALGQACFHLGLMEDAVVLLQTGRRLATAAFRRESVCW

SEQ ID NO: 55938 - protein, 183 aa, Sorghum bicolor
  Clone ID: 30934649.pep
MAASLGLAHDASCYAAYPPAAAAASSYFPSPPPPGDLVAEFPPTAAATAMADDYYYYYYFQFGEEMGGARAPGCGGGYCSPPAPAFDNGMSLLSYGGVDGDGRRPMSGPAAGTGGNGGGGRPPASRIGFRTRSEVDVLDDGFKWRKYGKKAVKSSPNPRYSTIQYDSRDHFSSIPWSRSCMHA

SEQ ID NO: 55939 - protein, 172 aa, Sorghum bicolor
  Clone ID: 30934662.pep
CGKMGHTPNLDVFQQLTQSERRRALDACATHLCFPPHRAIPACVAPFLLPVEHRAFLPSDPIDWAWRIQPLDPSVECPAGGVLSPSGHLRRIQSIGHGGAPFPADLSVERQASLSSHQAPSHRCPLPFRSCGGTHHISGLARKGNRLEPWSCLRKGRSLQTAHGKGRWGLQL

SEQ ID NO: 55940 - protein, 106 aa, Sorghum bicolor
  Clone ID: 30934666.pep
QEKKRSLNRRSAPPFRASADPPEPRRPPRPVAASSPPPFSASASASASSSSSCPMSALFNFHSFVTVVLLLICTCTYLKMHFPSLLIRRTGCASYLSFFNLYIVYF

SEQ ID NO: 55941 - protein, 199 aa, Sorghum bicolor
  Clone ID: 30934694.pep
MSGHLDRLARPCFEGCSSHDERRDHKSDFEVSEDEKKTRMGSLKKKAIDASTKIRHSLKKNRRKSGSRVLSVSIEDVRDLEELQAVEAFRQALLLDELLPARHDDYHMMLRFLKARKFDIDKAKQMWIDMLQWRREYGTDTIVEDFEYTELDTVLQYYPHGYHGVDRDGRPVYIERLGKVDPSKLMNVTTMDRYVRYHV

SEQ ID NO: 55942 - protein, 169 aa, Sorghum bicolor
  Clone ID: 30934702.pep
MGNARRPAADSPAASDREVGFAKLQGECFEYYMQTYSIVLGRHSRRSSKGPAAPPTEADDGVDVDLGALGGGMNVSRRHARIFYDFPRRRFALEVLGKNGCLVEGVHHVPGSAPVRLDSQDLLQMGEAKFYFLLPSRSVFDAGIARRAPAVQRGIPPPPSDDDEDEDEQ

SEQ ID NO: 55943 - protein, 149 aa, Sorghum bicolor
  Clone ID: 30934704.pep
MALGEGRDHGAALPLIADQAKHGAGGIVRSGSMWTAAAHVITAVIGSGVLSLAWSIAQLGWVAGPGAMLVFAAVTALQSTLFADCYRSPDPEHGPHRNRTYAKAVDRNLCSSSSWVCMLLQHTALFGYGIAYTITGSISCRAILKANCY

SEQ ID NO: 55944 - protein, 90 aa, Sorghum bicolor
  Clone ID: 30934735.pep
TICSCASQWPSAHIFPGFQRVAGDKGNALAASGGGSGLVKLWDTERWQPITSLTVPRPEGARPDRTAVASLSFQLPGAWSPDGKLSACEP

SEQ ID NO: 55945 - protein, 151 aa, Sorghum bicolor
  Clone ID: 30934745.pep
ALPFPNATPPGHPQRLSTLSLPCALHAARARETKAREVSVRRLAAGVWRLRPPEAVAGGGGESRVRVGVEHIPRHLQVQLLKQNTSGHHQSLKNEVSSPLSVLERKSGELHKVQLHATSAMLPVTTMEKATKWEPEAARGGRRGAEDAANG

SEQ ID NO: 55946 - protein, 144 aa, Sorghum bicolor
  unsure (1)..(144): unsure at all Xaa locations
  Clone ID: 30934769.pep
NDEMRLLAETRKLEDSLTVXERFRNRTMFDIIYVRDTHPLSSQIMFLYQNYYHLSRTDPYVIPIQPAVSGGMNGFLCLSERNWYIVTVTSPVRGFNGIAQNRVLNATYLNPQYHKHIPEPPAGVIIPAKILKPSDFKPFPVLWH

SEQ ID NO: 55947 - protein, 49 aa, Sorghum bicolor
  Clone ID: 30934774.pep
IDGGSNTENLGLQNIQARIRMVLAFMMASLMPWVHNKSGFYLVLGSSNV

SEQ ID NO: 55948 - protein, 164 aa, Sorghum bicolor
  Clone ID: 30934805.pep
VCDDRHSELIPCLDRNLIYQMRLKLDLNLMEHYERHCPPPERRFNCLIPPPHGYKVPIKWPKSRDVVWKANIPHTHLAKEKSDQNWMVEAGEKIKFPGGGTHFHHGADKYISNIANMLNFKDNNINNEGMLRTVLDVGCGVASFGGYLLSSNVIAMSLAPNDVH

SEQ ID NO: 55949 - protein, 64 aa, Sorghum bicolor
  Clone ID: 30934808.pep
DTHILQFSNRLLRLISEIHVYHDTASLGNLIQCKKFCCMFLEHESMAGRSAPCHRLLILLSCSC

SEQ ID NO: 55950 - protein, 88 aa, Sorghum bicolor
  Clone ID: 30934854.pep
MFHNMVHIVYNSQYTVSSHDQNTQALNCKFIHNAWAHFWFSLRTPFTTKELYFHRMKVLHAQIWITVCLDIKKLHSLRKLPPATPPLI

SEQ ID NO: 55951 - protein, 105 aa, Sorghum bicolor
  Clone ID: 30934910.pep
SLVSDATQVGSWISFILISVPLLDSFILRVDLAATYSQSLCYTLLGYNIKSLSSVSQTLFSLIHNRPRIQTCPGYSFTKQPNLQTLTTKLHVGALPLGHQVNSTP

SEQ ID NO: 55952 - protein, 222 aa, Sorghum bicolor
  Clone ID: 30934919.pep
MTNNERAPEPPTMTTIGINISMQQLHLTNTYHANNPALLQTPRCYVDASTLPDQPNMSMRQAGLGIFFLNTRVQPAQGIYIKAKLEACSSVLMAEAASLALASIIIDRLNIDRVSFLSDSELLVHFFNQTHHNDPPDWRIKHFTQTFSNHIISREPKIFKVKRSSNSIADTLAREAFLHRTVQSNNIQYSCSHEHHKIECPLTQVLHFVDLINVTIIAARCC

SEQ ID NO: 55953 - protein, 110 aa, Sorghum bicolor
  Clone ID: 30934931.pep
QKMQVSIELPFHCWRRTGESNQSSPALFLLLVFRILFLCGFLVVRVAAVTIAVATGGARAVLVMCLLRRGRVVVPAAAGLDAVPDAVIAAGGDLGGHASSPRAIAVGRDG

SEQ ID NO: 55954 - protein, 97 aa, Sorghum bicolor
  Clone ID: 30934960.pep
RGITSPEKTADGYELRSRGPASQGLDALDNLVSAIRRSSTSTSAPPTAAAAAAAHLAQQPSSPTPSTASTAQSPAMAEPTLADVLAQLKTMSDEMTT

SEQ ID NO: 55955 - protein, 220 aa, Sorghum bicolor
  Clone ID: 30934964.pep
MPCQSSPKVVGRRLSGMSYAGASNRCSFHHRTPWPPPLLDVSAEHPIWFQPPRPRSHRWKHQTNHRFKRNEPISICKEHPPTSLVRARSGSADIRQRQAHSPSPLFCTLGDLHRPPLQQRRTTSGHYVDTQARLPSQSGGVRTTLQLHPTLLALDPNLLRLTERSQIFIANDLPPHQFHGLPEIPVGGPAYSGQTRQPQGRRVHHESALMELPGISRLPA

SEQ ID NO: 55956 - protein, 159 aa, Sorghum bicolor
  Clone ID: 30934982.pep
MDDDGAASRSPSRSPSRSPSRSPSPLPVADPVTVAAAPPGHVAVAIPLRKPSPSSGGGREDAWSDGATSTLIDAWGERFVALGRGSLRHPQWQEVAEVVSSRDGYSKAPKSDVQCKNRIDALKKKYKIEKAKHDSDWRYFDRLDDLLAPVLKLNSSSSS

SEQ ID NO: 55957 - protein, 75 aa, Sorghum bicolor
  Clone ID: 30935009.pep
SISIIISTGVWIDVSVIFPSRLHMRACCTAIGKVELAGRPLIIHVFHAIAIRAGYRSHIDHCMHMDGCSSAAAAQ

SEQ ID NO: 55958 - protein, 77 aa, Sorghum bicolor
  Clone ID: 30935043.pep
HIYSFLFIGLSPSYPWTWVLNKMRWFSTIHQVTLCRLPYLTHCIGINVTIVLALVYATETGKEHKQQCITDVDRCLA

SEQ ID NO: 55959 - protein, 228 aa, Sorghum bicolor
  Clone ID: 30935049.pep
MPLPDMINAILALDTSVLDNDQVENLIKFCPTKEEIEMLKGYNGNKEMLGKCEQFFLELMKVPRVEAKLRVFAFRITFSTQVDELRTNLTTINDATKEVKESLKLRQIMQTILTLGNALNQGTARGSAVGFRLDSLLKLSDTRARNNKMTLMHYLCKLLAEKMPELLDFDKDLVYLEAASKIQLKLLAEEMQAINKGLEKVEQELAASESDGAISVGFRKALKSFLDA

SEQ ID NO: 55960 - protein, 140 aa, Sorghum bicolor
  unsure (1)..(140): unsure at all Xaa locations
  Clone ID: 30935065.pep
MGVPAFYRWLAEKYPMVVVDVVEEEPVEIEGVKVPVDTSKPNPNGLEFDNLYLDMNGIIHPCFHPEDRPSPTTFAEVFQCMFDYIDRLFVMVRPRKLLYMAIDGVAPRAKMNQQRSRRFRAAKDAADAAAEEERLXEEFE

SEQ ID NO: 55961 - protein, 101 aa, Sorghum bicolor
  Clone ID: 30935096.pep
WRGELVSATREGKNQIFFSFSSFSKQRLAQLSSTSQPQRREPELILLISVQPDAGSAAAAARGKVEVERERDRARRRGRRVRAVVVDDRGRGAAVAAAVAV

SEQ ID NO: 55962 - protein, 78 aa, Sorghum bicolor
  Clone ID: 30935111.pep
NSNANLWITDFLNSCFWVTKSISAVVISLRPRANILASLNILLVLCWLGQAVEALLVMALVCSSSSETATTVDPLISN

SEQ ID NO: 55963 - protein, 116 aa, Sorghum bicolor
  Clone ID: 30935113.pep
FMRPGKVFIQVVPLGTDWAAGAYYGEPAARMGLRYVGYKISPEESSLSREYPTGDPVLTDPAGVAQRGWDVTKKVYLDRQNVRLDLARFREELVGAHRYLMAGGDGGGRRRPRAPE

SEQ ID NO: 55964 - protein, 103 aa, Sorghum bicolor
  Clone ID: 30935140.pep
YVQIQSNQCGNNTMPGYHGISFLEQIKTCYYLSKILNGQRTTETGHTHVILSTPEAERALQLQLPIKQMGSKWLHAQYALPAFRPASVPKCMLFLKTLKLFQL

SEQ ID NO: 55965 - protein, 141 aa, Sorghum bicolor
  Clone ID: 30935221.pep
YSCVVFGWMTILAAKQPSSKLNIFGVLSLPISFAPFESLIFTSIMVPQASFIGHLSGIIVGYSIAWGLIHGMNNYWAITMLGWIALVFVLSLKRTGSMELSFIEIEPVTDPSLPSVGVVAPRNGRTLQMDVLPGRRVADIV

SEQ ID NO: 55966 - protein, 77 aa, Sorghum bicolor
  Clone ID: 30935225.pep
IYFPFWIIKASSYHSIAFLRKLDEFPTALYYILNTMLLTLLVFHMYWWKLICLMIMRQLNNKGQVTDDVRSDSEDDE

SEQ ID NO: 55967 - protein, 68 aa, Sorghum bicolor
  unsure (1)..(68): unsure at all Xaa locations
  Clone ID: 30935227.pep
KKVSYFYICNTGKLLTVTPTTIFSDTVIVRGVFNYDMRQPYRXNTFGLHSDVRTGASYKSIGAFPFEF

SEQ ID NO: 55968 - protein, 92 aa, Sorghum bicolor
  unsure (1)..(92): unsure at all Xaa locations
  Clone ID: 30935233.pep
NWCISAFFYFLRLRSRKARIFRYLRFHILVTRRSIGIRRNRNSFPLHIXIKGFKSQFFFSISFFFFSEXILFLFFHPCNRERMRKEGFSLKK

SEQ ID NO: 55969 - protein, 133 aa, Sorghum bicolor
  Clone ID: 30935277.pep
IIHQLRSFGVEKVDCQWLVDEAVEQEAGAEEGEGEEERDGDRLSAADRRHRRRGPTNQQNDLLPGTVTRPAPAPRDHRPHGDATHTLRPLARARADNVKGRLRVVAWRVGGLTGGGASGRGGVARAGRQEETG

SEQ ID NO: 55970 - protein, 86 aa, Sorghum bicolor
  Clone ID: 30935279.pep
MGNCMDKAVPVDHNTSYQSKVGSKSISSSNPSTVKSGSTRSTWTVASYKDSRELPTPKTEGEILSSSNLKAFSFGDLKSASKNFRS

SEQ ID NO: 55971 - protein, 121 aa, Sorghum bicolor
  Clone ID: 30935281.pep
PDSSSLFFLLLPLSLHPLSLVLLSEQGRRHRGRVARGGRRWLRPLPPPSPPLAPPSLSFLSLSNRRRSRGETVPDATAPPTGSVPERVPSLLTQAAVPALLRLGSARPPGRAAVGPPAPVA

SEQ ID NO: 55972 - protein, 115 aa, Sorghum bicolor
  Clone ID: 30935312.pep
KRGRIGIVTSNATTATGQLILVPTSVRAPAETKGGEHVQPRHGGAERSRGSDLRRRRPLTEADPAGAPPADKDVEGGDRQRPEHTVGVVTHRRGRRGRSKVAADEVGRAHDEILM

SEQ ID NO: 55973 - protein, 169 aa, Sorghum bicolor
  unsure (1)..(169): unsure at all Xaa locations
  Clone ID: 30935318.pep
MVQQQQQHRIYILQFRKGEPEQEVACKVSQPKGAGRRVMYYYQDCGSGGGKSGKQVQPRALGLRRFLAMLLLSFLCVGTLFAAPVSFLSFVHSDEGGAAAGAGTGAVATAAAARGAVSGPCSSVGNDSFCCDRTSERADICFAKGDLRMHSASASFQLVSAGNXTAAAA

SEQ ID NO: 55974 - protein, 170 aa, Sorghum bicolor
  Clone ID: 30935344.pep
LYQALQNELCRMKLDLTLLDKLVHEYCVYRGIVEGSSHVLSGTANFKCKQNIDINNETQLECEMANSQNGHCSTSSITRDDSWSRRLHRVRNSTSGQRRRKRWRGRLDDLDYACDALLDSSKHDSLSPTLDMDEDAMVEKQDLVVNFNLSDNIHMEDQKYEMILEMRDLT

SEQ ID NO: 55975 - protein, 138 aa, Sorghum bicolor
  Clone ID: 30935345.pep
EPEPPEPRCATPDHSTARRPRSAEKKKSAFSAAAVTRSNPTARGGRGRLARGTKIRNEELTLAEELPVRWGGGGIRELGNSFTAHRGRSRSVQCAGGRTERGGGGRWSPWVVLGAWLPLVSGGVSRDEGNWVQLALAA

SEQ ID NO: 55976 - protein, 112 aa, Sorghum bicolor
  Clone ID: 30935354.pep
LSPFSPFPFFCALPRRASSAIRDFASPWSSPSRPLSTAVIEEATSPLLAPVRRGLSEQRRFKRRRHCSAPTPSLYVASPSPNPLLPPHLPLLHLLRYSCSWWPLDLLVVVLV

SEQ ID NO: 55977 - protein, 195 aa, Sorghum bicolor
  unsure (1)..(195): unsure at all Xaa locations
  Clone ID: 30935360.pep
LMGPDMGDGAEGLDKDKEKWLDEERRVFRGRVDSFIARMHLVQGDRRFSRWKGSVVDSVVGVFLTQNVSDHLSSPFLFSXSAFMGVAAKFPAKTEVPEKPVAEMCHTPEQKHSCSGLFGDSIKLQGKISIEEISDVRSLITTEDNEESNSNELIGSSAGYGVNRATGGCHVSYRKSLTGSHGNGLSGPVFPSTGF

SEQ ID NO: 55978 - protein, 222 aa, Sorghum bicolor
  Clone ID: 30935394.pep
LFLLLASLCCAVAAQTTDTLRQGQSLSGAATLVSSPEGVFELGFFAPDTNQPSRQYLGIWYHGISPRTVVWVANRVAPATSALPSLALTVTGELRVLDGTTANGTADAPLLWSSNATSRAAPRGGYSAVLHDSGNLEVRSEDDGVLWDSFSHPTDTILSGMRITLQTPGRGPKERMLFTSWASETDPSPGRYALGLDPNAQAYIWKDGNVTYWRSGQWNGVN

SEQ ID NO: 55979 - protein, 178 aa, Sorghum bicolor
  unsure (1)..(178): unsure at all Xaa locations
  Clone ID: 30935406.pep
GFPPRCVSRKPSRRRRRIQLTALLAAAAVFRPWPLAPATTLSRRSTTARRSPTRSRAPSRSTSPASRSPRCPPRPRPPPPPPRPRSPSFARSPRPHSAPPSTRTHTRRPAPPPPRPPPWEELWWIPPPPLSRTTTLPRTTPPSSLLPHPTTRAPAPATXRPRGAPTEAPPPPARCHLR

SEQ ID NO: 55980 - protein, 115 aa, Sorghum bicolor
  Clone ID: 30935416.pep
MKHYGCVVGILSRAGQLEKAKNFINEMSLAPDPVVWRILLGACKTRGNVAVAEVATKKLSELDPSNSGDYMLLSNIYASADRWSDALNVRQWMADTAVRKSPACSVVDSASSTNS

SEQ ID NO: 55981 - protein, 115 aa, Sorghum bicolor
  Clone ID: 30935422.pep
RKVIQVNWMMKYMLIPLYVYSWLSIINILGKSQTRIWVLSFVLSVALVLVPAPLVEFRYYTIPFVILVLHSPAIGNGKLLAMGSLYAAVDLSTLVMFLFRPFHWEHESGTQRFMW

SEQ ID NO: 55982 - protein, 98 aa, Sorghum bicolor
  Clone ID: 30935427.pep
SLPQNYRVIYIHRFAEAFVGVKKIAPADDNNSHAGTRTELSSPPSLKDGVLYSQQAETTNVEFKNMARKLLLLSDISGIPAAYKRRMLVKMLRQDQKR

SEQ ID NO: 55983 - protein, 80 aa, Sorghum bicolor
  Clone ID: 30935433.pep
RIRTSLNAILHIKVTIHGHLVPVHISVSSRRNKAIDMHITRNEQLGTLSKLHRKGCKKQHITVNQVQQSWQYTGRTGKQP

SEQ ID NO: 55984 - protein, 178 aa, Sorghum bicolor
  unsure (1)..(178): unsure at all Xaa locations
  Clone ID: 30935441.pep
ESYIILHTEKELWXALVEKFRVTNAGSELHLIEXLYDYKMVENRSVVKXAHKFXSLAKEPELFPCPLPDKFVASSIIAKLPPSWKDFATSLKHKRQEFNVEELIGTLDVEEKARAKDIRKGVETSTTNVVHRNFXKFNKKKNQNKQENTSXPIQTTXFKKKKNNNNKGKGGCFVCGSD

SEQ ID NO: 55985 - protein, 144 aa, Sorghum bicolor
  Clone ID: 30935445.pep
ALFLSCFLQFSTLQFFCTIIILAVCHIHLIEILSPCFPVFHFAVAMPMYLMTQLTAEQFLALTLQVGANKHGVLMLLLNNTSMGDAQSKHQKRTTTCTRCTTIVPTDASCNIALTVLMALSLAQPFRSSSPGLQQQRKPTSAGA

SEQ ID NO: 55986 - protein, 53 aa, Sorghum bicolor
  Clone ID: 30935451.pep
LNGKEVIKADDVVGMSKLSIGEASSGSMEPTALSLQLIGSTNGTSLQLPGATF

SEQ ID NO: 55987 - protein, 102 aa, Sorghum bicolor
  Clone ID: 30935471.pep
CITVITDCLQGVLSGVARGCGWQHLGAYVNLGSFYLLGIPMAILLGFVLHMGSRGLWIGIVCGSLSQTTLMSAITFFTDWPKMAEKARERVFSDKAHESAGP

SEQ ID NO: 55988 - protein, 77 aa, Sorghum bicolor
  Clone ID: 30935489.pep
FSTQSPLLILIKPTPVMNVQYTFFNTSTNIHEKPYCECLPADFTTIGPDHKIYNIQQARIEEGSIFCCLCVVQPLNL

SEQ ID NO: 55989 - protein, 177 aa, Sorghum bicolor
  Clone ID: 30935501.pep
SNVLPVASFLTDDGKSAHLPNLNLNSLRELQLLMLKMDAVNLADLYVFLKTCQCPNLERLFVQLPKSSYGPMECSTDEVREEPPENGLDNLVIVKVMNFNWHRTEVELVSFLLRKASSLRKLLIVSPNIAPLDLPGVQEADLVLFKEALTNGKIILSESDDAATQPYHFEVPSSSCQ

SEQ ID NO: 55990 - protein, 202 aa, Sorghum bicolor
  Clone ID: 30935521.pep
ANIGRSARGSADGKCNDSNRLTQPSVVCNDGVTQQTPIQASNNCIGTQTQPSVADDTSSMPPYSAQDHTSDSMVEDDYDEDVIFEEDEEEDEAYFFAGQDEEEGTDVGTYEQENSEPDVPDPYDRVYANVPSESHMLPLVPNCKRCNAKKFDGEPPGFCCRGGKIHLSSPETPPELMRLWSSSDADARHFRANIRYFNDHSL

SEQ ID NO: 55991 - protein, 126 aa, Sorghum bicolor
  Clone ID: 30935563.pep
MGFPVGYSELVLPKQLLHLLLLLGYIRRFLLWAFDAVGLGDLLDLGDDHHQALLQQDHHHGDAQGRDHHGALALPHQAAAMLLQQHRRPEFRAVPAMVIEEVLPVVRFDELEEARVGGDCAVCLSG

SEQ ID NO: 55992 - protein, 84 aa, Sorghum bicolor
  Clone ID: 30935585.pep
TQVHPVSGSPKAKTNRKPAYPNYTHSKTDFCKYRNGTEFLRPIFIRLGIPSRFLTSRYACAHHHTSPASSASSCLPTKAKVMSS

SEQ ID NO: 55993 - protein, 102 aa, Sorghum bicolor
  Clone ID: 30935611.pep
MLGRAGRLCEAEQIIEGLPVEVNVIVWRILLGCCSKYGEVEMGKRAIKMISDLERESGGDFAVLSNVLNELGRFSDAEQARKLLDERKIVKVPGLALVGEIQ

SEQ ID NO: 55994 - protein, 94 aa, Sorghum bicolor
  Clone ID: 30935613.pep
MSKKLGKLPPPAAAHEEAREELFASCSFADLGLHPTLCAHLQDKMSFEAPTRIQAQAIPVAISGQHMLVKAATGTGKTLAYLAPIVHLLQMREP

SEQ ID NO: 55995 - protein, 167 aa, Sorghum bicolor
  Clone ID: 30935617.pep
ERAPPRVLCERCCVAARPESERRRASRCERRCVAARPERAPPRVPVRASLRAPSVCRCASGFRRHHSLVMASPTAGSDSRDADEDSPCEMKVILSEIPDTTNSSALLYNYTHSEGMHKRFWVNLGKGVHNSDEIHEIEIHKSKVHEQYQSYMFRSDEFPSLKDGLRM

SEQ ID NO: 55996 - protein, 187 aa, Sorghum bicolor
  unsure (1)..(187): unsure at all Xaa locations
  Clone ID: 30935619.pep
MGRLVVAAAVAAWAFPFAALVNSVVPEPYMDEIFHVPQAQQYCRGDFWKWDPMITTPPGLXFLTIPHCFKLKFTHDGSLXNFAAFRSTNVILAMVCAVLFHDLLLCIRPGIGERKAAXLAMYLFCLKKRFWISATFGVFSILFRQTNVIWVIFFAANGAITYVKDLYSKDNVSHENSEPTHQSKKTS

SEQ ID NO: 55997 - protein, 190 aa, Sorghum bicolor
  unsure (1)..(190): unsure at all Xaa locations
  Clone ID: 30935625.pep
NRSKPFSGTAPRINSRRRAARRRPPSPIPTRNLPIPHPPTHRRPPPXRPNSXSRSYPQPNRADPPPWRPSGSGSSSSSRSARRTPASPSWVATTPPPASAPAKLASSPYPRRPSLHRRLIRQALLLSSTKASAMPADSVVIRLPGPRALRVLARSVLFAVALLSLPWLRSAEAPARGRAVDTCAAAAAQA

SEQ ID NO: 55998 - protein, 96 aa, Sorghum bicolor
  Clone ID: 30935631.pep
MAAGKARKRARQAAPASDGGDRIGALPDETLHHVLSFLPAQEAVRTCVLARRWLHLWKSATGLRIVGANGEAPVPFEEVREFVDTLLLLRGSSPLE

SEQ ID NO: 55999 - protein, 77 aa, Sorghum bicolor
  Clone ID: 30935641.pep
SRRRRPQVVVDSARSSPCTRLSASGSGAPSLVSALHPSRRHRRLFIRSHLQEHGLYVPSPPTEEKMPVLEFVEMRKF

SEQ ID NO: 56000 - protein, 144 aa, Sorghum bicolor
  Clone ID: 30935649.pep
MTRRCSHCSNNGHNSRTCPARSGGGVRLFGVRLTTAPAPAAMKKSASMSCIASSLGGGSGGSSPPAGGVGGGRGGGDGGAGYVSDDPGHASCSTNGRVERKKGTPWTEEEHRMFLMGLQKLGKGDWRGISRNFVVSRTPTQVAS

SEQ ID NO: 56001 - protein, 168 aa, Sorghum bicolor
  Clone ID: 30935663.pep
MPPPPPQGPAPSHAGRANLFSAPPPPLSNRRYPSQRSLPLPPVPPRRRDPKNHRPQPSQEEERPTDSGPRRTAATNPAFRASHLRTAYRKPVPPAAAAGEGEALLAADPTDAASGRAVVVGPSGLSFRLPGAPFDFQFSYSEGPRAPPLAIREPAFLPFAPPTMPRAW

SEQ ID NO: 56002 - protein, 144 aa, Sorghum bicolor
  unsure (1)..(144): unsure at all Xaa locations
  Clone ID: 30935679.pep
MAAAREEDEAAQARPLLLPPRPAQEDQKWWRRWAREAGWVGYLALPMVVVNLSQYAVQVSSNMMVGHLPGVLPLSSAAIATSLXNVSGFSLLIGLASALETLCGQAYGAKQYHKLCLDTYRAVVTLLVGCIPLSLLWGVHGQDP

SEQ ID NO: 56003 - protein, 149 aa, Sorghum bicolor
  Clone ID: 30935687.pep
MEDVLTPPPPPPQQQQQPELAGEKRKREEGSVDASTEDAPSAPASTGSAEDAAGSGVARHPMWKTSLCSFFRRRGAGAEGCSHGESCRYAHTEEELRPRPDGTWDPTSDRAKKLRKVAAEAQEEAEEEVTVDEQALDKCLVGLPRGWTA

SEQ ID NO: 56004 - protein, 105 aa, Sorghum bicolor
  Clone ID: 30935689.pep
IHSIFFLLPAPVLLGSERGEGRDRERGRRSEAPVSSRGSCVGLLARRAALPFPQLTHHALPLLTNSFPLSYLLPRSHPPILPFFFGSSPPFLLRSFLDLSLAPVR

SEQ ID NO: 56005 - protein, 82 aa, Sorghum bicolor
  Clone ID: 30935693.pep
MGSRRRRHHHHGRWVVPAVAPAAAAFAAAGLLFLVVAFHCFLSPPQNDGGGGGASGSSRVFRRPNPPFLLNKPAEVRRNVIG

SEQ ID NO: 56006 - protein, 137 aa, Sorghum bicolor
  Clone ID: 30935697.pep
MDDVSGGAPGSACPKNKKPRHLSRSLTYHHHHPYQGRHLPPPPSPAPTPAQRLQSVVLYTTSLRGVRRTFADCCAVRAALRGLRVAVDERDVSMDAALRRELQGVLAARGRGFSLPQLLVGGVLVGGADEVRRLHES

SEQ ID NO: 56007 - protein, 126 aa, Sorghum bicolor
  Clone ID: 30935717.pep
RTSRSRTPSARGRSRTGGATCGRAGGRTAPPSRCTSAPATTRGGSWTRWSTNRARADGSTAAPSSSTSANSSPRSSGASSTTPRSAASRTSTWRRARSRPRTSSASTCRCRARPSRASRSAASASP

SEQ ID NO: 56008 - protein, 125 aa, Sorghum bicolor
  Clone ID: 30935741.pep
MAGDQEYKIAHSVCSLHNAAANSNESLRRVANSPSDHFFLPSSKDHDESREPGSLIEDQRRHISHPPCMEPKGVLGQILYDVCVPKNVEGWDIKPTVSPNGRPTFASARQLGPFNPIRYFRRSRL

SEQ ID NO: 56009 - protein, 188 aa, Sorghum bicolor
  unsure (1)..(188): unsure at all Xaa locations
  Clone ID: 30935794.pep
CQFTNAGFICGPPSPITTYDASPQLNSLPTPLKNTHSSTPPTFLDRHFSTDPIFTEARQKRRKKLHQKCLARRGQLDFQSATSSCGQFDQTYIDALKATYPRRSYYGSPQYTCPHCHAVYWLREGLXTSSSRRNGQPIYNNCCKAGRVNIPPFXPRPEPLASLAQFDGDSPCNRFMKNIRQYNCLFAF

SEQ ID NO: 56010 - protein, 69 aa, Sorghum bicolor
  unsure (1)..(69): unsure at all Xaa locations
  Clone ID: 30935806.pep
NEVQRXWSNSQLKKTIKDVMGYIQEQTLNTCARNRANKLLAPKNQSSTKKLMLSLPKMTRKLKQSSQFL

SEQ ID NO: 56011 - protein, 179 aa, Sorghum bicolor
  Clone ID: 30935834.pep
YKSKDDIEDAGIFRGAVVECIHKMYQDQPTQEKILHQLNLYRTASQSFKTAHIIDTNMNLDPVSWWELHGVAARELSTMAMRLLRLTCGSLAYEKSWIEKLHNKKPCWVKRKQFEDSMFVTVNRRIQGKAQMTNRDPILAYIPDEDEPFEWLVGRFREYAEQGENHAFRTARANISEEV

SEQ ID NO: 56012 - protein, 60 aa, Sorghum bicolor
  Clone ID: 30935852.pep
GLEQHTSFISSPGSYLVMRIFIHHHHHGYIYIYIYIYIYIYIYIYIYIYIYIYIYIYIYI

SEQ ID NO: 56013 - protein, 73 aa, Sorghum bicolor
  Clone ID: 30935857.pep
LGQREVYALLLENHVYWSTRGDGVPSSLVRHGNLLLLRRRHHCWPWPRCREQVHAKKPHRFHGGRCGRGRRRV

SEQ ID NO: 56014 - protein, 87 aa, Sorghum bicolor
  unsure (1)..(87): unsure at all Xaa locations
  Clone ID: 30935865.pep
IAKLKSFKLRRKDWRICLGGTREGVKGPLTIGAEVFELTPPLVMVEXKKKAGDNEEYEDFCNKELEPGMQHLVHHMVRAPSMLTDAE

SEQ ID NO: 56015 - protein, 223 aa, Sorghum bicolor
  Clone ID: 30935893.pep
GMPIALHSTMVFKGFTQHHSTPLARAFCSSFREHLKSALGELNKVSNSFEMTNIEKGVIPSLFVVEFLLFLAASKDNRWMNALLSEFGDASREVLEDIGRVHREVLWKISLFEENKIDAETSSSSSTSEAQQPDLSASDIGDSRYTSFRQYLDPILRRRGSGWNIESQVSDLINIYRDIGRAASDSQRVGSDRYSSLGLSSSSQDQSSSSSDANASTRSEEGK

SEQ ID NO: 56016 - protein, 170 aa, Sorghum bicolor
  Clone ID: 30935911.pep
MDSTSCLLDDASSGASTGNKNPAPAPAAATGGKPLQRVGSGASAVMDAAEPGAEADSGSGGAGRDAVTNFRPLAESDPEAAVELRFLASRTKAEVVDMLRKHTYGEELAQNRRAFAAASPAASPPPAKNNNPAASSSSPTAVTAREHLFDKTVTPSDVGKLNRLVIPKQH

SEQ ID NO: 56017 - protein, 203 aa, Sorghum bicolor
  Clone ID: 30935918.pep
VAPEVLGRRGYDGAKADVWSCGVILFVLMAGYLPFHDKNIMAMYKKIYKGEFRCARWFSKDLTSLLTRILDTNPNTRITLPEIMESRWFKKGFKPVKFYIEDDQLHNVIDDEDGLLDMGPAGTVPPPLPPPPPPLPPPKVDGDESGSDSDSSISSCPASVLSGESQRPRGSLPRPASLNAFDIISFSRGFNLSGLFEEKGDEV

SEQ ID NO: 56018 - protein, 172 aa, Sorghum bicolor
  Clone ID: 30935945.pep
MAAAAAAMAAHRASFPLRLQQILAGSRAVSPAIKVESEPPANVKAFIDRVINIPLHDIAIPLSGFRWEFNKGNFHHWKPLFIHFDTYFKTYISYRKDLLLSDDMTEADPMPKNAILKILRVTQIVLENCQNRSSFTGLEHLKLLLASSDPEIVVAALETLVALVKIILQSCI

SEQ ID NO: 56019 - protein, 195 aa, Sorghum bicolor
  Clone ID: 30935963.pep
FARAALPDAALELLASAQAIGLTPRSNAVTALISALGSAGRVAEAEALFLEFFLAGEIKPRTRAYNALLKGYVRIGSLKNAEQVLDEMSQCGVAPDEATYSLLVDAYTRAGRWESARILLKEMEADGVKPSSYVFSRILAGFRDRGDWQKAFAVLREMQASGVRPDRHFYNVMIDTFGKYNCLGHAMDAFDRMRE

SEQ ID NO: 56020 - protein, 161 aa, Sorghum bicolor
  Clone ID: 30935981.pep
MAGRRRRHRRGHPRQALPPPLPSPGEPPPLESNALREVTVAESSSKKTCHALSSTRSSLPLPPAFTFNIPPLHLRPNGHDSHPHRRYIKHSLLSNISWQLVDPAKQTSSLSCSALQNLQVHMQYLGCSYGYLIFSKLEQCLLVDVYSGATVRPPKLKFTDN

SEQ ID NO: 56021 - protein, 216 aa, Sorghum bicolor
  Clone ID: 30936015.pep
SESNKDEDESFREELHEMLIPAVLRPSGCKLDCSLKLHFYYIEFIPKPADRRYQMFGLFVINRLPEESEKLDVELHLAHARIVKAGIKYLGKIEFNKEEMILAHNFQEMFLKVLLDRSEFTSSYILLGNDAALDMDSTFYLLLPIKQKFYGDNMIDWPTIKKCLSSPAFQDPMGLSLPDSYLPNESLKLLGGAYKKADVIGSLVYTPHTDLFFFVD

SEQ ID NO: 56022 - protein, 227 aa, Sorghum bicolor
  unsure (1)..(227): unsure at all Xaa locations
  Clone ID: 30936025.pep
STKASNVNLPAKKXASSSDAVSCISSGDAASTVKETEMNQETYFGDQGMYYYGYYYPGSYGGLDENGYFVGYNGLEVHPAVVQADNGSYMCYLPGYENGYASITKGYLPSSKFVMHSNNQGKISVYQSKGINVKESGRSWNNSEKLKMRSKLNGHGDSESNENNHTDNSXHSLSPQSDVGLPSSGGANASIPSHVAISKNAYNLSDFVTKYEQALFFVIKSYSEDDI

SEQ ID NO: 56023 - protein, 59 aa, Sorghum bicolor
  unsure (1)..(59): unsure at all Xaa locations
  Clone ID: 30936066.pep
YNIQINVKDFFVEEQPKNYGDMYKNFASLIETVNSXVLSELNGDNAAAEAAKSSAAAAA

SEQ ID NO: 56024 - protein, 58 aa, Sorghum bicolor
  Clone ID: 30936080.pep
NCLIAILVCLYSYTVHDYTNTHVFVSFSIIFSYKLFNIFSPFIFTALCFPSHHNSTCS

SEQ ID NO: 56025 - protein, 53 aa, Sorghum bicolor
  Clone ID: 30936116.pep
SVNLHCYLVVCLSVVSKEQRLCMCHQLAPECQVAIETFVFVELERHVLPPYPD

SEQ ID NO: 56026 - protein, 87 aa, Sorghum bicolor
  Clone ID: 30936128.pep
ITSWSDLQSLEVVTCNKIKDEEITPALSELFSNLKELKWRPDNKSLLAASLVGTGMGKKGRVFFKRILPAHQRIKGKVRNYSAGVAA

SEQ ID NO: 56027 - protein, 113 aa, Sorghum bicolor
  Clone ID: 30936132.pep
PAEHGARIGSRLFSVPACCLATSCLFVRTLPTWLVVGYTRERSREQPPLAPIFRWCNLFPVSCHVNGLRMSVPRALTLIHPCMTPPVFCPPLTCLQAPGLSESDKLAMPRHAW

SEQ ID NO: 56028 - protein, 184 aa, Sorghum bicolor
  unsure (1)..(184): unsure at all Xaa locations
  Clone ID: 30936146.pep
FPYPSSPYITLVGGTDVYKDDKGRYYEIGWDGSSGGFSGDFPVPSWQAAQVAAYLQQPNPPXSYFNGSGRGLPDISAPADNVMIIMGGSQTPIGGTSCAAPVIAGLFSLINGVRLKAGKTPVGFINPAIYTLSSQNPTAFYDVTQGSNPDGCCPGFPATKGWDAVTGLGTPNFRELLKYFSQLP

SEQ ID NO: 56029 - protein, 88 aa, Sorghum bicolor
  Clone ID: 30936182.pep
GDTHRTWSYYCLFYMPDTSTRIKHPGNTSKRNTSYVRFILVFEIPVNTISCQSIMQQFNVRASSICLPMYAIFVTSYIGLQIPLNVLS

SEQ ID NO: 56030 - protein, 150 aa, Sorghum bicolor
  Clone ID: 30936270.pep
MALHAAAPACAVFCRLPSSSPSHDAGGRRSLPAVARPRGVVSAAPLRTRAVRTKATFSDGVPETSNSPHVVCFGELLIDFVPTVNGLSLSEAPAFKKAPGGAPANVAVGIARLGGSAAFIGKVGDDEFGYMLADILKQNNVNNQGLLFDP

SEQ ID NO: 56031 - protein, 184 aa, Sorghum bicolor
  Clone ID: 30936272.pep
MQHSKSTPRVAVSLGGSETRIIMAANKLSLVAVLVVVASYAALSSARTFTVGDDQGWMSGIDYTDWTTGKTFAVGDKLRFSYGSQYHTVTEVSKSGYYTCSANDALSDDTSGWTVVTLTAPGTRYFICNIPGLCSSGMKLSVTVPGSGPVPSEATRGGTLVPAMGSVVVVVAVATGALIKLALF

SEQ ID NO: 56032 - protein, 168 aa, Sorghum bicolor
  Clone ID: 30936278.pep
MESATGALGTLLPKLGQLLQDEYNLQKGVKKDIQFVTKELESMHAALRDVGEVPQEQLNEVIKIWARDARELSYDLEDIVDTFLVRVQGSEPPSKRSVKRFTNTMTSIMSNVKIRQGIKGIKERVKEVAERRHGYKVDDIAPTKTLFDPRITALYSKAASLVGIDEPR

SEQ ID NO: 56033 - protein, 225 aa, Sorghum bicolor
  Clone ID: 30936302.pep
MPSSVNDTKVENDVEQRLFGSDERAVYEEALKHITQETKEEDLSKGVMSVKLLKHQKIALAWMLSKENSSHCPGGILADDQGLGKTISTIALILKEMVKQSRFMTAGSYSTKFAPNSDYDNDDDVVIVMTKKEPKGEPFNELDDSARLHVASNLKVCDNKSNAATHKAEPYDNGDAVIVIAKKELKDEPLNELDDSARLHVASSLKLCDSKSNTATDKAEPKKKT

SEQ ID NO: 56034 - protein, 120 aa, Sorghum bicolor
  Clone ID: 30936314.pep
MARSAPALVAVFLLVLALLTLDAAQGQQPFPPTDPSDAEALHAVFRQWRLEGEAAAENPCMKRVWSGSFETNASIDCNCPSWCRITGLNVTGYRNITEIPLALFNLTELISLDLSNNNLN

SEQ ID NO: 56035 - protein, 169 aa, Sorghum bicolor
  Clone ID: 30936331.pep
MAAADVEYRCFVGGLAWATNNETLEHAFAGGCPTLQELELHRCTDLALRPVSAFAHLQILRIVAAAPALYGPAEGGGVTDIGLTILAHGCKRLVKLELQGCEGSYDGIAAVGRCCAMLEELTIVDHRMDGGWLAALAFCGNLKTLRLQSCRRIDDDPGPAEHLGACLTL

SEQ ID NO: 56036 - protein, 202 aa, Sorghum bicolor
  Clone ID: 30936333.pep
SVRKQVEQVSIALWAGFVPAQQTNKKKGEGLSRMDGAGYGGTGSGHGGTGSGCGVVGTAANSRAASAVGACPWLWPSHRVVAALGGSLAWTPHCRSTTPRADALGAASPGWHATGQGACPSHRHRRKGGRGRRLANMPPRRKRAREGEEGAARAGAATAAACCGRSDRLSRRLSSGVGGSTGRVEKERERERTRKREEEVRS

SEQ ID NO: 56037 - protein, 142 aa, Sorghum bicolor
  Clone ID: 30936335.pep
LTDVQKRKPCVIDFYHDSSVPDGRFASLPFRGPSAARRERTVRLCRPARRTTAGAPSADPRGRRHSIERPAKRRRGGVSTPAAAFRRTPFPRRVPWRRSRPCGRSGLCCARRSYSYTTVDPLVGHFSSCLWSTATLLTCVAG

SEQ ID NO: 56038 - protein, 93 aa, Sorghum bicolor
  unsure (1)..(93): unsure at all Xaa locations
  Clone ID: 30936387.pep
DAKEKSLIGAMSGHASWVLSIDVSPDGLAVATGSSDRTVRLWXINMRTSVQTMSNHSDQVWAVAFRPPGGAGIRAGRLASASDDKSISLYDYS

SEQ ID NO: 56039 - protein, 104 aa, Sorghum bicolor
  Clone ID: 30936389.pep
LKQRQGDCHHLSQRPFLCHVCSRQSRGFRQPARSELVTSWHRSDGGGERVQGDSKMIPSLGSCQRHHYHLFVNYGGNPGGAGEPRRAFPAVPVGVPPPSPNAPP

SEQ ID NO: 56040 - protein, 46 aa, Sorghum bicolor
  Clone ID: 30936399.pep
FNSRKVLDEMMNFVKQKYCPFLSLGTPMHFVCKTPMNQRKVSVRWS

SEQ ID NO: 56041 - protein, 52 aa, Sorghum bicolor
  Clone ID: 30936421.pep
SYVGTRIFYKTNFVPRNLAPHLATSPIPPLATCPSPTVNDRATQNLRTATSF

SEQ ID NO: 56042 - protein, 160 aa, Sorghum bicolor
  Clone ID: 30936437.pep
RPDIDRPRLMTDERPDVKHIWTMPDGWWRAEALWRPNKTCKQQESYFVACLTASTETKNSSYFDDFLKQVVYCSFMNSSLAPLDPTVVRSHVCLRSHVCLRSLRPATCYYVMSSLAISSPFLLCKDFFYFQFQAGMPTLLLSCCIWILIGCPILICSSNS

SEQ ID NO: 56043 - protein, 210 aa, Sorghum bicolor
  Clone ID: 30936476.pep
MAGTAVTLPSSGTPFAVATTASSSSARRCLLLRSSPPRRALRVVASAATEAPPKATPPPTSPSGIVLVDPSEAQRVHRLKAVYDQKVVPLITEEFGYTNVHQVPKIEKIVVNCGLGADAGNSKGLEAAMKDLAMITGQWPVKTKARKSVASFKIREGNTIGIAVTLRGRVSPIPLFIRPPQSSYTFSVDRQLGALVYQTRNLVAVWNDAF

SEQ ID NO: 56044 - protein, 60 aa, Sorghum bicolor
  Clone ID: 30936488.pep
GFNQTSHDCKSHSVSQIDRLVPYKLFNMDYAAPSCCSSSSSAVCNITSCISIISRCCRCS

SEQ ID NO: 56045 - protein, 207 aa, Sorghum bicolor
  unsure (1)..(207): unsure at all Xaa locations
  Clone ID: 30936495.pep
MASAASTAATGAPLRLLSSSSNRISKPFLPRPHRLTLSSPISFQRLTARSAASPSPSTTTSSPSGSGSVDPAQLPPALRDIVGLFQSVPDARTRYKQLLAYAARLPPMDPALKTDANRVRGCVSQVWVHAEPDEGDGGGRSVRFHADSDAQLTKGLAALLVLGLSGAPAADVARAPVEFIELLGIRQSLSPSRNSXLLNMLSLMKRK

SEQ ID NO: 56046 - protein, 132 aa, Sorghum bicolor
  Clone ID: 30936548.pep
PCSRAAHRRWPGSRSWEAPTSSQLSSPLRLSELAASCCLLHCVAFYCICSFQFSVLFCSVDAIPVLPSCQGMHLTTTRLVRVASTMQCRPLCSKIEHALVGGSTVVVRLLAENVHVMQARSVCWCYLVFFCF

SEQ ID NO: 56047 - protein, 177 aa, Sorghum bicolor
  unsure (1)..(177): unsure at all Xaa locations
  Clone ID: 30936603.pep
RIDPDPDPGAVLVVNSLFKLETLADDSLVVDRSSPRDMVLGGIARMRPAVFTHGVVNGLCGNSFLTRFREALFYFSAAFDMLDAXLPRSSEQRMVLERDFLRACVVNVVACEGHDRTDRFDTYRQWQQRSRRAGLRQLPLDPAVVGAVTEMVKQQCYHREFVIDENDDGWMLQGWKG

SEQ ID NO: 56048 - protein, 161 aa, Sorghum bicolor
  Clone ID: 30936639.pep
SACLPRSLRSSSRPTAAAPPRTSFLADPCHQLAAASLRALPSRPPLCARHGRLSAVALPYPVLASVARPSLPCLASPPSRRYRRRGVLVLEAARHPRGRCGASVCTRSPTSQPAVMASQPACSGHSGRRLVRLASLRQHAAVAAALPGCSPSRVKPTGSGL

SEQ ID NO: 56049 - protein, 51 aa, Sorghum bicolor
  Clone ID: 30936645.pep
SKFEVNNIVSFFNKNPICVNRNFLRAFLCFSNQKLYNHFVYKENSLSSFML

SEQ ID NO: 56050 - protein, 66 aa, Sorghum bicolor
  Clone ID: 30936650.pep
ASGCAIEAHAQKTLQTKMLPTANFCLSLMSCNKYQIYASIKHCQHIMKRVLVDSGYPMTEHKPASK

SEQ ID NO: 56051 - protein, 109 aa, Sorghum bicolor
  unsure (1)..(109): unsure at all Xaa locations
  Clone ID: 30936658.pep
EIKQKPSLHSGEQATAPDDLLLHHVSPLLFLPLPSLFPRMAIEASVXIIVTSLRLRATTCIIVIIVAARPRWRCVIVVGIAALCLSSTKGGPERPGQRNPEPPLSHPGG

SEQ ID NO: 56052 - protein, 78 aa, Sorghum bicolor
  Clone ID: 30936677.pep
KVKPEFGEFQFDGFWRRDVERIAKCLRFGAHVIMTSGACKNGSNCFCETLKKLEKHYDIVANIQEVGRGGYRGRGAGY

SEQ ID NO: 56053 - protein, 85 aa, Sorghum bicolor
  Clone ID: 30936714.pep
NILCLANNTNTYKKQEEVAARDSNRSSSLVPRQRGGSTTLLKLIDMVVALPPCSGYLSQQGGHCGFVDSTRLKNFNGRKTVKRHE

SEQ ID NO: 56054 - protein, 98 aa, Sorghum bicolor
  Clone ID: 30936719.pep
GLLEFFFSEAPPRMRSRATSLSWASLALGYYLSSVLVSIVNSATGRGDHRPWLQGASLNHYHLERFYWVMCVLSTLNYLFFLVLAIRYKYRNAGVIKG

SEQ ID NO: 56055 - protein, 38 aa, Sorghum bicolor
  Clone ID: 30936728.pep
RGDKKTPSLAIHSILFKQRLLTPSLFLGLLIGLDYSDE

SEQ ID NO: 56056 - protein, 90 aa, Sorghum bicolor
  Clone ID: 30936756.pep
FKVLPFSVLIAKLCPAGCEGSVMAFVMSALALATIVSGYLGVALAAFMGVSGDDFSALPACLLIEAACTMLPLCCSSLIKERREKEKKEE

SEQ ID NO: 56057 - protein, 59 aa, Sorghum bicolor
  Clone ID: 30936766.pep
VQRPGEPEVELHVDTTIYIIELQNSTKTCKLCGHEQEKHQHFCARIDCAYIHIKRSVLT

SEQ ID NO: 56058 - protein, 193 aa, Sorghum bicolor
  Clone ID: 30936770.pep
VNLSGSTVKTTLDFWNIATVSANKQILPDSKCSGVCKNAAVETVTTYPATCTASSQCQCVANITFCKDIVTYPTTSLLHLEEVDSFTQTAYNSAVDLMNLAGTVPDSCKSDLKVFLCKFYFPYCSADQNILKPTIDVFECKDASSSVKDAARENRAFSAYNAADGETTQGSSSAASIVPAILLVVASLIVINF

SEQ ID NO: 56059 - protein, 92 aa, Sorghum bicolor
  Clone ID: 30936794.pep
FPWFPLHTEILLKEIEREREREMSFLRVTSENLLGQCSSSSIDPYLHRPDTYHRRRFCLLDWILNSLPPHSRRQQQPLVPAVVAPKGGREKS

SEQ ID NO: 56060 - protein, 160 aa, Sorghum bicolor
  Clone ID: 30936804.pep
MEKEEKQELEGATAAAAAARRRLVIGVGFWVQGFRLFPWLGVNFFLKDGMGVAASSLQILQASANLPMVAKPLLGLLSDAVPIRGHRRLPYVAIGALLQAISWLAIALWQDISLQVLTIFLLLSNFGASICEVANDAIVAEAGKIVTSSSGSGQLQSFAW

SEQ ID NO: 56061 - protein, 101 aa, Sorghum bicolor
  Clone ID: 30936813.pep
SLSLSLSRSSSSSSSASLLFLPRVAASSLSHGRASAGVSAPPARRIDHLARGLTLGSGTNDYRCRQVVLGYTVAPDPDVRLCLRRHVYFSPSDDRGQGQLR

SEQ ID NO: 56062 - protein, 112 aa, Sorghum bicolor
  Clone ID: 30936819.pep
GGRRESGMNFPGGSGRRQQQEPEHLPPMTPLPLARQGSVYSLTFDEFQSSLGRAAKDFGSMNMDELLRSIWSAEEIHNVAAANASAADHAHAARASSIQRQGSLTLPRTLSQ

SEQ ID NO: 56063 - protein, 110 aa, Sorghum bicolor
  Clone ID: 30936845.pep
RTCAPSPPPPSCCCCCWCSAALSSPPPDRAAVGGAVNSIDLRRPAIDRDRAVRPSAKVGRYGRSAGRSIDDASLLLLLPFKLQTLTPCILFVYGMPLDGEQWRCSRYDYS

SEQ ID NO: 56064 - protein, 218 aa, Sorghum bicolor
  Clone ID: 30936847.pep
MNSPSYGKLGVIGIRREDKSKWERRTAITPQHVARLIEQHPHLKFVVQPSDKRIFRDIEYTKAGATINDDLSECSVIFGVKEVPIDELMANRTYVYFSHTIKAQDYNMPMLDHILREKIRLVDYEKITDEEGRRLVAFGKFAGNAGALDFLFGIGKYFLNLGFSTPFLNCSYAFTYKNLEKAKDIIRDCGESLAEEGIPASAGPLIFAITSSGIFHFS

SEQ ID NO: 56065 - protein, 150 aa, Sorghum bicolor
  unsure (1)..(150): unsure at all Xaa locations
  Clone ID: 30936849.pep
EHAELPSPAHACRGRRWQHPNLVVALTIEPFGKLSAPASRSGVLALPPLPTIPDVDYLLCPGRRIQFVQIVAVWNPVLCASVVFEVFRALCAFSFGSIAGSPNLSWMSRICNVLNFLGSSATPIHHGCAGSEFFLIVTSMSKFVSXEIVL

SEQ ID NO: 56066 - protein, 166 aa, Sorghum bicolor
  Clone ID: 30936863.pep
LLDPSEYNPKYKLREGEIGLIPHPTPNPTKQTLIRRPCRPPRRRWASTATSATATSPSPLPHPLTPTSSAPAAAADSSRSFLPTLAPRLRPRPPPSLPRPPSTSATPATSPPSSAPPPPSRLPQASSTPPTSSTTTSAAYSPAVPPSRSSSRVGPASPRPRASTLL

SEQ ID NO: 56067 - protein, 192 aa, Sorghum bicolor
  Clone ID: 30936875.pep
MATSTTTLHPPLRAPRHLRPLPHSYSSSFSRTRGRAPIRASAASASAPAQREAAAGVPWGCEIESLESAASLERWLIDSGLPEQRLAIQRVDIGERGLVALKNIRKGEKLLFVPPSLVITADSEWGRPEVGEVMKRNSVPDWPLIATYLISEASLEGSSRWSSYIAALPRQPYSLLYWTRAELDAYLVASPI

SEQ ID NO: 56068 - protein, 124 aa, Sorghum bicolor
  Clone ID: 30936885.pep
SGHRIRGRTAADRASAVGDLVARGAAPLAAAAVVLVGGAPPLVAAAAKRGHAGPPPSEARPRQGIILPLHPAAMDEPPSTRGLDHHPPRCGLIRLVLPGSGWQIQLASLYSQLRQLLLNFYLWA

SEQ ID NO: 56069 - protein, 202 aa, Sorghum bicolor
  unsure (1)..(202): unsure at all Xaa locations
  Clone ID: 30936897.pep
YWKTTSLALSVSPNAGRSLHPPDATAGAMARGRQRPSSSTSSSSSSSLPSPSSLSCPPDAARLARAPGSTRRVAASVIPSPTLASSLIPSSLSLSRCGGTTTTXPSAPASLAPDVLHRNPRCMSSSLPLSVSLFLSSAHGCRPSISTPWCRCRWQLGHDRPPELEDSASRPRANEVSTCSGCILFDLYNRTLPAGCIISAFV

SEQ ID NO: 56070 - protein, 167 aa, Sorghum bicolor
  Clone ID: 30936929.pep
MRSGGRGTWTGGTGRRPGPGTAAWSPPPSCSIWMGLKPLRRTPQSVVPKPGIKTRHESQCTNGSRTLNLAGRPVRIGNATRTSWGRYVMVEVLENLAFLANASNLVTYLMRFMHYSPSQSATTVTNFMGTAFLLALLGGFLSDAFFTTYTIYILSAFIEFMGLVILT

SEQ ID NO: 56071 - protein, 216 aa, Sorghum bicolor
  unsure (1)..(216): unsure at all Xaa locations
  Clone ID: 30936947.pep
MAGTDRLYPPIEPYDLGPPQVPAAAGEEEAGVCDAPVMWDDEPDASPSPSPEAGPHIFEEGARDPPPEAFKEERLGVVNSDEFSGEMTTVKESGENDYXGFPSCEQTGIIWVPPSVPPMTKHDHDEWQKGFGYNSAGFLEEEDKWDIDEENLEMTMWDVLSEMVVAGKDKVLSIASFDLGTYGMSMISDFFLEEALKDKAQTLEDVSAGSEHALLE

SEQ ID NO: 56072 - protein, 62 aa, Sorghum bicolor
  Clone ID: 30936982.pep
EEEEPAAAVHGLELEAYRSTMRALYASGPLTWEQEALLTNLRLSLNISNEEHLLQLRRLLSS

SEQ ID NO: 56073 - protein, 106 aa, Sorghum bicolor
  Clone ID: 30936984.pep
LKKRKEIPQDLVDVTISRRILGHATHSFLPLSTSSSPLSSALLFSLSPSSFLRLPCSESSPAPKLPPPAAPPATSLDEEDMNDLVLDMITPYCLPPASPQRAFDDR

SEQ ID NO: 56074 - protein, 211 aa, Sorghum bicolor
  Clone ID: 30937006.pep
TANKGLGFHYIDVEDHVGRFNHWVGLDNFGVLTIEEGDIDEEEIIENLRDLFDKEWAWRLKKSEEYKYIVRFPPHRKVEQLVIGRASVFDFNKPGVVGSLSVWNGEIEPVGSLVDVWVLIQGIPPKWVDWQTMNQVASSLGRMIQIDWQTLFDSFFSSVRVKLQCKDPSKIPKERLFVFKNKIHLVMFTAEGYEQEDNTSDGGSDKGDDNS

SEQ ID NO: 56075 - protein, 126 aa, Sorghum bicolor
  Clone ID: 30937008.pep
MQRMEQTGCELDSDTYNLILNLYTNWKYEKGVQQVWDEMERNGSGPDQRSFTIMVHGLHSQGKLDEALQYYTTMKSRGMIPEPRTKILVKAMHMKKDGAATEDDSTSMAGKHLKLDRRSRLFNVHR

SEQ ID NO: 56076 - protein, 125 aa, Sorghum bicolor
  Clone ID: 30937011.pep
SRKTTVETTSFSVQIRQHPFIVSRVHNDRLATKAQKITHASSVQENSSYWQLQDLSTVGTCLPSSTTLQSLSGASPASFLALRFPAYVHTFSRSPAKSFSTLISCVPRLFLCSGGCPLPGLPVTG

SEQ ID NO: 56077 - protein, 81 aa, Sorghum bicolor
  Clone ID: 30937040.pep
PPHVNNFHHRNKFIDCYITNTFKVSARRCPSLKANLLPFGKADFTGYHCYVQLCGHRTVRRASKTDGSWVWSLSQTHCKAI

SEQ ID NO: 56078 - protein, 127 aa, Sorghum bicolor
  Clone ID: 30937052.pep
CKNMKKPDWYTVLRVQPRNLFAMPEAEGTDNMGELDLDSVVIGVEDMNVEQQNEDVTAWSRFGLHGATVDASVIKHAIATAMPEPEHDDLFDEDEDPDDTYINDGVLPPFSTPGEDSDDDFLSNFFN

SEQ ID NO: 56079 - protein, 102 aa, Sorghum bicolor
  Clone ID: 30937060.pep
AACKHYMAGNDIGSVVPEDEDEEDSEYKSGDAGASSSSSTAPKPKPKPGLIKAIPPNGRSSGSFNPSLKVLYEDLLMEFNVKGADTRKFIVEKLKKNQPAAT

SEQ ID NO: 56080 - protein, 134 aa, Sorghum bicolor
  Clone ID: 30937066.pep
KFKNVNEGKYFQACLTKLKIDHINIIELLVCPPLNLKFFPPSPYSKNANHRQSDVFVKSNEVALHSPGASLQRQGKYKEAINYHSMVLNISKMTGEDAGVTEAYGAIADCYTELGELEKAGKFYDKYIARLENE

SEQ ID NO: 56081 - protein, 136 aa, Sorghum bicolor
  Clone ID: 30937094.pep
IKGFSTEKLSHPSWFKHFTTGTDTVFRGKASHSSATQIIVHLIRGQLLFTYELQVLLEAGRDWFKKSLNMKQNNINNKDAFSCINGNLSAASYNYFPYITITISLLSTVTRRGLVIVLKTRKKRCNKPYNNQLDLF

SEQ ID NO: 56082 - protein, 183 aa, Sorghum bicolor
  Clone ID: 30937150.pep
MAGSAHPASGAARAVVLRLDDLSLPPRYLTVPSHLPVSDLLGSLPLPSSSYYLTADGRPLPSSTPVSSLRPSASVQLRLRALRGGGGDGGATGAESRDCYLSMYLAKKPDKADPNEARLSRFTCCALSGEPLAAPAVADRLGNLYNKEALVEALLHKRLPKAMSYIRGLRDMIPIHLHPRPDA

SEQ ID NO: 56083 - protein, 110 aa, Sorghum bicolor
  Clone ID: 30937166.pep
LPSVLPSCRPAPPPPPPAAPGPSPPPPAALGPRSSRLRYLPRRAPRRTRPPTIAVAAGRARRCRGLEGEEGEVAVGRRPPARTILIPGPAPRGFASGCWSGSICQDNLHN

SEQ ID NO: 56084 - protein, 140 aa, Sorghum bicolor
  Clone ID: 30937174.pep
LGLLLRGCPSLVFLDWRGKSTGFCSLLGRIMKLKNSAVETFKENNMIFTSEGNFHSKKMREDYVASPNQADVQTRCKWIIGDVTEVLDRNTWKLGKILKMLKNNYFVIRLADCIQLKEFHISSLRIPRGLDAPQSKPFHA

SEQ ID NO: 56085 - protein, 114 aa, Sorghum bicolor
  unsure (1)..(114): unsure at all Xaa locations
  Clone ID: 30937176.pep
AFFSLLMLLNSXDGVESGELSSHLVSQILTYKVSTKMALSWQQGTTTANRGCFISDERRSQIPRARSTAAAPWSRRSLRPWPRTLALFPREPPAPACGIDAKGSGGLHWRQRRS

SEQ ID NO: 56086 - protein, 142 aa, Sorghum bicolor
  unsure (1)..(142): unsure at all Xaa locations
  Clone ID: 30937198.pep
MPPPGLESAILAAACRFSKPLSALRRLGVLAWHCPPTVRRNAAEGSVPSLGLPSPFHQVVVRSGNLVGSPRFCHATAGMSDHLTDVYASEVLKVLKSTSADXAXLSDALRRFAVHMDEDIILTVLXKQRSNWQVALAFFNWA

SEQ ID NO: 56087 - protein, 176 aa, Sorghum bicolor
  Clone ID: 30937200.pep
HGSTIKQLPEPAEAAGDGGTVSAAAGAGRDDSEELWWKTVDSVYLNIKSISFFHEDKQETAASRWSRAGKRIAKVGKGLSKDDKAQKLALQHWLEAIDPRHRYGHNLHLYYDIWSASSSCEPFFYWLDVGSGRDLHHHKCPRSKLNSQLIMYLGPVERAAYEVVVEEGRLLYKQSG

SEQ ID NO: 56088 - protein, 134 aa, Sorghum bicolor
  Clone ID: 30937202.pep
MASASEDEAASDRCSGSYSPSADVSESETSSDCSAPTTRRFASSSSASATVSRLASSSSSLPTPASATAFYLSSKPVSDLSEIDMMKERFAKLLLGEDMSGSGKGVCTALAISNAITNLSATVFGELWRLEPLA

SEQ ID NO: 56089 - protein, 227 aa, Sorghum bicolor
  Clone ID: 30937264.pep
MDTEYRALQQGSSSSWCTADASSWGAAQQQKRQRCQASSSDQVGSSSNSSLKISEPQQIQEEEEEEEDYYMEDDCDDDGDGYDEDDYEFDEADFNQHLADKFDDLDLPPGVEATVPWLQKIAPKEEAKEPPKSNTADENENKYTQFKQFDTVQNFSDHYYAKNSNGEPTRAWSKRVQHDWKLLEKDLPAYIYVRVAEDRMDLLRAAIIGPKGTPYHDGLFFFDVHIP

SEQ ID NO: 56090 - protein, 202 aa, Sorghum bicolor
  Clone ID: 30937268.pep
MALLLRLAAPSAPPRRSSGGRALPRVVLPEAISKQSFLLPLRVDNTASLSCPIKCSAARHAPSLIDHTDSRNGGIHAASVYGHDLMKSISDLQEVVFSSFSKACLLSSCIIYGLPPSCIAEPCEQAYSLPNMPLLFAIAMVGATVGGLLARQRRGELARLNDQLRQINAALRRQAKIESYAPALSYAPVGSKIPESEVIVDP

SEQ ID NO: 56091 - protein, 62 aa, Sorghum bicolor
  Clone ID: 30937295.pep
SRGLFLEDEIEGDCSFAGHFFVQVVIYPIFSIVPDNGASIASQKGMSSLELNFWYDVVLKPI

SEQ ID NO: 56092 - protein, 113 aa, Sorghum bicolor
  unsure (1)..(113): unsure at all Xaa locations
  Clone ID: 30937297.pep
SPSPSPSPPTPQPNARPVLLGRPRPRPTPDXCRXPALPGCPRPHPTPSPDARARPALPGLGVFLALARMSLKPTRTSHLSPAASLKPSILRFARSWSRPRPCVSWPVHNPGIT

SEQ ID NO: 56093 - protein, 64 aa, Sorghum bicolor
  Clone ID: 30937301.pep
LPVPKGLYEELKSIPGFEEAHLEHYYAYLCENPPLARAFYALPQLTSKIIWVARYIKNHRSELI

SEQ ID NO: 56094 - protein, 103 aa, Sorghum bicolor
  Clone ID: 30937307.pep
MISDVVLSCIIVVLGARRRRFRRRCVMEIELRGRQQAAQQVPIHRRRLCSDGGGGDLIVVAMMLHDAAVDGGGACGAAACRRGAAPAAWTQPPSRRRGHALPP

SEQ ID NO: 56095 - protein, 97 aa, Sorghum bicolor
  unsure (1)..(97): unsure at all Xaa locations
  Clone ID: 30937329.pep
QVFVSRKDGXEVWSRLEEHRHNTGELTEQSGIKERPKSEGIDERFYRSCYVDTEEDAKRGMIQMIGGGGDRLLVTREETPGVEVWETSRLAGSISLS

SEQ ID NO: 56096 - protein, 110 aa, Sorghum bicolor
  Clone ID: 30937331.pep
AREGDVVGVHQGKLVVNGEARNEEFILEPPSYDMNPVQVPENSVFVMGDNRNNSYDSHVWGPLPAKNILGRSIFRYWPPGRIGGTTKGCFNPELDSETKPGSLIDVKLTK

SEQ ID NO: 56097 - protein, 129 aa, Sorghum bicolor
  Clone ID: 30937341.pep
RKHSSPDSRSPKRVTVALKALINLMREAMRGWRKARVTIKWILKNELILTPEELMKFNNLKESGFRHTSILDPTLVDRIGMSKEFNDILIPLVWEVFGEYLKLGIEVLTKEFLCTLKLTHNISHVRARV

SEQ ID NO: 56098 - protein, 129 aa, Sorghum bicolor
  Clone ID: 30937366.pep
ERSVGYVAAVGFPALIVVILNDHRGIATNISGMGGCFIIICLVKQLGAQKAGILVVSFCQISHRCQLSVANDLILKRRNHEYWAEILYSIRSKCAHIQDIRTVGGIAFSGRPVSIVKLDHIGRQKHQLF

SEQ ID NO: 56099 - protein, 95 aa, Sorghum bicolor
  Clone ID: 30937380.pep
MHNIDSSATEGDQSLHNQASTTPMQFTTSTPSIQELHAIIKDMRSNASPGPDGLNAAFFKSAWSWIANDVHNLVTNFYSTCFMQPEINQTFIVLI

SEQ ID NO: 56100 - protein, 65 aa, Sorghum bicolor
  Clone ID: 30937390.pep
SKELIQQLESVYTQDISILDPFSNPIAKKLYDEWLGQPGSENAKKYLHTEYHPVVKSVASQLQNW

SEQ ID NO: 56101 - protein, 71 aa, Sorghum bicolor
  Clone ID: 30937400.pep
ANDMNNYFPTTYIDDLFVYMFMPWALRYRRYDWQFAYSPYEYIRRFISNCVNKGVILLLFFHGSHSAFNFP

SEQ ID NO: 56102 - protein, 186 aa, Sorghum bicolor
  Clone ID: 30937412.pep
NITWVDSFVEKLGVPAVPILAAAVAAAPRLGSPLLLALPSLFSSAWLPVSSPRLASFLVFFPVFVFLVSPGSAPCSQSALPCHPLSHSLCLLRSFRSWLLLFSRSAGSPFWKLLPPWRLLLCFAVPFPIRSGWLLPLCLSMRPLLVCICGSLRSSSMVYPARLLQSTKAQHQLEAPALASRAPRKP

SEQ ID NO: 56103 - protein, 127 aa, Sorghum bicolor
  Clone ID: 30937424.pep
MPTVSIGLQHVVLDLGVRGALLSAQGGEDPLVSMLRTQLGIIHPLSAPPVSRSVVGLFTLFFFVGAAFDKLQPVIDEVAREAARAAAAVVRERETAPGAAGQAWQEVQPAAAACQAGAGERAEAAEA

SEQ ID NO: 56104 - protein, 161 aa, Sorghum bicolor
  unsure (1)..(161): unsure at all Xaa locations
  Clone ID: 30937432.pep
GRKAKAAERARQSSRIETHLSLPESVRPAPAPPFRRVTRQESRGDGQRFRMAAASSVVRRAAAASASRGLLLARAFASGXAAARRPSGWLVPVAAGTEPIEAAATADVLNRAGARVTVATADPPGDDGLVVQAAYGVKFVADGRVADLQGESFDLIALPGG

SEQ ID NO: 56105 - protein, 209 aa, Sorghum bicolor
  Clone ID: 30937454.pep
MASESSPPPAEAPPPVPGNKLAVFWHEGMLAHDAGRGVFDSGRDPGFLDVLDQHPENADRVRNMVSILRRGPIAHFLSWHSGRPPHASELRSFHSSECIEELVQANATGAKKLCEGTFLNPGSWGAVLLAAGTTLSAVKHILDGHGNLAYALVRPPGHHAQPGHADGYCFLNNAGLAVQLALDSGRAKVAVVDIDVHYGNGTAEGFYRT

SEQ ID NO: 56106 - protein, 138 aa, Sorghum bicolor
  Clone ID: 30937460.pep
ADQCSSDAPGWLPSPAAATSVNLRAQSASRRTGGRSFRESSHSLDGRASGSARRRMDFCPVILYLYKTCQQLDSRKASKILGSVAGGARCRWSRRRSGRRRRSSSCAWDSHDGTDLQEAFLGFHPCERRIRSSISRGC

SEQ ID NO: 56107 - protein, 199 aa, Sorghum bicolor
  Clone ID: 30937466.pep
NSSRSTRDCILIEFYHRMREESLTAISRHVKELREAQKESTFSDENNKATAIGRDIQEIHDKLKDSSLPKGFFTEEQPWKDVYITELLKCTKEEHLKDFEQEYCLAEKIERALEDTDIAVELYKLSVSTLHILKLASKEEQGDYVGAWYSMLLSCAQELQCFKPWVLADPGKLNKMLSCLDSCTDAWTSGLEMALKMVI

SEQ ID NO: 56108 - protein, 91 aa, Sorghum bicolor
  Clone ID: 30937470.pep
QQCSREGPPCSGWVEGMAPVFSKSAWQCVWHLIQNDLIHGWGIDYKFGYCAQGDRTKNIGVVDSEFIVHRGVQTLGGSTITKDGTRGKNAQ

SEQ ID NO: 56109 - protein, 147 aa, Sorghum bicolor
  Clone ID: 30937476.pep
MATPPPQDMDLEQHGDNMAGKGGAGQVYWSNAMSSFVLKYLANLVASGTKTMSGFKQAHLNSCARALYEKLGVQRSGGQVGNHLRKWKRIYAKIEKLKNLNGAVWDEHNCIIGLDAEHYNNHIKDHREDANYLNIPIDHYHEMATIC

SEQ ID NO: 56110 - protein, 150 aa, Sorghum bicolor
  Clone ID: 30937482.pep
MALFALRLGPLLPAPPHRRRILRNRRCQGRIVASNAANPVRDGGAAAVVWFKHDLRIDDHPGLAAAVSEPRRPVVPLYVFDRRILAGYSDKMLGLLLFALKDLKMALKSQDSDLLIGLGNAEDVVLKLVNEVQAGLIFTEEEVEYRVRDV

SEQ ID NO: 56111 - protein, 187 aa, Sorghum bicolor
  Clone ID: 30937500.pep
MGTVGGGGRSGTMKQLNVGGKLFSLEASSLSLSLSLSLGSPSPTPTFVDRDPALLSAVLAAIRSPSSAAPDFPARVLLDEASFYGLHAQLLAALSPPPLRGFSASLASTLCPASEPFPTALAPHHDGSLCLAHGAGLVSYYSPALDHHTTFRTHLHRITSLRQLPPRLAVLGSDSAPGLHVYDFLDG

SEQ ID NO: 56112 - protein, 140 aa, Sorghum bicolor
  unsure (1)..(140): unsure at all Xaa locations
  Clone ID: 30937504.pep
MSSVHFFPASSQTPVPARLLKTSPKPPLPCPRTTAFQSVGGNCNAWRGPYIRLRRRVRTPAAPADAPPVGPDGGSGGGGAGGGSGGEDEEEEGGEXXRKGLXPEWMNLTTEDAXTXLAAVAISLAFRTFVAEPRFIPSLS

SEQ ID NO: 56113 - protein, 236 aa, Sorghum bicolor
  unsure (1)..(236): unsure at all Xaa locations
  Clone ID: 30937518.pep
MPPRRRDRRRPRDPSPPSSDARAPPSASGLRLTLLVPLLLLVLVLTALGFSGFLSRSPPHSQTLQTTAHSVYERGLVKRDVSAREILAEHTRVSENRSQRNFPNPVLAYVTHWNSXGYVMAKLFSKKLTHVSPVWYDLKSDRNRLVLEGEHNFDAEWVSELQSNGSLVVPRIVLEAFPAVFLLEKKXKEKAIDLIVSECRDKGYDGIVLESWSRWAIYGVLDDQELRYMALQFVKQ

SEQ ID NO: 56114 - protein, 37 aa, Sorghum bicolor
  Clone ID: 30937533.pep
PPGFRFHPTDEELVGYYLVRKVASQKIDLDIIREVDL

SEQ ID NO: 56115 - protein, 187 aa, Sorghum bicolor
  Clone ID: 30937543.pep
EEHLDLADMLQHLEGELEAARDSEKKMLLSLEAQTKQLEQTKVSLEEAKIEIASLRDSSNPGRQPVKNFRRRGMMSFSFADPGEVETWSLQRELKLAVESEEKCKKAMDDLAIALNEQTTEARETKAKLSLVQAELNNARTEVNNLKASLESTEGKLQLALEDAERLKVESDELAAASKKKKKKKRP

SEQ ID NO: 56116 - protein, 182 aa, Sorghum bicolor
  unsure (1)..(182): unsure at all Xaa locations
  Clone ID: 30937549.pep
TTYTHPRPLAPVAYLASFSSISPVVHQGPCAFGGVLSQLGPVRGPATASGRPSSPLGPVWGLPLRTPALHRSLLLASVWAFLALRPPGFRCPFSSPRSIVLLAPKGRNAVDLCLLVSIPVYVLLGEALFPFGFLRETHKKLCESQKVQLLLRISHHTCTCGPAIPKPSAAXQLFVNKVKYRX

SEQ ID NO: 56117 - protein, 87 aa, Sorghum bicolor
  Clone ID: 30937596.pep
FLNLWDEEPIFLSACGLRRLAEANVSRQLRRKSEQNTHATRDVILLKTQALAASVRRLVVVGRGSTAASPWHCHTCRQQYTIPTAQG

SEQ ID NO: 56118 - protein, 173 aa, Sorghum bicolor
  Clone ID: 30937606.pep
KQVEKPKQVEQPKQVEKPKQVEQPKKELKEKKPVEPVQKERLPLDQAQEIMASNVLSKPIEGQESKLDESEQPKEVEKPVEKEEDLTATDKYFVHHVVQPNISFADAVKMNPEEAEQKRKRFEEQQAQKEVAQEFHRDKHAIPQEVVLQEMKAAPIKTENPFDILNQADAMSA

SEQ ID NO: 56119 - protein, 138 aa, Sorghum bicolor
  Clone ID: 30937608.pep
KVLSVYFFLRVKLTDRSRAERATLAAAWSERQDAAAEQASSRSRRPSTSTSSASGSLSAQSAAKPPLSVVLDGSLLQPSPSLSPAVRGFFSAIVSSIPFASEPGPAAYSGARGLCWIAKCTDLGAGRRNGGESHVICR

SEQ ID NO: 56120 - protein, 80 aa, Sorghum bicolor
  Clone ID: 30937636.pep
TLRPHLIDQNYEAGSNIPCYPRFKDRKTLKGERRQICRTGYIHEGKSTSFETVPLYVYRNWVIGSLLVNHLLQCPVATYA

SEQ ID NO: 56121 - protein, 99 aa, Sorghum bicolor
  Clone ID: 30937638.pep
LPTSNLAVAKGELMDKVVAKWQLVPASKYCAAAMSNGRPAGRSDFTPRRVFGLLNSLACFDSSRGSRVGRFFYVHCSDKCASRSPTLTLNGDGLANLCR

SEQ ID NO: 56122 - protein, 49 aa, Sorghum bicolor
  Clone ID: 30937643.pep
KANFKDKFHEVKKNWGGGVMGSKSQVKTKGREKLLAKEAAQRMTYDTPC

SEQ ID NO: 56123 - protein, 74 aa, Sorghum bicolor
  Clone ID: 30937645.pep
RCSRALQATMTAVGRPLTLISQADFGSRIVSSKDSKDRTSLEKLIYGGGWCYMLNDRTGNQRVVNGSITVLLST

SEQ ID NO: 56124 - protein, 174 aa, Sorghum bicolor
  Clone ID: 30937665.pep
SQPLQYNSPPEFIASRYWNASWVSPFAANVMFVMYECNLNGDTTRHYVKTLHNEREVLLPGCDDVYCEWTQFVQLFSGYFHCDFAGMCYDENPTPLPVDPPHAGPSSPKPPGTGAAPFGTPGHVTPPEDYLSVTTTAAIAISAFVLGFIVAGIGAVLFVRRKISTQQQFETLVD

SEQ ID NO: 56125 - protein, 91 aa, Sorghum bicolor
  Clone ID: 30937694.pep
SDDDMVLNILASCDCPVTVDGNTYSVRHLVCSSPVMLMPVSVQEMSSTLEPDRCIAHRREVKQAEPAREPAALLEQDRDGSINNNQYNHLP

SEQ ID NO: 56126 - protein, 41 aa, Sorghum bicolor
  Clone ID: 30937700.pep
VYAHFTVIENLILAAPKAAAKNITLVGSTNTYIHQVERDLA

SEQ ID NO: 56127 - protein, 192 aa, Sorghum bicolor
  unsure (1)..(192): unsure at all Xaa locations
  Clone ID: 30937704.pep
MALIFKLHLALFALILCCLCQADSNYDWTKHLGTKTPYFPQQDYQNHTKIGADKGQCSVLYLNYVGRHGSRYPTSGDIVKLQQLKKELYSHRDLLNKTDYLWMVNWTDPYKFQTAGNLDKNGELEQYGIAQRVREEYNITVPCCDTVYPIQTTXVPRAARSGXAFGFGLFEXMGSLGSSDYKHFTRIRARCL

SEQ ID NO: 56128 - protein, 147 aa, Sorghum bicolor
  Clone ID: 30937742.pep
MAFRLQARPGFRDRSIQGLAHRGGRDPQELEALFGRVLSYIHHALPTPPVSVDGDLCILFDADGGGVDRLSRLPDKLLCDIVSRLPIKEAARTAVLSRRWSPIWRAAPLVLVDTHLLPAGDDEIPIDLDHAHSDAVGAAVSRILVAH

SEQ ID NO: 56129 - protein, 95 aa, Sorghum bicolor
  Clone ID: 30937745.pep
MECNRDEAARAKALAERKMMDKDFVGAKKMIIRAQQLLKEVGDVDIPKMLTVCDVHCAAGAKVNNEIDWYGILQVPVNADDALIKKQYRKLALLL

SEQ ID NO: 56130 - protein, 143 aa, Sorghum bicolor
  Clone ID: 30937791.pep
PQKNQFSETWVTFPSQKLPWPCRSRRPASHFESPDTILDLSGADRHPGIISNGNGKGSSVSFSLRRDRVDKRSEEATFVCTATVRVSGSVRFEVQSKDERILVGILEACDCDVDDSKGAGTTKSWVMKCQVPTQRGSGFLRCG

SEQ ID NO: 56131 - protein, 154 aa, Sorghum bicolor
  unsure (1)..(154): unsure at all Xaa locations
  Clone ID: 30937799.pep
IYNEVVRDLLSAGSTSLRLWDDAEKGTYVENLTEVILRDSNHLKELISVCEAQRRTGETYLNENSSRSHQILKLTIESSAREFLGKDKSTTLVASVNFVDLAGSERASXALSAGARLKEGCHINRSLLTLXTVIRKLSKVRNGHIPYRDSKLTR

SEQ ID NO: 56132 - protein, 130 aa, Sorghum bicolor
  unsure (1)..(130): unsure at all Xaa locations
  Clone ID: 30937817.pep
KREQIIKSGTASSLSQTRKXHFLFSQSVFQPXSLIVSYCYKHRLQRTTWLQTEELPAQIDVNKHVCEQLGMYREKESKCLISFLGKKISRDFFLQHKCRLISPISSDYYESTKTIHKCSQRKCSVIKLSE

SEQ ID NO: 56133 - protein, 103 aa, Sorghum bicolor
  Clone ID: 30937841.pep
IPECRGRNSRRSLSHARDSSLASGARNSLPHLPATAPPPLALEKGFQYTAAAAGGGIGSCRLRGRRLKLQVLRICAAISSKTRPGFAVLSTISTRSRLGHFSF

SEQ ID NO: 56134 - protein, 126 aa, Sorghum bicolor
  Clone ID: 30937843.pep
PLSRCTDLLSALRSTTAAVLEGEEGTAAQLGSRWAATSPGGGAECVSADELQLPVPLPLTRQQVGGKHLPAVGQNASAQVLPSLLSLSPVHSFSPDFCHHSPWISLFSWPNHSYGAHHKRLARFGR

SEQ ID NO: 56135 - protein, 181 aa, Sorghum bicolor
  unsure (1)..(181): unsure at all Xaa locations
  Clone ID: 30937847.pep
FPFSLFSPPSLLLYRRTHSPTLLRTLHRRIMSAKSRSSGFLSRSVCLAFGVPMRSTGEARPPPSSHVVAEVESGGGCGRDRLHQIHAMESFLPSLARRTLTHTRDLLSRRADLVADCSLDDNRWVVAPCGSAGTVVLMLIQKEDDQALXCAALEKLPVQPHPLCHYLGVCTDRAKAIGWKG

SEQ ID NO: 56136 - protein, 145 aa, Sorghum bicolor
  Clone ID: 30937855.pep
FFLQHEKTPAAAAATHPTHPRRLSRRSDSRDSSSPLPYGRTMAGRRRWPPGQARPMVVQARPFSPRCSCLVSWQPTEMESPEACSSEEVSPESPAAEARPSEDERSAGPCLPTGHRGGVSGVLWRRWLQLISSYSYSTAPSCVYY

SEQ ID NO: 56137 - protein, 89 aa, Sorghum bicolor
  unsure (1)..(89): unsure at all Xaa locations
  Clone ID: 30937857.pep
MQPTLINWAEXDQVFSMQMEHRLERHLGENSRLVVVKNVGHVASLEKSKVVCKSIISYFQEPASSASIGGKAPRPNAGKLNISHWCVHT

SEQ ID NO: 56138 - protein, 169 aa, Sorghum bicolor
  Clone ID: 30937859.pep
STIRTTQTQMQESRSFSILRPIGQSRLINLAGGVVNFGINSSTKVIKGGLHLVDRSVGTSVNLTKSAIGLVRNGVNLGCDLAVGVVDVGKNLTTGVIKNVEGKVDYATETTKKILHVDLPQLMPAMKTHPKLQIDEEESLINRNRLKKAVKGQEKSEVADLTRLVLIAE

SEQ ID NO: 56139 - protein, 79 aa, Sorghum bicolor
  Clone ID: 30937887.pep
EGIFPVLAVPFFSPLPNSVCFGLGSHRIMLWMLNRCGLHARRNRDCSASELQVNRVLCLLHLDFYINMGLPDNISCELE

SEQ ID NO: 56140 - protein, 72 aa, Sorghum bicolor
  Clone ID: 30937893.pep
PSIHDVTDHYANKFPHLDVLRATEAVVARVQPEGDKLGELGFRYKYGMEEILDSSVACAARLGCLDAAKLSV

SEQ ID NO: 56141 - protein, 78 aa, Sorghum bicolor
  Clone ID: 30937901.pep
GARARTTSTRSRVRSRHPKLWPPPATTTMRRSSSRRRRCRSRTRLAPASRSSSRTCLQWRHHHCIISPDEQIDRLLSC

SEQ ID NO: 56142 - protein, 177 aa, Sorghum bicolor
  Clone ID: 30937903.pep
SNIKMTWHNTSRVNIASPWMINDMRPLSGPNTINGYVMLNNTNLQIEGNWQITPSAFVEGIQSGYGNLTYLAAYSGSTLTLAGTFNNMFFFGNSSGVTYLTTGTFNNVSAILTERCTGWTWSRQNVTGTATFSSIQIATNVTLILRDGAFSFDSRSGGGLFQLVNAIVTVAGKAVFS

SEQ ID NO: 56143 - protein, 89 aa, Sorghum bicolor
  Clone ID: 30937915.pep
TLQGELPDGLMIAIKRLNEHAAVFDFSSEFLLVRLEHTNLVRLLGWCIHEKERILVYELMHKGGLHQFIFGMFSYFFSRTTQESCLSFH

SEQ ID NO: 56144 - protein, 111 aa, Sorghum bicolor
  Clone ID: 30937917.pep
KDNKSHTYPLLCNYYKAFLQHGAIGSLNGAGGRGRGEGAADLMTRRHSSSDKPPATARPASSRRHAATAHPAHSHPPATIAPLTVPPLQHTPTRPRRPTATPHAHRWASRA

SEQ ID NO: 56145 - protein, 215 aa, Sorghum bicolor
  Clone ID: 30937956.pep
CAGGILADDQGLGKTVSTIALIQKQRNEQSKFMSVDSDRLKSEALNLDEDDEGEQTLSNEPNKDQGASSSSTAAGTSAELCVNQPNSILNKMVETKAERKKKAKASTSSASTSRSMTRPAAGTLVVCPASVLKQWANELTDKVSESAKLSVLVYHGGARTKDPSELAKYDVVVTTYTIVANEVPKQMADDDADQKNSEEPSAGNKRKPPANIKTR

SEQ ID NO: 56146 - protein, 62 aa, Sorghum bicolor
  Clone ID: 30937958.pep
CKMGIFTIYEFLLHAQLSQIISRDIINICHLQYIKKTRAIFPNIFQNGFSFFKENTSLQEQG

SEQ ID NO: 56147 - protein, 73 aa, Sorghum bicolor
  Clone ID: 30937978.pep
GGDRSARYLAIFTTFEHPKICHNLHSSLKGLIDRRQRTSWSACPLIRVLLPLVHFIQLVLEPELCHQIRDRSS

SEQ ID NO: 56148 - protein, 86 aa, Sorghum bicolor
  Clone ID: 30937999.pep
SNQSPCGKIITNTNCKPVQKITKYIHSQQPPIIPGRIFFARMRRIHHIIRINQEAANKSPTWVLIRNCTKIKLLTGAYVCMYFHAR

SEQ ID NO: 56149 - protein, 182 aa, Sorghum bicolor
  Clone ID: 30938015.pep
MAQTPNPSRRSWVGPAPMPFLTPRPERRHLEMRWADGVSQGAARRSGVGAIAGNGGGGDGCERNREVNVQVVLRCRPLSEEEQRVNVQSAISCNDLKREVTVLHSFFKQVDKTFTFDKVFGPKSQQRSIYDHAVAPIVTDVLEGYNCTVFAFGQTGTGKTYTMEGEMRLKVSELPDTAGVIP

SEQ ID NO: 56150 - protein, 105 aa, Sorghum bicolor
  Clone ID: 30938057.pep
MAAARHGGYRSHDVSRRREHDLERSRRSKEYRRPSRDRDSERRRDGSRGREVDNGYSRPRSPYPPPRSRPSRRKDDKEPGEVSSDSGSESAGRPPVPRQDGVLGV

SEQ ID NO: 56151 - protein, 129 aa, Sorghum bicolor
  Clone ID: 30938061.pep
SEQFPYACMARASGSRRRSRRMRRGGKMPGDGDAVMKPHGQGVVKHAGRGIRRRGGDGGLRQVINTGSADSEVEHPSSTDSASEGWIYVPPSSPSHLVLLDSHHSYYTAVIVLLPPLIHGRRCAAASLL

SEQ ID NO: 56152 - protein, 204 aa, Sorghum bicolor
  Clone ID: 30938073.pep
MKNSSSEVRVCVTGGAGFIGSWLVKKLLERGYTVHATLRNIEDEEKAGLLRRLVPAGAAERLRLFQADLFDAATFAPAIAGCRFVFLVATPYGLEAAAAGSKYKSTAEAAVAAVRVILRQCEESKTVKRVIHTASISAASPLKDKDEAGAGGAGYKDFISESCWTPLDVDYHLRSAHFDKYILAKLQSEQELLRYNDGESPAFE

SEQ ID NO: 56153 - protein, 209 aa, Sorghum bicolor
  Clone ID: 30938083.pep
FGSSIPALCIIKPTTSKMRTALLFIAALCLVARISGQVATTYGSGIPNPNLSMSIWKFTGYNSNMVEPRNWECMSRDDFGQIACTGPMPWNYTDETVDHIRTWYCGWDYANITVQNNNNYVWPGLSVYIGTYNPADSCFMLAVEGDSSLSIYNGGMYFFMTSDYKASNCFSTQTSTFEIRNVLTIPFNPKSFTTLTCPGTVIMKTYSGI

SEQ ID NO: 56154 - protein, 155 aa, Sorghum bicolor
  Clone ID: 30938106.pep
MRKEIIIRMQPDSDKGRAKALKVAASVSGVESVTVAGESRDMLLLIGDGVDAGKLTRKLKKEVGEADILELRTLPATGSTSSALAPGSSTVVTQSAYQRHAATPGRSVPGGSRIECPFAAAAAAQWPGEHGRQQAVGYYHRRTPGPGYYHQQSSP

SEQ ID NO: 56155 - protein, 86 aa, Sorghum bicolor
  Clone ID: 30938136.pep
DSVYLRIWRMMLKVLDRCNSHRLTALVWIGFTFNCGLHNMHLERRSTSSFLSSTQNARILSGIEFDMAASMFLRVQLMKHTFSLTP

SEQ ID NO: 56156 - protein, 128 aa, Sorghum bicolor
  Clone ID: 30938144.pep
GKRSPDNTYGACASFNMIENGGIIDLSSDSDDDSIFGDDHQPASAITRFDQNAEGRIINFEDEDWQRSAPGPSSARPVENNNGQYRILPASLTNGRNAETTRYTFGSGDRIHPHPMRQGLSTSSRIDS

SEQ ID NO: 56157 - protein, 244 aa, Sorghum bicolor
  Clone ID: 30938162.pep
SLLPLPLESCSASAISLSCLAVDGCRSPSPSPAQRLQPPCLLAVPFELLSVAVQVGLPAGALSVLPVVARRRHSSERKCSSVRLALPWALPRAAVGTQQGRPVRPGPALGVSSAAAVVGVRLVLGLAASGCVCAACAAAVLGGEEPLPCWAGRSSGRAAACARSRDRRCFSWPVARFPAPRSQVPIFNQPGVNPGSHARLPARRFPRRSLGRRLAPRSLTTVGDVNNPCPRASHASTRERRSAS

SEQ ID NO: 56158 - protein, 63 aa, Sorghum bicolor
  Clone ID: 30938222.pep
MSKSSSSGVVEEEAAAAETEQCVDARADDFINKFRQQLQLQRLNSLLNYKEMLNRGGGGAGKQ

SEQ ID NO: 56159 - protein, 86 aa, Sorghum bicolor
  Clone ID: 30938226.pep
HSAPTQVPHQQRFSWLVYMKAGSRACRLETWSSVWGLDIECQGGGGGGIPCPKKKMVKQNSNDTQVEREGKCSRYLESKGYKICRL

SEQ ID NO: 56160 - protein, 115 aa, Sorghum bicolor
  Clone ID: 30938237.pep
GGAVARMDDELVRSAVDYLELADEVDSRPLRGSMPETELRVISWLGMPAYEADFGGGSPQVMSRAESVRGGFVYVMNDGRPADSSGVRVVMCTKAADMKEFERLLYANIAKPSKL

SEQ ID NO: 56161 - protein, 107 aa, Sorghum bicolor
  Clone ID: 30938263.pep
AMRTDSALKFGLFFLLYLFHILFCVFSAVAPPVVFEGKSLAGILPAIDLISVNALVGIFYFVGFGLFCLESLLSIWVIQQVYMYFRGSGKAAEMKRDATRGAMRAAF

SEQ ID NO: 56162 - protein, 132 aa, Sorghum bicolor
  Clone ID: 30938264.pep
EDTGEHNLGSWYALVLIAMYNVWDLIGRYVPLITCLKLTSRKGMMVAVLARFLFIPALYFTAKYGDQGYMIFLTSLLGLTNGYLTVCVLMEAPNGYNGPEQNALGNVLVVCLLGGLFSGVVLDWLWLIGKGW

SEQ ID NO: 56163 - protein, 73 aa, Sorghum bicolor
  Clone ID: 30938350.pep
QANNLLHRHMRWDTSYNLKLVQLCGLCGEVEVLQHSVSLSGTLLVVFLTLHTKNNQAYFRKAGGREGAIYFVS

SEQ ID NO: 56164 - protein, 181 aa, Sorghum bicolor
  Clone ID: 30938422.pep
APDANPHHHHRLPSPSLPSVLYPKPVSSLFPCTQTQRRRDGQRRRGDAGDARAWAWIRGYFTPATLFLVVNLVIGTIALTSRATQQRRRREHYYHDDAHGRGHHLQEEPLHPQMEQPGYGHYYHPEQTLYAAPPPPAPLARTSSVLDRLRSLGLYRFRSGEFPPEYAQDVSAPVGEEETTA

SEQ ID NO: 56165 - protein, 108 aa, Sorghum bicolor
  Clone ID: 30938426.pep
SVCSLLLYQGDESPIYPCGWRGEEGKGLPCWRLRRWASSASHSNPWICSAIVSTDAVRVIRNPISRSSCYLLTCSCLSFCTCLQKRARKFGLSLATRWSSLYCSDSLS

SEQ ID NO: 56166 - protein, 166 aa, Sorghum bicolor
  Clone ID: 30938436.pep
QVEVLESCFVAPREATPTKGLRLSPFDLALANRGHTPLVYVYRSGAAFFDVVRLKSAMAKALVAFYPLAGRLGAGDDGRVQIYCNGEGPLFVVARSFVTANSINFSKPSPELRRMFVPRIEPPSLILAVQVTFLKCGAVALGVAVHHAAVDAMSLFHFMQTWSAIT

SEQ ID NO: 56167 - protein, 77 aa, Sorghum bicolor
  Clone ID: 30938458.pep
RSQIDAELVRMATMTAEAAAAAAAHAVAEAEAIMAEAEAAAREAEAAEAEARAAQAFAEAAVLTLKNRNAAKLMAQA

SEQ ID NO: 56168 - protein, 120 aa, Sorghum bicolor
  Clone ID: 30938460.pep
YINSVLASIPIYYMSTILFSKAFISKITTIIRNFWWAGAQEDNSTSPFHFRSWSDICKPKKEGGLGIRDLLIVNRSLILHAAWNVATGKNPFLSNILKAKYFPNEFATLLQYPKTKNFVN

SEQ ID NO: 56169 - protein, 146 aa, Sorghum bicolor
  Clone ID: 30938462.pep
PEEKLELTKEDRLPMSKEMIIFLERNGFAVKPQMVNDRTIEMAYALCENKHAKSLQDMEDISGVMKKVSDINFDDWDSLKRVFVVKIIICYPEETENSKMFSDNELSKLLSIAPSLEGKLFIKNTCMEIYEDIVFARAVRVKSVED

SEQ ID NO: 56170 - protein, 140 aa, Sorghum bicolor
  Clone ID: 30938468.pep
DDFRGTAVGHDLHYIAWDYPPKQHPLILSMKDFNKMVKSGAPFARKFPKDDKVLDKIDRELLHRSEGRFTPGAWCDGSSEGGADPCLSRGEDSVFEPGPGAERLRGLMKKVLSWDYRNGSCSSLAYDQTKRDWYVPKSKG

SEQ ID NO: 56171 - protein, 123 aa, Sorghum bicolor
  Clone ID: 30938470.pep
RPHEFHYRRTQSAMDVPDRHTLRLPEHVMKELAAVRRHRRAASLAGYPDGGAERTPGWLASFWRSVSWQRPSRTDQDAVDEHGGSNSKRVVPITGTPAENPSGSGAAATDGKEKPDHDALNQV

SEQ ID NO: 56172 - protein, 88 aa, Sorghum bicolor
  Clone ID: 30938474.pep
YLICGLCVHFDIKFIFRGGGPVTVACCWGPHVSLGRCTAARAWRTPTKSNWNFDRRPSLFTKLAKFPLSWLFFILLYILKSIIIYSLK

SEQ ID NO: 56173 - protein, 168 aa, Sorghum bicolor
  Clone ID: 30938486.pep
FSHSYQIMRSLQKNFSDPQEGWELYDTMFVWNEFLTRGIRDILKTTLWTVALVYGFFKQDKLAICGKDIMLTLIARRSRHYAGTRYLKRGVNEEGRVANDVETEQIVYEDMLGPWQISSVVQNRGSIPLFWSQETSKLNLKPDIICKHWSHSMRKILFEHLKFFSCSA

SEQ ID NO: 56174 - protein, 143 aa, Sorghum bicolor
  Clone ID: 30938488.pep
TFQREQRTSQKTRLTALPLCWIRIGVERRAEKHPARDPAAPDVRTAKTKTGGQKTVAPRPTNPHATRHGPLTQRSLPKPDSAVVHARRCRGSPGVTCRKPLAVAAALPCHGRGSGDESAAFFFFFWRELCTGTVRRTEHKRRL

SEQ ID NO: 56175 - protein, 75 aa, Sorghum bicolor
  Clone ID: 30938506.pep
FTPTRFVDCYDLYTRSDDAMLPPLLWPSKCGKRAIACMYIFTDLVSCTNPGVKANVSCNSCLLLFSFLYHLGKQN

SEQ ID NO: 56176 - protein, 152 aa, Sorghum bicolor
  Clone ID: 30938551.pep
VMECYGKRWENQMEQKLYGAGLFLNPGKYFAIKEKDMRQARKLRCMFNDIVWKMVPDESEARKISKQADDYDRAGGESFSKRLAIIERNKKNPVLWWDAFGVHAFELQSLAKPIVSLCCSASGCERNWSAFAHVSAIFYGCRTAGTLMHFYM

SEQ ID NO: 56177 - protein, 104 aa, Sorghum bicolor
  Clone ID: 30938561.pep
RKSKPITPKHTTNSEKETNERRSSGKGSTSKGESAEAEQALPSKDELQKIIVQLLKKADFDKVTFSDILKMLGKRYKMDVSSMKDTVKSIILDELAKLAEADED

SEQ ID NO: 56178 - protein, 107 aa, Sorghum bicolor
  Clone ID: 30938587.pep
EARAAAASILPLLVLSQSPSEPASSAPASSAPALPHSRRPGQLRPRLQLRPRLPSPPARVAATGRPHFRPRELQPPVSARPPAPSPPPARAVGTSGSARLHQDESLI

SEQ ID NO: 56179 - protein, 163 aa, Sorghum bicolor
  unsure (1)..(163): unsure at all Xaa locations
  Clone ID: 30938595.pep
RRSPNGRACPELSPQFFLIXSASALPSLARSSLKMSNVMEHSAVSPVKSNLVRAQIGHRDEPDQGMEDSEGDRLKNRSSRSRRASWLARSAGRRCSARKASRSRHRVGVAHVRCDDGKTPLRRRPTRASSRGRRARPAPSARVLSSPVNHLAGGGADLFSPSR

SEQ ID NO: 56180 - protein, 121 aa, Sorghum bicolor
  Clone ID: 30938599.pep
EVKVGNNEDRQDARASEGDEIKMVEAKTDAGHAEVEGNEKKEDKAGQTEEKKNNATTETEELKVPDKEYACEEEDNNLKNEGIHDGKAADGEDMRSVEGKIDAEIAEVIESRKNGEVEFKA

SEQ ID NO: 56181 - protein, 91 aa, Sorghum bicolor
  Clone ID: 30938635.pep
VATRTFWADAGFSSSCSHVTVALPSPPDLLNLYLNPSRFVSIAAIPHLFLWFFGSDLLWLLLFLCKSASASLSLCWLLLCHCCACLGGLCD

SEQ ID NO: 56182 - protein, 158 aa, Sorghum bicolor
  Clone ID: 30938637.pep
NYSHNKQTKREVTVAKLASMHVLYSSFPTANFCLGKKPLLDHPSKPIINTSIKFNGVGLVLKSLKLSQHDNAFCYIILGKVSPYFLYGIWEEEFGPIVTEYCKARGRLKQHQDPPGIPQPFTNADGRRPSGGGGGGGGGVTRSIELDIQIVWSWSRSH

SEQ ID NO: 56183 - protein, 199 aa, Sorghum bicolor
  Clone ID: 30938649.pep
MARRRTAPRLAALFLLLLSTAARPTLAQPSNTTIDDHHSRTAVGGFTPTTVIVLVALISAFVILTVFSIYINRCAPTRAPPPRRSPSRYAPPDHHHAAAGGGAVVHPERRTRAGLDREVVESFPTAVYGDVKARVAAKSGPPLECAVCLAAFEDRDDLRVLPACCHVFHPDCIDPWLAGAVTCPLCRADLTVTAPYPPP

SEQ ID NO: 56184 - protein, 75 aa, Sorghum bicolor
  Clone ID: 30938651.pep
ACSPTSSSAPPRPRPRVRPRRRCARGRRSSRASQSPQLNCILRSIDMESGPLSSSSLNASCHDAAFDQLNSETNI

SEQ ID NO: 56185 - protein, 67 aa, Sorghum bicolor
  Clone ID: 30938687.pep
MATVVRHDSRQYSWLWVSHISPKNSKWLQENITDMDTKVKAMIKLINEDADSFARRAEMYYKKRPEL

SEQ ID NO: 56186 - protein, 100 aa, Sorghum bicolor
  Clone ID: 30938743.pep
ASSMIHCCNFWGIHFLQTNRAKCHSLRSILTITLSKKMQDTTEYCTLQAALPEILTGFSPSRRYLQLHLLPFFFSLLSFRCMPERSHHRVSSIITCSEQG

SEQ ID NO: 56187 - protein, 81 aa, Sorghum bicolor
  Clone ID: 30938756.pep
VSWDKENNVPPDKSLKVPYKIDGDKVGGYRVVLGDFNTKENSTKALKNMLCDLKWVLYWFIGTAMQVSTCPWINAEELGLV

SEQ ID NO: 56188 - protein, 65 aa, Sorghum bicolor
  Clone ID: 30938762.pep
PCYVCFTYVCYQIGYVLLLYDPTLLIGHPRMNLFLNKMNLFFYNMNLFWLAVDQLRNIIEMILDE

SEQ ID NO: 56189 - protein, 125 aa, Sorghum bicolor
  Clone ID: 30938772.pep
KAAKLDDAVRIFRKMQGNGVIPNAFSYWLLIQGLYKGGRLDDAVGFCVEMFEAGLAPNAETFVGLLDAVCKTKGVDDGEKLVRSFQDRNFAIDEKSIREHLDKKGPFSPVVWEVIFGKRKSGRPL

SEQ ID NO: 56190 - protein, 64 aa, Sorghum bicolor
  Clone ID: 30938794.pep
LEITIHTRTILNKILFSSTQKPKTFQDSPSHRILRHMQSIKYSQKQKLITQFTCKSRDKSFESS

SEQ ID NO: 56191 - protein, 120 aa, Sorghum bicolor
  Clone ID: 30938798.pep
DSNTIILYIRSLPSSSNYDLAYRTNQSRVQIMKQPHIFSGLIVQIAWFVCPSQSPICFYLAIPLIKQCNRPLLIWDLWLLYKWKRVLETHSNTKWIRVQHKKETMTFPFYSTMLTLVNLS

SEQ ID NO: 56192 - protein, 71 aa, Sorghum bicolor
  Clone ID: 30938800.pep
RCTKCNGSFTQKPLTLEEAVEASKGFQVIPSCLFNRNLEFWKCTDCNQLYWEGTQYHNAVQKFLSVCNISD

SEQ ID NO: 56193 - protein, 103 aa, Sorghum bicolor
  Clone ID: 30938820.pep
LALALCSAGGFFVLSSFPGRRKLAIQKVNKVADELSRKVDEAIQKDISQSANDVIRFVEVISKPYQEACQRKIDWLQGVQGELSAVERKLQTLKVEIQNLHGS

SEQ ID NO: 56194 - protein, 188 aa, Sorghum bicolor
  Clone ID: 30938822.pep
PNAYRNAQLLVDLKPKKCPQCYAINLAPSDVKSKGEGWESLVAEKMGNIGYAFNRTVWRKIHAKAKQFCAFDEYNWDITMWATVYPSFGAPVYSLRGPRRSATHFGKCGLHQGQGSSNVCVDNGSGAVELEDADKVPNIKTDWPVRIIQRQEGYQAGFKGWGGWGDRRDRELCLSFAYMYHVKDPSSL

SEQ ID NO: 56195 - protein, 75 aa, Sorghum bicolor
  Clone ID: 30938828.pep
VLCTFMPQHCFSYIPPTLCMYRSHLAACLLYLVPARKLQRNANEDEALDALAFDCLHLELLKQVLHRSTWQHDRL

SEQ ID NO: 56196 - protein, 105 aa, Sorghum bicolor
  Clone ID: 30938834.pep
CLRQGAGRKRTIVGGLIHALCGLPRGGAGLGYVGRGRGDYNVMLICIPPWMRSLMACRAPRLPLLQGGSSCHIKMDLRSGARLEQKFPIDELNSLVFAAISNRSG

SEQ ID NO: 56197 - protein, 78 aa, Sorghum bicolor
  Clone ID: 30938864.pep
PLQLHSIHGHFSSLTHQCRSCQVLLPLHSQQALEHLAAWWLHELLEVSYDHHLLQLLSHWHFDLLTAKEICTFTWKKW

SEQ ID NO: 56198 - protein, 59 aa, Sorghum bicolor
  Clone ID: 30938870.pep
PPSSHSSSTGTTPVAARRSARTSSTPRSLMSFDRCSLLQERGVVDMVKHYYVRQQLAPV

SEQ ID NO: 56199 - protein, 176 aa, Sorghum bicolor
  Clone ID: 30938872.pep
NCPAIGTNEQFIESSPGKIQFSQQLSCEQTCKIGSSLSPILNRTHHGEARRFCPHTGRPRRMRLACEVRQAAMSPRQRMEQGHGPPPAADADGPAAGRSRRMGTSGKDTGLWIASAGRAGRSGGGGSTRWSGAGGGSARGEERRRCLRASTTCARARSRVDRAAVRVEASEASGRA

SEQ ID NO: 56200 - protein, 202 aa, Sorghum bicolor
  Clone ID: 30938876.pep
MPMAVSTVTATHLAPSFPARSRRRRAAPRAAAGGLTARARRLRCEFVAGGGNGALSGEDDPRLVDRQKALDAAMNDINSSFGKGSVTRLGSAGGAFVETFPSGCLTLDFALGGGLPKGRVVEVYGPESSGKTTLALHAIAEVQKLGGNAMLVDAEHAFDPAYSKALGVDIENLIVCQPDNGEMALEIADRMCRSGAIDLICI

SEQ ID NO: 56201 - protein, 188 aa, Sorghum bicolor
  Clone ID: 30938912.pep
MEHKDKDKKDKHKRDKSSNKDVAQSSPSDAGDILSKQTDIIHNLKLEDTSCDFVTVYSDRAEITRTLKVAIEHEGVQQVVISRLSESVDENSDRVSGGACKATILEVAYEQKYITEPASTPSQQKIDRIAEIDAQISELNTNRDRVNKEREWLSNYSQHKAVVGEHNKLTLDEVSAFMNFYQEQLERL

SEQ ID NO: 56202 - protein, 57 aa, Sorghum bicolor
  Clone ID: 30938914.pep
NQDLISSSNKLNLLFIQENPSWLLDNSGIIRSNNKLLEKILRFYQYKCLKKPHQIQL

SEQ ID NO: 56203 - protein, 192 aa, Sorghum bicolor
  Clone ID: 30938922.pep
VVRANVDNNIEVISNFLLKNEQAGETISNLATSDKNKATITNLGHLYNVLANKSCLNVYTIIMFANFDQRNVQQETTTDEQRNAPGRLGVPNRVVLERQVVEVPIHVVHHPILIKERRRAGLATLPFAPAAATYTRHAGAPLAPAAELQPCGGSGGGTGEERGRRGRAGAAWAGRRRGWARAEKAERAHFLP

SEQ ID NO: 56204 - protein, 97 aa, Sorghum bicolor
  Clone ID: 30938953.pep
PAPPYPPSLPLSPHVALHNVQIPTMTGATTAAAAMPSPMPHAPPPSLSPILHSTPYATRTSTDVVAQQPAVAAAATRCAQFAISLKRLCSLSQVSSR

SEQ ID NO: 56205 - protein, 46 aa, Sorghum bicolor
  Clone ID: 30938957.pep
KRHTYDAQLLFLSSKAASSSGGVTSAPVASGQTPPSYVVRAGLGTP

SEQ ID NO: 56206 - protein, 173 aa, Sorghum bicolor
  Clone ID: 30938965.pep
MSLQIPVRSGALRRLLLLGGAGGLPRPYSTDDRRRRVIREARQEEEDEAFLRTLNFGADPENNPLPPPPRRGRGLSDASAGKQQQQPERSAQKVVGETLLQKLKLGDGPSAAAAAATGGGDELRQPEDEPAPAQPVDVDEIFRKMKETGLIPNAVAMLDGLCKNGLVQDAMKL

SEQ ID NO: 56207 - protein, 128 aa, Sorghum bicolor
  Clone ID: 30938975.pep
MQTVDKRSKYLYNGESRNMAVTQFEAADARRCFPCWDDPAFKAKFKLTLEVPSDLVALSNMPVAKETVSGSIKTVYYEESPLMSTYLVAIVVGIFDYIESSTSEGTKARVYTQVGKTNQGKFALDVAV

SEQ ID NO: 56208 - protein, 196 aa, Sorghum bicolor
  unsure (1)..(196): unsure at all Xaa locations
  Clone ID: 30938987.pep
MSDSNPAAAASSKRPCDPSLDDPTPSAKVQRSSEPSDPTPAVKPNGGAETGEESEVMTGVRNPRAQRYLVAVEYIGTRFSGSQQQPNQRTVVGVLEEAFHRFIGQPVSIFCSSLXDAGVHALSNVCHVDVERISKRKPGEVLTPHEPGVVKRAVNHFLLKNEGDIMVTDVRCVAPDFHARYKALERTYHYRLLSGP

SEQ ID NO: 56209 - protein, 49 aa, Sorghum bicolor
  Clone ID: 30938993.pep
FHKVAKEGLSLTIQLAAALMVSAMLSLTPKKVQDKNIFHVISTYSNFMS

SEQ ID NO: 56210 - protein, 208 aa, Sorghum bicolor
  Clone ID: 30939013.pep
PTGKDLVYGANNYAIKLKSDSNSWQNQISSLIERAKGRAVTLMGSTLQLSNIDLIFTYTVKGKTGSSTRATSFVQNDILSPTLDDAVNLLGDYSTWLSSSNTREAKVYLECFSARWDALVGPEERALLDPNGLVNEGEKLTIKALDGFNASAAAKVFEEEIREVAFGTFGGLGIAGLSASLLTSVLSTTLEDLLALALCSAGGFFVLS

SEQ ID NO: 56211 - protein, 163 aa, Sorghum bicolor
  Clone ID: 30939023.pep
PARGGRPSARQRQPSSSSSTHLSARAARAGHWRSLPSATPVQQMGTPATRDPNGRHPKPRRVRAGLPMVAGAVAPDTASSRRAVLSPVLHETLGVCSSSLYPPPFHTDSPYPSALGGPSQYHGYLLWLHAEYCWDEDYGGFGQIQCPYGWNHCLLARSRAAAQ

SEQ ID NO: 56212 - protein, 170 aa, Sorghum bicolor
  Clone ID: 30939046.pep
WFFEKDVWDYFLSYLGIGKAEYNSVPSDGDKVEGEVKFSFPCMIEERCHILEVHSRVPAFFRVKEVAARAALLFMESKFNVKIVDLNYVGRQTAEKEHKSVEFIIYRLLEVAHQMKTQLGNMVECIAGGRAAYSGDPRLMFGGPLFQEQMMAVEFCFKNVEVVRADCAPR

SEQ ID NO: 56213 - protein, 91 aa, Sorghum bicolor
  Clone ID: 30939060.pep
PPNQADKSEFNPFLLYLRLKISIPIFKFHSRFRLHAYSIKTHPCPWVRPNQKAETGIEGNLLPVTTQHHHNQSVWCSTSTTCPVPYNMREP

SEQ ID NO: 56214 - protein, 93 aa, Sorghum bicolor
  Clone ID: 30939070.pep
HGCSTTDLITGCLCKASLESQFKHIFKLKKAIESVLMQDPCHLGKIFFLVHTGLSCGGIQFRFVQSIDRSVSIVFFRVSPLYMCRKLCIWGGR

SEQ ID NO: 56215 - protein, 97 aa, Sorghum bicolor
  Clone ID: 30939116.pep
LLPKCPPAQYLFCCCCSCRNFLLRSPWIIIFILPIIDRRQKGVCVSTRGAEQSDKEAMYHHLFIWVCLVVQLSIPDSQWMIPRSPLCLSTIVGTCSL

SEQ ID NO: 56216 - protein, 83 aa, Sorghum bicolor
  Clone ID: 30939132.pep
KTCALEQVIKGIYVCVILSCLVRCKLFCCSKITMIDLRRIHRLYPDEARIAHVARENGKFCSSKGNNCLRVGFQVCASHCFKV

SEQ ID NO: 56217 - protein, 130 aa, Sorghum bicolor
  Clone ID: 30939138.pep
RAGLLDEAWDLIQTMPMPPNGVIWGSLLASCRVHGSISIGIQAAEHRLKLEPSCAATHVQLANLYGSIGCWDDVARVRKVMKERGLKTNIGCSWIEVGNKVYTFTAENRSKSQETSVILYWYALYSSTNL

SEQ ID NO: 56218 - protein, 82 aa, Sorghum bicolor
  Clone ID: 30939146.pep
FPFANDWSSRPNIISFEGVSETLPVCWGLIWTAWIWSRRMGAHICGSLSGIKWPANGYEDLIPFPSNLIRWPVSLAILFLHI

SEQ ID NO: 56219 - protein, 62 aa, Sorghum bicolor
  Clone ID: 30939169.pep
KMQASSFILIVSLLMQKKGISGLVKAALLSALQTTFSFHPHTGKLLLFIFFFNVVLLSLRYI

SEQ ID NO: 56220 - protein, 108 aa, Sorghum bicolor
  Clone ID: 30939174.pep
PVPQCLLAAAALVLCLFPCCYANAKCYCYAASLLYYKIKLVCACGMCTPMGIFLDGPLLTCTHISSATVISNAMLCVRVKRALLTQAQTKHSLNAVTFSQIIPQFAPP

SEQ ID NO: 56221 - protein, 107 aa, Sorghum bicolor
  Clone ID: 30939212.pep
VMLGPSIQIRVEKLLDACICWAEAEVFARALLLSFFNCMYACSGKEAAVVALFFLRSDGMQLVSHTMQCRFSLSCGSALKSGKRHGGHAFVRRKLHGSSQGVLLVGF

SEQ ID NO: 56222 - protein, 174 aa, Sorghum bicolor
  Clone ID: 30939221.pep
LIFSLPQAPRRLLHHAACRPHRRPGPSSLLRRCSTTPCHRANSSPSHLYISPCRCVCRRTSPRGRSSSTSHPPPRCAAIFFAARSRCLVGFGSMEPSGSGGIEEHLQELKKCTRSVLWFDASSSCLDFMVSVASQDGLTQNCCCCPCHPYHQLQTQQQPKITTPPHRTLICVKQ

SEQ ID NO: 56223 - protein, 135 aa, Sorghum bicolor
  Clone ID: 30939235.pep
MAAAAPPVAKKVPRQLVEHGDVRVDNYYWLRDDSRSDPDVLAHLRAENDYTAAVMSDVKQLEDEIYAEIRGRIKEDDIDAPLRKGQYYYYERTLTGKEYVQHCRRLVPTDAPVTVHDVMPTGPDAPDEHIIMDEN

SEQ ID NO: 56224 - protein, 174 aa, Sorghum bicolor
  Clone ID: 30939257.pep
QTPRRASQQQQQQWRASPRSSPPRRSSPFPPPPRPRPRPRPPARAASASAPPSSPARRASSRVAGARSGASTRWRGCRRSGAASEEVGAGGSPPSSSRRDRGLAVDFKESQVADFDDLEEDKFLNAVVKVYCTHIAPDYGLPWQKQRQHSSSGSAFMIGDGKLLTNAHCVEHDT

SEQ ID NO: 56225 - protein, 130 aa, Sorghum bicolor
  Clone ID: 30939265.pep
MGPAAGSGVVIRAAAVGLVLVGIALAPPLAAALRPLRERVASVGAAASAGSWGDEHAFFKRDENDIGPYSWNITGTYKGSWTFAGATNGSSRFLEFVESKGDSVLELLSTPTKISGVHYVQGSITFHDVI

SEQ ID NO: 56226 - protein, 76 aa, Sorghum bicolor
  Clone ID: 30939350.pep
DGLACTNTGSYITAAMHHQHQKQISKQDRQGGNQQPTLIYLLPPSDHVLHRPSNVFFLMMRGASAQSFLLLPLYCE

SEQ ID NO: 56227 - protein, 81 aa, Sorghum bicolor
  Clone ID: 30939381.pep
SWESSLTRRGRYGGRTRGRKPRKTVVTVIVEEEEVEVSPPPKPVGTGDLEADDRGMIGWGRTTRRCRRTRCPSGNNMATAS

SEQ ID NO: 56228 - protein, 86 aa, Sorghum bicolor
  Clone ID: 30939383.pep
GSVLIRVVNRVTARHGAGTGWLDGASLSAGRLDLFYWLLALFGLVALLLYLLCAWRYTYRYHPSRMQSAMEDHRVSPASKKLDAAL

SEQ ID NO: 56229 - protein, 114 aa, Sorghum bicolor
  Clone ID: 30939430.pep
GSDRFGDRYMDDRYDGGRYGYRDQVDARDRYAGGRDRYANDRYPSGGDHFGGDRYGGGPDRYVPGGYDRDGPRGGVADRYGGGGPARNDGGSYRDRPGPYDRPGRGGGRFDDRY

SEQ ID NO: 56230 - protein, 124 aa, Sorghum bicolor
  Clone ID: 30939523.pep
VLRRDDDAGPPGAIGAAQPDQGPLHGDIHRRGPVLGQSPHLWWRWRSNSNPLLLLLLLSGNLISPLAQGEGLRRRGGHRPRAPLPPWWREARRSSGVVGVGEEGEKRVLVSLYYSSSPHGVHSS

SEQ ID NO: 56231 - protein, 143 aa, Sorghum bicolor
  Clone ID: 30939531.pep
MSLRKRQRSASSSRLAAFCSPPSPPLPSSISTSPDSLTFPNADVILRLHLDPSSPDDVDAIPDTDCHLSAASSGTFLDLQVSSASLLRPHYFAALLSDRWPTAASGRLSLAVVAPPSCPRPFDAHIQVLRLLHTLDFAGAIRS

SEQ ID NO: 56232 - protein, 125 aa, Sorghum bicolor
  Clone ID: 30939566.pep
EYRAHEQPRWQQHAHDPATPPQPWQVPPPKSPAKVGFLRRKGANSTGREQSSSTHEGIAADPGWGSGKELDLMGQGGGTGGGRERGRRRERGGEEEVRTGGFLFLFCLNKRLRGFLSPFFPPFSS

SEQ ID NO: 56233 - protein, 157 aa, Sorghum bicolor
  Clone ID: 30939568.pep
MALQCLVDWKGRPVNPNRHGGVKATMFIYFLVVMTNIGNIPMLLNVVSYLHGKMHMGIADASTTATNFFGAICVFTFFGAFISDSYVKRFYTILIFAPIEILGYMLLACQAHFPALHPPPCDIVNHPSECTAVSGRNLSLLTLGLYVIPIGEGAVRV

SEQ ID NO: 56234 - protein, 114 aa, Sorghum bicolor
  unsure (1)..(114): unsure at all Xaa locations
  Clone ID: 30939573.pep
MAEKEGNLXVLKEAVDLENIPLEEVFENLRCSREGLSTQQAQQRLEIFGPNKLEEKEESKFLKFLGFMWNPLSXVMEAAAIMAIALANGGGKPPDWQDFVGIITLLVINSTISF

SEQ ID NO: 56235 - protein, 67 aa, Sorghum bicolor
  Clone ID: 30939581.pep
CLHGHKRNQSLHILKPTTLNSQLSLCLFSVFYLKVDNDRGRCCKASDIFCMGLSRGICVGSTSNLIK

SEQ ID NO: 56236 - protein, 97 aa, Sorghum bicolor
  Clone ID: 30939641.pep
NMNVMLHTRKKKVAKIHSETCRIISQNYITRNIICCPHTSTTVSFFVCSHKIVWRLENIHTGEHHMHLSMLSSLHPCKRDFLQGTLPDFVASCKRAK

SEQ ID NO: 56237 - protein, 144 aa, Sorghum bicolor
  Clone ID: 30939657.pep
LQLCNGRKIFSVRCSPESFIVQVGEAADILSQGKLKSTLHAVSRPLSSMDISRETFVVFLQPSWDKTLAYPGYSLDEGESILSKETSAISDGSAGPCDEDAFMQGILKKIPPLSSRLKEGMTFAEFFRQTTKQYYGGSGIQQNN

SEQ ID NO: 56238 - protein, 118 aa, Sorghum bicolor
  unsure (1)..(118): unsure at all Xaa locations
  Clone ID: 30939660.pep
AAETIDHLLVLPVFAREFWFQLFSQIGLRAYSPQPTDISFHNWWERVSNAAGEIXRKGINSLIILGAWTLWTHRNKCVFDGAAPSVAGALAVAEDERRSWSLAGARGLSLLATFASGA

SEQ ID NO: 56239 - protein, 96 aa, Sorghum bicolor
  Clone ID: 30939688.pep
SISTKRGGQFVIDPATFPEAAAGAAWPFAGGFVMGSTVEGEGRASRPTVQVGVQHVTCMGDVAVFVALSAAVDLCMDACKLFSQRLRKELCQDQDE

SEQ ID NO: 56240 - protein, 50 aa, Sorghum bicolor
  Clone ID: 30939692.pep
QNNFVVPRSSGESSRKHRWGHRGQLHYMIRIFLCSNSILQRILQNFVGVS

SEQ ID NO: 56241 - protein, 90 aa, Sorghum bicolor
  Clone ID: 30939720.pep
MLKGEAKLWGRLQLQCPSPHDTATVARLVYLPSHVVFHPKTPARERRRATTGAPRGARARVHPRGMASRNLPCTAQHKNTVMLYPSTCSH

SEQ ID NO: 56242 - protein, 86 aa, Sorghum bicolor
  Clone ID: 30939742.pep
FRNPELHSVSRQQIGSPESIGRLCYPRNPNRTPRHRSWLGTWEGQIRSLNPGEEVEHAPELLLVHGRRRRDVSGDGLGAQGEDGLE

SEQ ID NO: 56243 - protein, 126 aa, Sorghum bicolor
  Clone ID: 30939749.pep
QCAALAAEFRPQFRGKKDLTLTPHPEAREGGGLAYSAGAGGEQEEVTDPPYQNPRFEGRGSSGGRSRGEGDRADSPSTTSTARRPPAAGPRNTSRREPLRAFLPRPSRRGGGGEREGKARRLEPGD

SEQ ID NO: 56244 - protein, 160 aa, Sorghum bicolor
  Clone ID: 30939787.pep
MASPAAAAAKGSKGGEDGGGPVTGDMVSAGFAELERQQQLLATCTRLYQQLADHFGSLERGLAARSEQLRVRRRAFHARTHRALDSLHRREASVDTSVSRALDHLHSISKEAAAAPAPTPSDSAASEEGLAESLRALCLRMDSSAFLGYVVTHRKEADAL

SEQ ID NO: 56245 - protein, 43 aa, Sorghum bicolor
  Clone ID: 30939823.pep
KKRMVTSVLDITKGKSSTKTNRTRSRVDKQITRTKLLNKESIN

SEQ ID NO: 56246 - protein, 210 aa, Sorghum bicolor
  Clone ID: 30939842.pep
YWAATATALDIAEIPFSDLVVLLSPDTLADDGRCRRVVDTVATELGRGGSGLLAIAGVPRVGALRRRLLPLARRLALMDHPTRSQLLKKHGLGSDVALKKLDRSVSSFAQLLRHSGELTLLESVNSNNGFNSSDKIQDCNQPEEANGDDDMENLGDLVMELGLYMMELGILVARACDIVIGRGHLEQSITDLGTAKARLIHYHSELDNSI

SEQ ID NO: 56247 - protein, 95 aa, Sorghum bicolor
  Clone ID: 30939844.pep
VVCVLVSLLFACVGILGTNKWYQSCTAVLPDLPPAMAPGSETADSSSVAGAAQPRQEVVVHTVREVSGISWPMLTRTNYGEWAVTMKVKLRARRL

SEQ ID NO: 56248 - protein, 96 aa, Sorghum bicolor
  Clone ID: 30939888.pep
CGCPRVLLPLNSPVRTMAAPMTARSGHKALAKAGSHRRKDETHLGRRRNLIRLHHDSGVLRSGQHHILSEVARSPRSPTEKAGSPSPSAAATLTMT

SEQ ID NO: 56249 - protein, 186 aa, Sorghum bicolor
  Clone ID: 30939946.pep
HYPDHIASILKLVNGNFRSHPCLTNQKLLYAPMGEVFILQPDEKLSPHHHLLPAGSGLYLIGGQAVDSDTSSSVLRSALSAFFNSPHPLEILRDAGAYGPKGTVYRDHDVHSYLRSIRAVLRKEMRAEKERRRRLLRWPIEVYGALATMDRRHVLRQLRRHAHLLVVFLLPAKLLFLGVLSVIRPN

SEQ ID NO: 56250 - protein, 79 aa, Sorghum bicolor
  Clone ID: 30939952.pep
EQAEEKFGYLLECFDMGAPPHGGIAYGLDRLVMLLAGESSIRDVIAFPKTTTAQCALTKAPSAVDPQQLKDLAFPNSTS

SEQ ID NO: 56251 - protein, 65 aa, Sorghum bicolor
  Clone ID: 30939970.pep
QSFIDSPTFKKKASYVEHIGGEKPFPGETPSHQSMKKSAYATPSYSRTSSSKSPATNFTSIVESN

SEQ ID NO: 56252 - protein, 59 aa, Sorghum bicolor
  Clone ID: 30939999.pep
LKITLTISLALLICSLWIEGWRLDYFLVSESIAEKVHDSYILPDISASDHSPLGLVLKL

SEQ ID NO: 56253 - protein, 184 aa, Sorghum bicolor
  Clone ID: 30940019.pep
RHTIRTQESERERSSSRSIHDRHGDRHCDRRGSQERYRDDRIDRDKIDSLEATRRHRERSRSHSRSDLRESTRLCDQSRERERQSGSLRHRDHDSKSDTSKDRHRESGRVSSAHERERGRDARDREWHRVKGSETHRAKEGRDKVSDGDRHRDSTRSKYSVSDGYKERTRSGEKGRDVDHKNRK

SEQ ID NO: 56254 - protein, 56 aa, Sorghum bicolor
  Clone ID: 30940021.pep
ILTSFRDTCYIEILPVVEKSRRVICLSFWAEVHYNSIYPEGELPVLENKKKSWWPF

SEQ ID NO: 56255 - protein, 200 aa, Sorghum bicolor
  Clone ID: 30940051.pep
MPAAAAMRGDITYSGRARRVAVLRCLVAALVVTILLAGVAALIFWLVVRPKPIDYTVTRAVARHFNVTPPQPDDATANATFYLTLAANNPNRRVSILYEWVEFRVLYGEGEAQLATGEAPAFAQPHRNETRLDVRAVARSVHVGEQTARELRQDLAAGQVGVDVRMHARVQFKVAGVRSRRYYIEAFCSPVVIGLAPSSA

SEQ ID NO: 56256 - protein, 60 aa, Sorghum bicolor
  Clone ID: 30940054.pep
PQCPFHHSPPSSCSSSSPPPPPPPPEATRLRRSWTTSSTLLTTPTTSPPTTPMGGLRAAA

SEQ ID NO: 56257 - protein, 114 aa, Sorghum bicolor
  unsure (1)..(114): unsure at all Xaa locations
  Clone ID: 30940064.pep
PYPPLSPSPWPPAESPPPPPPPPPCPPHPPPSTLARPTTPSPTHLXAPQAPPSPPPPPPPPSAPSRRFPGTRGSRRRGRGGGDTRRCRRRLCHGGRCCGRSPTSFPCSDAGALW

SEQ ID NO: 56258 - protein, 118 aa, Sorghum bicolor
  Clone ID: 30940075.pep
KTHTAAGGGRVHLLSVSSPCLAPVDPRPRILVVHPHPSPKPELLHPLHLVVAAPIFGAIIPILCPMFAEGAKNGLEFTIARPFNWIGPRMDLIWGVNESRGKHSYSHEFHIAHILKIS

SEQ ID NO: 56259 - protein, 94 aa, Sorghum bicolor
  unsure (1)..(94): unsure at all Xaa locations
  Clone ID: 30940147.pep
LQRGENVLHYKTITAKGKLIFNMKVKTIYIMKLAQKYISWKRKCSLYFSESALQCTVVTTKNSEEVIKIMXYVVFVGINCAYAFTRIYFSVGHT

SEQ ID NO: 56260 - protein, 172 aa, Sorghum bicolor
  Clone ID: 30940151.pep
RATPSAATSKTRPDRAPPPRQPPSSLPRCPVWRRTSPRAAGYYSRPPRPRLSQEAPSPRRATATAAATTTARAVSAAPSCCRRPCRPRPPRPPPACDGDDPSPPRRPPPPRPPRRGSRRGEGWQRRRPDADAGHESQDVHGGPVWVAPPSTVRIFLGGERSTQTNGKGNGNW

SEQ ID NO: 56261 - protein, 178 aa, Sorghum bicolor
  unsure (1)..(178): unsure at all Xaa locations
  Clone ID: 30940157.pep
MASSLLRASPFSLLSRLKPRSSALHLRRLLPLSTTSTSASVPAPQLRTLASAAATDAAATPPEEAAAPAAAGAKVERLQPLQWPPRDALCGELGAGDAGRRVRLCGWVALRRAHAGLTFLTLRDRSGMVQCXVTTLTEYPEVYNIVNKLRVESVVAVEGVIQPRPVDAINADMKTGAI

SEQ ID NO: 56262 - protein, 152 aa, Sorghum bicolor
  unsure (1)..(152): unsure at all Xaa locations
  Clone ID: 30940174.pep
FTEGKEIVRPGVTRFASTFLTLNSILEKKDQLRKKVVLNRWDSLRDVKSKKGKDATAIVLNPTFWKDVKLTVSVFEPLFKVLRLVDGDXKPSMGFVYGEILKAKKEIKESLGNNESRFKEVIAIVDKKMKGRLDSPLHLTAYLLNPHYSYAN

SEQ ID NO: 56263 - protein, 200 aa, Sorghum bicolor
  Clone ID: 30940176.pep
HQLQSTQASSNSVFNYLQKGQDWTVEGSGTEQTPINIVPNTATMANETMKMEFFLTDHTLSNIKVNDTGVALTAFGPFSKLRATDVDGDVYEFEALQFHFHAPAEHTINEGQYELELHIVHKMTEESAKRAKTNRNLAVVAVFFQLDKDPRATPNAFIDALKLDKCGCDIDLNMHELLGQDLGEMTSFFAYKGGSTTPPC

SEQ ID NO: 56264 - protein, 131 aa, Sorghum bicolor
  Clone ID: 30940181.pep
MSTSYTEAQFGSLFDLPAGDDLTSWFTHLCAEEQAAALPAFQAPVAMADPSRKRSADYHQLLEGEASGVKRQRSPTTSSRENSAGSNDGDHEHSSGAAPGGAAAAAGRGGGRRLWVKERDHEWWDRMSSPA

SEQ ID NO: 56265 - protein, 224 aa, Sorghum bicolor
  unsure (1)..(224): unsure at all Xaa locations
  Clone ID: 30940203.pep
MPLLLRGASLLRLYQCTCGLRSANFSSRVPALVNLITTRDRTRATYSRRAASKNSEVNKDEQPVIEKEDAAESDLEIESVRXNGDEGKSSIELVSPSEIPLKRKSGASVVIEQKLESSEIISETPSKKRSRTKQKSSKSTTLEENSVTNVKLSKTIVQKETFVVQGAVPNDDSEPWTVLVHKKPQAGWIPYNPKTMRPPPLSKDTRALKIMSWNVNGLKALLKS

SEQ ID NO: 56266 - protein, 40 aa, Sorghum bicolor
  Clone ID: 30940232.pep
DIQIGSPRSSHHHSTPVQKVSQGGNVGHLHRLLSVASSSQ

SEQ ID NO: 56267 - protein, 92 aa, Sorghum bicolor
  Clone ID: 30940243.pep
LRWGGVSISQEKCLDYRPSLSNLLLRSVLIPPWETGSSRELATYHWIIAILIPKGISVINPLHKTLRELLRLNFSKMVFHDVRSYATNDILS

SEQ ID NO: 56268 - protein, 173 aa, Sorghum bicolor
  Clone ID: 30940279.pep
TLLGTVLSFGNRSFGSTLSRLPSPEVYGDTPLVITRGKNYSAQNMPEFLAAIGFAGDEVERYRTRTLPVTLNFRAPLVPVTSINGVGVPTVHRLIYWDGNFSAKPQVVNGDGDGIVSLDTVLALQTFVGDDPDQRYFKSVLIPNMTHTGMISDDVALSRVVKEILEANQATSS

SEQ ID NO: 56269 - protein, 70 aa, Sorghum bicolor
  Clone ID: 30940293.pep
ISQCIRHVGEKLGILVGSGFCVNISQDACCDRIPIRVHRHLRRRMMTRCQDGVVVALPVLKIMLSLYPML

SEQ ID NO: 56270 - protein, 92 aa, Sorghum bicolor
  Clone ID: 30940311.pep
QILHFLGGMKVKADTDESSPAAMLASQDLAQRCKELGITTLHIKLHATGGNKTKTPGPRIFLHYSFYHVECKKIYSIIFYASKFDKKQNVFE

SEQ ID NO: 56271 - protein, 107 aa, Sorghum bicolor
  Clone ID: 30940343.pep
RFHSLPILSRRTHALAPLVHSRSARPPSRARALPCVCAGHQTKPPAEGFCSFACRRAACPLCSQRRLRRPGVIGRLLLVLWSAGKMILRLQFLNLIGDNGRCTCRFL

SEQ ID NO: 56272 - protein, 103 aa, Sorghum bicolor
  unsure (1)..(103): unsure at all Xaa locations
  Clone ID: 30940415.pep
ALLQEASRRRSPPRAPLASAAAPLRVRVLLLLARRRRFGLRLQRLRWLFPRDFVAPLLSRAEFVDFIRLLGSLWRXGMACKEXGXXXEFDGFCILYHRFVIQP

SEQ ID NO: 56273 - protein, 165 aa, Sorghum bicolor
  unsure (1)..(165): unsure at all Xaa locations
  Clone ID: 30940428.pep
IFGHPVYQVTRTSMVELANSKTRSTFQNSKDESRYRKILNALDLRKDFFFSYSYHIMRSLQKNLTDPQDGWTLYETIFVWNEYLTRRIXXXLXXTLWTVALVHGFFRQDKFSISGKDIILXLIARRSRHYAGTRYLKRGVNEKGRVANDVETEQIVYEAVPGPTE

SEQ ID NO: 56274 - protein, 62 aa, Sorghum bicolor
  Clone ID: 30940436.pep
LASELLVAKLTTLRSSLAPNAHAPQNNPASLSPHIARKSNLFGPNQPPNPPFSSLHPVLNPL

SEQ ID NO: 56275 - protein, 146 aa, Sorghum bicolor
  Clone ID: 30940444.pep
AGSSGKNLSHLGHRTSRIRATASAAAAAGSPSIPSVRFSPSTEKFHLLGPSSHKNSCRRRVRINPRNKQEGDAQESPKKLKVDAEPSGIKGSDQPRAPRTAAWPPDGATAARRSSVWCVGEGAELLKPGTGERQRAARAGARRWWR

SEQ ID NO: 56276 - protein, 97 aa, Sorghum bicolor
  Clone ID: 30940457.pep
PTGKSPDTRMWEQAGSAVHHTLASSASQLKTPPPPLQELQQLPSKCPPSAEPSGGDADPKDLRHQHLEGALAIADSRRHQRIRGHKRGSSTMACSSR

SEQ ID NO: 56277 - protein, 212 aa, Sorghum bicolor
  Clone ID: 30940461.pep
MEAQQQRLTTTLVLLLAAVLFVSASAPSSSEAHEATPGLHPVILLPGYFCGQLDARLTDEYKPPTPGCGVPKQGRRWFRLWENFTALQEDPALLPCYEDQLRLVYDHAAGDYRNLPGVETRVVSFGTTRSFFFDDPAKKNTCMERLVEALEGVGYREGANLFGAPYDFRYAPAAPGVASMAFADFSSNLRLLVERASVRNGDKPVILVTHSF

SEQ ID NO: 56278 - protein, 83 aa, Sorghum bicolor
  Clone ID: 30940497.pep
ERKPKTKFYWPTSSEKAGSVYICNLYKYGGPILLGGQIAPSHWTFDLSPLEGTPRSLIPTTAKGSTCTYGHCDLPSQYYYLIL

SEQ ID NO: 56279 - protein, 46 aa, Sorghum bicolor
  Clone ID: 30940512.pep
LNTAASSKHAINAKHIPIQKGRPEIYIHHISSIINRSNNQTRMSLT

SEQ ID NO: 56280 - protein, 91 aa, Sorghum bicolor
  Clone ID: 30940535.pep
FDISMSMTCETKSSTTTCANLIFMCILTQNLIRDNFRITIQVKEFHKQFKYLLINTSLSIMDILSTHNICHGYNCNFIISMITSRAYSQHI

SEQ ID NO: 56281 - protein, 135 aa, Sorghum bicolor
  Clone ID: 30940578.pep
GQGQHQTYALGIKEVWEIEKGKHKPGSVIHTGGWPFDTKTYGGSFLYHLDDKQLAIGLVVALNYRNPFLSPYDEFQKFKQHPAVKKLLEGGTAIQYGARTLNEGGFQSIPYPVFPGGAIIGCSAGFLNVPKIKGT

SEQ ID NO: 56282 - protein, 80 aa, Sorghum bicolor
  Clone ID: 30940582.pep
CMSVSAACTNGLTKFEYKMKWKMMLIAMFFLLHFSKVEGRVFGQWRLSMRFSMLVDLLSTCNPLFIWIHTLDKNIRIKLG

SEQ ID NO: 56283 - protein, 110 aa, Sorghum bicolor
  Clone ID: 30940594.pep
FQGFVSPADRTYDALGLVKHLSKPSAAAAVEACEVLASGNRTFDKENKDNSDGKEPVARKSQVKIMAEAGVLDFDEFSTPARTADKKFGSCFGRFVSSPIFPSPNLRSFR

SEQ ID NO: 56284 - protein, 88 aa, Sorghum bicolor
  Clone ID: 30940626.pep
WVFEQGDCVIVKSFNEKRMRENLDIFGWELTEDDRRKISGLPESRGTFDFFVHESGPFKTAEEFWDGEIVAGQSTNQVAVRLDPTSLQ

SEQ ID NO: 56285 - protein, 70 aa, Sorghum bicolor
  unsure (1)..(70): unsure at all Xaa locations
  Clone ID: 30940630.pep
MLARFNFYFSSIQFSGEISFELKDPACIYVILKKPDDLNALSANIIKXLSEVENSMVPCKPPSNAPTPFP

SEQ ID NO: 56286 - protein, 195 aa, Sorghum bicolor
  Clone ID: 30940634.pep
LLAMVPFVVAQEMPVSVLSGVSSAEQKLHLISDAESLKSELWKDVSLQTLISGVTVDADASRLNHPDSSKMDTNFLTQAYPLHTSNPSGVMETVYEPMPSETISPSFICSDGLSVAPENRSEPREMPDCEAQMATSSNIFCDGDQSAIPGSSDDRPEAFTMTESITNCGGQQSTDAEEPMATTAKEQLSKDIETV

SEQ ID NO: 56287 - protein, 77 aa, Sorghum bicolor
  unsure (1)..(77): unsure at all Xaa locations
  Clone ID: 30940640.pep
MTIDMSMPGSSGLLNAAGKRDMKXFSNPYXLALTGAAGIGGFLFGYDTGVISGALLXIRDDFPAXRDNYFLQETIVS

SEQ ID NO: 56288 - protein, 193 aa, Sorghum bicolor
  Clone ID: 30940720.pep
NFYNNITCPNPTAIGIDLGTTYSCVGVWMNDRVEIIANDQGNRTTPSYVAFTESERLIGDAAKNQVARNPTNTVFDAKRLIGRKFTEDVVQKDIKLWPFKVESGPDGKPLIVVKHKGEVKKFHAEQISSMVLTKMKETAEAFLNKPIKDAVVTVPAYFNDSQRQATKDAGAIAGLNVLRIINEPTAAAIAYGL

SEQ ID NO: 56289 - protein, 199 aa, Sorghum bicolor
  Clone ID: 30940752.pep
NPRIESRPNPRPHALPHHPHPALTHQHPLRSSLRQSTAQPIPPHVFGAMTAVAAPPPPRQLSLEDLKAVSVLGRGAKGVVFHVVHAPGGEQDGEAGAAAMALKAVSREAARHKKAAGGDGDGHRRIWFERDVLLALRHPLLPSLRGILATDAVVGFAIDRCGGGDLNSLRRRQTEKMFSDSVIRFYAAELVLALEYLHS

SEQ ID NO: 56290 - protein, 199 aa, Sorghum bicolor
  Clone ID: 30940785.pep
GSYLFPVLLPEVTAMPPPLAPPAPLAPPLPLLLSPSSLHPDALSRCLSRQPQGEGAHDAVSARAGPCPCPCLRLRADHAPGTAPAGERAPVARHGGCRRGPVQSWWLTHDRPARTPARLAPGFLLKTQWPELCLLIIEKSVSSQDPESLLESGFPCGLFVRAVLYLIKCYGGVQLAKLLKRRVHRITYWPRKTLVESNL

SEQ ID NO: 56291 - protein, 169 aa, Sorghum bicolor
  Clone ID: 30940787.pep
RATRPRGRQVDHAARQPAASARPAALRHFPFSLPPCRRSPVLPAADSLPRLSSRALRSQVPVAGSTSPSSSRGLLLLPRAWPQAPSRRRRWPARGASPVDGDSSTGASPHRLYESMMISTDGRNEETDTDSLNVARGLSHPGLSSSLSNKASVAPTPLLPSGPSDLRFN

SEQ ID NO: 56292 - protein, 198 aa, Sorghum bicolor
  Clone ID: 30940793.pep
RAKGEQPVTCRRAQWGPGARTAGQPPPQGPEDDFFDQFFSMAAGGSYPAATAGGGRAPGDQPFSLALSLDAAAAEASGSGKHADGGKDREAVQLPGLFPPVFSGGVQPPHLRPNPPTQVFHAQQPKQGGAGVGPQPPAPRPKVRARRGQATDPHSIAERLRRERIAERMRALQELVPNTNKTDRAVMLDEILDYVKFL

SEQ ID NO: 56293 - protein, 77 aa, Sorghum bicolor
  Clone ID: 30940797.pep
TTIPPRNRSTATDGSRGGIEQRQETRDAPKSADGDLKNGGKRGGIFTGGFDERRRLRRIGRGSPPSLPPAANSCFSR

SEQ ID NO: 56294 - protein, 89 aa, Sorghum bicolor
  Clone ID: 30940836.pep
DRVRDALHIGVKRAMAVVCSGFSYDMEVVSHGFITDISKTDAENEERLHALIDDVEAPGERLAKLFEPEVLPPETSSGGGEGGEDRATN

SEQ ID NO: 56295 - protein, 104 aa, Sorghum bicolor
  Clone ID: 30940838.pep
PTSDMAATWLMEWGLLPLDVATKVFEKKQGQKFKSPVKTIVAKRKPCSPTPTKALPSSAKKSVVSVTSAGKQPSQKKRKASDDTDDDDDDDFMAPKAKTKRHKA

SEQ ID NO: 56296 - protein, 101 aa, Sorghum bicolor
  Clone ID: 30940860.pep
RCCKLNPLLLVVLCKLRSSGGSKPNIGEYSLHPGLVSQLLDWSIRLVCLIQAHGCNLFETLLVTFAAVLTDRSCDADNLDGVLIGAWLRAMLSRKSLQPMP

SEQ ID NO: 56297 - protein, 101 aa, Sorghum bicolor
  Clone ID: 30940872.pep
NSSHDFFITEFNNSLRWKQNPVINSIHGKIAIVMCEHVRAGGKPYILFEDNALYVDLGICFWLDKVHWLLPLPCCLGCFVLGHLRSRANRKLRVMTKIIEA

SEQ ID NO: 56298 - protein, 44 aa, Sorghum bicolor
  Clone ID: 30940873.pep
TLITLEMLSMPDLNLRERKIQRICPTTIVTCGWCTVVTDGNSYL

SEQ ID NO: 56299 - protein, 67 aa, Sorghum bicolor
  Clone ID: 30940877.pep
YFFQDSFTFYTILQFFTLTLYKQSTNHQCFGHHFSNTTRDNTNITTSMKCLVIITMTTTKGSPNGNF

SEQ ID NO: 56300 - protein, 82 aa, Sorghum bicolor
  Clone ID: 30940889.pep
FPYACCLKAAVSQSTCKFKTELDCNFQAAAFVKNTILVLLQPIALLSCFTACSLLHALAVLCIICSYPTAKADCGMLNVSVK

SEQ ID NO: 56301 - protein, 134 aa, Sorghum bicolor
  Clone ID: 30940891.pep
LYGTYAYFKKLDYFSTECIYSPNAYRGFAREFIKDLERMRPRAILDIIKSGENFRISTTTRMPEQGTCERCGYISSQKLCKACVLLDGLNRGLPKLGIGRTKSGAGADSDGKQRTKRSERRNTSLQGKHGNFDF

SEQ ID NO: 56302 - protein, 76 aa, Sorghum bicolor
  Clone ID: 30940892.pep
KIPSSPLSAEFTKVTVNNNKLEAVECQAQAVSQVETLQDPVDIVPVPRLMKLIKNFNIELNVVYNYLLVGLLSNYF

SEQ ID NO: 56303 - protein, 82 aa, Sorghum bicolor
  Clone ID: 30940913.pep
MTKAYPSIERNDLILLQEIASYMLLACGAVYVISGILCIGVLKRSRQQKATSREQAVKDLHELEKRREELEALLLAERSELV

SEQ ID NO: 56304 - protein, 97 aa, Sorghum bicolor
  Clone ID: 30940916.pep
FKDVVAAFEVVNCNGVEVQCQGTAPTISIDNTSGCQLYLSKESLGASITSAKSSEINVMVPSGGTDGDWVEHALPQQYIHSFKDGQFTTSPVSHSGA

SEQ ID NO: 56305 - protein, 173 aa, Sorghum bicolor
  unsure (1)..(173): unsure at all Xaa locations
  Clone ID: 30940918.pep
RSRTLPPVPAXSRLALARAWPAHXSDPSRRQDTSYRHVPPPCLLPTWHQPPAGPRFQGFQTIGGASNGGGGPGALVVSRIAAACWLDATSPSQIMGINGEEWEGTVVDGGVRRWKGGAEGACLGASSSFAEGTGEFVLRSMDARFSGSVDDDELFVSSRQPVFGHSKSTAATS

SEQ ID NO: 56306 - protein, 96 aa, Sorghum bicolor
  unsure (1)..(96): unsure at all Xaa locations
  Clone ID: 30940956.pep
MANAASSASSPGAGPSTSSSSPXAGGERGGGTPRQRQGRPVRAGYDPLLIVCGCFSVVTAATALLCVAVNVVSAVQSFRAGSDVRDPPRPQCDFPS

SEQ ID NO: 56307 - protein, 81 aa, Sorghum bicolor
  Clone ID: 30940960.pep
STSNRGDHSIQGGSRAAAGGIQLHPMRRRRPFQCSLLIQLLSGQSELGARTDGRTAKPAWGINYRLDWTGRRIWDPFPRLG

SEQ ID NO: 56308 - protein, 111 aa, Sorghum bicolor
  unsure (1)..(111): unsure at all Xaa locations
  Clone ID: 30940964.pep
PHHGRRALAPNSINKPYSPPPPPPPTSTRLPPPLTTITSRRGVAQSSTPDPQQQPPNPNPCLRTALRSPASQTLASKSRPDSQREAAESGEAGGESTGDRPRGLRWHDXTR

SEQ ID NO: 56309 - protein, 65 aa, Sorghum bicolor
  Clone ID: 30940986.pep
SGSSYAGEAPRGAVDPRRPESLGGAASVIPSLNYQQPNRLLRSNLGLGPHQHSHLQTMSFLVLDS

SEQ ID NO: 56310 - protein, 102 aa, Sorghum bicolor
  Clone ID: 30941006.pep
ELSPRELAMAGEDAAAAANPAVARKLLKEEEEDDDVLDVVPLAICRAKKSGNPSVSNVKKEEEDDYDYQEDYQLISRSRQRTAEPTLISLAAPLRLGPSPSA

SEQ ID NO: 56311 - protein, 113 aa, Sorghum bicolor
  Clone ID: 30941014.pep
REKPLSPFVPYFYPPIPPSPLRPIAERRARVQGSGGEGEICWLPRRGPSLGEQEPGEMQRRRAHTWAGVGKTAQAAAAHAALFCFTLLLALMVDGRTTYSWWIIFIPLWLFHG

SEQ ID NO: 56312 - protein, 89 aa, Sorghum bicolor
  Clone ID: 30941038.pep
APTGFGVYSPALKASQRYDQGALDAVAFFKDVGANVGVLSGLLAAWAPAGGRRRPWLVLLAGALLCAAGYLPMWLAVAGVAPAPLPLMC

SEQ ID NO: 56313 - protein, 74 aa, Sorghum bicolor
  Clone ID: 30941048.pep
FCSHEYHLSPALSLQQLGGESACLHFFAATCLFSVFPYCTTISEPYTGLRLYKEPLRLRHRLLLLFQNGEFNYF

SEQ ID NO: 56314 - protein, 57 aa, Sorghum bicolor
  Clone ID: 30941050.pep
SHERSLTCSSRVPWFWHKDLYRSTSSFLRINPHAIQYMYSIKQFQTLTPPPWWPFFS

SEQ ID NO: 56315 - protein, 65 aa, Sorghum bicolor
  Clone ID: 30941068.pep
AWCFFQEYRMISYLLLLLFKTRQCTTAVWFELRTTIAVWFQSHWWQRWQLGRRVESAGATPTIEA

SEQ ID NO: 56316 - protein, 144 aa, Sorghum bicolor
  Clone ID: 30941082.pep
PRGKKDAATAIFNLCIYQGNKIRAVKAGIVIHLMNFLVDPTGGMIDEALTLLAILAGNPEAKAVIAQSDPIPPLVEVIKTGSPRNRENAAAVLWSLCCTAVEQTRAAKAAGAEDALKELSDSGTERAKRKASSILELMRQAEEA

SEQ ID NO: 56317 - protein, 109 aa, Sorghum bicolor
  Clone ID: 30941135.pep
KGARSCVECRATTTPMWRSGPTGPRSLCNACGIRYRKKRRQELGLDHKQQQQRNNGEAKAEVKDSSSNSSSSGSSNLQVVQKRRLLMGVEEAAFLLMTLSSPTFTLLHG

SEQ ID NO: 56318 - protein, 108 aa, Sorghum bicolor
  Clone ID: 30941147.pep
QMVQTLEPHDDISWEPSEFCHNQLKELVIIGFQGAERQIYFVNFVIKVSTSLQLVSLYKNGHVQDRGRWNWDIVTQQYQWVKEEKVKILNQIADSAPCAATPVQVVLE

SEQ ID NO: 56319 - protein, 101 aa, Sorghum bicolor
  Clone ID: 30941150.pep
RMKITWLADMEELVPLSLVEFDYLICKKKLEEDEDFLENLNPCTRRETLALGDANMRNVKRGEIIQIERKGYYRCDAPFMRSSKPVVLFAIPDGRQQASLN

SEQ ID NO: 56320 - protein, 78 aa, Sorghum bicolor
  Clone ID: 30941172.pep
SPSLPRNYSLLSTTRFNLSKKQTDQTTHAGRKPEFTKRSCRQPRPHGSGAVIYCRRRRSTPTPMGSADRSKIDGIVVA

SEQ ID NO: 56321 - protein, 143 aa, Sorghum bicolor
  unsure (1)..(143): unsure at all Xaa locations
  Clone ID: 30941188.pep
RVSRRRKMRSSRSSVRALRRSSLQEARNPRRPHHPFLEMGKLSRRRRIXRKAAVARLPGAPGLRLRLRLHGGIRIARRPNGGWRMGGCKCHRRRTRWWTACLRWANRRPLVGSSAAPNPRPSSQGRAAGGGALEGGGGLRGWS

SEQ ID NO: 56322 - protein, 125 aa, Sorghum bicolor
  unsure (1)..(125): unsure at all Xaa locations
  Clone ID: 30941190.pep
MEAKVGFSQESPPISIICAAKVADVPLTIDPSLPTGSAPILKFSSGXVEWLDYAPTFFSGSEFENACSFVDGFLASRTFLVXHGLTVADIAVWSNLAGIGQRWESLRRSKKYQNLVRWFNSIDAE

SEQ ID NO: 56323 - protein, 131 aa, Sorghum bicolor
  Clone ID: 30941224.pep
PSLGNHLDEIHTELLLLQEPHAALHAASASATTDHLLNGGGPSPTHTTRSKRRCSTLGAMPPRSRPYSGSAKRPSSSPWSAPQHDTEKDIACLASSACTAARLPQVKSDCRRLPDLHYLYFCSMRKASFKW

SEQ ID NO: 56324 - protein, 110 aa, Sorghum bicolor
  Clone ID: 30941230.pep
ARAPGTQLLRTSQRHSHKGEQRSIGRRTPRTGESRRVPEAERDQAEEGWERALVRGARGDETRGLSSPPHSRLVAGSAIASAAEAAAAGRRCSSPQARDRACGGAVGLRG

SEQ ID NO: 56325 - protein, 109 aa, Sorghum bicolor
  Clone ID: 30941232.pep
LFLLCKLHILLRLPDTTGQQPSPEQTIPVRFADSLPYHLGGPPADPSPRRPLTVTFRRPLPWRPWPRPRGRQRQHRRRRRRGWGRCGRRWRTSAGRRSRCSPRPGPCRP

SEQ ID NO: 56326 - protein, 78 aa, Sorghum bicolor
  Clone ID: 30941244.pep
MLRELELDAGRPAGGGGEFDMATPLIAGLSVAAAALGGRSMIRAWQAFQTRAAMPRVRRFYPGGFQGEMNRREAALIL

SEQ ID NO: 56327 - protein, 145 aa, Sorghum bicolor
  Clone ID: 30941248.pep
MEADIASRYEIPRTAQFRGDCAYNRVALQFPDEMLKDAAAVARALRRELASGGAGGGVRVFVMADTAYNSCCVDEVGASHIDAQCVVHYGHGCMSPTSSTTEENTIPQSSGTSCNGDITRNSDVATFLDNHYGMKCSSSTQKYSL

SEQ ID NO: 56328 - protein, 93 aa, Sorghum bicolor
  unsure (1)..(93): unsure at all Xaa locations
  Clone ID: 30941254.pep
MQGLAVASPLPPAAAAARRRPRASWGTREAVSQCWKYELSRDQYLGGFLRISQSQGSLHRHRSTNLLRPAAAAISVEXDELNTYLPKGDMWSV

SEQ ID NO: 56329 - protein, 73 aa, Sorghum bicolor
  Clone ID: 30941283.pep
MAAAAEEGPEPLRYQTLALRVSIHCEGCKKKVKKVLHSIEGVYKTDIDTQQHKVVVIGNVSVDALVKKLLKSG

SEQ ID NO: 56330 - protein, 75 aa, Sorghum bicolor
  Clone ID: 30941309.pep
INRRYLFPFTISLHQKQSFKGKTCILCNCVHTLPELVILSPAKQVASSFNGKIFSKKKEKNVCTGDIRKGLFEPY

SEQ ID NO: 56331 - protein, 97 aa, Sorghum bicolor
  Clone ID: 30941317.pep
IKLHGKEKLPVEYLPQRRRNGEKEKKVKPVEASVTDKFKKGAEKETQEEKKARKAAVKEEKREARKAKKELKVLYKSETQKAQKVAAVTGPSSIRLM

SEQ ID NO: 56332 - protein, 116 aa, Sorghum bicolor
  Clone ID: 30941328.pep
MWCNGLVCGPSVLFLTYIQGDLRRTVEFPYLYSPGFMVVLLFSCILAFLLNYTIFWNTILNSALTQSMCGNLKDFFTVGIGWVLFGGLPFDLLNVIGQGLGFLGSGLYAYCKIKGK

SEQ ID NO: 56333 - protein, 84 aa, Sorghum bicolor
  Clone ID: 30941352.pep
PKLRMEAVALENFRARAFSLLSIAGLSGFCQLSIPLGVRGGVPVSVSLVACHGADRFLLSVAQELYETLKEETKKAWSSPDSSL

SEQ ID NO: 56334 - protein, 55 aa, Sorghum bicolor
  Clone ID: 30941354.pep
PYQGLSYVLPCYPQHHYQEPLYLVNAKFAAALSSSHYPGETAIPIDSYPARGLFL

SEQ ID NO: 56335 - protein, 176 aa, Sorghum bicolor
  Clone ID: 30941383.pep
VTVDRAAWNMLVEGYCRLGQVETAKQVVERMKERGVQPDVATYGSLAKGVAMARKPGEALVLWNEVKERCLEEADEELLGALADVCVRAAFFKKALEIVACMEEKGIAPNKTKYKKMYIEMHSRMFTSKHASQARQDRRRERKRAAEAFKFWLGLPNSYYGSEWRIEPVLDGDDPI

SEQ ID NO: 56336 - protein, 69 aa, Sorghum bicolor
  Clone ID: 30941397.pep
TTIRTCRHKSDTQSEMLSLILLFGSLFLEQTLLQKLRPYIIKSLRNYKDYMQYVSGGAYFSLYFALLLG

SEQ ID NO: 56337 - protein, 107 aa, Sorghum bicolor
  Clone ID: 30941421.pep
VASPAFYAIWNLFSGFLIPRTRIPVWWRWFYWICPIAWTLNGLVTSQFGDVTENFSNSGVGIFDFVEDYFGYHHDLLWLVAVVVVAFPVIFALLLGLSLKIFNFQKS

SEQ ID NO: 56338 - protein, 251 aa, Sorghum bicolor
  Clone ID: 30941450.pep
LKCKKEERVKQFSDIRSQIEKIRFELSEHNDQGGNVSSLAAEEHDLSTRKLNSYQAQLRALQKDKSERLRKVLEYINEVHSLCGVLGIDFGSTVHEVHPSLHQNGIEQSRNISNSTLEGLATTIYKLKAERKSRIHKVRETMESLCQLWKLMDSPEEEKRQFSKVMSILILPEEGITSPGVLSKDTIDKMEAEVERLTKLKTSRLKEIVMKRRAELEEICQNAHIEPDVSTAPEQTDALIDSGLIDPSELL

SEQ ID NO: 56339 - protein, 104 aa, Sorghum bicolor
  Clone ID: 30941470.pep
YWIGVGAFFGYVLLFNILYTICLTFLKPFDTNQPTISEETLKIKQANLTGEVLEASSRGRVANTTVTARSTLDESNDEATVNSSQVNKGMGRPFVPLSITFEDI

SEQ ID NO: 56340 - protein, 120 aa, Sorghum bicolor
  Clone ID: 30941478.pep
PLTFTCQGSSVGERVRAAVLSSEESSAEQLNGHGFRVVLGRGYAPIQSQPRKGGGGGGIEFPRWICASAAALAEGMARGRRSGRSRARLHGTAGTHGPRLTSPFGSGAEWRWSRRSSRAV

SEQ ID NO: 56341 - protein, 141 aa, Sorghum bicolor
  Clone ID: 30941492.pep
MWGRHYWGGGRRPSWAPGGDGAGGVVVMFAWLSSQERHVRAYVELYAAHGWACLVCHSDFLTLFFPEKAAMLAYKVLQLIERRCEGQLSLDEYQLVRDCLCGQIYDSSPVDFVSDLGTRFLLHPSVLKMSEPPRVLSWMTK

SEQ ID NO: 56342 - protein, 160 aa, Sorghum bicolor
  unsure (1)..(160): unsure at all Xaa locations
  Clone ID: 30941498.pep
MGGRGGDGGGRKARNFATFRLFPRAGAADPNDRVFVRVDNNDYTVPGFADEDSFDPSLSDPSAGDANFHSASGSLPEHVRREILEXXXPDDGYXYLSHLRELRPTAAAASSFVPSSTARPEPLPLDVKAYDASRVRVGPSDGELDEGKTMCKVAAKTAPL

SEQ ID NO: 56343 - protein, 140 aa, Sorghum bicolor
  Clone ID: 30941512.pep
MAKGGGERGALLPVSADDDGKGNGGGGGGDDAVLFKGSAMTRRGAAAALSYMACSVLLVMFNKAALSSYNFPCANVITLLQMVCSTCLLYVLRRLKIISFTNSDPSGPSDSLFFVPFRLLLRTTPLSLAYLLYMLGFDGI

SEQ ID NO: 56344 - protein, 185 aa, Sorghum bicolor
  Clone ID: 30941536.pep
MAMGGDYGAFMEKFELLPPQSQQHLPLHGLTFAVKDIFDISGRVTGFGNPDWARTHAPAGATSPVVLATLAAGAISIGKTVMDEMAYSINGENAHYGTPTNPCAPDRVPGGSSSGSAVAVGAKLVDFALGTDTGGSVRVPAAYCGIFGLRPSYGLVSTENVIPMSQMFDTVGWFARDLSTLSRVS

SEQ ID NO: 56345 - protein, 189 aa, Sorghum bicolor
  Clone ID: 30941562.pep
MGFAAAAADDAGKPHAVLVPFPAQGHVTPMLKLGKILHCWGFHVTFVNSEYNHRRLLRSRGAGALDGLPGFRFATIPDGLPPSDADATQDVPSLCRSTEETCLPHFRALLQALNAASSSPDDDVPPPVTCIVGDVTMSFTLEAAREIGVPCALLWTASACGYMGYRYYRTLIDTGIFPLKEEQLTNGFL

SEQ ID NO: 56346 - protein, 205 aa, Sorghum bicolor
  unsure (1)..(205): unsure at all Xaa locations
  Clone ID: 30941564.pep
ADGSAKGEKTRKATDGREEPSDSGPTTPLPNKKLLIFILDRLQKKDTYGVFSEPVDPEELPDYHDIIKHPMDFSTIRKKLDKGAYSNLEQFEDDVFLISSNAMCYNSPDXIYYRQARGIQEIAKKDFENLRQDSDASEPEPEPEPEPEPELEEPKPQPRRGRPPNKNNAEQKVGKPPAERATADFSGATLATAANIGRHAQADFD

SEQ ID NO: 56347 - protein, 196 aa, Sorghum bicolor
  unsure (1)..(196): unsure at all Xaa locations
  Clone ID: 30941578.pep
HYLPQGCYAARATRSSASNPILPSPVAPPALAHALAPRLPPPPATSTRGSIRQPPCPQLLPAPPHHSPTHLTMTTMAPPTTPSWRSSAPMTPMPPTASSPRCLLPSLPPHHGLSPPRAALLQFQRPRRVLPRRPPPPEPPRPRCPRPPRRXTPSPSRPRPLPVPAXPPRPLPPPIHAPPGPSPRPTRVHRRRRPPH

SEQ ID NO: 56348 - protein, 71 aa, Sorghum bicolor
  Clone ID: 30941596.pep
DGTCELVDRPSTPKDGMFENASFDVKRPASDRSLEENEVTRGDAKTERHYKRRKLLALEKQSSFSGETCTD

SEQ ID NO: 56349 - protein, 40 aa, Sorghum bicolor
  Clone ID: 30941624.pep
SLRKLPFLAHASVTNPCCDASTFLHTLIKTAQREVLESRG

SEQ ID NO: 56350 - protein, 137 aa, Sorghum bicolor
  Clone ID: 30941716.pep
YRGNKSKFEPHRNHLLQFQKLHDDGTNPPQRSTQPNPPRRSKRIATRRSTPPIATPPQPSTNQPAASKFPTLLKTRNKKTHTSGHAANPASDGPETEGGDARARPGSIGRPAGRCGGIRSGSVEEEEGWRERRRAAA

SEQ ID NO: 56351 - protein, 128 aa, Sorghum bicolor
  Clone ID: 30941767.pep
IDPLESNSQLNMRSYAPKYDEMLKKSNCMVTDKESEKSLFLSLDSDQKVHSQAEAEVQDIMVSTSCSISETLAQKITSKEQSFKKSIEVGDECFRPQDMDYVMMFDSSKDDNGPNPERMTAEGDCGDP

SEQ ID NO: 56352 - protein, 181 aa, Sorghum bicolor
  Clone ID: 30941795.pep
MEVSFSAPPPAPDAACAATAAPLMPPAAAAQTLPPPVAAVSSSPPQQQQAAAAAAVVAPSPADDKVLVSVEVLLHAASAARHEDVQVAVERMLEARCLSYVDGPVPIPADNSFLLENVKRIRICDTDEWVGNRKVLLFWQVKPVVHVFQLSEDGPGEEPSEDDTLSSFNEWALPAKEFDGL

SEQ ID NO: 56353 - protein, 87 aa, Sorghum bicolor
  Clone ID: 30941825.pep
SVSNLDASNTLSSGSLPTWPHGRDDLWHCANSSIPESQSLSAYRNPDAHMWLSSLAIGVLLGSTEALTGPKHSRWQWQVIHHPPWCG

SEQ ID NO: 56354 - protein, 134 aa, Sorghum bicolor
  Clone ID: 30941827.pep
FVNRVNASCCRCLDKAAIVEADLSAPAGKQQQQASAPASTVTEVEEVKMVVKLLPIWSTCILFWTVYSQMTTFSVEQATRMDRHLRPGSSFAVPAGSLSGFLFISILLFTSLNERLLVPLAARLTGRPQGLTSL

SEQ ID NO: 56355 - protein, 180 aa, Sorghum bicolor
  unsure (1)..(180): unsure at all Xaa locations
  Clone ID: 30941869.pep
LLXYVPNYFGYIHPRVTFLFERYSLLLCIGIVWAFAAILTAAGAYDHVSLKTQQHCRTDKSRLISSAPWVKVPLPFQWGPPIFTAGHSFGMMGAVLVAAFESTGAHFATARLAGATPPPAHVLSRSVGLQGIGMFLGGIFSCPTGSSVSVENIGLLGLTKVGSRRVIQISTGFMIFFSLF

SEQ ID NO: 56356 - protein, 29 aa, Sorghum bicolor
  Clone ID: 30941879.pep
EFQHSSKPVDKVVITVKPPRCLHEAILDL

SEQ ID NO: 56357 - protein, 114 aa, Sorghum bicolor
  Clone ID: 30941897.pep
GEHHYGVLEGWFGIHWWNGRFFVLLVTTLCVFTPLACFKRIDSLSYTSTISVALAVVFVIITAGIAIIKLIGGQIPMPKLFPTLPDLASVWELFTAVPVLVTAYVCHYNGMSNF

SEQ ID NO: 56358 - protein, 180 aa, Sorghum bicolor
  Clone ID: 30941902.pep
DDSFNAKLSDFGLCKLIDRDTSQVITRMRGTPGYLAPEWLTSQITEKADIYSFGIVVMEIISGRKNLDTSRSEESTHLITLLEERVKNGQLAELIDKHNNDMQVHKQEVIQVMKLAMWCLQIDCKRRPQMSDVVKVMDGTMDVETNIDHNFVARNRTIFGVAGNAASSSPYLASDVSGPR

SEQ ID NO: 56359 - protein, 95 aa, Sorghum bicolor
  Clone ID: 30941936.pep
VSRRPMPNVSTHVSPPSHTASPLPRPPAAMTRSYSIPSNSQQTPIITVDKLLEARHSRESSEVSSPPVTPISLADVSRRSTTETVVDKKRIKESL

SEQ ID NO: 56360 - protein, 90 aa, Sorghum bicolor
  Clone ID: 30941987.pep
AKRLAQGHHIKVEISTTMPIQVDGEPWSQEPGTIEVSHHSQAFMLKRVSEEPLGHAASVMADILENAENSGIISASQKRTLPQEIASRLL

SEQ ID NO: 56361 - protein, 137 aa, Sorghum bicolor
  Clone ID: 30941989.pep
QEQIEAIGLFAEAIGVGFQIQDDLLNIAGEKFAAKIAVQGEDIPEGKRTLMVIPSFKHAAPEKAERLRTILNEPPDDQAKIQEAIGIMRETGSLEYPAGVARDIVNKAWKEIESKFPDNEGRKKLKAFASYLVDRDW

SEQ ID NO: 56362 - protein, 167 aa, Sorghum bicolor
  Clone ID: 30941994.pep
KSSGNSIVRAYAKDHYFDVITNVVGLVAAVLGDKFLWWIDPVGAVILAVYTIVNWSKTVLENAATLVGQCAPPEMLQMLTYLAMKHDPRVRRVDTVRAYSFGALYFVEVDIELSEDMLLREAHTIGELLQEKIEKLPEVERAFVHIDFESTHKPEHKVRSRLPSTDP

SEQ ID NO: 56363 - protein, 147 aa, Sorghum bicolor
  Clone ID: 30941996.pep
SICTIIVHEIEGLNWIDSFYLSVISVTTVGYGDKSFSTTAGRLTATVCLLVSTLAVAKAFLFLTDLRMDKRNRRTTKWILKKKMDNEPLVGDLDNDPAVSKSDFVIYKLKEMGKIDEKDIKLISDQFDQIEFGKCERIPLADIIGKL

SEQ ID NO: 56364 - protein, 44 aa, Sorghum bicolor
  Clone ID: 30942002.pep
NNNGECIFRQAYKLSYKPLYEAAKIMFYNKAYMTLKQSMLYSTF

SEQ ID NO: 56365 - protein, 88 aa, Sorghum bicolor
  Clone ID: 30942008.pep
IKLRTKCLAAKLKWLKPMITAERSLVMSMCLIQWQVRLNTAMDLTRGSHFFLYDFVEEQAHCFLNRAACTLTVLQHGFSMTRRKREYF

SEQ ID NO: 56366 - protein, 109 aa, Sorghum bicolor
  unsure (1)..(109): unsure at all Xaa locations
  Clone ID: 30942010.pep
SAEAEYRAVANGVAEASWLRQLLXHSPLSRSALFYCDNVSAVYLSTNPVQHQRTKHMEIDLHFVRDRVAVGDVRVLHVPTTSQFADIFTKGLPSSTFAEFRSSLNITGG

SEQ ID NO: 56367 - protein, 144 aa, Sorghum bicolor
  Clone ID: 30942016.pep
AAQGRPRDGVGRGPGVRGGPGRREGPRGRRRTLPADNVDAALTTVGCPRCCCAPALASAPRVGGGCAAREAGGGAARASTDAARGVAAATASSFPPRRCGLHGRWIRYTCFCCCSSSHSNFQPLLRFPFRTGVCVGLFHSIERL

SEQ ID NO: 56368 - protein, 191 aa, Sorghum bicolor
  Clone ID: 30942024.pep
GAGILSSITNGANELASTVRETIRIRSKRYKKGSASADSDSSGAIELPSDVEGDSQEVNSAAKRRDDQANGELNEVHQSSDAEKDKQHVPDNAATTNRSQRENSHVQNHQKYEIIDVPSDSRPLLVFINKRSGAQSGDSLRQRLQILLNPVQVFELSKQQGPDVGLALFRKVTHFRVLVCGGDGTAGWGLD

SEQ ID NO: 56369 - protein, 174 aa, Sorghum bicolor
  Clone ID: 30942026.pep
MSDITIDQVFEQYLPKVKHILEQQLPRTFDNDTMKRYAGNARYAYDVETATKSILEPIWDMLDRGGKRWRPVLVLLVAETLGGKEELVAPCAYLCEMVHNGTLAVDDIEDDSKLRRGKPCMHLIYGVDVAINAGNAMYFLPTVIFKELRLKGVDPVKVCQAHELYEQELSNLHF

SEQ ID NO: 56370 - protein, 195 aa, Sorghum bicolor
  unsure (1)..(195): unsure at all Xaa locations
  Clone ID: 30942032.pep
FPTDPVVEPPFLVFPAGTATSPVVRDTSGPLPCPGPEVSPSGPAPAPDAGLGSAPSTPAPPVRFAQPVRVYQRRAPDVGSVPSTPAPPARFAQPVRVYQRRARLAPLPPAAPVAPSSPGSPAPSATSSPPATPTPPPQHPATRAVTPVXPPTAPSPTPASCSPDGDATRGWDPAAPGSCGDAWGLAGLTGTLFRP

SEQ ID NO: 56371 - protein, 167 aa, Sorghum bicolor
  Clone ID: 30942039.pep
MIQPENCKLQLSNPSSNMSSMEEPLLPLVQRDQKYISKKDRRRSCDVPSRCATSFSPNSYVKANFSTLNHLPPTDESTNLVSSPNIQRVHSSPSIFTSSKEAHCVDELDGQSHAATAQYTPSIARQAIVSVILYISIGVLVYMTNVEGFKGKSTFKLVDALYFTIIS

SEQ ID NO: 56372 - protein, 119 aa, Sorghum bicolor
  Clone ID: 30942056.pep
MNGEVECSVCHAKVQVPPAVSKAYDSHRSTVSSRQRALNVLLVSGDCVLAGLQPILVYMSKVDGKFKFSPISVNFLTEITKIIFAIVMLFIQARRLNVGDKPLLTVSIFMQAARNNVLL

SEQ ID NO: 56373 - protein, 178 aa, Sorghum bicolor
  unsure (1)..(178): unsure at all Xaa locations
  Clone ID: 30942064.pep
PPRAGAMAAAARAALLPSSSSSPSPLLRLPRRFLSLTATPYPLYYDLIVHRPADPNPPXSSASDSDRQPQPPLDEQPLDRAKRRYLRKRRSRLLPDPDATTTTKPSSSSSEFVELRPEVVDFPRLHAREEALYFHDTFAMPWEKDKHYRMLYRLEKKYFPHQSLDNAFVSADAAPASD

SEQ ID NO: 56374 - protein, 94 aa, Sorghum bicolor
  Clone ID: 30942072.pep
IEGSFGTFNVNNIQVFAGYVLHIGSFAKGSKVLSLGDSVICKVDYNRRTLIAPNHTCTHMLNFALREVLGDHVDQKGSIVLPEKLRFDFSHGKP

SEQ ID NO: 56375 - protein, 117 aa, Sorghum bicolor
  Clone ID: 30942086.pep
KKDKNRAKILGHVSTETRSRFTATITETKSGPLRIKLLGSSSSPRPCRGSQGEPWQHVFPNPLPVLLLPICSANTLHFRRFNGTGDNFYPARLPIEVLAWLAVSPILIPRDSWRFCY

SEQ ID NO: 56376 - protein, 77 aa, Sorghum bicolor
  Clone ID: 30942090.pep
VLLHRIQRLRSVQLTPNNWDPSATCRSSTTRISRTPYTLFSSPQNPKTFQDFLDSICRPSVLPDSCMNRVDFACPVV

SEQ ID NO: 56377 - protein, 146 aa, Sorghum bicolor
  Clone ID: 30942109.pep
MGHSPSSLSKSGTSSSPPRRSRSLFHMAPPPPPQQQQQLLRLTAPMQVAAAGDSSSSFAPPARDYTQDLPDEILALVFASLSPTDRNACSLACSRWMEVDATTRHRLSLDARAALGNAAPALFARFTAVTKLALRCARGSGADSLS

SEQ ID NO: 56378 - protein, 191 aa, Sorghum bicolor
  Clone ID: 30942115.pep
MAILAGLVAVLSALLAAALRRLLIPRRRPADAAGFFHPYTNDGGGGERVLWCAVRAVQELRPDLPCAIYTGDADAAPDALAARALDRFGVRLLRPPQVVHLNKRKWIEASTYPHFTMIGQSLGSVYLAWEALTNFTPMFYFDTSGYAFTYPLARLFGCKVICYTHYPTISSDMVERVKHRSSMYNNNSRIA

SEQ ID NO: 56379 - protein, 149 aa, Sorghum bicolor
  unsure (1)..(149): unsure at all Xaa locations
  Clone ID: 30942121.pep
KSLTPTPPTPXSPPHATSPPQSLPHGEAPADTGPPPLATRAQGPALSPMVRHQRTRGCPTRRGRRPRTRGRPLPTTRAQGPALSPTVRHQWTRGRPTRRGRRLARCLGFRRGPLAMSSLGPFAGDEHQQVHPPLPCSPFCVKPRTQTLT

SEQ ID NO: 56380 - protein, 93 aa, Sorghum bicolor
  Clone ID: 30942123.pep
MKSPLRRFRGFAHHHHHHHHHHRERKDHRPPPAKLDELTYAAQEMEDMKNCYDSLLSAAAATTNSVYEFAEAMEEMGTCLLEKAALNYDDDES

SEQ ID NO: 56381 - protein, 177 aa, Sorghum bicolor
  Clone ID: 30942151.pep
TGTSINPVIFLLVVATREHCRAEPELGSCPPRCAGAAPHATKAVIPYAVGRDTHGKQRPSLSLGPSSPPSLARRRRSHPISTSQNPHGTPAPLHSTRRQRRHGGSLDVAPFRQAHHGHLAAYSRIRLPRSPLPPRPRHRVEESPRGGDPDAAGETGDGGALRGVRRRAPGRSRSRSR

SEQ ID NO: 56382 - protein, 182 aa, Sorghum bicolor
  unsure (1)..(182): unsure at all Xaa locations
  Clone ID: 30942163.pep
KPLPRERRGRHPSPAPPAPPRPPPFLPPRRHLPSPHPRSQWRXPPKASPCVPRQRGPAATAGGGPLPCPPPRSRAAGGSITRGKPYPSRPPGTNPPLAHHGVAPPPPPYAPPPRPARSPAATRSPPSPESSSPRYLPSSLRPLRPALPSSSPRRARPFFSGRLGGSEAALGVSSAAVAEGVD

SEQ ID NO: 56383 - protein, 48 aa, Sorghum bicolor
  Clone ID: 30942174.pep
PSPSQRRPRAIPAASTGDGRKLRSVAGSPQHRLSGCGDAGDLRGEEVE

SEQ ID NO: 56384 - protein, 102 aa, Sorghum bicolor
  Clone ID: 30942199.pep
PALPSSSSSSCSSSSSSSSASSSVRTSSESDGAGPALRRSSSASSEVENPIQGLIAYCKKSQQLASVRKSASDAGFRFLSSAASKIAAESDSLDELTEICRG

SEQ ID NO: 56385 - protein, 66 aa, Sorghum bicolor
  Clone ID: 30942201.pep
MRTMEFPLFLDSQETTRSAYAIFLLNKDIEQLLNYIGAESLGPRHVLANLRQLTRIIQSQEYISVD

SEQ ID NO: 56386 - protein, 151 aa, Sorghum bicolor
  Clone ID: 30942210.pep
TYNICKGPIRKHETSWQNSTTNSMKLVHTVLNFQCICKYMLTLRGSHLPEVPQRQLPVVVVSAGMLPKVTCCSTFVGVPRRKGLAWFKSKLEKRLVTVLCSSLCTAASQQVDGAASRRRGSSATGGGAVTVPPCCSRRSALPSLCRAPLMH

SEQ ID NO: 56387 - protein, 146 aa, Sorghum bicolor
  Clone ID: 30942247.pep
IGLARSRDGIRWKKTGKVLEAGRAGSFDECGVRHGHVVRDRAAGRYVMVFEGVDADGRVSIGMAVSEDGLKDWRRSSEIPVLCPSDDDDGWDGAGVGSPCLVQMDGAYDWRLYYMGVGRDGEASIRMAHSEGQALLKFEKCDAILM

SEQ ID NO: 56388 - protein, 81 aa, Sorghum bicolor
  Clone ID: 30942269.pep
VIIDHETYPRRKDDTRGIRNTLEDTRRNGRASSHQVGPAGRPLWLGFAPSFRKLPPSPLRSHLGRLLSRFDPTAHVHPTRL

SEQ ID NO: 56389 - protein, 136 aa, Sorghum bicolor
  Clone ID: 30942275.pep
PPPQQPHPSQTLQQLGAIQLPHQDQQLPYPQSAILPQVPLQFPNQLPIPQLQLYHQSQQESGQTLRQVGEQSQLQNQGMQADSFSQQQQDSGINLNQFFSSPEAIQSLLSDREKLCQLLEQNPKLMQMLQDRIGQL

SEQ ID NO: 56390 - protein, 105 aa, Sorghum bicolor
  Clone ID: 30942279.pep
CDPAVSECRSLAVLEEEELGEFVPFEDAPVYATSGFWDFEPDAGFLYAEPSSPELSWNAAGAGAEPASSDDAPSWAASASPMQENNDYFQDLRDLFPLNPLPAIF

SEQ ID NO: 56391 - protein, 124 aa, Sorghum bicolor
  Clone ID: 30942301.pep
MALSPPSPPHATTALLLLLLLLTCTAASIATLASAQPQPQPLASSQAKALLRVRRLLFYPPALEPLRGAPDPCALPPTPSLAVACEGGQVTALSVRGDRDPDAAWRAALPATFSSEALFTTLTR

SEQ ID NO: 56392 - protein, 114 aa, Sorghum bicolor
  Clone ID: 30942325.pep
RKIKGLHLSSAGLGFSPVKTTQVELAFRAAASVSGLCGRQARRATRRARGWCRLQRTTRTWDEASKRRRRASSPLSRALAMGTRPSRAPPQRGHSPGRASAPALPSPRTVWQRA

SEQ ID NO: 56393 - protein, 242 aa, Sorghum bicolor
  Clone ID: 30942332.pep
IEDPSPVATARRLFKSEHLEGLLSYKATIDLISSSKYSFLQYDTDPYLLSLIQERSFFPLSAALLSSPILHSASGPAAEILMGIASSIESLILSLLFCRSGLSFLLSQPEATELIVLSLQDAENMNKAECITLRQAFVLLSKGFFCRPKEVGMITELHLKVGSAANRILSVPPNSDELLWVLWELCAISRSDSGRQALLALGYFPEAISVLLRSLSSYKDLDSVMAKNGGSPLGLAMFHSAA

SEQ ID NO: 56394 - protein, 105 aa, Sorghum bicolor
  Clone ID: 30942336.pep
FPFLPRPGLPSFLLASPSPPSLPDPLLFIPLPIRRAGGNPPGRPFRSPLQLLFLLGSGLLQLARGAGFGWGFLCHLSFLVASLGLTPGVPCRARARSGSSGTILT

SEQ ID NO: 56395 - protein, 147 aa, Sorghum bicolor
  Clone ID: 30942354.pep
MAPNLSKTTPAAGLPLGDEVAPVEGLKPSRFTLKGKDLAVDGHPSLLDVPANIRLTPASTLVPAAPAPAGDGSFLGFDAAEAKSRHVVPVGRLRDIRFMSIFRFKVWWTTHWVGDNGRDVENETQMMVLDRSAAAGEPGSGRPYVLL

SEQ ID NO: 56396 - protein, 146 aa, Sorghum bicolor
  Clone ID: 30942369.pep
IPAVESYTNHAVFANLLAYEQSRGRWELQRLVSYVLLMASVVDARRDVEALQRAGVLARGDEETAAFYANLGELCPPPEFVDNCYAALLRDVRDYCGRSWNRHRAVLVHDYFSNPWTSMSAAAAVFLLVLTVVQTVYTVLPYYSPN

SEQ ID NO: 56397 - protein, 82 aa, Sorghum bicolor
  Clone ID: 30942379.pep
MAGRREEGDGGEVQRQVEEEEEEDYIDMDLSSSAGAREFEFMSAPLDRWGEPLASPADELFYNGKLLPLHLPPRIQMVEELL

SEQ ID NO: 56398 - protein, 134 aa, Sorghum bicolor
  Clone ID: 30942381.pep
MEDPAPSSAAPDPPLSPSPHPQPPVEEGDGWVVVPASEVEGVHAPKVIHWDDLQQELARLWSLSAALQPAGDRKAHLAARLESTLQVRQEFLEQDNELAEMRRRLQEHTDRLGDLKMRTNKLSEDVVDQREQLC

SEQ ID NO: 56399 - protein, 142 aa, Sorghum bicolor
  Clone ID: 30942395.pep
TGVHIHSPRHRPNRHTSTPLAPALERRRLRKRPTAHIRLSRTASRTVSPRIVAPPLSIVPGRWPSSPTPDTLVKREEDPQRRPSQRPAPTLQSGERRCARICLSDTGYALDEGGAATRGSRGSGVRPTAPHLPPPCTSRPVL

SEQ ID NO: 56400 - protein, 189 aa, Sorghum bicolor
  Clone ID: 30942398.pep
MENREEERKGSGGAAAVGGSTPGANLRDLVSREYYGHKKKVHSVAWNCLGTKLASGSIDHTARVWSIDPHGHSKVKDIELKGHTDSVDQLCWDPNHPDTVATAAADKSIRLWDARSGKCQTVELSGENINITYKHDGTQIAVGNKEDELTILDVRTLKVAKKHKSTYEVNEIAWNKAGDLFFITTGLGH

SEQ ID NO: 56401 - protein, 169 aa, Sorghum bicolor
  Clone ID: 30942400.pep
IAASATGIPTSNSVRYQSRPLGVAGASGDELESNRLLDDESVNWATSCGQRKVEKIGDWHVGSWTAVVADLAEREVRGGGGGGSGRTRRWARPWDLNAGRERERERERERESCRPGGHRVAFRRWRAAPGWRNPATRRRRRRWWRSRCTTGGGGRAGEGKTEAARGENG

SEQ ID NO: 56402 - protein, 117 aa, Sorghum bicolor
  Clone ID: 30942411.pep
MGHGASCGRPSDEVDFFGAAQAGDTARLAAALRSRPTLLTRTTLFDRLSALHIAAAHGHLQVVSLALDLCVHPDVVNRHKQTALMLAAMHGKTDCVRRLLDAGANIVMFDSSHGRTC

SEQ ID NO: 56403 - protein, 178 aa, Sorghum bicolor
  Clone ID: 30942415.pep
LLSQLCMVATEPMNGYSFSPMIISYFNDYRNYIVSTTTEAIIVDKGTSRRGRKRKEVLASPEVETTDHMQDSYWSGLSLHNHPINDLRKESPNTRPRRRRRSSRHAYEPLSELGDPVPKKQIQVMERSIIHVDEKMVDELKPTALVLSFGRSAALPSGLDLVKMFSRYGPLKEGETEV

SEQ ID NO: 56404 - protein, 93 aa, Sorghum bicolor
  unsure (1)..(93): unsure at all Xaa locations
  Clone ID: 30942420.pep
RSVEVDFFSDQKIAADAANNNTCGRTTVSPGSGSGASCLAIKKEDLTINLLPGTGSNANDDXAATRLRLLDQDKQSTNTNEMQAELARMNDEN

SEQ ID NO: 56405 - protein, 152 aa, Sorghum bicolor
  unsure (1)..(152): unsure at all Xaa locations
  Clone ID: 30942422.pep
LARHPRAYINPHRFATCFSHQSTTTTTNPRVPCRAYPQRKATMRRPPPPPALRLSALLLLLFFLCLCAFPAPARSQNTTAATAAPASVEGFNCSANRTYPCQAYALYRAGFASVPLDLAAIGDLFAVSRFMVAHANNLSTAAVPXNGEPLLV

SEQ ID NO: 56406 - protein, 152 aa, Sorghum bicolor
  Clone ID: 30942437.pep
MSSSSHRAEYNRSYMAMVPSDFSYHGVVDNGPTGFTQGSREEASKLGPSWYFSRKELEENSPSRRDGIDWKKESNLRKSYCKFLQELGKKLKLPQLTIATAMVFCHRFYLRQSLVKNDRRIIATVCMFLAGKVEETPIPLKDVILISYEFIH

SEQ ID NO: 56407 - protein, 179 aa, Sorghum bicolor
  Clone ID: 30942448.pep
MLPAALLPSPPGRLLASIPLRCHAPTQQPSTAAAAAARGLLLGGARSPVVKRVPDGGGWLLWHQSGPRVALSTSMDGLRWSAPVSPDPLLPTEDWWAFDTASVRPSDVLLISGPAASSRRFPSSAVYWLYYTGSTDERFGSPFPDADVPALPGLAISQDGRHWARIEGDHHTGALFSVA

SEQ ID NO: 56408 - protein, 78 aa, Sorghum bicolor
  Clone ID: 30942453.pep
PNPHPPRTAEEQQGPPTERDGQGGRRRESELGPEIAGVRNAFEVCARKQWSRKGQRKRRSKPREERRGSVTEQKGKKL

SEQ ID NO: 56409 - protein, 218 aa, Sorghum bicolor
  Clone ID: 30942486.pep
KLMTPWAMEKQCRGIYTHEVFSKFQEQLIAARDHCIFQGTSECEDIRSFTISSLTGKDRVVHMNKSNMFGMCSCKFYESYGIPCRHIIQVLRVEKQNEIPSLYIMKRWKTRCKRELFFDEEGNLLDEKPKDPMEVAMRKKISESRNKFEDLIQMAKTSEQGMDFLYSSLSNLVEPLQQITPAMRIDKKEEYETFLGNKIPNEVDIHPPTDITSKGRSK

SEQ ID NO: 56410 - protein, 68 aa, Sorghum bicolor
  Clone ID: 30942521.pep
YNSWEKLILRQSSDIGKTAVQYKSERRAAMEAEGFKILGISGDQWSDLIGSPMARRSFKLPNPMYFIS

SEQ ID NO: 56411 - protein, 71 aa, Sorghum bicolor
  Clone ID: 30942554.pep
IIETSSKDDLLVKIDEISVKQHQLLCLLDQAKWLDDDGSLLMIIQFFPLLILILMYFKLFVGDLCLYMLHN

SEQ ID NO: 56412 - protein, 95 aa, Sorghum bicolor
  Clone ID: 30942583.pep
LPGTLQYVMADPYLEQNEQLKEMALTIQVMHQKLEDSQLELVEVRQHYEEALDEIDEWRSRAGLPKINEVEEIPRLTPCKRCYPGCRCSHTVFKK

SEQ ID NO: 56413 - protein, 128 aa, Sorghum bicolor
  Clone ID: 30942610.pep
IKMVFLSATMSNATEFAEWICSLHKQPCHVVYTDFRPTPLQHYVFPIGGSGLYLVVDENGQFREDNFSKLQDSFAKQNNQLDGRKGGGPKASGRIAKGGSASGNSDIYRIVKVDRHSHSSILCMISLA

SEQ ID NO: 56414 - protein, 77 aa, Sorghum bicolor
  Clone ID: 30942635.pep
SRNRSLKMVRNENIARNNSRRPCLTRGIYGLTEPEYEKARPVPSRHICWRKEYFTTSFNGGRFLPPSACAYTTRPLS

SEQ ID NO: 56415 - protein, 147 aa, Sorghum bicolor
  Clone ID: 30942658.pep
MGEEAESTCKRKAPDSSAEEQPSSAPAQSQSQADPAAKRRNLSRSCVHEVAVPKGYESAKDEAVHGTLANPDFNGEMAKQYPFNLDPFQSTSIACLERNESVLVSAHTSAGKTVVAEYAIAMAFRDKQRVIYTSPLKALSNQKYREL

SEQ ID NO: 56416 - protein, 143 aa, Sorghum bicolor
  Clone ID: 30942663.pep
SSSPLPPSKHRARRSASTRSPRRCRHSAAIHTAPPHGRIRRIHPSHRRTSAPPHPRIGGDEIEQSSLASTVHIHSRAPTRDEKHRLAFLQIRRHHLLRICHGGCHSCLPVHDEVYTASVLNSSAMARCRGVEGAAFISVALTV

SEQ ID NO: 56417 - protein, 64 aa, Sorghum bicolor
  Clone ID: 30942690.pep
QWNFNQNPDPRHGGLFLPASNPLQPPPPAHGVSFGLFVWNDGGGGARKDSRRLRRHPTLPGTVQ

SEQ ID NO: 56418 - protein, 191 aa, Sorghum bicolor
  Clone ID: 30942698.pep
MICLYTLWLAACCLLLLLYSVRFRSGFSHGSGPRSYPMIGCLIAFYQNRWRLLDWYTELLAASPTQTIVVDRLGARRTVVTANPANVEHILKSNFGNYPKGKPFTDILGDLLGTGIFNVDGELWYAQRKLVSHEFSARALRDLEFAVLEDEARERLVPALSLAAARGGVVDMQDLLRRFSFDVIWRVSLGV

SEQ ID NO: 56419 - protein, 223 aa, Sorghum bicolor
  Clone ID: 30942700.pep
YEFMVDEQGRLVRVFWADAICRKNYSVFGDVISVDATYTTNQYNMKFVPFTGVNHHLQSVFLGAAFLANEKIDSYVWLFQTFLKAMGGVAPQLITTDEDASMTAAIAHILPDTAHRFCMWHIMEKVPEKVGPSIRNDENFWERLNKCVWGTENSEDFVSQWRSIMTDYELMENEWFSTRYAIRESWIPVYFLDIPLAGMLRTTSRSESANSFFNRFIHRKLTF

SEQ ID NO: 56420 - protein, 189 aa, Sorghum bicolor
  Clone ID: 30942726.pep
MICLYCPCTAWYTDGILTCTVPEPTPWNGQEFMKEWRRHREEATLLDPVVVEAAPDSLDALMAEMATMLASYDRRIDMEAVAIKMMAMLLKMDRKVKTSRIRALFNRHLASLGVPKSVHCLTLRLAEEFAVNSAARSPVPPPEHATRLTDASCLHVALVTDNVLAAAVAVASAVRSADDPARLVFHVVT

SEQ ID NO: 56421 - protein, 215 aa, Sorghum bicolor
  Clone ID: 30942750.pep
ANRLCLSQDLIDLGRAGLGTCLLAGLPGWLVAYTANLVRFIYLERQKLPDEILRHNVDEKRQFLIEINMDSEKNDAEVQAEGVLNSRLQQIVHTLDKVRYVMRCVFGDPKNAPPPLVRLSGKSLVSAIWKGDSSIVAELLQSMEPHVEEEVLSDLKVKIRAHDPPDSEDIEGGIRNSLLWLRDELRTLPCTYKCRHDAAADLIHLYAYTKCFFRV

SEQ ID NO: 56422 - protein, 78 aa, Sorghum bicolor
  Clone ID: 30942756.pep
YACQTNDDLKGWYIVHKVSPHGRLPIPNDQDYNFNPNTYEGDFFQEEELEGRLVIDLTEAIGMDVVVVDDDDDAGDEV

SEQ ID NO: 56423 - protein, 102 aa, Sorghum bicolor
  Clone ID: 30942772.pep
GASSSSSTSSPYEPRRPELPPSAVSGGRPQRQPCSSGRRRRRSWPPKIRYGAAVPVALGSGRGGGESRTLKAIPLRRGCELRSASLLSARFLGPSSLAAPRP

SEQ ID NO: 56424 - protein, 162 aa, Sorghum bicolor
  Clone ID: 30942773.pep
MQADGDAPAPVPAVHFWGERPATEAEFYAAHGAEGEPSYFTTPDAGARRLFTRAWRPRAPERPRALVFMVHGYGNDVSWTFQSTAVFLARSGFACFAADLPGHGRSHGLRAFVPDLDAAVADLLAFFRAVRAREEHAGLPCFLFGESMGGAICLLIHLRTRP

SEQ ID NO: 56425 - protein, 188 aa, Sorghum bicolor
  Clone ID: 30942775.pep
WQMKRRRSSPTPRALVIRSPKRLPVRSPTRARCLLAVVRIYALAVVKSPARCRDVDAAAAPTRACRPLVSVRSPRRARCPLLLSSASTRSPSRKGRRGAGMSTPRLRPHALAARSFPSARPRVRAARSTLSARRRLHLSRRQDRRGVETSGRTREQRINLKSKFDTNFPSSMSFYESSRIGQHSWRTN

SEQ ID NO: 56426 - protein, 125 aa, Sorghum bicolor
  Clone ID: 30942786.pep
SFIYKLRTLFLYNHKYTHTFISLRTQVYKQTCTYTNFFCTGKLTLRWSCHTYTDVMHWVYIWCFNLKKVWKTYPPGDEIAAARTGEDANCSCSWWVSEGEFSRARAPKGRTKAMAKRQRRLRENG

SEQ ID NO: 56427 - protein, 66 aa, Sorghum bicolor
  Clone ID: 30942800.pep
CMHARTRRQETSGTASVLQSRHCFLWLGWVVVAGFDRSRSSSLSPPASGWLPPLICLFPWLGVAYY

SEQ ID NO: 56428 - protein, 78 aa, Sorghum bicolor
  Clone ID: 30942818.pep
AWPAGAGPQHQRQEQSTKATRQPKDRPERVQLELIIVVQQGVSEKTGLLPRSLAAVLKMARGHRCAVLCTSMPCSRLQ

SEQ ID NO: 56429 - protein, 170 aa, Sorghum bicolor
  Clone ID: 30942845.pep
QGVVQDRNGRTVATLFGKWDESMHYVMGDCFGKGKGTEQFSEAHLLWKRSKPPKFPTRYNLTRFAITLNELTPGLKEKLPPTDSRLRPDQRCLENGEYERANAEKLRLEQRQRQARKMQESGWKPRWFAKDKDTDTYRYLGGYWESREKSSWEGCPDIFGQVPNDLMITD

SEQ ID NO: 56430 - protein, 101 aa, Sorghum bicolor
  Clone ID: 30942849.pep
SLRKRLDKSKWAYVASLTLYRDVLQVSVVKQDTLSSIHSCICFFFGEKIAYMVWFDVSIKHGRITIGYGNLILPINCCCKPLKEVYNRSTVPQSVNKRQVY

SEQ ID NO: 56431 - protein, 59 aa, Sorghum bicolor
  Clone ID: 30942851.pep
GTNELEEGSNVTSYAKARVWGEKYFNGNFKRLAAVKSKVDPHDFFRNEQSIPPLPAAAK

SEQ ID NO: 56432 - protein, 84 aa, Sorghum bicolor
  Clone ID: 30942878.pep
FIQGTLYKTAMESKKQSYLANLALYPGRSELPFLPANTQALILQPIGDKGIAIVGGDTIRGFTNIDQAWIAMIADKLDATLSKS

SEQ ID NO: 56433 - protein, 81 aa, Sorghum bicolor
  Clone ID: 30942886.pep
AAAAAAVCQASYRVRVVYEYSCSLVVSCDSVGAPGQKDGLAVSSPVSRAGSGYGCTCISLILPVVVGRIWGWTYARTYLFH

SEQ ID NO: 56434 - protein, 106 aa, Sorghum bicolor
  Clone ID: 30942920.pep
VCLVGHAIYRGWKRIKLRREARQAQQMFEDAEDAIREDNSSDDDDDDVGDGQLCVVCLRKRRKAAFIPCGHLVCCCKCALRMEREVEPLCPMCRQDIRYMIRIYDS

SEQ ID NO: 56435 - protein, 164 aa, Sorghum bicolor
  Clone ID: 30942922.pep
FQIQSLSGTQTLGGPCLPNVQASQHLLDAVTTSSPQAIIHPTSSMVTPPPTLQIDNTPTTSDIVSEKGSPDRNIERVKRPLFQQDTTMDNDQSTKTIHETIQKDGVASNQMKLHPNIHEAAIKPNDVSINEATNASNLSDDHNLKRHASEDSIYEPKKKSRELA

SEQ ID NO: 56436 - protein, 179 aa, Sorghum bicolor
  Clone ID: 30942928.pep
MEQPRSRLLSVCAVVLLLLLLLLLAPGLAAAFNYADALAKSIIYFEGQRSGKLPPGNRMPWRGDSGLTDGAQHNVDLVGGYYDAGDNMKFGLPMAFTTTMLAWSVADFGKYMGANLPHARAAVRWGADYLLKAATSTPGTLYVQVGDPAQDHKCWERPEDMDTPRAVYAVTSSNPGSDV

SEQ ID NO: 56437 - protein, 200 aa, Sorghum bicolor
  Clone ID: 30942932.pep
LLAMHATDHSLSYLLNVSQGDNSESGSHVEKLNSGPVTKDYGTTGYVHGTDKVAPEPHILLPIKSSEAFVTQRSMGNGEPGVYQNDNLHKSSVHSPGLATSLHTGLIDTDLNMNLHSNGGLSLSSLHIPVVDGVSRREDPLRDWGNISCSKGIIGFDHTTTNNEHIKLAHRLHDNVQMNVPVIVEDVTDNVPSGIPSSRP

SEQ ID NO: 56438 - protein, 214 aa, Sorghum bicolor
  unsure (1)..(214): unsure at all Xaa locations
  Clone ID: 30942972.pep
MITHHPSLLRPSILTHRAGVLGRRPTLNAFLSTTVASATPPLRLRSLRATAGGTSPVSGDGGKRAVPPPTLGAALLGFVRSNFLPLALIGGIILGLLDPTLGCLAHKYSLSKYGTFGIFVISGXILLFTPFLAQFIMQVQFFPREFITGLAIFCCMPTTLSSGVTLTQLVGGNSALALAMTVASNLLGIIIVPLSLAKYIGTGVGVSLPTEQLF

SEQ ID NO: 56439 - protein, 181 aa, Sorghum bicolor
  Clone ID: 30942984.pep
LLARKMDMILALDLSANRLAGTTPSQLGSCVALEYLNLSGNALRGALPASVAALPFLQVLDVSRNALSGPLPGSLLLSTSLREANFSYNNFSGVVPHAGVLANLSAEAFRGNPGLCGYVPGIATCEPPKRARRRRRPMVLAVAGIVAAVSFMLCAVWCRSMVAARAKRSGRQSVRLVDVED

SEQ ID NO: 56440 - protein, 126 aa, Sorghum bicolor
  Clone ID: 30943010.pep
KSKRSGVSYTILNVNNMWCISFTSSFLYVFTLICSVTFSPQDGLFGFIPKSKPAKAPVDKYQSNNNSDKLQQSQTNNSPAKVGKTMCTATLQMIRYLDSLPWSHAQHNLLHNLVMIIVASILLPKT

SEQ ID NO: 56441 - protein, 135 aa, Sorghum bicolor
  unsure (1)..(135): unsure at all Xaa locations
  Clone ID: 30943034.pep
MHPFCCAPLVPVSPAASAASAGAASSAVAGAPAMMPPPQPPPVPPPPARSNSAPIGERRAXAGVSGGGGGGGTSPPEGVKLNEIVGGGISGILYKWVNYGRGWRPRWFALHDGVLSYYKIHGPDRIILSRETERG

SEQ ID NO: 56442 - protein, 110 aa, Sorghum bicolor
  Clone ID: 30943040.pep
MAGGRSAEHQLLSRIAAGDGHGENSSYFDGWKAYDMNPFDLHRNRDGVIQMGLAENQLSLDLIEQWSMEHPEASICTAQGASEFRRIANFQDYHGLPEFREAMAKFMGQV

SEQ ID NO: 56443 - protein, 104 aa, Sorghum bicolor
  Clone ID: 30943056.pep
MSPAPTSHHSQINSRKEKRMRKVDTFAPHNDGHQWRKYGEKKINNTNFPRYYYRCTYKDNMNCPATKQVQQKDHSDPPLYAVTYYNEHSCNSAFLPLSPSEFQL

SEQ ID NO: 56444 - protein, 133 aa, Sorghum bicolor
  Clone ID: 30943074.pep
MELSRGIVSAPRRPVYSLHGRCCPLSGAFSPPPSSSTMEVRRRCISRALRPPQQEWVEGWVRRNDTLVRGLPILVGGASLVAVLLNRAVSGIAAVADASSSQSRADILTLALSMNFFGHGIPSLPQLVANHWL

SEQ ID NO: 56445 - protein, 44 aa, Sorghum bicolor
  Clone ID: 30943082.pep
RAEAKREPAEVRRNQEAARTEEQAAQIRETGHTPSSFSCWCWCL

SEQ ID NO: 56446 - protein, 170 aa, Sorghum bicolor
  Clone ID: 30943122.pep
MTLPVASLLPATVEPLINKKVVTRWRPLKLVYDHDIRLGQVPEKCSFRTLREFVAKRFPSSKAVLIKYKDADGDLVTITSTGELRLAESFIDKVGHEVVENGREGDNKLPVLRLHLVEVSPEQEPTLSSEEEKLEEDEELLINGEYSTLNTSAVVTNAEVVKQCLPAHIV

SEQ ID NO: 56447 - protein, 88 aa, Sorghum bicolor
  Clone ID: 30943163.pep
RVFMVSAEELIIMQYTVTLTKLHPECRRPRYIKMGSFSCHESIIRPNGPTSKVPVQQPCRSRTRPNDVDHRRASWYWHPAATPRAGLP

SEQ ID NO: 56448 - protein, 94 aa, Sorghum bicolor
  Clone ID: 30943179.pep
NEKAREGRDYVHKNFNCEDLLMNFLYANASSTRTVEYVHPAWAIDTSKLSSVAISRNTQKHYDIRTDCLAKFSSIYGPLPQKWEFGMREDHWDK

SEQ ID NO: 56449 - protein, 141 aa, Sorghum bicolor
  Clone ID: 30943183.pep
MFAYSMREKTHAHRNYEDDVPEDVKQRRLMELINTFRETTKKNYDSQIGTVHLVLVEGPNKRAPKTELIGKTDRGHKVSFASVPIPHTFEGEEARKPVVGDFVEVKILRSSTATLFGEPIARTSLSVFHKNVASEAQAVAA

SEQ ID NO: 56450 - protein, 112 aa, Sorghum bicolor
  Clone ID: 30943193.pep
DHAYSYLSLCWKYQGEGGWKPQNYTGLCEKILGKSQTVAGFFLIQYAHLWKDHLEKLLNLYASGKLKVFVDPKKFMGVSSVADAVEYLHSGRSVGKVVVCMDPSYGQTLAKL

SEQ ID NO: 56451 - protein, 132 aa, Sorghum bicolor
  Clone ID: 30943207.pep
MARHAKTDSDVTSLAASTPPRSPRGRPAYYVLSPAASHPDVHVGGVAGTTPAESPLHYHFHHHHRGSSGGAGAGGMHHSRESSTGRLLFSDQLRSGGDVAAVVSVPWRRLGHGGSGAGSVGDDDDDGGGASL

SEQ ID NO: 56452 - protein, 55 aa, Sorghum bicolor
  Clone ID: 30943221.pep
RAINARLINQAGSLACNKPELPRCPSDELLCGGGSGGLVGCDDRRPKWTDGTGDL

SEQ ID NO: 56453 - protein, 185 aa, Sorghum bicolor
  Clone ID: 30943225.pep
MAAPLAPLTAAAPQPHRSAIPAAAARRLPTPPPPAPRRLARTLAASAATVVSKGQTDLVPGSTTSSKGRIYHETYGCQMNINDMEIALSIMKNDGYDEIVPDPESAEIIFINTCAIRDNAEQKVWQRLNYFWFLKREWKANVAEGRSKSLRPPKIAVLGCMAERLKEKILDSDKMVDVVCGPDAY

SEQ ID NO: 56454 - protein, 168 aa, Sorghum bicolor
  unsure (1)..(168): unsure at all Xaa locations
  Clone ID: 30943235.pep
FVQRFVLEAKRVXHAMALAAKQAALCFKKVLRLSIRKSYTFVSEHPVLFGLGVLLYLLYRSSPRLFVFLLSSSPVIICTALLLGILLSYGEINLPEASEDHKGTPEVSTSNVGNSSSDIHFEENQKPSVLEFRDNAPNFKEREAKQTVSFRERASEHVDVDDYVPLLK

SEQ ID NO: 56455 - protein, 130 aa, Sorghum bicolor
  Clone ID: 30943237.pep
PPILQVPPRRASPSQRCKRAAAPARRSVRIAARNWPRGDTQAKARQVLMKRLGILDNEGLSHDDLLLRYFYLFKGPLTDAVVKALTALCGLDAAASVCMLPVLWVEWGDSQRPTVASPSNWEAPPPSSSL

SEQ ID NO: 56456 - protein, 208 aa, Sorghum bicolor
  Clone ID: 30943253.pep
ERSRRLLSPFLPRGAATPPLAGMPSQPAPDSTGGSPRIPVASAEAVRRVVDFFKTNGKLRSVTGAAVSSPLLPRGAATPPLAGMPSQPPQGSAGGSPRISAPFQPAPDYTGGSHRTPAPGSIGVVPRIPELSAQAVDRIARKCIILVDWWLERVEGEEGKIRVAGTTFTPRMAEQMRKGASSSNMRMAVRVFRSSAIVKRHDYTSIES

SEQ ID NO: 56457 - protein, 62 aa, Sorghum bicolor
  Clone ID: 30943279.pep
MQRLGDFRLPPFFNYPPYFTLQPVRETREKQVQLWKDLILDYCRSQKIHTISLDEDFPLFSN

SEQ ID NO: 56458 - protein, 144 aa, Sorghum bicolor
  Clone ID: 30943281.pep
QEESSRNKVMELIQEADRSKWMVPSNHSIRCFIQGDIERMTNNYRTSLGRGAFGEVYEGVLEDGSMVAVKRLIGSVKEKFAKELIIHREINHKNVVRLIGYCVEENALVLVMEYIANGNLNDVLHDDNRPILLDIRLRIAIECA

SEQ ID NO: 56459 - protein, 223 aa, Sorghum bicolor
  unsure (1)..(223): unsure at all Xaa locations
  Clone ID: 30943300.pep
MMLFRYLQEKDVFEKYYKQHLAKRLLSGKTVSDDAERSMIVKLKTECGYQFTSKLEGMFTDMKTSQDTMQDFYAKKSEELGDGPTLDVHILTTGSWPTQPSPPCNLPTEILTVCEKFRAYYLGTHNGRRLTWQTNMGTADIKATFGKGQKHELNVSTYQMCVLMLFNNADGLTYKDIERDTEIPASDXKRCLQSLACVKGKNVLRKEPMSKDISEDDTFYFND

SEQ ID NO: 56460 - protein, 108 aa, Sorghum bicolor
  Clone ID: 30943324.pep
QINQPAASPEEYSRANKEFRKLESTMELINELRSKREEIEGLKSLVTNAREEKDMREMAAEELLEAVEVEKRLQHELFISLLPKDEADERDCILEVRAGKPDLALAHT

SEQ ID NO: 56461 - protein, 84 aa, Sorghum bicolor
  Clone ID: 30943367.pep
ISGLAFMTFLLQNKSLCDLLSLDAVRLYDSRLQSYCYYRRTPYASMIPAYKATVITAKIIFPTLCRRVALVRTAGLQEPPNIVP

SEQ ID NO: 56462 - protein, 94 aa, Sorghum bicolor
  Clone ID: 30943377.pep
FPPLFSIVAPEQQPNVQPQSQQPQTQNQPQAQNQPQGQQQPQVQQPQVQQQPQVQQQPQVSSTTNEPMVFGVSVKEICGTTVAALALGWLLACF

SEQ ID NO: 56463 - protein, 75 aa, Sorghum bicolor
  Clone ID: 30943385.pep
GDSNSQEETGHVWYNFLRNVFLRNCTNGRKAKCFPEKKEAEERRVMYFCIQFIDAKTLQQTSAPNEQLYFGTRNY

SEQ ID NO: 56464 - protein, 71 aa, Sorghum bicolor
  Clone ID: 30943387.pep
IGQFCVNAQNLIVVNIVIMFKNYFSFLVLLTYSCFASARKGTPFLLVANKTDDGFVLWCIDSYYMGVIGCS

SEQ ID NO: 56465 - protein, 63 aa, Sorghum bicolor
  Clone ID: 30943405.pep
THHLPDQNTHTHTHTMSLQRLSQQITYAILSSSPYPTLLRSGHLYIFTKTRSSSQFPVSSHWM

SEQ ID NO: 56466 - protein, 111 aa, Sorghum bicolor
  Clone ID: 30943412.pep
GAGGSPGVDTKVLHAFQTSFVQVQTLLDQNRLLINEINQNHESKVPGDLSRNVGLIRELNNNIRRVVDLYADLSSLFAASDAGRAASEGGSVGTVRQAPGAGHKRIRSGLD

SEQ ID NO: 56467 - protein, 171 aa, Sorghum bicolor
  Clone ID: 30943445.pep
IAVTQTFVNQSNFQHVCLDMAPGHRHKGVCRAGLLAVPGKFIKDNENHPSVTMSGWNHPDMSRKEKRLKSSEPLRTSNSINHCSAFEFSGVQESLENQDFSYDIDFLSQFLEKERDHYSSLWSPTNSLGQREAREWLRRLWVLKPELRELIWKGACLAINVDKWYSYFPGQ

SEQ ID NO: 56468 - protein, 163 aa, Sorghum bicolor
  Clone ID: 30943447.pep
AADLYGLDVLAHGLQDESWNVTRFLLLSRPSAVAALPVDAAAGGATKTSMVVAHRGGSMMVVLKVLSAFSSRGINLTKLEVINNDGAAAADAGSGARPPVVILDTSARGKPTLRAFPHVLYVDCEGAAHDPRVREAIQEIETFAVFVRVLGCYAADSTVYDLQ

SEQ ID NO: 56469 - protein, 151 aa, Sorghum bicolor
  Clone ID: 30943473.pep
MFHMKTLFFLFFIIIFHLAIPMYATTIAIGTSLLHTHLPLPDFESRKALININLRTVQIAADVNIDEVARRTEGYSGDDLTNVCRDASMNGMRRKIAGKTRDEIKNMSKDEIAKDPVATCDFVEALVKVQKNVSPADIEKHEKWMTEFGSA

SEQ ID NO: 56470 - protein, 200 aa, Sorghum bicolor
  Clone ID: 30943560.pep
MQPAVRTRRRRTTTVVVPLPSAVRRVPLSPLDTRWVALPPMCHVFLFPAAAAQVPFSDIVSVLRSSLAAVLPAFHPLAGEVAYSPQLGTVSIVYGEDDAGGVAFVESETDLDFARLVADRDDDDDALLQLVPDIAQEELPAPVFAAQVTEFVQGSRGIALGVAFNHVAMDGIGFFRFMEMWGASAMAAAGASSHATEPPL

SEQ ID NO: 56471 - protein, 189 aa, Sorghum bicolor
  unsure (1)..(189): unsure at all Xaa locations
  Clone ID: 30943564.pep
MASARLRLRLLDGYGLLMSPALSATALRSSRGLRALCTLSTTLRSGAGEDEIERIRREFEDAKRNYLSIPAAIKDMPKMNPQGIYVNKNVKLDDLQVYGFDYDYTLSHYSEHLQCLIYNLAKKHLVNELKYPESCXQYEYDGTFPIRGLYYDRLKGCLLKLDFFGSIEPDGCFFGRQRLSLSEIKELYG

SEQ ID NO: 56472 - protein, 102 aa, Sorghum bicolor
  Clone ID: 30943581.pep
YTRRGVVEYGTEFLTETVERLGLRRPPTAAEGQLPSPHPRPGLDLQAIGPWPVATVHRREHNCEHLHRAAYDVSSKYYRVEIRSRRRSPATRQHARMAGIEF

SEQ ID NO: 56473 - protein, 191 aa, Sorghum bicolor
  Clone ID: 30943604.pep
MAVLQSPHLTPPPLCCCSHACLYPRFLKPPPKFSNGVCSTSTARPSDRSELLVGKSGALVWRAAGRQRRRRLGLGVTGAGRGPFFGGGGRRMDKGTTRVVGNLTFAAVVTYLAVTGQLRWVIDAIVSLWLLTILLPVLALGAFFFFAGQDILQGDCPNCGKSFQILKSALKDGPQLCPYCTQPFSVQGNKF

SEQ ID NO: 56474 - protein, 89 aa, Sorghum bicolor
  Clone ID: 30943614.pep
IASKGRCSPPRSCCCCCYGGGGLQLLLLLLRGKHRHPRRRRRLLQLDCPAAELTGAGFIPWLLSLVVFGHGDRCSDPPAPQFLPARLRL

SEQ ID NO: 56475 - protein, 85 aa, Sorghum bicolor
  Clone ID: 30943644.pep
VAMSPGTVRFTIEALMVAYGKIQFSKNIDKRGLLLNGTLNSSELGYCSCRREIKLRLQSIHIIQLLKKSTSTNIRNKKLNAPSSP

SEQ ID NO: 56476 - protein, 217 aa, Sorghum bicolor
  Clone ID: 30943646.pep
MEAAGNGRRDAALGALAVLPDEVLCAVVDLLPPADIGRLACVSSVMYILCNEEPLWMTKCLSIGGPLEYKGSWKKTTLCRLGLCSENMEILQKPRQFDGFNSLHLYRRWYRCFTTLSSFSFDDGHVERKDDLLLDQFRSQYDGKGPVLLTKLAETWPARTKWTLQQLTKDFGEVPFRISQRSPQKITMKLKDYVSYMELQHDEDPLYIFDDKFGESA

SEQ ID NO: 56477 - protein, 88 aa, Sorghum bicolor
  Clone ID: 30943656.pep
ASSGIGKDIKIWEPGEGENLTITQAHEDDEDIWISSDYDSDDFIISDGFGYVIDLDPAHLYENGDHESEEDEEEDFDGGNSAGDEGDD

SEQ ID NO: 56478 - protein, 133 aa, Sorghum bicolor
  unsure (1)..(133): unsure at all Xaa locations
  Clone ID: 30943698.pep
MLLTYQCLPPMPMPPPPPPPPPPPPPPPPPNPPPLPNPKPNPLPKPPPEPPPAPPPYPPPLPRPPPLPKPPPXPPPEPRPPPLPKPPPXPPPEPIPPPLPKPPPMPCPPPRPPPLPXPPPMPXPIPPPSPPPF

SEQ ID NO: 56479 - protein, 96 aa, Sorghum bicolor
  Clone ID: 30943706.pep
IPGEVKAGYSPIGFVRCGRSACRMKNINWKVGKETGGKKMEGAHSLKANEMAEVVFEPCQPLVVDSFKNCEGLSRIAFLDGNTAVMLGKITAVTGK

SEQ ID NO: 56480 - protein, 118 aa, Sorghum bicolor
  Clone ID: 30943716.pep
ENGENWSVGQRQLFCLGRVLLKRSNVLVLDEATASVDSSTDAIIQKTIREEFGECTVLTIAHRIHTVIDSDLILVFSEGRIIEYDTPSKLLENESSEFSRLIKEYSRRSHGFGGTANN

SEQ ID NO: 56481 - protein, 92 aa, Sorghum bicolor
  Clone ID: 30943720.pep
VMGSEGTGLSPLVERSCPHLVRIPGNVDVFVEGAGADADPGEEGASFFSNQDLRSFLAVESLNVSVAAGVLLYHLAAKDPCFRSDNPSVTLM

SEQ ID NO: 56482 - protein, 57 aa, Sorghum bicolor
  Clone ID: 30943744.pep
KELSIQECPNIESLPQLPRFLKTLVLSQCNRSLTDSCRTKGHPNWQKIRHITEKIIS

SEQ ID NO: 56483 - protein, 82 aa, Sorghum bicolor
  Clone ID: 30943758.pep
MEGRKKKNMSCRHPGLLDSSTAHTFQFSVELSRHIWWRFEKPNFSSSVSDMFLPWTEAIPGNSTVSTLKAKRAIGSVSELHK

SEQ ID NO: 56484 - protein, 129 aa, Sorghum bicolor
  unsure (1)..(129): unsure at all Xaa locations
  Clone ID: 30943774.pep
RIDAHCMCSPGFSCDSAYQVTYIVRGSGRVQVVGIDGTRVLETRAEGGCLFIVPRFFVVSKIADETGMEXFSIITTPNPIFSHLAGRTSVWKAISPAVLEASFNTTPEKEKLFRSKRLDSEIFFAPASN

SEQ ID NO: 56485 - protein, 132 aa, Sorghum bicolor
  Clone ID: 30943782.pep
VRNGQTWASWVKERIDLRRTRVFFRTYEPSHWSGLNQKVCEVTEQPTTEANGNDRREFGDILAGVVANMGVPVTILNVTLMGAFRSDAHIGLWSHPNTILDCSHWCLPGVPDAWNELVFSHLLTNGWRVPAS

SEQ ID NO: 56486 - protein, 81 aa, Sorghum bicolor
  Clone ID: 30943804.pep
LKVKVKDRSVIVTTDAETKVSQPSSLQELIDKETANYTNGRCFVRPSGTEDVVRVYAEASTQVEADSLAKSVAHHVERLLG

SEQ ID NO: 56487 - protein, 187 aa, Sorghum bicolor
  Clone ID: 30943810.pep
MVQRTSTAQVMSMDLSPKKPNKAYGSDGGAYYDWSPADLPMLGAASIGAAKLCLSAGGLALPSYSDSAKVAYVLQGKGTCGVVLPEATKEKVIPVKEGDSLALPFGVVTWWHNAHAACSSSDSDDLVVLFLGDTSTGHKRGQFTNFQLTGSTGIFTGLSTEFVARAWDLTPDAAAELVSSQPGAGII

SEQ ID NO: 56488 - protein, 211 aa, Sorghum bicolor
  unsure (1)..(211): unsure at all Xaa locations
  Clone ID: 30943818.pep
TTRSXDGPDGAAAAQYQFRCAAPGVDTRGLPTPPLAVSRADVLRLKLPLTISRSPPQPPDLPFQSFPVAKSACNQFRAKLCPTKISSNLVPAASPQFRRADGYPASGFKFVRRIDSDRSARLQSKARAQLSKPRDQGALSPVVGRQRQRQRQAMQGTRADQALTELRRPAVLSPAIAGAGRAKTLKKLAAKTELSMRQRRAARCDPRLERW

SEQ ID NO: 56489 - protein, 93 aa, Sorghum bicolor
  Clone ID: 30943825.pep
MEAGRVDQPCMAATNSQPFVADIEPVKKASGDMPVTTGSGCFDCNIWLDFAAEPVVTLCGHLYCWPCIYEWLCPGVESTASDNSSSARRQCPV

SEQ ID NO: 56490 - protein, 165 aa, Sorghum bicolor
  Clone ID: 30943846.pep
MAATARLLPAFADAAAAAAALLVVVLCLAGGARATNVTYDHRALVIDGVRRVLVSGSIHYPRSTPDMWPGIIQKAKDGGLDVIETYVFWDIHEPVRGQYDFEGRKDLAAFVKTVADAGLYVHLRIGPYVCAEWNYGGFPLWLHFIPGIKFRTDNEPFKTEMQRFT

SEQ ID NO: 56491 - protein, 223 aa, Sorghum bicolor
  Clone ID: 30943854.pep
WPTGGGQDTAQVLLGRDTRPTGAYLLDAALQGINAIVGARAIDMGILTTPQLHWMVRSKNRGVKASESDYFMQLIGSFRRMLELVPKDKGGDEAAKKLIVDGANGIGGVKLEQIKAELSGLDISVRNSGKEGEGILNHMCGADFVQKERVTPHGFSPEDVGVRCASLDGDADRLVYFRLSSASDNRIDLVDGDKILSLFALFIREQLDIINNNGGQANKSLSA

SEQ ID NO: 56492 - protein, 167 aa, Sorghum bicolor
  Clone ID: 30943908.pep
MATDGKQHLSIVICGHVDSGKSTTTGRLLFELGGIPERELEKLKEEAARLGKSSFAFAFYMDTQKEERARGVTIACTTKEFYTEKYHYTIIDAPGHRDFIKNMISGAAQADVCLLMVPADGNFTTAIQKGDHKAGEIQGQTRQHARLINLLGVKQLIVGVNKMDSDT

SEQ ID NO: 56493 - protein, 106 aa, Sorghum bicolor
  Clone ID: 30943914.pep
PPSLGREITPSRMAQSNWEADKMLDVYIYDYLLKRNLQTTAKAFMAEGKVAADPVAIDAPGGFLFEWWSVFWDIFIARTNEKHSEVAAAYLEAQQIKAREHQQQMQ

SEQ ID NO: 56494 - protein, 136 aa, Sorghum bicolor
  Clone ID: 30943916.pep
MADEAISAACSCLEPLFGCLLQAADREVAAFLRIKSNWGDLGRARDSLRAVETTVRAAVAAEEDKLNVCDPEVEVWFKRVDELRPDTIDEDYSSLLGFSCLCQCTVHARRRASIGKRVVEALEEVKELTEQGRKFR

SEQ ID NO: 56495 - protein, 166 aa, Sorghum bicolor
  Clone ID: 30943920.pep
MEAHGDQRWLVECLTATLDTARDVRAFAEESLRQASLLPGYGAALTKVTINKEIPFGLRQLAAVLLKQFIKQHWQEDEENFVPPVVSASEKVVIRQLLLTSLDDSNGKIRTAISMAVAAIGQQDWPEDWPELLPVLLKLIGDQSNGNGVRGALRCLALLSDDLDDT

SEQ ID NO: 56496 - protein, 211 aa, Sorghum bicolor
  Clone ID: 30943924.pep
MKDKVPIKDDDDNEAIGNPERGRIKGRYQRREVLGNRMPNNVAIREQEDDDENEPIDNPKWGKIKDRYQRVVGRDGGSRGERFRREGFDKPDVRQWNKQENWGRKTGKEAGESSVPNIVGQGVYGVGPVLAALMARRREFYALYIQESMDLSGNNKKRKDKKAVEKVLRMAEEIGLKVIETSKHDLNMVVDNRPHQGVVLDASPLEMVNIK

SEQ ID NO: 56497 - protein, 230 aa, Sorghum bicolor
  unsure (1)..(230): unsure at all Xaa locations
  Clone ID: 30943948.pep
WSYDVIVGITYYQVDGIAVDSFMPTIARWHLRKRIEELENVVTDARKCPLLKQQSSSGWNDIGKMNRRSITSSTTRKVFGRDRERRMIQSMLREEPDDHAPGTSSSKCCSVICIHGIAGSGKTTLAQYVCDHENENREKYFNPIMLIHVSETFRVSDILHDMLEAITEDRHSDISGCKGLQAKLVDKLSGKRFLLVLDDLWVNDENHQDLEEILSPXHVGKRGSRILVTA

SEQ ID NO: 56498 - protein, 162 aa, Sorghum bicolor
  Clone ID: 30943962.pep
MDGSRRSPRIQSTALAAGAGMDYDLAIGDQGELWEWQSQEYDLQNDLLADPCSSLWAETSNNVGDEWSMFDEQTPIKHCTDFEFQFCDIGEIIVKDFEEGKETSQAKRRRMLQFCPENAEMTCSMTEDGLSESLQEMDFSGTDCLLNSDGIDELPEEWLVDC

SEQ ID NO: 56499 - protein, 87 aa, Sorghum bicolor
  Clone ID: 30944041.pep
ESINIFCPSTSRHTKNCIAKYSHIAYLIECTINYISICMDDVIKAYCCKVYGYENQLMQAQVMPLQASAQTKNKLRTEIIHGIACTN

SEQ ID NO: 56500 - protein, 117 aa, Sorghum bicolor
  Clone ID: 30944048.pep
LKLYVGGALTGSVFFLLEKAFLAHRKQDYEGWDTSRVAGLGASAAVNATILLQIFLYPKGLVYLYFLIPVPAALMGAAIIGADLLRLKRHGEVSGSAHLGGALVAALMWARIRKGWI

SEQ ID NO: 56501 - protein, 127 aa, Sorghum bicolor
  Clone ID: 30944060.pep
SCRLIHSRFSAVKLWSQHPYFFSIHVPEHLRALIIPHGSCCCRSAQGNNTAACFLVCLMNDLRQGRRLQWCLHLPPNLIHDESIVDSPCALKGTTYDAATEIIVSVTTAHHIDWRITVKEAGRVCRQ

SEQ ID NO: 56502 - protein, 101 aa, Sorghum bicolor
  Clone ID: 30944063.pep
INHVHLYNSNFRTILKFLPAQYYGCFWSLFATPKCLYPLLGKHVLLLFYDLSCKIAATAGKKATTDTEHVSGEPYKELLNSFVKVIYNGQPTKSGSRSQIS

SEQ ID NO: 56503 - protein, 121 aa, Sorghum bicolor
  Clone ID: 30944067.pep
KQNLVPWSLIAPAGFEVFEADLSTKPGQWISVRELGSQALFVGKHCSKSFPAGEFTGVEENCIYFMRDYFPANLAANPLGDSGVYNMKSGNIKPLLSETAAVPQHHGGRWCPTWIFPTDAM

SEQ ID NO: 56504 - protein, 100 aa, Sorghum bicolor
  Clone ID: 30944099.pep
VNDLLKEAAANARAQLEKERNSIEQSLSNIVDVQMMEIQDKICRFEQKEMLMEKERQQLNCLRDILFTDQLAVMQHQQRTPAVVTECKGDEKPKPLANMS

SEQ ID NO: 56505 - protein, 180 aa, Sorghum bicolor
  Clone ID: 30944147.pep
MATTATTTATVTAPAATANFVPTPTPPHPRPAAPPALRAPSTLGPVKSEAPPTPSSSTATTAAAAAAVAEDPSYIITVPSYSAWFSFDSIHDTERRLLPEFFEGEAAAASGCRGPHAYKYYRDSLIRRFRARPGRRLTLTEARRGLVGDVGSVRRVFDFLEEWGLINYGALPSGSKQAKE

SEQ ID NO: 56506 - protein, 142 aa, Sorghum bicolor
  Clone ID: 30944211.pep
PRERCPRRRSSLHLRPLLPPPSSPPSRLTPNPNRRPARAPHPASRSSPPPRDLDTIQIPEGAGIQRRVPHGAGPARLIPPRSLCPRRARPRLRQLLEASSQRLPEPPLSFCCCFCCCSSSSLRPRRRGDRGSTESPARCREV

SEQ ID NO: 56507 - protein, 214 aa, Sorghum bicolor
  unsure (1)..(214): unsure at all Xaa locations
  Clone ID: 30944215.pep
NNGGASPPPPPPGPPRXRRLLSTTTPAASSSNPPTPEAVLYDIHSLSKDPSQALAVFRRSAAAGQPVSSAAYNLTLRTLASHPSSAQRHFWPFLREMQEAGHSVDQGTYLAALASFKKASLTADYASLTAHYNKFRKGANSAAAAAAAAEAVRDHDAAGLDSRLADIGLLPLTETTVITVLRELREYPIKALAFFRWAEQQQGYTHSSVAYNAM

SEQ ID NO: 56508 - protein, 215 aa, Sorghum bicolor
  unsure (1)..(215): unsure at all Xaa locations
  Clone ID: 30944237.pep
RHSIKTATFAPISIHTALSGDSIQYXQGAPWRKGEDDNCHHEALRRRCNEKRSREPEPRAAASHRDAAVRATAATSAAVLGRRESPVAPERRFHRRWADGEGEGDADVGAEGECTKRWWWGWGWGLGFGAPRRACCAMRDGNSSSFLRMVNPPGNLEKLCKAAPAAVAAGSRGGSSTSKSSAKLLRPPSPPARAGAPRCFVSNSEKGGFRTTLES

SEQ ID NO: 56509 - protein, 107 aa, Sorghum bicolor
  Clone ID: 30944245.pep
PLPFGLLTSPPAASADVRDDEEEEEEEEVVALLLPDPITHQHQPTPPAPTDPRIGPDRSPLLRLHASLPRDGAWVRVAACATPRRLGGREWGTSAAVASFVFPQTLA

SEQ ID NO: 56510 - protein, 68 aa, Sorghum bicolor
  Clone ID: 30944257.pep
MVTVREEMRKGPWTEEEDMQLVCTVRLLGDRRWDSIAQVSGLNRSGKSCRMRWVNYLHPSRKHGRLSP

SEQ ID NO: 56511 - protein, 160 aa, Sorghum bicolor
  Clone ID: 30944265.pep
PASKRNHGPASLDCITPARPLNASPSATLPSSSSRPRASLQPAGRGLRRSRHHASPPGAAPLAASPPPARTSRQPYPRTLPPSCSSSRRLQGAPRSLTNGPQGHSGIIVKVAHEFPKTSPNIHLHFQTIIFANLSGTYLLQLHYRVAVGVEKIMYALVFL

SEQ ID NO: 56512 - protein, 153 aa, Sorghum bicolor
  unsure (1)..(153): unsure at all Xaa locations
  Clone ID: 30944271.pep
MMKEARSSSWSDLLPEILGLVLRRLPSLADRVRLRAVCRPWRSNAQLDALLPLLPWLTLLDGTFLSIPDGKIIRLPIPFKAFCRGSVDNWMFFXHGDGGCSLMNPFSKATRDISKLVTTWFNSNSRCYSYHFFKLVAPSPLESSPGSLVALIL

SEQ ID NO: 56513 - protein, 167 aa, Sorghum bicolor
  Clone ID: 30944283.pep
TKASATLLILHNAHLLAQLLAFAAILTLFILQGLRGAEPWAAPDAGREGPGAGGKRRREGAVVWLGVGGGELERLLVGLRRVGGRGGQRDGPNIRAAAGEIASDSKAQPGRHGGGDRRELHHDVGLPEVQSAATEIGTAVWFFSSEEGAILIVCRINVDENFIYTMF

SEQ ID NO: 56514 - protein, 82 aa, Sorghum bicolor
  Clone ID: 30944285.pep
HGVETRTSSPLQISRHGETYESTSLRGLYPIGEGAGYAGGILSAAVDGMYCGFALAKQLSLFHGDIESFLGKAQKQTGFVKY

SEQ ID NO: 56515 - protein, 101 aa, Sorghum bicolor
  Clone ID: 30944301.pep
RQFIHENSSKFGRHPYDLISQNKPVQFWRMPIPSEDVVPYAPYQRSSHEEVPDITIQDVLYGNSKLHGKFEVLSWRSQIPPFYSYVLSCEIRKKKTAGTKR

SEQ ID NO: 56516 - protein, 115 aa, Sorghum bicolor
  unsure (1)..(115): unsure at all Xaa locations
  Clone ID: 30944331.pep
SKVILAKDLVCLSCIFHVSFQVLLEQVTSSPWNNILFLFYXGYVAERRPLKEVTTRVKKQYPSVQLSAWMFWPIVGWINHQYMPLQFRVIFHSVVACCWGIFLNLRARAMSLKQA

SEQ ID NO: 56517 - protein, 203 aa, Sorghum bicolor
  Clone ID: 30944388.pep
LLQEIGMDTEFDLIFQMLGWTNFWNIIELGSRLLTLEFLCTLQYYEGGIVFRMFKQEIMLSWRELSDHLGFSSRCILNIDSDLPNFERHQFWREISRDNFYSQARTSDMEHPTLRMLYKWLGYNLFYRDDIRKVRVGDLQLLYAAINKVPTSPVTLLVSHWLSIPSLQGPVGCTSLITRLASNLHLLENSSLDFINELRIYHG

SEQ ID NO: 56518 - protein, 129 aa, Sorghum bicolor
  Clone ID: 30944394.pep
SPDIWCKEGELLKRTRKGGLHKIRVSIYINKRSQVILKLKSKHIGGALSKNNKSVVYGVYSELPTWAEPGKNSTEETCCFGLSTAQGLVEFECEGNASKQKWVDDVQNLLRQAALHDQVGNKLGLVKLS

SEQ ID NO: 56519 - protein, 197 aa, Sorghum bicolor
  unsure (1)..(197): unsure at all Xaa locations
  Clone ID: 30944429.pep
MAMEKKSWKATRDVAAGAFSMDCLELVGEEDDDDAVPAIPPPQTPMEPMEYLSRSWSVSASEISKILVGGGGKKSSAGVAAASRLRPEVTIPELSVLATTSSSIVPLPCHHQQHRDARRSSMSSGHYYHHHQSIGKWFQVHHRETCRAKQSGKEKQRADXAHVHAMVSVARVAAAVAAVAASTATSSDSTQAATKMA

SEQ ID NO: 56520 - protein, 46 aa, Sorghum bicolor
  Clone ID: 30944440.pep
VVVYFLLNLLFGQLFVRAVDLYRFRLHFFGLVDFHSCCTLTYAGLK

SEQ ID NO: 56521 - protein, 98 aa, Sorghum bicolor
  Clone ID: 30944448.pep
MMSRNPWLVLLILICFLVCPVRIHGFSWNIFSSSSAPKGGDRAPVMELEGAVADFALDGTNDPRGLKLLENARNKLAGPRNCWQEAYRKLFASCSEIM

SEQ ID NO: 56522 - protein, 209 aa, Sorghum bicolor
  Clone ID: 30944450.pep
MAMAFATASASASSLSLTAFSLPLLQSLRPSPSHALHGATSSFPRPRRCGWGAVVRCAKRTGKRRYPSEKKRLNRRQQELLRQAAPEEGSKGRESGYWRLSKLAVPARDDPGKDFIGISLPLLQAIAKAIKFPVPSMLPDEAFTVIRKSFDARKVLKEPQFTYIVDMDVKKILDIEPRAWDFIARLEPKLGAVEYMPGEKSAADLVSML

SEQ ID NO: 56523 - protein, 160 aa, Sorghum bicolor
  Clone ID: 30944472.pep
PPTPPPPPPPRPPTLAELLPKYGLPPGIFPSTVTAFSLASNGSLTVDLAGPCYVHFEYLTYFDAHITGVLRYGSLSDLQGVQVRRFLIWYNVVRIKVDLPPPPRYVYIDIGWITRKLPADDFESLHACEDSKRCRLSSALAVAAKWFQVPDLPESSSATW

SEQ ID NO: 56524 - protein, 84 aa, Sorghum bicolor
  Clone ID: 30944502.pep
MASVGGAGRGEGKRDGGKGEEGSLARRAWRQYLLQLQQHPLRTKMITAGCLAGVSDTVAQKLSGYQKIEKRRLLLKMVRTLPCI

SEQ ID NO: 56525 - protein, 213 aa, Sorghum bicolor
  unsure (1)..(213): unsure at all Xaa locations
  Clone ID: 30944536.pep
MLDEVLKPIXVAGNVSKRRRLDEESNAARLGAPLDVRLLGLQQRHLRLPCLRHPPPKRAIPWQQSTARTRRSLLRLCRSSACRGRPYPASSRVVGFPPAPVLACRLPCNPRGQVVAAARASSFTATRGRGRGRTQQRHRDTRGGSATTTAGTWLWWTGSGRVGRKREKYEGSGGEKIRRAKARNEPGQSSADGESNRFAPAADRNHAGHGRRE

SEQ ID NO: 56526 - protein, 54 aa, Sorghum bicolor
  Clone ID: 30944564.pep
RITVQISLIKKKTFCRYLYSSQTPLPQQRSTMRITYPVPSPQLFKLTNQPGGGG

SEQ ID NO: 56527 - protein, 131 aa, Sorghum bicolor
  Clone ID: 30944582.pep
GATANANDDDDFFLPLPASAEVDSLAAVLGPPAAGRPGILSPAALPPAASTGLFSPMPFDPSCLSWLSELSPFLPSAGTRATAAAAGLLDQAPFAPSPRSSSSLLLSTPTMPSPATFSVLEFFSSNNFPDL

SEQ ID NO: 56528 - protein, 48 aa, Sorghum bicolor
  Clone ID: 30944602.pep
AGNGRDVGGSRSQSFGLVVPEGRVHGGGLMSMFGVGGNLGNNPDCSKP

SEQ ID NO: 56529 - protein, 127 aa, Sorghum bicolor
  Clone ID: 30944638.pep
NKISQLATYRTALLSLNGTLELCCCSSPLTKAIGLRNMDPIIHWMAQIVTCCRMTSDKTVTSKLPALVSSQVILGIQNAEGQTTKRTSSQGLFHISILKNSNTLLCLVKNCPEGFTFNTKLFTEPSF

SEQ ID NO: 56530 - protein, 152 aa, Sorghum bicolor
  Clone ID: 30944648.pep
KISDVEGLHRLLKLAVLDVSFNKITTAKSLGQLVANYGSLRAINLLGNPVQANTGDDTLRKAVSGLLPRIEYLNKQAVKPQRAREVAKDSVAQAALGNAGWNSRRRLTRRLSQSPGSAGKGGRGRDGNGNGSRRGSRSRSMTRPQSSSLPRR

SEQ ID NO: 56531 - protein, 62 aa, Sorghum bicolor
  Clone ID: 30944664.pep
LEILNMSLIKTCNTTNMGIRAARLHSKTSLVNEVLNQQMSYNLLHHQFFLELSRQVLQLIQI

SEQ ID NO: 56532 - protein, 59 aa, Sorghum bicolor
  Clone ID: 30944668.pep
GCCIRDAFWQGAYTSFFYSIIIADFCSLLRVEWVMPIMFHFYRDGSCDSYTSSFMASFY

SEQ ID NO: 56533 - protein, 83 aa, Sorghum bicolor
  Clone ID: 30944670.pep
QTYIILVPHPSIKSHLTEANRTRHPCGNLKRNLRIELIENDIVENCRIISITMSILALNELFSLPLKATYLKPPELENVTLIV

SEQ ID NO: 56534 - protein, 83 aa, Sorghum bicolor
  Clone ID: 30944686.pep
YDIEEEEKERILLGHSEKLAVAFGLINTGSGEVIRITKNLRLCEDCHSVTKFISKFTNREIVVRDVNRFHHFRDGVCSCRDYW

SEQ ID NO: 56535 - protein, 137 aa, Sorghum bicolor
  Clone ID: 30944695.pep
NPSPLAATTHPTVMSLSAASAAVASSAAAADRYDTIRPVSRLRFCGLRREALRLQSPRSTPQLVAARRSVVYAATAGNGAAASSEFDYDLVIIGAGVGGHGAALNAVEKGLKTAIIEGDVVGGTCVNRGCVPSKALL

SEQ ID NO: 56536 - protein, 173 aa, Sorghum bicolor
  Clone ID: 30944706.pep
AWQQQHEGRPPPAWPSERQQQQVWGTKHYPAASTASPATSSSPCSALPLACTVRVGAPRSCRTQAAAGSTLHVAGSAAVASAWPRSCSVVSDVNRPCRAAPPSRLPPRCQSPPWLLRAAWRSGARRPQSTRAAACGAGAGMLRPPTAAPPPTVTSASAPRHPHPSATRMAAAA

SEQ ID NO: 56537 - protein, 99 aa, Sorghum bicolor
  Clone ID: 30944714.pep
TDHTAWTNLQFILFHWRSHRPATPGGRPGSSLKCKRNLLYIYIEFCDFIVKYFYLMRIARAPEIFWLRHCLIPICQKTSTLTNQTDLTQHSMLPTQVAT

SEQ ID NO: 56538 - protein, 228 aa, Sorghum bicolor
  unsure (1)..(228): unsure at all Xaa locations
  Clone ID: 30944720.pep
MGRSPCCEKIGLKKGPWTPEEDQKLLAFIEEHGHGSWRALPAKAGEYGQTXNSTIFQMNKVCEISTNILQACRGVVRASLRWTNYLRPDIKRGKFSLQEEQTIIQLHALLGNRWSAIATHLPNRTDNEIKNYWNTHLKKRLAKMGIDPVTHKSLSGTLTGTTNNKSAKAAASLSHMAQWESARLEAEARLARESKIRTATPTPTALHAQPTNVPASAASPCLDVLHGW

SEQ ID NO: 56539 - protein, 167 aa, Sorghum bicolor
  Clone ID: 30944730.pep
MSATASPHTSLLHLPHRPFGPRRPRLTRLRCLASLAPASSGASPENEDHLIQTLCAHGRLARAAALLQGLPAPTQRTYESLLLAAARAGDTALAAAVHRRLEADPVFRSDPFLSTRLIDAYAALRALPAARQVFDEAPVKNIFVWNAMLKALALADHGEEALACLSD

SEQ ID NO: 56540 - protein, 90 aa, Sorghum bicolor
  Clone ID: 30944761.pep
SPLAPRLFLLALNHSTRLSPPLPSPPLLRTAHRSYYKAPYGVRHLAPARRLLIQLPSAAGRLLRTPVRTWTRRPATARRRGAGSSSRARV

SEQ ID NO: 56541 - protein, 101 aa, Sorghum bicolor
  Clone ID: 30944765.pep
FLVGERPGRGSVERLNSSVERLSKLKADRFTEIKKKALAIISFWNTLLVPYEKKQELLSLMYYVEVESDKEMTEVSALSVEFLNRVVQEYDELCEQMNGLV

SEQ ID NO: 56542 - protein, 56 aa, Sorghum bicolor
  Clone ID: 30944785.pep
IMIGRNLYAVQRPDAQSNQQRSEPQLYNFTTEEAHSIHKMEIHMDVHVMYATTDKT

SEQ ID NO: 56543 - protein, 187 aa, Sorghum bicolor
  Clone ID: 30944835.pep
MDHPWRFPAGAGTGADLCPVCCARHLPFCPPPPLPPHPFPYDLQPPPPPPPPNPYPYDFHPPPPPPPPMWGPPPPGPHDPRPYELPGREGPHKRMRVGEAPPFDPYDFVPPPPPGRASVQGDRLLGLIRDHGRNPLPGCPPDGGFGYGGGRFCPRQGGDFADFDQMLPPPMPIEDWHNGFGQGFVPE

SEQ ID NO: 56544 - protein, 146 aa, Sorghum bicolor
  Clone ID: 30944847.pep
RRKLPCGRSVVSRNATTSGSVAIRPHRSSLRSALALFLAPPEPGWTLLISRLLCFPVPARRESPPLLHLKGQRLYRSSLWPSPPAAGASTTAPARAHAGDIPLSGSLRRTWVLPRNKTPTYSLGNVSGSSLRHQRIACPAPCACAV

SEQ ID NO: 56545 - protein, 79 aa, Sorghum bicolor
  unsure (1)..(79): unsure at all Xaa locations
  Clone ID: 30944874.pep
GXNMLIIYYLMLYIIYVTLIMRLGELYNLVAILGEFDMDSLLLFPHTLQEKLNLVINQSVGSCKEKLILQVRSCLSAVR

SEQ ID NO: 56546 - protein, 72 aa, Sorghum bicolor
  Clone ID: 30944901.pep
AECSSSHPMPGLAPHVKQACRVNGTCMGEADVKLVTLAVVPRKQKGNGSLLKRILTGRRKEAMAKPQVVLSS

SEQ ID NO: 56547 - protein, 69 aa, Sorghum bicolor
  Clone ID: 30944919.pep
KFVSFIIQTKEAITTVLKDVLLNDNNAEDQFNNCSKALRPGHCREAIFHCISLVIHSSFYILLEQISTL

SEQ ID NO: 56548 - protein, 179 aa, Sorghum bicolor
  Clone ID: 30944941.pep
QKPRNDTRQSPDAVDAKARRLGRSSSDINNNHQDTRITTLIRRNMALEEQLSAALASKDEAEKNLSLVIDSKDELEKRLAEKDREVEALKEKATGLELAQEESNNLSNTVHADNVRLEREVAFLKAVMDETQKELHSTRGVLAGERARAFQLQVEVFHLKQRLQTMEGRSPTPRKPQNQ

SEQ ID NO: 56549 - protein, 82 aa, Sorghum bicolor
  Clone ID: 30944949.pep
FFFFCKINIVALAFVFDKYYIIIDYLALKDSSCKLQTNCVISYSLRSKLYYIPRILESKSIFKFDQKYKEKYKDLCHKIGKL

SEQ ID NO: 56550 - protein, 186 aa, Sorghum bicolor
  Clone ID: 30944951.pep
GPCTQLCAGSHCKPQQWLCTAWCMCMRTWRLCIPLPTGLPTLGLSMGSCRRQVRLSFMPTRSGETADSCPATTLHATGAVLCMGWGLDAALQGLVRACAVHEGHSSCCQAPQLERSGPLAGQQTPGLHLLLSGVVARPIVKLVCISHSCSRPGQGWVQLWPACLPIPLQLLPTCHGRQFTAAAGTS

SEQ ID NO: 56551 - protein, 81 aa, Sorghum bicolor
  Clone ID: 30944955.pep
HGECIRPWLAIRNTCPVCRFELPTGDADHDWRRSRTGVVSVAQQSAPAQSGGPGAGSGSTVGAGDDATECSGENRPEQGTS

SEQ ID NO: 56552 - protein, 68 aa, Sorghum bicolor
  Clone ID: 30944983.pep
MIVQTVNIKQKCRIPVKFLQEMYFMVCLCCSLVDVALLLCYVLAALQSIYYSYPAYVLYIPPLYILLL

SEQ ID NO: 56553 - protein, 66 aa, Sorghum bicolor
  Clone ID: 30944992.pep
GQAKCFGLSRLLSDALFFLFFSERHHRALSCAIVPFGTVGLSRPNKIKTMDGFPNHNINKCYKNLT

SEQ ID NO: 56554 - protein, 167 aa, Sorghum bicolor
  Clone ID: 30944994.pep
GAGEGLCTVDRLGSQPVNRPHTTCHSTPCTCRARRVPPPGPRVCHGRWHNQTTAGWSLASCVHAAAGLSPRAAAGLSPPALRSPRRLLWTAVCCSYQGMPECSWRLPGLRCRPGFTTWRHVNRVSDAWLLLVGHVLQRPAVWAAPRVPCSARWGTPPCLLTRQGRAC

SEQ ID NO: 56555 - protein, 77 aa, Sorghum bicolor
  Clone ID: 30944998.pep
STRPSKPPTTRGSRVNPPRRPSTSPIPPSSSSAGSSTTAPRSNSDPPPPRAFPEIIASSSSSSEVSSTSSNAETRWG

SEQ ID NO: 56556 - protein, 160 aa, Sorghum bicolor
  Clone ID: 30945028.pep
NQCLSTATKAPQSSVVLGCTLEQGMKPYESTQHTMAIPKMAEERPATGQDYMNSTQIEYLDTSSSATSVCLSQADGSLQQNFPPSFNQHQTLRETVPDSEFEVTDPGTNFLFGANIDGHMEPLNEDALLGNTFETDKYMDQMPGNGISNYISSKDAQQEL

SEQ ID NO: 56557 - protein, 125 aa, Sorghum bicolor
  unsure (1)..(125): unsure at all Xaa locations
  Clone ID: 30945030.pep
FFSFLFYFYIFFFFSLSSYINHFFLFFILSYNLHLNITFQRFVSRFFLLPNFIFXILFFIIFSNTLLVVYLILIFPSTKFSIPTKRLSSFIHFFLNCILYFFYFFLISQKFFFCFFFCLSDILIF

SEQ ID NO: 56558 - protein, 163 aa, Sorghum bicolor
  Clone ID: 30945032.pep
QLPPLSARGPRSFASGSHRNKRLKIEVDGITAVDVTAVGLCCSSSFQSYWISIYDGCISIGQGKHPSNNLLFQWLDPDPNPHVQYVGLSSWDKHVGYRNISLLPSAPPNSIFWTQIEYANVHWVADAGDYVRKQLSRDDCHQRVLADFLENWDFSDAVFVVGT

SEQ ID NO: 56559 - protein, 135 aa, Sorghum bicolor
  Clone ID: 30945090.pep
MATAARSLHHQGPTPSNPSPHRLPVPSHLRPQRHGCCSRRLAASSSDLTSFPEPDPAPNGVHVPWAAASSVATAAAAAAFDVDAATEAELRENGFRSTRRTKLVCTVGPATCGAAELEALAVGGMNVARVNMCHG

SEQ ID NO: 56560 - protein, 183 aa, Sorghum bicolor
  Clone ID: 30945102.pep
KKKKKTRVFTSKSLKISTSPPSLCRALPPLHPRARAGGLAEAAASVLAPALKGPASALLFGSPPPSASCSVADEADAPAVSRRAELGFRCFRGGSGSARSRVRRSVSNFEEGISCLEPKHQLDRCSAKEGSKNVAKNEDKHLQMEFEISTASEKLIECRETIINLGKQLKALASPKDAILFDQ

SEQ ID NO: 56561 - protein, 124 aa, Sorghum bicolor
  Clone ID: 30945118.pep
MGGVTSNIAARFAFFPPTPPSYTVVVADAATGRLAIPEISRGPSRRRRRDGAGGSSSSSASSVAAAGAEEEDGAEVVRLRTRRGNEIVGVYVRHARASATMLYSHGNAADLGQMYGLFVELSRR

SEQ ID NO: 56562 - protein, 145 aa, Sorghum bicolor
  Clone ID: 30945176.pep
QATKVRETDGYIDPEYLHTDLRTEKLDVYCFGLVLLEVLFGRPVIKHQRLEEQVAWLVSWAVQWPTMDYLDQNVDPFLRGEINPQCLKKFFETAVKCLAEKGIHRPSMRDVLSDLDYALELNERLESIEEDYGGCMSDDDMNEGR

SEQ ID NO: 56563 - protein, 93 aa, Sorghum bicolor
  Clone ID: 30945190.pep
HISRSQHYWKSLHQNNNEKKKLNEPVEHTRYHDIITRSTFQDLLGHRLQNGKASRCFSEKPEITSHNETALESLHAFTSMALETCHLLSNLMI

SEQ ID NO: 56564 - protein, 82 aa, Sorghum bicolor
  Clone ID: 30945222.pep
PTTYSSCRHALKLQVDKQMMIGMFLRPLKNPTCFETNTFFVAAAEILWTFKTTCWFAGQKCQWDLLLFMLQFSLVYIGATTR

SEQ ID NO: 56565 - protein, 81 aa, Sorghum bicolor
  Clone ID: 30945249.pep
IANGCFYPFTIPRMHSTREQGHLWQKLQHSTREQGHLWQKSHITTSHHSPCRYIQNTSSAPQETDHEAAHLALSLDGNWTP

SEQ ID NO: 56566 - protein, 159 aa, Sorghum bicolor
  Clone ID: 30945267.pep
LVEWLKRMVPERRVEEVLDPRLPEPPPSKALKRAVLAALRCVDPDGSQRPTMPHVVHMLEDDQILRDVRTPYRSPCNIHARLSFTAFSFLIVTTVKMCVACRSSSSRGTCRLGSQIATKNANAAGDGRLLGHWDGMLIIAKCFGTSCNLLHCKDYVFVL

SEQ ID NO: 56567 - protein, 106 aa, Sorghum bicolor
  Clone ID: 30945282.pep
MESLAQRAALLRESLQKSQQVTDAVVSILGSFDSRLTALDSAMRPIQVRTHAVRTAHENIDRTLRSADVILTQFDRTREAEREIQKGPHENLQGFLDAVDRLRSIE

SEQ ID NO: 56568 - protein, 216 aa, Sorghum bicolor
  Clone ID: 30945348.pep
VSFCLEINYQFVQVVHTRRCSFAPPQSTAAAETNPTEFILETLEQSDSRSLIQYLAYQDLCVVSECNVEPWRRAAFFEESGETYKRIVTACLKPLEEFTSKIAEALEGLSSDKPELMLQQSKLFSAFDDSQICTWCARTLAVLTARSRQEDRYGVAQLTGCNAAVMTTLLSALVAIETCLGKKTNPQPVHSLGPENIRWASLSTGRKGTGVSIAST

SEQ ID NO: 56569 - protein, 225 aa, Sorghum bicolor
  Clone ID: 30945354.pep
VQKIISITKSHCKLGLTATLVREDERITDLNFLIGPKLYEANWLDLVKGGFIANVQCAEVWCPMTKEFFAEYLKKENSKKKQVLYVMNPNKFRACEFLIRFHEQQRGDKIIVFADNLFALTAYAMKLRKPMIFGATSHAERTRILYQFKNSPEVNTIFLSKVGDNSIDIPEANVIIQISSHAGSRRQEAQRLGRILRAKGKHQDRMAGGKEEYNAFFYSLVSTDT

SEQ ID NO: 56570 - protein, 115 aa, Sorghum bicolor
  Clone ID: 30945356.pep
HLLLTFQHRAGVRPYTSSCDFAEPCVFDKQSPGPFHCGPDCSGRPFSRSYRSILPNSLAMNLSSTLGFSPQLPVSVYGTGTDYLKFRGFSWKPLGALSLCPETPSTIVFRQFLRI

SEQ ID NO: 56571 - protein, 230 aa, Sorghum bicolor
  Clone ID: 30945364.pep
GNLHDQLHGEQKPPLTWRQRIEICIGAARGLHYLHEQHIIHRDLTMKKILLDEEWVAKITDLSLSRTGTSVETLVAGTVGYLDPEYCHTSVVTEKSDVYSFGVVLLETLSAQHPYDSICQVEQGLSRWALGCKEGNLDQIVDPYLMGKVNLWSLNKFVEIVLRCVAPKGIDRPSMGDVISDLEHALQWQERADASECASILPSRLCRQFWLAEMEAATNNFDKSLLIDSG

SEQ ID NO: 56572 - protein, 189 aa, Sorghum bicolor
  Clone ID: 30945368.pep
MAVRLLLAVAVALLLRPGDASVHEYRGLSFANKGNAFILHAGSEGLYAASHANTTAEDDEDAAAVADAFIRFDKITFRRPEDTNNSVKETSSAKVQVLVFEIEDREMIGGSAYGGQKAICCTSDLAKLGACTEGSVIYRPSQVNPGWPKLFVASFDGSDLIATLPSRTIPITKTGMYNMYFIHCDPSLA

SEQ ID NO: 56573 - protein, 188 aa, Sorghum bicolor
  unsure (1)..(188): unsure at all Xaa locations
  Clone ID: 30945380.pep
TPAGPTPAMPSSPTPAPQLPSWVSPSPSPAQPPSPTSSPAGSPPPPRPPASAASAPPPRPTPSALSSAPTASLMRTSPRWSAERHGSSPSTLTGSSGPSSIFSLPSASSRGGSPPRRTSSIAASTSTSCPASSSSAAXSAATATSVPRSTAPHAPSRSTWTRGCARSWTPSADSASPTSPSRSSSPSR

SEQ ID NO: 56574 - protein, 143 aa, Sorghum bicolor
  Clone ID: 30945382.pep
MAASPDQFRGQARLPRFAAPLRYDLRLRPDLAACTFTGAAAVAVAVSATTRFLVLNAAELDVDRASIRFQDLAPTDVAQFEEDEILVIGFDRDLPLGEGVLTMDFTGTLNDQMRGFYRRYTLPLTVLVSCACQTPIIPSCKYL

SEQ ID NO: 56575 - protein, 143 aa, Sorghum bicolor
  Clone ID: 30945418.pep
MPTAGCSLLHPPDATIGATTTTSGASRAPRLPSSSSTTSSSSSSSLPSPSFISLSPALPMRRWAAWPARAAGPRRRDGGSAAPPPPASSPFLSPHDHSHVCSAETLGAMVGSDLAAVIPGMRCTAMAASDISDGGVSSAQFIS

SEQ ID NO: 56576 - protein, 101 aa, Sorghum bicolor
  Clone ID: 30945420.pep
LPVPSLSLSLSLSLSPTSHPRNAAGVGVPPPSPPPPLTLPPLQLPLPESACARFGFDVNATAAVRLIWQAPQPGAGRVKRETPRAPASVSTPPSPSQATDR

SEQ ID NO: 56577 - protein, 164 aa, Sorghum bicolor
  Clone ID: 30945485.pep
EGIRQFFINVEKEEWKLDTLCDLYDTLNITQAVIFCNTRKRVTWLTDQLKARDFTVSSTHGMIDQKERDVILNEFRTGSSRVLITTDLMARGIDVHQVSLVINYDIPKQNFDKYIHRIGRFGRFGRKGVAINFVTNEDFHILKEIERFYNTQIEEMPAHVADLL

SEQ ID NO: 56578 - protein, 63 aa, Sorghum bicolor
  Clone ID: 30945505.pep
KKQKYDKISEKKMLTSAEVLCKSYPSEFISYFHYCRSLRFEDRPDYSFLKKLFRDVFIREGSY

SEQ ID NO: 56579 - protein, 134 aa, Sorghum bicolor
  Clone ID: 30945525.pep
AQFHVIIYNRFLIQVYSTYTSSFLSGHIHHLVTVPSCKAWWEQGASGLPRSTPTLPLPSPRIEQIAAIVQLTGESFLPLHASLDLGMYAFRTYLSQMQQLHASFGPGNVCISYLPVSNANMRPQPACRGIKPRK

SEQ ID NO: 56580 - protein, 85 aa, Sorghum bicolor
  Clone ID: 30945541.pep
LLSWIYCHISLTMFFFSILYFVFSHCYFLHKCISTNETAAISEDSLANHATICINQVTTRLRPKLIPGKWIAEAGEEPPIATRLA

SEQ ID NO: 56581 - protein, 234 aa, Sorghum bicolor
  Clone ID: 30945564.pep
AIAYGMDQKGKEKNILVFDLGGGTFDVSALTIDNGVFEVMATNGDTHLGGEDFDQRVMEYLLKTFKKKTGLDASGDKKALQKLRRAVENAKKSLSNQHQVRVEIEAFFDGQDFSEPLSRAKFEELNMDLFKKTLVPLERVLKDAKLDKHEIDVNGILSVRATDKASDKSEQITITSEKGRLSEEEIQRMVKEAEDFEEEDKKAREKVEAKNSLENYVYSCSRTSSTAKSPNRVS

SEQ ID NO: 56582 - protein, 157 aa, Sorghum bicolor
  Clone ID: 30945586.pep
RGSSHLRVSSKGAEKDETALTAAAALLLNGRPIVSISRFRLRLRLRACHVVSASPPCGCFGRIGLGTATRSGQHRLLNRAEKPRRHRIEAKGRAGGLAAAAGLRHRGSGVGAPPRAPGRGRRGVAGAEARGEGGGDRHIGGWQLPVARLGLGGARRL

SEQ ID NO: 56583 - protein, 235 aa, Sorghum bicolor
  unsure (1)..(235): unsure at all Xaa locations
  Clone ID: 30945671.pep
MSADNKQTSANTVGEKMTVTAENGFELESNWEERCDSFDNMGLKEDLLRGIYGYGFERPSMIQQKAIVPLIKGKDLIAQAQSGTGKTATFTIGVLQQLDYTQPTAQALILAPTRELAQQIQKVVTMLGDYLGVKCHACIGGTRIRSDIQILQGGAQVIVGTPGRVLDMIDRRALKPDTIKVFVLDEADEMLSKGFKDQIYXIFQTLPHNVQVGLFSATMDADTLEITRRFMNNPV

SEQ ID NO: 56584 - protein, 117 aa, Sorghum bicolor
  Clone ID: 30945689.pep
MEHVIGGKYKLGRKIGSGSFGELYLGVNIQNGEEVGIKLEPVKTKHPQLHYESKVYMLLQGGNGIPHLKWYGVEGEYNVMVIDLLGPSLEDLFNCCNRKFSMKTVLMLADQLINRVE

SEQ ID NO: 56585 - protein, 52 aa, Sorghum bicolor
  Clone ID: 30945733.pep
HCYPCSPQIWPNQKESPHTTYIAEGCNHMMTDLSPVPRHVGLKKSELTKNLA

SEQ ID NO: 56586 - protein, 133 aa, Sorghum bicolor
  unsure (1)..(133): unsure at all Xaa locations
  Clone ID: 30945737.pep
FTFEQTAAVRNPNRSPLAHXDSSLRVAYAGGELGAVYIPAGLIDGGTTKHVSAVFDVPAIPVAAQPPMLGGAVDAASAAQSQQQPPAVIEVHSLLVVKGRVNVLRVLTHRVQAAKLCRVGVSPLDGTVIGFRC

SEQ ID NO: 56587 - protein, 108 aa, Sorghum bicolor
  Clone ID: 30945741.pep
PCIDGFPSSFILTKIILSCSLRTLFLCLFAFNVLFSGRCRYLYQICRFSVQVAMGVNNLAKQWGIPPYKTNGFIIRAWTICFPNNFTRLVLRGVSSSRWYLTSSLLSI

SEQ ID NO: 56588 - protein, 100 aa, Sorghum bicolor
  unsure (1)..(100): unsure at all Xaa locations
  Clone ID: 30945743.pep
VGACLTTAGWLSRALDEDGAADTXLRRFSALVPRLKQCLAPGRPARHRVLAAVSLHHFSRIPDCRELLMLLADGLRDHLADLSQQTWTAGQLSAELRGHE

SEQ ID NO: 56589 - protein, 118 aa, Sorghum bicolor
  Clone ID: 30945803.pep
KESMGEDKIAFCGSELFYVPRRFVEDFVDLVGLVGDLDLHHKIAVPMFFLAMDPPQNFDSDALAGTVFKNQLPANATFSSIYTAQAPAVFPVKVMNEIDFIKVIRLMSIGDPLLMELV

SEQ ID NO: 56590 - protein, 180 aa, Sorghum bicolor
  Clone ID: 30945823.pep
DDNLSAKLSDFGLSKMIDRDKSQVITRMRGTPGYLAPEWLTSQITEKVDIYSFGVVVMEIISGRKNLDYSRPQESVHLISILQEKARNDQLEDLIDIHSEEMQIHKEEVIQMMRLAMWCLQIDYNKRPQMSVAVKVLEGTVNVETNIEFNFVAMVPNNLANDGKLASSAPLLASHLSGPR

SEQ ID NO: 56591 - protein, 140 aa, Sorghum bicolor
  Clone ID: 30945838.pep
CEEFIMSITKLVVDPMLSFVTKVTAVKVALSSGSQGQKLDSVLAKLLKTQAFASPDKVAELVQKVAAAIQQDLPKVMSKMRLYLQNPSTRMILFKPIKTNIVEAHIQLQSLLKSEYSTEEMQSIGMLPIPDLQSQLDSLL

SEQ ID NO: 56592 - protein, 216 aa, Sorghum bicolor
  Clone ID: 30945856.pep
QSLFLPLPASSLHSRRPRRRPAKTLAVPRVNAILFTGDRVRGTGDPAIERLSDAAHLAGVLAAKLPVETNAWVVDAACFAGPFAVYRELVPTVDGAGDPNGYDPTGLPAAAGVANILAHSIREIQNRFLGFSAKDSAANQHPSESLSSYSPPRTIILGFSKGGVVVNQLVTELSHWASESMKNTVDISRPNPSHLTENLLVPTSNSDVLSSISEFH

SEQ ID NO: 56593 - protein, 231 aa, Sorghum bicolor
  Clone ID: 30945863.pep
LLEQNQNPNTTTTTSTTHTQQQSPRELHCQTGRASRSAAIAPTPRTRRAAPAPPPYALWRGASRLAAGGRREARFQRKKKRPRSKRRGGEVRRGEKRQGSAQWRGGSPVQSNPIQSNLAGPRPTRQQRSCDWLEGKCARQATHATDTGNPPRGDRSRAPDPTPPRRNRGGVRRPRPRPGSAFRAGGSPPDRLAPSSPQILCKQWIDPTGLGRRNHLINHQMQMRCIILIMQ

SEQ ID NO: 56594 - protein, 209 aa, Sorghum bicolor
  Clone ID: 30945872.pep
AFQIASPIPTRPMPPSHLLSLLLAVTVAATVDVVHAQGIPFPTPASTNLSTSWTISLKADGHGAQSFDYMDSTSVSVFLLQSIQSPPQEGLCFAACFYCVAPCEAFLFGVCIVYVDGGGFLSWPNAGSPQVVWSANRDRLVRENATLTFTAGGDLQLRNTAGGLVWSTGTSGQSVAGMTVTKSGNLVLFDRKNAAVRQSFDHPTDCLLP

SEQ ID NO: 56595 - protein, 63 aa, Sorghum bicolor
  unsure (1)..(63): unsure at all Xaa locations
  Clone ID: 30945916.pep
LARVSHEEEEPSRGGHGVAIWWASHEEEGGVRERDGELVPLAGAFLSYLRRSXGSQGEADRRN

SEQ ID NO: 56596 - protein, 189 aa, Sorghum bicolor
  Clone ID: 30945920.pep
MHPPTATGRRRDLPGAAARGGGEFTRQHPPPAGPGRLFFMPPPPPATPGHNHRPRPPDRDRPFFMPPPAPPGRSHSNQPSPADPPTASTRPPPPPPPPPPHPHAYANYDPAGSAADELPRRPPHPPPPPPPLPPPRRPSTSPCSSALSSCLVATAFLLLSAGVAGTALFLLYRPRPPDIAVAAVRLPSF

SEQ ID NO: 56597 - protein, 101 aa, Sorghum bicolor
  Clone ID: 30945923.pep
GDADDEDPAAAQRQCAPCHCDPGGTAVKAKVATAVGSSPSGEPPMQLEHVSLICFLSDCRSDATAAGLTPFEAFLGKEDSSQMDTDEPMEESSQPGFLLGS

SEQ ID NO: 56598 - protein, 136 aa, Sorghum bicolor
  Clone ID: 30945925.pep
MAPPPPSLLRELLAADGFKNRRRPPDSSAPAASRAASMPLQHRRPGKPPSRSQSDVLTRSRLRQMNVDADDGSRDAGAERRRAATATRGSSASLTSARGHSNKGDAGARRGSESDPSAVPALDESALTALISLAAG

SEQ ID NO: 56599 - protein, 215 aa, Sorghum bicolor
  Clone ID: 30945930.pep
RRLGTRMWRRGANLEGATANFVETEQLVEYEGLTSSFIQVRGSIPLLWEQIVDLSYKPRLSIIEHEETPKVVQRHFHDLSQRYGEAIVIDLTDKRGDEGDLSNAFAAEMGRIPGVRYIHFDFHHVCRGGNFDNLQALYNQIEEAIHKQGYFLMNTKGEILLEQSGVVRSNCIDCLDRTNVTQSFLARESLDSQLQRMGALLSSESISLSDNINDI

SEQ ID NO: 56600 - protein, 101 aa, Sorghum bicolor
  Clone ID: 30946001.pep
KYLNFEHVLVYNMQGLQKNSRSKIQKKKSSIFAEGQFWPFAKELFAESQDGLPSAKVVGLGLSFRQRGLCRVPAVALGKGHLFAESHVARCLCRGLAFAES

SEQ ID NO: 56601 - protein, 37 aa, Sorghum bicolor
  Clone ID: 30946003.pep
AVAVECPVQLGMLVSTELSPVLIQDPAICSCCALILR

SEQ ID NO: 56602 - protein, 75 aa, Sorghum bicolor
  Clone ID: 30946013.pep
LQFEKVNHHTKQKYNSVSQSIEKHKNTPKMQILTKHLSVPSKIGNAQYSKRAFLIRSLGYHLDMEGSSMVKMSIQ

SEQ ID NO: 56603 - protein, 193 aa, Sorghum bicolor
  Clone ID: 30946072.pep
NWYCYAKTIAEQGAWEAARARRLDLAVVIPVVVLGELLQPSMNTSTLHILKYLTGQTKEYVNESHAYVHVKDAAEAHVRVLEAPGAGGRRYVCAERTLHRGELCRILAGLFPEYPIPTRCKDQVNPPKKGYKFTNQPLKDLGIKFTPVHEYLYEAVKSLQEKGFLQKTSNTKVPERRSRLPEQSQPPVLISKL

SEQ ID NO: 56604 - protein, 134 aa, Sorghum bicolor
  Clone ID: 30946078.pep
MLQNRDEEVLELLQHGADRRPQRADEQAQSSSCVELQRDRRKKRKVPDVQQIMETYLNFRMKQARVKEQRAKDVDQFTISSCIKALHPMPDVSDEVKVLASDVFKDPENREIFLSYEPRLRTLWLKREVGKLLS

SEQ ID NO: 56605 - protein, 118 aa, Sorghum bicolor
  Clone ID: 30946080.pep
DGVETAEGISVLRRSNGVAPIFAILKENPTGSLQHRVTWAVERILRAEDIAQAASTDHSLGSALVHAFQHGDSRTRRIAEAALKHVRKLPTFSIIIDKSPSIRGSSLGSMERFIKFDR

SEQ ID NO: 56606 - protein, 131 aa, Sorghum bicolor
  Clone ID: 30946094.pep
MDNSSRPSFTNMMNSALASSNQQNTNNQQHGLQLSVSMNFPPYQFGPNFQTPLYPQSFHSFGGHPSFQQLPSSGYQQGIPFHGNFHGADMTGGPSSPVASASLFGVGGGNGSRCEGSASPVSSPIPLCSRE

SEQ ID NO: 56607 - protein, 106 aa, Sorghum bicolor
  Clone ID: 30946110.pep
RARVQRCCCMWPSYLMIPIWPIPIYSSSCNSEHELQCPGLAAAASQSQVTVLARYRYLVAYLFQGDRATMRLYFIRRSLLPPSRAPLGRRLPSCIVLLPSRRNTHG

SEQ ID NO: 56608 - protein, 121 aa, Sorghum bicolor
  Clone ID: 30946124.pep
AQLSLLENEMRRVERVNVGLMLAGMGVSVDVFRMASARWEKRQAKVLGKVRTRMVKQENSDTRSSWSDIWGSPPQDQSNEEEVSERAKRAAAAARRWREFSRRGADRPPTHKLPESVGSKD

SEQ ID NO: 56609 - protein, 103 aa, Sorghum bicolor
  unsure (1)..(103): unsure at all Xaa locations
  Clone ID: 30946128.pep
VLNFPVERVQESLRALALSSAAASAPGGSPVLALKRRHSIRKRSXEQEQEAAGAAAAAPTGGRGRRTTAAAAAVPRRXVVELEDLGADYLDELLRVSSEFDWQ

SEQ ID NO: 56610 - protein, 208 aa, Sorghum bicolor
  Clone ID: 30946146.pep
SKVGLVVYDSTISAGATTEYMAGHYMKQGASSFLPVMALAPQEKERIVDMAAAPGGKTTYIGALMKNTGIIYANEFNEKRLHGLLGNIHRMGVTNTIVSNYDGKELPKVLGMNSVDRVLLDAPCTGTGTIWKDLQIKTSKDIEDIRNCAFVQKQLLLAAIDLVDANSKTGGYIVYSTCSIMIPENEAVIDYALKKRNVKLVPCGLDFG

SEQ ID NO: 56611 - protein, 151 aa, Sorghum bicolor
  Clone ID: 30946148.pep
WRCGRGLKRLDQPRHGGLHCRHENLHRRHVARQLSNHPCKRVKRKQLAGKKNAEESSNEVEGGGAAVTAGATEEAGGCVEDGRGPDIADTRCYVAARIERGEMGKQRLLACYSTRGYCSHGMLWWRRGLRGREEAGRGPCPWLGKREGFSF

SEQ ID NO: 56612 - protein, 130 aa, Sorghum bicolor
  Clone ID: 30946150.pep
MAGRGGGGGGGGGGGSKSSSLYAVLGVASDCSDADLRSAYRKLAMKWHPDKCAGSSAGSADAAKARFQKIQGAYAVLSDPNKRILYDVGAYDGEGDDDGAGEILGDILEAMSQAGPADNGEGESLEDLQR

SEQ ID NO: 56613 - protein, 176 aa, Sorghum bicolor
  Clone ID: 30946178.pep
CRRWPPLSAASSPSPNPSVGPRASPPPLAPPSLLLLPRLLRPRRQPPRPRLPPPPAPRASPWEQHSREGARQGGDGQGGGVNRKRAEGKDGGKRGTMELKARRLNPVNTTCYVQILGTGMDTQDTSPSILLFFDKQRFIFNAGEGLQRFCTEHKIKLSKIDHIFLTRVCSETADIL

SEQ ID NO: 56614 - protein, 194 aa, Sorghum bicolor
  Clone ID: 30946202.pep
NQRPSSPPPSPPPSLSCPRGRPANARASPHLAHEPRPPSAVRRRAPRPPAPSAASHRPRASPTECRPPSSASPTEHRPPLSPRPPSTVRRRAPRPVSHSPHGIPLSPCTARGVLVSPDPRRLLFSPTRRWISLHHALMATRSRTSRTNTQPDPTTMVMTHAAERDYTALSPSPSTSLSTPAPHTLRPLDPPSTR

SEQ ID NO: 56615 - protein, 156 aa, Sorghum bicolor
  Clone ID: 30946233.pep
MELITNVTEYEKLAKEKLPKMVYDYYASGAEDQWTLKENREAFSRILFRPRVLIDVSRIDMATNVLGFNISMPIMIAPSAMQKMAHPDGELATARAAASAGTIMTLSSWSTSSVDEVNSVGPGIRFFQLYVYKDRNIVRQLVKRAEMAGFKAIALT

SEQ ID NO: 56616 - protein, 38 aa, Sorghum bicolor
  Clone ID: 30946247.pep
RPEGNPHPGAASGSDWIVLRRVKLPALGLLGFSSAGQI

SEQ ID NO: 56617 - protein, 135 aa, Sorghum bicolor
  Clone ID: 30946263.pep
MDTAFLRPPLARNLVYDEFAVLHPTSYPFHTLRYLRCNPMYSRPLLTTSPASPSRGLTQRMAALPDVDDFFWEKDPTPILDTIDAPIHLKNLSSKELKQLADEVRSEIAFIMSRKCQPCGPGRSVVELTIAIHYV

SEQ ID NO: 56618 - protein, 96 aa, Sorghum bicolor
  Clone ID: 30946265.pep
MAAVVCVTGAGGFIGSWIVKILLARGYAVRGTSRRADDPKNAHLWALDGAAERLTMLQVDLLDRASLRAAFHGCDGVIHTASPMHDNPEEIIEPII

SEQ ID NO: 56619 - protein, 79 aa, Sorghum bicolor
  Clone ID: 30946271.pep
MERHRQGSWRQQEDGLDGHEEEDGELSAFVCPITMQLMRDPVVIETGHAFEREAIARWFSECRDLGRGPCCPITMLEVH

SEQ ID NO: 56620 - protein, 152 aa, Sorghum bicolor
  Clone ID: 30946295.pep
KGAFAALPVKVQTISNRILEHITEQCLVCYDSGVPCAARQACDDPLSLIFPFQEDEATKCSLCMSIFHKQCFRKISVCPCGKASNGRKIVALEQAVHDGTGMPSTESLQPPRFSSSSGFFSDILSKARPDKLWRPRNSSPVILMGSLPDMSI

SEQ ID NO: 56621 - protein, 126 aa, Sorghum bicolor
  Clone ID: 30946305.pep
HVHVHKDTMPGPGGANVVRLTVDEDVKFQEAVKKQDAIGESSSTAAAGKTAHHHLPWTWHKKHESREDKKTEVINVTKHKHVDEKIIPGPHGEKIEVLSEDEDIRFEEAGENEEEYENSKARITKS

SEQ ID NO: 56622 - protein, 171 aa, Sorghum bicolor
  Clone ID: 30946327.pep
DVNLIKWHSSPHVGHYKFHPEEYRAAVTELLKKASVLYMSRRQLNGYDVGTSEHSDTPPSTSNLPRTAASSVGSRLRRAPIDPTDQFFLPSSMEYHESSEGPQPELFNMPSLESLSLHGVLGQVLYDVCVPKNVEGWDLKPSASMNGRHIHTAASRHGSFNPMKCVRRSRL

SEQ ID NO: 56623 - protein, 193 aa, Sorghum bicolor
  Clone ID: 30946330.pep
QNEQNSTYNFKYSFSVEIPKICKDDLVILKPKLANQLGGCGKILLCTKVASVIQFIDVINLKVVELTGSQYFQYETELMIVPSKENLREFMVFDVELPESKNQSSSFIGTKFKCSTAMIGRVSDWENFEVKTHMGDVLNEGSSVLAYEMTSINLTGDNDDLAYLGNIPEVIIVKKIYPEKKKNKKKVFKLKHF

SEQ ID NO: 56624 - protein, 117 aa, Sorghum bicolor
  Clone ID: 30946334.pep
RVRTPSHQPEPHGENIKKRQQHVRTSRPHPHHIKKKKEKETRLSATILPLLYLPRTEDCSSSTPHARSPSPPAPTSTGSTSLLVSPVPSTSVRRQLVPTAYPIDLTLQHNTHNSTRT

SEQ ID NO: 56625 - protein, 130 aa, Sorghum bicolor
  Clone ID: 30946350.pep
LSSQTIFAFRSTAEAGFKALSLFPFAFAFAPSPKIGISGAPMAVPAFVVGSMSCVASRRLVPACRASIHSHHPCVSSLTYLRCKAAASLPASMMATGGKEEAAVPPLDWRDATPAAAPARLVARVPWRPK

SEQ ID NO: 56626 - protein, 150 aa, Sorghum bicolor
  unsure (1)..(150): unsure at all Xaa locations
  Clone ID: 30946360.pep
AATPYEHSHDAKYCRKRDVKSLLNDGGYGPPPQATYPKWSLCDNKGNSPSHLLVNSLLEYLIFNQARINEKLHVMLLQHDKILGEVHVKLDSFTMSLKXQLSFNRRLXNQVANFKSQVAYHEKVNVVTTRGGNATRDPPFPEPAPHKGKN

SEQ ID NO: 56627 - protein, 125 aa, Sorghum bicolor
  Clone ID: 30946369.pep
PIGHVGLTEDEATETYGDIDIYISNFKPLRATLSGLPDHVFMKVIVCAKTNKVLGVHMCGEDSPEIIQGIAIAVKAGLTKQNFDSTIGVHPTTAEEFVTMRNPTRKLRRRTTAEAKTKDKAASQK

SEQ ID NO: 56628 - protein, 78 aa, Sorghum bicolor
  Clone ID: 30946372.pep
MTQIPKRTASSHTMEAHTGTHIFEIDDYSQKMGSTYVGKFIRSSTFTVGGFNWSTRFYPNGNDDVTRHYIIVFLEFMS

SEQ ID NO: 56629 - protein, 123 aa, Sorghum bicolor
  Clone ID: 30946385.pep
KNLRSVGVSAISGAGVNTFFEAIEASAKEYMETYRADLDKRIAEKERLEEERRKENMEKLQKDMMRSKGQTVVLSTGLKDKNSVSDMMDDADEEEEEEALEDFGFSEEDEDEGEDEEVAHFGF

SEQ ID NO: 56630 - protein, 63 aa, Sorghum bicolor
  Clone ID: 30946387.pep
FSFKIFGKMNTVALSFIFDKYCSNHGLYRLKRFVSQITGNCVISYFLSIFNALCISRKIRCDG

SEQ ID NO: 56631 - protein, 135 aa, Sorghum bicolor
  Clone ID: 30946391.pep
GDAEVTTGVAGDLQQVTQVARQMVTTFGMSEIGPWALMEPAAQSGDVVLRMLARNSMSEKLAADIDSAVKHIIDQAYEVAKEHVRRNRAAIDQLVDVLMEKETLTGDEFRAILSEHVDIGKEQRETAARTELVTA

SEQ ID NO: 56632 - protein, 94 aa, Sorghum bicolor
  unsure (1)..(94): unsure at all Xaa locations
  Clone ID: 30946396.pep
MSNQCRMSSQQSSIARGPPPWPSFLCTLFVALSPIQLDFTNGFSFLTQNAMVQVLNLSMFEFSTFGLVSNIATXGAMVGAIASGQMAGTFVVKG

SEQ ID NO: 56633 - protein, 141 aa, Sorghum bicolor
  Clone ID: 30946434.pep
MSPTTMSLTTTSRLPICRAQDVSKQAPGQKRAPPSSSKSSSDTAGFSRRRLLQSAGMGLGGLGLAVRDPARARAGTAPALAPEEVTSNRMSYSRFLDYLNASAVRKVDFFENGTVAVVELDDPALAPSRVHRVRVQLPGLS

SEQ ID NO: 56634 - protein, 212 aa, Sorghum bicolor
  unsure (1)..(212): unsure at all Xaa locations
  Clone ID: 30946444.pep
CSLAQWLETEAAPSRLSLLYYPTMESVAVVAIPFPAQGHLNQLLHLSLQLAARGLPVHYAAPAEHVRQARARVHGWGDDALRRIDFHELAISDYASPPPDPAASSPYPSHLMPLFEAFIADAPAPVAALLRGLSASXRRVVVLYDVINAFAAEEAARLPNGEGFAFHCTAASSMVPHMDGGARLLRDVHGLDDQPVHAFVTEEFLEFIGKRA

SEQ ID NO: 56635 - protein, 152 aa, Sorghum bicolor
  Clone ID: 30946452.pep
PTGICTKPAELLVVVLLGPGAHESTRTSYPECFFTHLLHLHHHLSLLLLVPLLLCSASRFVLPPRHILLHLPATTSCSHRRHLLLPAPASAAVLVVVRLSGGGVVPDVVVGGRRVGAGGAEPPGPGGANPPDPGAALGAASRAAAAAEGPAG

SEQ ID NO: 56636 - protein, 202 aa, Sorghum bicolor
  Clone ID: 30946474.pep
SRHSYGVRAGIQSGMEPPWRSAGGAASEASSAAGSDAEDDRYCSANSALGTPSSIATLLPSSDFWDHQMDLLDDHPATAGFPKKHQLSRLQTLASVQSRQETGPPPATAGVDALARQGSSPASPYIPPRPDHNQAHEFGDNDLFDDMVQEMEQILLNSGEPHENGSFMDNRRSNARQAHHFRDGSTTASTSGTDDAYVCPVP

SEQ ID NO: 56637 - protein, 143 aa, Sorghum bicolor
  Clone ID: 30946484.pep
RCQHGKCRCSTAEREEVTMPCGLVPISKKLHENSTACMKMGAATSYLGRPAVSPLLCLATNEADVLRAPALLASAHEMEFLHLRGFLGVSPGTWPSCPAPSPPLILASLPSFFHPLLHAEGPWLWFFPTTPTPPVALAPTAGD

SEQ ID NO: 56638 - protein, 88 aa, Sorghum bicolor
  Clone ID: 30946487.pep
MATPPLSSVSTHHRAPPPWPLPKTTTSPRTNLRCGVLAPPAGQVLEAAAAAPSPRNPPSPVLSSGVNLQIQRLCQAGDLAAALRLLGS

SEQ ID NO: 56639 - protein, 205 aa, Sorghum bicolor
  Clone ID: 30946513.pep
MEIADKQQQIGIQSAPDGTRTTTILCCHCGAAFAPSSTGTNICVKCISNQVDITTGITKEGVLEFCKKCERYLRPPWIRAELESKELMDICLKKIRGLNKVKLVDVNFIWTEPHSRRVKLKLTVQQEVMNNTSIQQSVVVEFVINYLQCPDCKKEFTPHKWRAQVQLRQRVDHKRTFFFIEQLILKHNMHQKMLNVEEVHGGIDF

SEQ ID NO: 56640 - protein, 59 aa, Sorghum bicolor
  Clone ID: 30946517.pep
RRGVEILEESRPVSASSWLYSSGFGSLARNYVLRYFCIYPSDSSKQLVCIRFLFATHII

SEQ ID NO: 56641 - protein, 75 aa, Sorghum bicolor
  Clone ID: 30946525.pep
RRSVEKQRHSDTNPRHTNRHSKRLSGKQDYTECSHYETSRHSRRSREKQHYPDSSASDYSDFDRHNKHRHHHRRK

SEQ ID NO: 56642 - protein, 165 aa, Sorghum bicolor
  Clone ID: 30946535.pep
GLYWYAPKDQCDAVSPCGPNGVCDTNKVPACSCLPGFTPRSPASWAMRDGRDGCVRATPLDCGGNANRSSSTDGFAPLPHAKVPDTTRAVVDYGSSLDQCRQRCLRNCSCTAYASANLTGAAGHRGCVMWTGGLEDLRVYPSFGQDLYFRLAAADLGTSRLHTYA

SEQ ID NO: 56643 - protein, 114 aa, Sorghum bicolor
  Clone ID: 30946544.pep
LMPIQPSILTTTIVVPVAVCLQDEAIRHPGLTMVLPVKPRSVKMLSKCFLQGLIQHPVVNWAQTKAGLDPPLISGRSALVPPPPWLAAVGWWSGVDTGDGGAAPHGSIWGGSIH

SEQ ID NO: 56644 - protein, 64 aa, Sorghum bicolor
  Clone ID: 30946548.pep
LFKLGWLDLIFQKIIKMILRTILRRARDNLTPPRRTSGAHPRDRPLDEPPSDPTSRPSSSTNPP

SEQ ID NO: 56645 - protein, 167 aa, Sorghum bicolor
  Clone ID: 30946561.pep
GMIIRHPDMFYVSFKGDRDSVFLREAYKDSQLVEKNQLVLLKEKMRALVAVPRFPRRGAARIGEEGEGVNGSLQLSDEESDEEYDEDEGLSDMEDLISELSGGKSDADYQWGDGWFGENDDAPPDFGDDDTSPQEVKVALKNADGSANGVAPVPVFPDGRPREAVVN

SEQ ID NO: 56646 - protein, 181 aa, Sorghum bicolor
  Clone ID: 30946566.pep
ENKLHYVHAMADFKLNRQILPFANAFYRGLSDLISPYWLSLFNANEFNQLLSGGLRDFDVDDLRNNTKYTGGYTESSRTVKLFWEVIKGFKPTERCLLLKFVTSCSRAPLLGFKYLQPSFTIHKVPCDVTLWASIGGQDVDRLPSASTCYNTLKLPTYKRSSTLRSKLLYAISSNTGFELS

SEQ ID NO: 56647 - protein, 53 aa, Sorghum bicolor
  Clone ID: 30946574.pep
ISCRCFLKLLASSLMGSGRVLPLFLGSILLGSIRNAPFPCNHPIICPFVFFMG

SEQ ID NO: 56648 - protein, 213 aa, Sorghum bicolor
  Clone ID: 30946588.pep
NIVQCYPATEYDFTPNNLQVNQGDYIHFQWTGCDFNQGNAAGEGTDKTDRHNFVILKGNQGRRNYPATLDEQTFLPRDVMERFAHVGQPTVWCDTLDSQDCCLTQDQITSGQVDANQDVRNCNKLNAGSAYFDGGVIQMSNTGTWNYYSTRNNNFTNRSQKAQLTVNPLIPWWGVAFVGVGGAGFIGGAVVAVLVWYAKAHPGSAAANYNLKI

SEQ ID NO: 56649 - protein, 88 aa, Sorghum bicolor
  Clone ID: 30946620.pep
MTEEEGESSVASVEEQLKKEMTVYEKFIVGMLTNFGSMSLDRIHNTLKMFCIAEPSYDKSLQQLQSFLSGLVADEKLETRDGLYLLKR

SEQ ID NO: 56650 - protein, 228 aa, Sorghum bicolor
  Clone ID: 30946644.pep
MAIAAVRRRLWRGLGTAAAAVASGTDGNLLARLVSEPECRVKATMEEAASSGTHRDGAFWEPLAAALLRASSPTKAHLILEWELEKLLKENIQDCEPYSRIIHFCGQTRNATLAMRVFECVEAKGIQLNTNIFNALINAFLSAGDLLSAMTLYESMEDMDGCNPNSATYDAFICAFSLLGSGHAMMSWYVAAKNAGFTPSIQTFESLITGFVQLNMLDDAKTIFEEMI

SEQ ID NO: 56651 - protein, 131 aa, Sorghum bicolor
  Clone ID: 30946654.pep
MAVAAVVEQAATMDTRVGSLTVPPASLPVFPVTFIIILAPVYDHAIVPFARRVTGSRMYRNKVPTGSPLTTIAKVLVAAALAGRRRGGCGYGAQSAISNGAVIDRAPSPTGSTDMKEYDCKPGAGDMVEDA

SEQ ID NO: 56652 - protein, 197 aa, Sorghum bicolor
  Clone ID: 30946699.pep
MSVPPAGNRQVSLRGSSAREITRDALLQKVSEERQLRSHLRRAAVAALSIQRIWRRYHVIRTVSEQLHEDWELLMNQPNIDLTTQWISRKMLRPFLFFITQPSSWYNGQRSKTVESILTCFKILLNSINSMDASKNFCSFAVGMPEERSIWLYQAKKLISLCSFILARCDHSCCKDGNIVDMTAIAMRLAVSLTDFK

SEQ ID NO: 56653 - protein, 142 aa, Sorghum bicolor
  Clone ID: 30946719.pep
RAGTPPPCATRRRRRRCPGGGARRRPRPRGTGKGLPPPGGAPRPPPPGGLCWCSSRRRPRCRRRRRGSESTGAGRAPRGRAAPPPATSARRRHRTLASQRRPPCCECEGPEWWRWVRSGLPARVAVCCSSAETMPYPKRRLQ

SEQ ID NO: 56654 - protein, 120 aa, Sorghum bicolor
  unsure (1)..(120): unsure at all Xaa locations
  Clone ID: 30946725.pep
MQLKNILVLSVLLSVVCFIAAESDVVELTTANFNEVVQNTPNILVEFYAPWCGHCKNLAPEYEKAATELKAKGVTLXLXKSNGSAEQAIAQEYGIKGFPTLFYFKSFEQGKIEYDGERNA

SEQ ID NO: 56655 - protein, 225 aa, Sorghum bicolor
  Clone ID: 30946733.pep
MAAAAVMVSSAGSLLAMLQEPAPELKLHALSSLNSLVHAFWHEISTSVSSIESLYEGEEFVQRQLAALVASKVFFYLGELNDALSYALGAGPLFDVSDDSDYAQTLLAKALDEYAAIQSRPTGEEKTMDPRLEAIVEKMLDKCILDGKYQQAMGMSVECRRLDKLEGAISRCDNLHGALSYCINLSHQYVSHREYRLEILQCLVKIYQTLPNPDYLSICQCLMFL

SEQ ID NO: 56656 - protein, 238 aa, Sorghum bicolor
  Clone ID: 30946739.pep
MLKAVLLVTCLFLASTLADVYGHNPRMSNNRLNTSSRNTVTQNRLMDSQNNAAGGYCWGEALTYYYGSILQVEWTAQHGCGTGHNNVDCNFVLQYMCGAELRDGVVDERIPLDDTRDDKNANGEYKYGMHESYEFYMNCSTRQRNNGLFAADRIIRGNLNPNGPATNTRQNNNGARSGYECPEERDYYPYWHPAPWKDIAVITSNIARCNFYKTESQNVKPRNLCSIPDWNNPVDCAT

SEQ ID NO: 56657 - protein, 218 aa, Sorghum bicolor
  unsure (1)..(218): unsure at all Xaa locations
  Clone ID: 30946765.pep
MSNQDDILRWIPAKDGRCSTKAIYKHLTSQQNTPLPNFGSRSISTEANRILQKVWKSKKIPPILKTFAWRLIRHALATGERAGRYSIHIDQHCSHCGAIENDFHLFFQCELPKSVRATTNPPFLVHNILPEQNGVQVTLPILLTTNPSDDLLCKFLFILWYIWKARNDNRFQRRTWTSWQVHXAASAHLNSHLQALTETAGRHLLDIGQNTSVQRMQP

SEQ ID NO: 56658 - protein, 190 aa, Sorghum bicolor
  Clone ID: 30946773.pep
MELISTTTAFLSALMLILVSFLAHKARGKSMKKRRPPGPLALPFVGCIHHLLTSQPQAALRDLAQKHGPVMYLKLGQVDTVVISSPTAAQEALREKDLSLASRPSLLGSEIICYGNRDIAFAPYGDYWRSLRKMCTVELLNASKVRQFAAIRDSETMSLVREIRCAAAATGGGGGGEPVNLGGLLLSCSN

SEQ ID NO: 56659 - protein, 52 aa, Sorghum bicolor
  Clone ID: 30946781.pep
LQLVAATRHLNSKTPDLMWKPPNRGKIRETKPTKSSSTMCLWSYKKFISRLH

SEQ ID NO: 56660 - protein, 219 aa, Sorghum bicolor
  Clone ID: 30946787.pep
KAVRETANEAIAAIFSTEDPKPAVATESLGKRIQGFGNTNYEPSRDDKKSFLSELTEVVGIGSASIKQGLSNFAAAHAMMTNDNGSTYKSPNLRRSLTTGSERYGRYDPSEIQSESRASSGASKNAASGSWGPTSSSVPTDDTSSSQPGIKTREERLLETIVTASGVRLQPTRDALQIFLTEASKLDAVALSRALENKLNSPLWQVRMKAICVLEAIVR

SEQ ID NO: 56661 - protein, 128 aa, Sorghum bicolor
  Clone ID: 30946791.pep
SLRFNFPTLNLPSLNENPLTFPPRKTLLALASWIVTTLAKVFLHIIQSGAWLSVMFLALVEKDSTTTFVWRLRAPLPKHLIFNIILMLLNQPTVNVNRLWRQPLRRHRRDDFLPFLELSWFRREPRQF

SEQ ID NO: 56662 - protein, 159 aa, Sorghum bicolor
  Clone ID: 30946793.pep
RMWTLLVLGLQVLIIMAWHGLGSPTQLLDPIIFEDILSIFITNAVLRVIQGFILDIAFSWRTKGTMRVDQILRFTIKLSLAVAWAIILPIFYANSQNYKACSTKRSKAFLGMFCLSKYMVVVALYLASNVVGMALFFVPAVTNYIETSTWRICNVLSWW

SEQ ID NO: 56663 - protein, 180 aa, Sorghum bicolor
  Clone ID: 30946811.pep
GGLPRPIGRSASGCISRSLSGARQAMEREDADGALDSWAQFCSLSNELLAGDGDLTVGPRLAPVVADLCTRGLATLVRDYFLYSLEETFRNNAVKKFWQHFHPYCSASAVDRIKFCVKENWPEEILSKALEDICLEKGYQEKCVLVLVQAFQSYEDRAPQKKFKAVDCISSLMASLRFMN

SEQ ID NO: 56664 - protein, 198 aa, Sorghum bicolor
  Clone ID: 30946815.pep
MAASPYFLLLLLFLFHPLAALAPLAPSPSPSPSQPSPPRSQPPPPRVPQQVQVWPKPVSISWPLPVYAPLSPSFSIRASPSHPSLRHAIAYYTRLIRTERHAPIMPPVNYTIAGVPIRLLALSVSDPDTKLGPGVDESYTLSVPPNSSSADISAATPWGVIRGLETFSRLAWSSSAAAAGGQPIVPSDLEISDHPLFT

SEQ ID NO: 56665 - protein, 81 aa, Sorghum bicolor
  Clone ID: 30946835.pep
GPLVRMGVRNDRLIHSCYGMKGCSGSPLIHKGSSLGVFFASRKQIHMAIPSRTIKEAVRIWLAGKAPIGEDDSLNTMLKRL

SEQ ID NO: 56666 - protein, 173 aa, Sorghum bicolor
  unsure (1)..(173): unsure at all Xaa locations
  Clone ID: 30946841.pep
CGEKWSPQHKCPSIVSLNAIEDFXKCFSNSNELTSLTPEIESNSDDELMVVSIQAVNGTEGAKTIRLRGHLGGQEVFMLVDSRSTHSFITEFVAQKTHPWTELAVLVQVQVANGEKLVCTHELPNXIWGIQGNSFLRTFKILPLGSYDIILGMDWLSSVSPMEIHWTQRWLKF

SEQ ID NO: 56667 - protein, 113 aa, Sorghum bicolor
  Clone ID: 30946879.pep
RELERDVTRLWYRNCGRDDRLVSDHGRELRIPFLDEHVMSYLPSLPVKARMNMSEGPGVGDKKLLRQLALSLGLHHAAQLAKRAIQFGSNIARLNKEQKGGNKRPIKGDDKIQ

SEQ ID NO: 56668 - protein, 161 aa, Sorghum bicolor
  Clone ID: 30946885.pep
IDGVTILDDKDTEDCHVFIARISGECGIIDMTVSRLNFAVEATIEVLISEVYSNFYLCVGCFTSGLREETQLFDGVIGKPQNLKRSVVAVRIDTNLDLKLKVGSESFISAEHLCSFIANEYGYVSQEIKTGPALFSVKVTWSTMPPSVDAVMRKVDHSASG

SEQ ID NO: 56669 - protein, 162 aa, Sorghum bicolor
  Clone ID: 30946887.pep
MLKDAVQSKSNIDVVKLHKSEGVVLRNTKYRQKTRSFRIREYFYGIANDLAPHSNIVNFSHVSVYKIGGGHQAPRSALPIGAEPVADPTRLVAVNISTDMIHTVLAISYAKEPDEIISSNIAGFIHVTDVDIQRKKLTYIAPCPGDLPSRLLIASSLTWYEA

SEQ ID NO: 56670 - protein, 85 aa, Sorghum bicolor
  Clone ID: 30946901.pep
YISTPLNLHSLGHVWFQVGTIAKLAGVDDYSFYCQGATRSLQGGTGETMQNQRTQRMSRVAERHIRLCSSRSWVSLHRFVKLGFR

SEQ ID NO: 56671 - protein, 116 aa, Sorghum bicolor
  Clone ID: 30946929.pep
MGPTQFVSLWNCLGQWRGIFDRYDRDRSGKIDSRELTEALRSLGYAVPPSVIELLIANYNNGVPSNGALDFDNFVECGMIVKGLTEKFKEKDTRYTGSATLTYDGFLSMVIPFIVP

SEQ ID NO: 56672 - protein, 131 aa, Sorghum bicolor
  unsure (1)..(131): unsure at all Xaa locations
  Clone ID: 30946975.pep
AASSASEFLLHSCTSREFFFVFCCSASVPPTRPPPTSPRQASARTTKQVASRHATPPPPLPYHGRLQPLRPQLQLRRRRWVXQGPPPSAPPAPXCPPPPPPPPPPRPPPLPPSPTAGTRPRPRPPTLRRPR

SEQ ID NO: 56673 - protein, 144 aa, Sorghum bicolor
  Clone ID: 30946981.pep
MAEAEVAGSLSRRRMEGEEGAAAMEADAGHRGRGEAEEAEDEEVESSDYTSEDEGTEDYRRGGYHSVRVGDSFKQGTYVVQSKLGWGHFSTVWLAWDTAHSRYVALKVQKSAQHYTEAAMDEIKILKQIADGDPDDSKCVVKLL

SEQ ID NO: 56674 - protein, 52 aa, Sorghum bicolor
  Clone ID: 30946983.pep
AFGYDLLGHQNFFIINLFILWNFFVYIVSVLARNSTKLQGLYFSVVIKFFRM

SEQ ID NO: 56675 - protein, 198 aa, Sorghum bicolor
  Clone ID: 30947036.pep
GEGGGPWSPSLETALICYLFVPDVTCYLFVLEQICFVFFLYAFSSDPSERSYFLFFPRSIYFFAAESVSSMRKVRSVRRRFEAAAQKALSDHCFSTASILAGVNNDPSSKWFVGSGFIVQLKSRECKVMTCLHVVQDFIPGPMQHLVGLHGIPLWVRLYGAKADSKVTEIKQDEARDLAVLTLKLPPDHSSAKALEFS

SEQ ID NO: 56676 - protein, 171 aa, Sorghum bicolor
  Clone ID: 30947040.pep
YRIPSELGIVLRTCDRRRVQSGIHHSKSSTLVGVVVAVATWPRSRPGWGRSQMSAIQLLRLLTCPRDGRGRLQHLLHLEGIVPVDEEFDTVVESVDSVLQIGHAVVDLWLPSIEVSLCHLHLRYGVLEISDPLGILAQESEDLPELLLLSHHKLLASEVLVVVAAGWSLCW

SEQ ID NO: 56677 - protein, 150 aa, Sorghum bicolor
  unsure (1)..(150): unsure at all Xaa locations
  Clone ID: 30947056.pep
APLRSLFQIWRRPALLDPLGTRTRSSSSSYATPLRIRRDFETFPSMPPWLLELEGKGREREELGWRENWGASVQPPLSSALAFALALALALARIHLCYASSRQGHAISPASSXPWWEWRWRWXTPPGACRPGHPXPSHLPLFFFFFFFFF

SEQ ID NO: 56678 - protein, 211 aa, Sorghum bicolor
  unsure (1)..(211): unsure at all Xaa locations
  Clone ID: 30947079.pep
MCGIGALIRAINAAECKIPRDEWLTMLRRRGPDSCQELHLTAEHATLDLFGSVLSMRGALTAQPISDQHGNCLIWNGELFGLREENSAEVQSTLDVSDPHVTTRNRNCSACCPMQCGVECACQXCDADHVMRVLARIEGPYALIYYHRASQRIYFARDPLGRRSLLLSAGDIHQGTDHVPETTEDGEGDIPPPLIDRLANTALNMVMLSSV

SEQ ID NO: 56679 - protein, 176 aa, Sorghum bicolor
  Clone ID: 30947089.pep
MQFSRLLGRPDVSTALHHLSRHSRALICFMASAPPPLARRVSPPMATPNPPVRRLPRCPHGYQNMPISTRVKGDRLDKPIQGDRAAQRPRHPVYPLRGLPRSRHRDGSIYRGTERWKERFHLSDRRETRLEPMSLSDPSRTIIHGPRTMLQIFSIELAKIHVEGLVELYGYIAVRD

SEQ ID NO: 56680 - protein, 115 aa, Sorghum bicolor
  Clone ID: 30947101.pep
GWRGCTEVAWLHRAAREGMARLRRGGSTATSGGAGRDDTAARRQGSEIVGFVSSPRRTSSTTSRPEAATSSRELADNEVLHYTIPSVPVYHHRASVINCRHRPSPRSPCLYYYDY

SEQ ID NO: 56681 - protein, 76 aa, Sorghum bicolor
  Clone ID: 30947107.pep
VLPLLGLCYYTISWYVYSSANESLTFVLCCNLCCILVMIVNHSGTAGHVEVVVEACLLCSLNSIVLHVQFSSSHGY

SEQ ID NO: 56682 - protein, 69 aa, Sorghum bicolor
  Clone ID: 30947142.pep
APQWTTAPQSTTEPQAPPSMEFPFAVTTPSVILTPTRNNNNNNDVFASDSIHGKILMSLVSALCFIILR

SEQ ID NO: 56683 - protein, 76 aa, Sorghum bicolor
  Clone ID: 30947174.pep
HESGRVSDSQSHLPHTTSHSSTSTSKSGGTKNKSSYRNQEEEEEETEIHGDSASVVWLMDMDGTVEMWNAMQLSYS

SEQ ID NO: 56684 - protein, 144 aa, Sorghum bicolor
  Clone ID: 30947183.pep
QVFTSFFVKEVKPTFKVAINHGGEVNGIRSLEGKMSDFRFDEGNQTTTIAQIEWTSSLLVLLFVFLVGQHGLSLSWSRRHRVNRAQPNREKGHPVRPMWHKENVAKKMWHKENATSAIGLQEVRTHNHKAPTDSAATLDGWVHG

SEQ ID NO: 56685 - protein, 171 aa, Sorghum bicolor
  Clone ID: 30947214.pep
PTDHIHLFTDPSIIPYNVSSCRLIFVPIYEVAHYALYAFDMEKKMVNILDPVRDTSMAGKDIEHRHSTTKIQVSKALQECMKLAFPDWNEHIQNWEAKYPTNTIPECHKGDSAYHVLNYMRNWDGTRLVNSVPKESLNMRKEFLFNLLSFRSNEAILPEHVERIIKMASRR

SEQ ID NO: 56686 - protein, 118 aa, Sorghum bicolor
  Clone ID: 30947242.pep
ICSRFTGSQSGPWHDLLTGKHYSKLAAVHLLMQTNTVECENKKPPHAEGVILSGGHVSSGCNCPAASTHTCMTPKPHACMISVVCGYCGYTRNKGRFRLMPCTSTYDGQMGNLMASQP

SEQ ID NO: 56687 - protein, 109 aa, Sorghum bicolor
  Clone ID: 30947248.pep
ESEIDFGCTWIQFAAIELDFGDIRGSVFHSIKLIWRAKQGRVTTQAKGGLSCVGKENLAHPGKIARQGKMYEHYQTPGLAKQGEVSACSETKHALYFSALVVLCCHLSD

SEQ ID NO: 56688 - protein, 91 aa, Sorghum bicolor
  Clone ID: 30947287.pep
MMTGENQMTSKGTESSSSSVPPDGVVSREPQKGGRLPNGRTTGPARRSSKGNWTPEEDDILREAVETYKGKNWKKIAESFPGRTDVQCLHR

SEQ ID NO: 56689 - protein, 101 aa, Sorghum bicolor
  Clone ID: 30947317.pep
KPLQQDVKDSDAEMYVHHSLGRSRPRIKCWIMHQLIFTIQNQITEQEKQQQKKRLEGICSYSVVAIGYWFDSASECPQCFQKRELSILIATVHPTLQWKKK

SEQ ID NO: 56690 - protein, 118 aa, Sorghum bicolor
  Clone ID: 30947342.pep
NSPWRRVAAGSAGPAFFSGDGVALTGGIPHPNRSHRSPHRPPRAEPRRGARARAGRDAEEDGERRRSDRGGQAAHRLVGALHLRHLLHTHTVQSWLGPCGTIEMLVCLTEIHQVSQPL

SEQ ID NO: 56691 - protein, 109 aa, Sorghum bicolor
  Clone ID: 30947374.pep
WPPLLEGNHLLVVAAYYKLLLQSGKENTGEMSRFRGSIGYELDMHGQWGGELAVCLSHVVLCEGMDAAEILLQASAACFALLALSGIQACFREREREGGSGLVWCVRAV

SEQ ID NO: 56692 - protein, 93 aa, Sorghum bicolor
  Clone ID: 30947380.pep
ARSRRAVLPCCMHIYAPHLSAAAPLVVSVGGAAPLAAAWSDTRAAVSGPGGCMRAGKRAYVPTENREKEGTHAVYLALVRAAVTYYVCAGICY

SEQ ID NO: 56693 - protein, 136 aa, Sorghum bicolor
  Clone ID: 30947401.pep
ARRDRARAVDAPASQRLAARAAAAGAARRGLPSSCCLRRRCEPPPAPATPPCGRSPPPWRSRSPCPPPARIPAPPQLLPAPASTSQALEAVRVVLCTHPSNTALIKQVLWRSKRLGGGAGGRRPQDLQSHARMPRG

SEQ ID NO: 56694 - protein, 156 aa, Sorghum bicolor
  Clone ID: 30947407.pep
VPCWSSVFPHAAELRFIHGAQALPRRARFGRHSQHPPCGPVPHLAPPLDIHYRPNSASPKSESKLHPDEPEAFAGAKIFPRRAVPQLAPPLKICYRLWRRLIRGCESAGGVMSTRRSGSTASTSSSAPAEWIPCFSANSGCLFRSPYLHSPSRRCS

SEQ ID NO: 56695 - protein, 68 aa, Sorghum bicolor
  Clone ID: 30947427.pep
FSSLLAAETALTKQMLAKILVRPRCKRAAVHILSFSISHTKNMRFVGALGFHVSAATKLGCLVSPTFF

SEQ ID NO: 56696 - protein, 125 aa, Sorghum bicolor
  Clone ID: 30947447.pep
IRDVHYNGYDIPRGWKILPVLAAVHLDSSLYEDPNRFNPWRWKSNAPSSFMPYGGGPRLCAGSELAKLEIAIFLHHLVLNFRWELAEADQAFVYPFVDFPKGLPIRVQRIADDQGHRSVLTESTM

SEQ ID NO: 56697 - protein, 109 aa, Sorghum bicolor
  Clone ID: 30947491.pep
IEREAQRALDLLLESEKTTKAPEVQRMSDEITVTRDHDEEQQEALRRAITLGVADVKMPSAYGTFDENPTSEAEEAPLLSDSGRRRAVWEEWIARIFEKDESGQMVPRR

SEQ ID NO: 56698 - protein, 37 aa, Sorghum bicolor
  Clone ID: 30947493.pep
YATTAISFSLLLEIILDQYGRYYALSGFLVLSSVPTT

SEQ ID NO: 56699 - protein, 203 aa, Sorghum bicolor
  Clone ID: 30947546.pep
GTIVLSTKLLTVVDSGQLDLDTMPCASAARSSCVLLQLALLSCVWLESGRAGSERTHSRGCLVGVWEGWVVFRVKYSSQMRVGLRPSKSGGRSRSSRVDVHQTLNSFNQTPNGAAPSPILQPNTETGWVCLQNRSATKHSFGLDPTQLTQPPTKHTVKVRLYEVADSGQGKLDWTPCHVLVQLALQACHTARCLLCALLAKLQ

SEQ ID NO: 56700 - protein, 71 aa, Sorghum bicolor
  Clone ID: 30947562.pep
FGCPRVSDESGSLNLGISSINCFYSIVGVFGKLNHSWIKESFMAIICTAIVYSFMKLKAYSSNSVSYYWSV

SEQ ID NO: 56701 - protein, 119 aa, Sorghum bicolor
  Clone ID: 30947570.pep
TVPGLGSIPGATLPITTPSIDLAPPSECLLLKNMFDPALETDPDFDLDIRDDVQEECSKFGQLKHIFVDKNTAGFVYLRFDSITAAMSAQKALHGRWFAGKMITATFMTPQQYEMKFPS

SEQ ID NO: 56702 - protein, 135 aa, Sorghum bicolor
  Clone ID: 30947578.pep
EEEKVQVPSWICFSSVDGKNLCSGESFADCLKILDTSDKVAVVGVNCTPPQFIEGIICEFKKQTKKAIAVYPNSGEVWDGRAKRWLPVECLGHKSFDALAKRWQEAGASLIGGCCRTTPSTIRAVSKILKGKTGH

SEQ ID NO: 56703 - protein, 194 aa, Sorghum bicolor
  Clone ID: 30947579.pep
MALPSSPASTIHHPPRISSCCCCPPSPCPCPVQIQTTSRATPSAAYLLPLRVATASPTAISTRSPGPGRRRLPPLAALPDPQSAAALLVVAAGTVGAASLLLRSTSSSSAASQQQQRRQDEQEEVEGEECPDCGGTGLCDRCKGEGFVFKQLSDETATKARKAAKNMATRYTAGLPTKWTYCNKCSSTRTCTTC

SEQ ID NO: 56704 - protein, 152 aa, Sorghum bicolor
  Clone ID: 30947580.pep
MASEAEPRVVDECRGVLFVYSDGSVVRRAQPGFSTPVRDDGTVEWKDVTFDDAHGLGLRLYLPRERAAGGRRRLPVFFYYHGGGFCIGSRTWPNVQNYCLRLASDLGALVVAPDYRLAPEHRLPAALDDAAAAVLWLAAQAKEGDPWVTEAA

SEQ ID NO: 56705 - protein, 148 aa, Sorghum bicolor
  Clone ID: 30947586.pep
MASSVPAPSGSVITVASSSSSAAAAAVCGTGSPCAACKFLRRKCQPDCVFAPYFPPDNPQKFVHVHRVFGASNVTKLLNELHPFQREDAVNSLAYEADMRLRDPVYGCVGVISILQHNLRQLQQDLARAKYELSKYQAAAAASASTAA

SEQ ID NO: 56706 - protein, 106 aa, Sorghum bicolor
  Clone ID: 30947588.pep
ISGEQQVDLESMGYQRWIKWLKEYLLGCWTQILLRHELSGRLKKINSRLNQISDNQKEYKIEHISLATLTSSTTATSAWYGTSYVNPVIMNYQCCTFDEYTRNIFS

SEQ ID NO: 56707 - protein, 126 aa, Sorghum bicolor
  Clone ID: 30947604.pep
MAGTKLISVGLIVLMSIGLANAARVARYSSSYGTGTGGGDGGALGNAGGSGSGSGTGSGDSGPYGAHASAGGGGAGGGTSYANRFWSGSSDAGASASGNGGGTGNTQNAGAGGGSSAGSGYGNAYP

SEQ ID NO: 56708 - protein, 64 aa, Sorghum bicolor
  Clone ID: 30947606.pep
AKLSSSDQLPNQERSDYLGWLPEKDGYLRRMQGNNFMRAHVVQISGRAASSSGSDKLTLCCFTG

SEQ ID NO: 56709 - protein, 96 aa, Sorghum bicolor
  Clone ID: 30947608.pep
SVSTNIFHTHWLQITQQKVGRLYISVDNVFLKQVGHPSAYMQRKLCKFWEAQHIMHGQLSTAKENSVAIPSTDFVFAWMSPHLPLIVAHGKDHVHL

SEQ ID NO: 56710 - protein, 119 aa, Sorghum bicolor
  Clone ID: 30947614.pep
MDFDEYEYLEKTVEASGAPANGSSGPGSGDKDKERSSRRRSSGGDEERDDVKRRSKRSRSEEGRDRDRERHRDRDRHRSSRERRDRDRDGKEKERDREKDKDMRSRDRDLERERERERE

SEQ ID NO: 56711 - protein, 171 aa, Sorghum bicolor
  Clone ID: 30947622.pep
MGALEELVAKAGGCAVIDGGFATQLEALGADINDPLWSAACLITRPHLVKEVHMQYLEAGADIIISSSYQATIPGFLARGMSVDEAEDLLRTSVKLAVEARDEFWKSALRKAKPIYNRALVAASVGSYGAYLADGSEYSGSYGADITAEKLKDFHRRRLQVLASAGPDLIA

SEQ ID NO: 56712 - protein, 213 aa, Sorghum bicolor
  Clone ID: 30947639.pep
GSSPHSFGFPSHTNPQKGKTPSLSSPIAGRSAAMERIKIKIDWEEVFRGSPSRDLDAEVCFASPSSAPRASGAKAATKARALGVARALSGDERRRGSPDSSSHRRTFRTRRDDVGWCVAERRTAANVDVGARRPVTRAAAKAAGGREQDAHSTSKDVFAFSLEDEQVGHEGNRFLSRSPPIQKTKYCQLPLNTLKSQGRAGKRNPISVDKMYS

SEQ ID NO: 56713 - protein, 91 aa, Sorghum bicolor
  Clone ID: 30947640.pep
MGAMMASITRELLFFLPFILLALLALYTTTVAKCHATHHQWRRPKKKRPNLPPGALGWPFVGETFGYLRAHPATSVGRFMEQHVARYGKIY

SEQ ID NO: 56714 - protein, 204 aa, Sorghum bicolor
  Clone ID: 30947664.pep
MAHGGYPRRGAAVRRPKSSASAPVADRKRKRTAAAKTTSLKNQIRSTERFLRKDLPDDIRVAQEKKLEELKRQQELQNQLAVQRTLQLRDRKIKFFERRKIERMIRRLEKQQRSNGDGFSNNLSTLREDLEYVRFFPKNEKYVSLFSGGNSQDIVQERNKWRKQIKDNLMAAAANGKDLEETASDDDTLDVSDDDFFVSGSSSD

SEQ ID NO: 56715 - protein, 98 aa, Sorghum bicolor
  Clone ID: 30947712.pep
MSIACCLPVVECVYCLACARWVWQRCLHSGAYDSETWGVASAEEFEPVPRLCRIILSVYEDDLENPQWAPPGGYGMEPRWVVHRRTYEDTHGHAPTYL

SEQ ID NO: 56716 - protein, 197 aa, Sorghum bicolor
  Clone ID: 30947731.pep
MSDPAAGGTMVHAAGGGGAWANGGPRFGDMVWAKVKSHPWWPGHIYSVNLTDDEEVHRGYRDGLVLVAFFGDSSYGWFEPSELVPFEDHFTEKAAQGGSSRSSFAAAVAEAVDEVARRSALALLCPCNNPDAFRPHPIDGNFFLVDVPAFDTDADYHRDQIRAARQRFVPRKALDYLLDAAVTQHDAAEKAARTVPG

SEQ ID NO: 56717 - protein, 110 aa, Sorghum bicolor
  Clone ID: 30947747.pep
SSFFFTALIFPFYEDHTTGDHSSAASSSLVCPYLALRGFLHPVHVPSTSNSGAESTSFHRHSTGLEGHATPDLNNAPVFHATESRNHDSEHRHLSNLPVSGIPEYSMTPF

SEQ ID NO: 56718 - protein, 109 aa, Sorghum bicolor
  Clone ID: 30947764.pep
KRKPTAGGCVDLELEIDEDTRFGAWIELDKKPNSRLLRWAVTLSDTPQGDLGWGVSLRRGTEAKPQLFQVEGFLNLHLGKTAAVQPGIVFNVDGRRCRPGLVFHSSWSL

SEQ ID NO: 56719 - protein, 156 aa, Sorghum bicolor
  Clone ID: 30947818.pep
LLLLSFCFRENHTHRHTGFHHTVTGANQDRQVAKASIRPATQQYASYTSAMNSTYVRITPVQLQLHHQSRKSVSTIKQACPEPAEQAPPVHALRRSLACPSRVLSIRQADSRQHQRPHPRMLVAACAAMDLHTVVGGRERRVTRRGRARPTPAMTP

SEQ ID NO: 56720 - protein, 96 aa, Sorghum bicolor
  Clone ID: 30947828.pep
DGQDTCTVPRRGGYGGRDANYDALVPPSFAFTGAGGRPAAPVHTFGFGTDHDAAAMHTIAEATGGGAWCGVGHGRPHDVVHDAGDAGHAGPVAEGA

SEQ ID NO: 56721 - protein, 86 aa, Sorghum bicolor
  Clone ID: 30947873.pep
QQRDGQHAWQEATVDDLVPPNYVWHVADPAGDESLPLANELKRYYGKAPAVVELCVQAGAPVPAAYRSMMRLDVVPPARDEYDLVA

SEQ ID NO: 56722 - protein, 111 aa, Sorghum bicolor
  Clone ID: 30947881.pep
GTVTGVDGGKVTRSVSCHQSLFPYLVYYCHSVPKVRVYEADIMAAAAAADDDGGSDAGEKEIINHGVAICHLDTSDWSPTHGAFVALGGKPGEVEVCHWIFEGDMTWTVAD

SEQ ID NO: 56723 - protein, 140 aa, Sorghum bicolor
  Clone ID: 30947898.pep
NSVPTPLRPSPVPRVPVTASPAIARGIAACPPLPHANKAPVPEARARQAKPPPPPPPRRARDREPPHLGVGVGFASFRASTDARRMAAVNCLYVAGASTGGSAAALQWWASSLLDGDAGAGGDGDWLGAVLRARGTVALL

SEQ ID NO: 56724 - protein, 180 aa, Sorghum bicolor
  Clone ID: 30947926.pep
SPCPPAAAALQPSRPRGQLLLREENTRRRARRSGSDAEGPLHLLRRAQRALGLKRHSVKHLRDATAQLGNTLTRAAFGAAARKGRGRRGRAQAARRRRGRRGRAQFGKLAQAQAHRALATERSRPAAEPRLLLPTADRDRLSGKPPRHRVPVPIGDCPPFGLAALERRPRRQAPESVGDD

SEQ ID NO: 56725 - protein, 192 aa, Sorghum bicolor
  Clone ID: 30947931.pep
MASSPPPPPIRTVLAATLLLLLVYLLPHNAAAAAAVADASSAVNPFTAKAAFIRYWNRKVPNNRPHPAFFVAKLSPLPAADSASFPTALPDIRARLPELCTKAALLCPGPATTDAASLAASGPRGGGPFKGYSNANFSNYGTGGVAGADSFRNYSPDLNIAADSFRRYGRDSSGRADSFASYESDGNVVTAN

SEQ ID NO: 56726 - protein, 132 aa, Sorghum bicolor
  Clone ID: 30947943.pep
MANGLPNPPCAVLTADAARSLVDSVDAFLFDCDGVIWKGDKLIEGVPETMELLRKMGKKLVFVTNNSRKSRRQYSKKFRSLGLEVTEEEIFTSSFAAAMFLKLNNFSPEKKVYVVGEDGILEELKLAGFECF

SEQ ID NO: 56727 - protein, 171 aa, Sorghum bicolor
  Clone ID: 30947956.pep
RRNPILVISLSPPFPHGIQRRRLPVAPSSPPATATPPLESLPLPPPLLFHHHHLSLPSPNLAGASTYLVPWTIAQVGTAPGGAGGVRSGWRTQGSMPMTTHFLPACVSDGLQPRRRTPYQRRRVGPHAPVAVSTLPIPNPIPAEPSSHAGSGRPPTQSTFFEPDDVFSAHA

SEQ ID NO: 56728 - protein, 111 aa, Sorghum bicolor
  Clone ID: 30947962.pep
TGSLPWSSRDAIEAMARGDLGGGLPATRQRPPLSSSSSSSTSLPPHDARQRGHNTNGGLGLAPPSPVLSTGAHPGRRREQRWSARGLDGGDPPSPPGVDEPAIVAEVSRWR

SEQ ID NO: 56729 - protein, 132 aa, Sorghum bicolor
  unsure (1)..(132): unsure at all Xaa locations
  Clone ID: 30947966.pep
RDHSFNFLLSLPQLHNVIKCLLLQTLQDPYGVGVGDRTRRRRRAAEGEEEALGGVSHVXGXIXRXGPRRLHPLLPPRPRFAPQHWRESVRQEAGWLAGGWMDDSSRGRGGGKAAQHPQQRGREWKVLVFFFQ

SEQ ID NO: 56730 - protein, 194 aa, Sorghum bicolor
  Clone ID: 30948000.pep
LLVKQIGSLPSPPPPNPANLDLKERFKELKAQKSLNTISPSSDEARAYFQREEFLRYSIPDRAFCYTAADGEKSIVAPLRRGGGKPTAKARGHPMLLPDRPPHVTILCLVRDAASRLPARTGTRADVCTLLRDSQYLNHEEANKEAAINQVVSGALDRLHYGRDPCVLYDNDKKLWTYLHRGREEEDFEDDGTS

SEQ ID NO: 56731 - protein, 48 aa, Sorghum bicolor
  Clone ID: 30948008.pep
MLCRHETRERVRVQITDADKQRWEVPYNLLPREPAPPVTGSKVTGAPF

SEQ ID NO: 56732 - protein, 134 aa, Sorghum bicolor
  Clone ID: 30948025.pep
LSPPLPRRQRAPSGGTACSDASGAPPSSSQRQGRRRRHRPRAARRGCPIPPPVPPPLSPPSHTGGGTTCSGATTRVALVFCSSMKPYLPTFDLVFAFCFTMLIFQLSSYSSLGFLYEHQICCLHSMHAYCEAPA

SEQ ID NO: 56733 - protein, 91 aa, Sorghum bicolor
  Clone ID: 30948027.pep
MTRRCAEAAPSLLQVLLALHCGVVFLQCSAASAMGSDVSALMAFKRAIIEDPHSVLSDWTDADGNACDWRGVICSAPQGSVISLKLSNSSL

SEQ ID NO: 56734 - protein, 169 aa, Sorghum bicolor
  Clone ID: 30948042.pep
MESSPWSNCHGDMRRTCTRSGGGGGSGSGHVVFPLQCSHQDQSHSRRVSGSGIVEANGRPVCQLCSARWRELPSLRSTNPSPPSPVPSSQPFFRPMEPRVFDDDDPVERTPRPLRDDHHRGASADGGAVALTTHCECSALARDASADDFAVLVHARAPGMMAGAGGGAA

SEQ ID NO: 56735 - protein, 42 aa, Sorghum bicolor
  Clone ID: 30948058.pep
HYYWRKFDDGFMRPVFGGRGFVPFHPGSPTESSVPLLAGNGN

SEQ ID NO: 56736 - protein, 87 aa, Sorghum bicolor
  Clone ID: 30948061.pep
IHRFIIHKKDKDRNRMKKKRLGTMILLQERKTSLLVGYLHISFCTQIVWERRVSLFLGLYLHSEVVTEMAHVTVHNLIYQSKVWTSV

SEQ ID NO: 56737 - protein, 73 aa, Sorghum bicolor
  Clone ID: 30948091.pep
SLARDDATTTNRQMQVSQHLVPTTNAASPFFERFQFLPYLNIPSIYLFYTPVYSWIFRSVERVELVDLTNLWN

SEQ ID NO: 56738 - protein, 93 aa, Sorghum bicolor
  Clone ID: 30948096.pep
NQIGRPYGFRYTPVDEILRYNNKKSARRGKGILYKTVSPLLVHNFLMDCCRVPIISSCICLIRYESLVQGQLILLACLLHLGTSGIIKSQVHN

SEQ ID NO: 56739 - protein, 88 aa, Sorghum bicolor
  Clone ID: 30948098.pep
LAEYLRLSCCCRRRRSSLHFSMRGVGVDVGGVGVRASSVHEPVQHDWNISHARLRRSPCRCRTLRGVIIIALAWLVSLESPRTSSAAS

SEQ ID NO: 56740 - protein, 55 aa, Sorghum bicolor
  Clone ID: 30948101.pep
LPTFQLIFVHVIESLVFVPIMIGILFFLFEFYDDQLLAFLVLTLVWLCELFTMIR

SEQ ID NO: 56741 - protein, 67 aa, Sorghum bicolor
  Clone ID: 30948109.pep
KEHILAELTKIAKEKKLKGFEFIKAIHLDPLPFDIERDLITPTYKKKRPQMLKYYQGVIDALYKSMK

SEQ ID NO: 56742 - protein, 43 aa, Sorghum bicolor
  Clone ID: 30948111.pep
STAVGNPARLIGGKKAEGENDEDMPGESMDHTSFIRQWSDYTI

SEQ ID NO: 56743 - protein, 80 aa, Sorghum bicolor
  Clone ID: 30948113.pep
MCEDSLKWIESNPEAEPESYEQKQKEMESIFNPIISRIYQGDGQQQQAGGCGMSGAGGFPGGNFAGSSGYSAGPKADEVD

SEQ ID NO: 56744 - protein, 53 aa, Sorghum bicolor
  Clone ID: 30948127.pep
FYRTKYCSYHKMLVLRVLNSAYQTKEYNTGFMCSLQRRASRRAGSAAAVTQLF

SEQ ID NO: 56745 - protein, 126 aa, Sorghum bicolor
  Clone ID: 30948135.pep
TKGLDHLNKLTLPMTLLSEANLEELSKLKALFSLTFTSSAAQLDQETVTIIENNRSGLNGEIIVPAGGFSNLKLLRFTAPRMPLLCFAKTAMQCLERLELNFSMLEGLLGTENLQCLKELHLRIQR

SEQ ID NO: 56746 - protein, 122 aa, Sorghum bicolor
  Clone ID: 30948143.pep
MQDLNVADKLVIPKDWYLIFPYGLISQNNSIYSAPDSHNPDRFLTEAKEPYQNVSFGAGRHPCTGVKFATMNIKTLIFSFLERYDAEMSDNVHDLMPKEQVMGVFRPIKPCIAELTPKVSIM

SEQ ID NO: 56747 - protein, 95 aa, Sorghum bicolor
  Clone ID: 30948155.pep
LKNNQRPTSTQVPLPSSPATIQSHPSWLQFNNVAKPSHSSNSLHLTKLGSLLHYTASENDHVSSLLASSETKTDWQHLHALCTHLLIILIKNRSL

SEQ ID NO: 56748 - protein, 217 aa, Sorghum bicolor
  Clone ID: 30948189.pep
AYTMLLYILFTVAAVLAAWIWFKHPAPKSKDFPHLAIPPRLTWGEIFSIMKNAPNTKNSFFEAVQKKYGDLVWIRVPFWSDIALFTSPEYAKTFFAAKEADFMRGYYIFHKLASPPLFYESKSYLTDVFAKAFSAERYSYFAKLLKRQVDEYFNEHWSGSSRSINLFEEVDHLTLNGMIRSFLGDDLQGAELEEFVHLVKELDIEDRMKNLKASMYY

SEQ ID NO: 56749 - protein, 166 aa, Sorghum bicolor
  Clone ID: 30948191.pep
GAGHGLQLGLVVGIVAMAARLGLSVSSRSSNKVCLRGDAEVLESCAGSATTVQEAEVGEKAMAEFASAKSCAPGAQPRTWRRPRPVLGVGRALAKEQPRHSHLAAVPVAEGQGHCSGTMGPWGWVRPAMDDGLGHRAVAPGMPRYGWGLVPPRPTAGLRPAMAARS

SEQ ID NO: 56750 - protein, 120 aa, Sorghum bicolor
  Clone ID: 30948201.pep
MSRTLVQPVGQKRLTNVAVVRLRKHGQRFEIACFPNKVLSWRSRVEKDTDEVLQSHTVYSNVSKGVLAKSKDLTKAFGTDDLTQICIEILEKGELQVSGKEREAQLSSQFRDIATIVMEK

SEQ ID NO: 56751 - protein, 33 aa, Sorghum bicolor
  Clone ID: 30948205.pep
IILTLHLCPFLFTHTRKKHIARPKLLPIVKPRT

SEQ ID NO: 56752 - protein, 172 aa, Sorghum bicolor
  Clone ID: 30948209.pep
FGPSQALSVSLADTWLAGAAWRETPRLRMRKPTRLPRGASAPAAGRRRGLRVASPVPPLSVCRFVRRRPARFLFDWSFIPSSLTPESRLHSLIVKSSPSKYLRDRMMERLSALVLDSDPTSLSTISETLAKFNFKVFPFQTAEAALDFIEGGAAKEAELDLVLVDVNLNNMA

SEQ ID NO: 56753 - protein, 133 aa, Sorghum bicolor
  Clone ID: 30948238.pep
TPDSHLGLPSKQPRRPHATLLGGKGVPPPSPDCIRGKAMDLLCRRNRRNPAPLRARELVRSPVVRTLDSGSRGGLCAWRRYQGGNDASRIRMRRSRRGRAGIGGNLREAVAPPIRGRGVGFGGPGGGWRATAS

SEQ ID NO: 56754 - protein, 198 aa, Sorghum bicolor
  Clone ID: 30948240.pep
KKKVGPLGIISCVHVGTADGPVTATVHRQDGGTAWRSFEQLLDARRGSHVAGLAELKRYLARFGYMPMPGAAAAEREPTDAFDAHMEAAVRRYQSKLSLPVTGQLDATTLDRIMAPRCGVGDDVPVSLSGSSTASRDGAAVSRFTFFKGEPRWTQPDPLVLSYAISPTATVDYLPAETVRAVFRRAFARWARVIPVGF

SEQ ID NO: 56755 - protein, 126 aa, Sorghum bicolor
  Clone ID: 30948258.pep
MKHLVEVEPATATTGPAYRNARAKDGLLQAPPGLHSCWDIFRTSVEKYPNNQMLGRRRVVDGKAGEYTWVTYKEVYDVVMKLAASIDKSGIKQGESCGIYGANCPEWIISMEACNALGVCCVPLYD

SEQ ID NO: 56756 - protein, 193 aa, Sorghum bicolor
  Clone ID: 30948260.pep
LLAYQSNIEDIVLSGTEIEMESYGQESSDSSDEEWSAFSTPRKTRLQDNEKASLTESLRSSKRCSRRAAAREQNNEHTQSEQQTREQLHGSAREQQTEVLRSNVSTGKVSKYHFGPIVSQKLKEHFEKDPYPCRATKESLARELGLTCNQISKWFSATRHYSRDAVAKNQKHLGENTTENNNSTTFDGIQVLE

SEQ ID NO: 56757 - protein, 189 aa, Sorghum bicolor
  Clone ID: 30948287.pep
IQYLTVLELQDSEVTTLPASIGHLFNLRYIGLRNTGISVLPESIENLINLQTLDVKSTNIRNLPHGIVKLTKLRHILADRYADVKQSEFRYFVGVEAPIGLSNLEELQTLETVQSSIYLAEQLENMMQLRSVWIENISTAHCSKICKVLSMMPFLDSLLLSASNVNEPLSFEDLKPTSTKRHMPRTCPI

SEQ ID NO: 56758 - protein, 172 aa, Sorghum bicolor
  Clone ID: 30948290.pep
MARNLTENRTRNTLIVIVILGLCSFFYLLGAWQKSGSGGGDKTHQWVIEQMKCAQLPNLSFETHHSASNLPNDTGSSKIEPFKPCDEQYTDYTPCEEQKRAMTFPRDNMIYRERHCPLDKEKLHCLIPAPKGYVTPFRWPKSRDFVPYANVPHKSLTVEKAIQNWVHYEGNV

SEQ ID NO: 56759 - protein, 85 aa, Sorghum bicolor
  Clone ID: 30948294.pep
LDDAAAECTLADVKAWKMSSVRPPSVRAYSCRPSYDGGGEAHAIRTPLAYVYVQRFRRHASARGKHVRAGVFWPCMHLHMHVQAK

SEQ ID NO: 56760 - protein, 96 aa, Sorghum bicolor
  Clone ID: 30948300.pep
MDPEQTFLRVHARLSGTLSQLLTPRIRLALEYLYLAGAVALFCLLVVMHTNFVQQPGCSSEFSGIKFGEAQLVQIKIISGGLWSSRGASYIMDLQN

SEQ ID NO: 56761 - protein, 136 aa, Sorghum bicolor
  Clone ID: 30948302.pep
MKEKRGLEDAAGSSGGAGDGGPDAKRARPPALASVIVEALKMDSLQRLCSSLEPILRRVVSEEVERALVRLGPAAIGGRSSPKRIEGPDGRTLQLQFRTRLSLPLFTGGKVEGEQGAVIHVVLLDAGTGCVVSSGP

SEQ ID NO: 56762 - protein, 110 aa, Sorghum bicolor
  Clone ID: 30948336.pep
MAGYPEDNQHALNGYDEEEVDEEEGHPGRRGGRDGASGYGDAGGEDGRGAGGDSSGTIFVGGVAWETTEESFSKHFEKYGAITDSVIMKDKHTKMPRGFGFVTFSDPSVI

SEQ ID NO: 56763 - protein, 195 aa, Sorghum bicolor
  Clone ID: 30948345.pep
PEESKNLFKQAVLESGMKEEEYRKIDRVTKKVVNICGGLPLALVSMAGYVGCNKKPEELLKHFQYLGPESTKDHREGLNQEEESTKDHRGGLNQEEEPTKDHPGGLNQEEEPTKDHREGLNQEEAGRIISYCYNDMPAEIKTCSLYLSIFPKGSRISRKRLTRRWIAEGFVSEKQGMSMEDVADTYFSHLVRRKI

SEQ ID NO: 56764 - protein, 172 aa, Sorghum bicolor
  Clone ID: 30948347.pep
MASLLCPQIKLSKVFVRRRFHESGQTNLPRSLHWKPLRPGHLENLVLRCTENLSWETSLPYASVEDGASIIKGTGVVEPIDTEEAPQIPILQSDEDVVEVNNEPSWQLKAFKLPLWLLGPSVLLVTGIVPTLWLPLSSVFHGPNIAGLLSLVGLDFIFNMGAMLFFLMADAC

SEQ ID NO: 56765 - protein, 99 aa, Sorghum bicolor
  Clone ID: 30948387.pep
YTFSNSGLYMEGTLPIIKWDGNHIKIPLYVWMHHKYFKPKKQHQIPLHAEKSTGDNFIYTDSFLYLKTEWSLVCLLGQHTALKLCRNQFLSHLFLSHKG

SEQ ID NO: 56766 - protein, 72 aa, Sorghum bicolor
  Clone ID: 30948457.pep
KGRAMLIITFFLRLLKIFSRAALFDHTKMDGRKRAHYIDGYLWIHSGSTSELVKKKITKLHQRIDGLIHAHP

SEQ ID NO: 56767 - protein, 90 aa, Sorghum bicolor
  Clone ID: 30948465.pep
FEWCFAFCILIYIHPCLPLIHWHFFSRGGLLQLAFSPHCQKPARFVSAAACWRRPCHGMEWDAVFVQIGVHVWLSLWPPTSAHAIHDLRD

SEQ ID NO: 56768 - protein, 102 aa, Sorghum bicolor
  Clone ID: 30948469.pep
KDSSSCSNEMMVRNSTKFDVEKRGNGSTRIEICCPTNPGVLLSTVSALEVLGLEIEQCVVSCFSDFAMQASCSQEDGKRQVLSTDEIKQALFRSAGYGGRCL

SEQ ID NO: 56769 - protein, 90 aa, Sorghum bicolor
  Clone ID: 30948509.pep
NLPLVTKWGLNTPVIVTGSLDLDPTVPATRDSRGRRRQSARAHTHTLTCVHDKDQKKGTHSQPTGRHSKAAAPAAAMPSKQAKVRPYHLS

SEQ ID NO: 56770 - protein, 160 aa, Sorghum bicolor
  Clone ID: 30948511.pep
MELDEEAFLDELMSLRREAAASSAPWQQADPCSAYPGAGGGGGGMMMSDLLFYGGTTEGAAADATSMDLSPFHQEPLQAPMPPAAARTPLPPPHPHEEFNFDCLSEVCNPYRSGGGGVAVPGAEAVAVPGHKQALAALHDAMVEEETSGDLDLQGQQHYG

SEQ ID NO: 56771 - protein, 206 aa, Sorghum bicolor
  Clone ID: 30948527.pep
MSRHHHHHHAAAAAIAAVFFLLTAPPCAADPNDERCLSHLHQSLYDPSGGLNWTKAAISAPCDGFFSHLQGVTCNNGRVYKLALPELSLGGTIPPELSNCTNLQSLDLSANALSGAIPTELSALLNLAVLNLSANALSGAIPRELASCAYLNVIDLHGNQLSGPIPDELGLLVRLSTFDVSYNRLSGPIPVLLANRTGAGSTAAVG

SEQ ID NO: 56772 - protein, 188 aa, Sorghum bicolor
  Clone ID: 30948529.pep
MLMNFRDWISYRLGSSLLSARPFALSPGADDAVASEGDAHGTTHNDYVDTVTASPFSSNDTRVSDVTTNSNSGATYSGTVRQDDDNKKSDPLMKVEALQIKFLRLVYRTGVSPSADVVAQVLYRLQLANLIKAGEAVARRPNLAINKARVIAAQQEAPGGPDLDVSLRILLLRKTGVGKSATINSIFD

SEQ ID NO: 56773 - protein, 173 aa, Sorghum bicolor
  Clone ID: 30948537.pep
MEAASGGGQLFSVDPLERQAARGHGVVTSMAAGSDVIVLGTSRGWLVRHDFSFEDAHDLDLGSGRSGDHSVHRVFLDPGGKHCVATVVHPGGVETYYHHARWPRPKPLPRLRGLLVNAVAWNRQSITEASTKEVILGTESGQIFEMAVDEADKREKYVKPLFELTEQREGIKD

SEQ ID NO: 56774 - protein, 143 aa, Sorghum bicolor
  Clone ID: 30948563.pep
TAGILAIHSVEEQKKYNLFVTLFSSRCRRRCTYEPEGEEIRCKGGAGTKSSAEAKPGQRSVQSPVQGLPAQAEMVMLACAEDTKLPGAARVGRLDQRRRWCGFRVRRPPAQGFTRAEATATGLAWSCATLGATLGAAMVVEWR

SEQ ID NO: 56775 - protein, 64 aa, Sorghum bicolor
  Clone ID: 30948569.pep
AATIAASEKAQRRAVDRWAAAMAGLHFLLVPLVAQGHIIPMVDLARLLAGRGARVTVVTTPVTP

SEQ ID NO: 56776 - protein, 125 aa, Sorghum bicolor
  Clone ID: 30948571.pep
SSSFTNVSVRRTCDSRGGSSLRFRRDLHSSPVDTEGGTAAAAAAPRRTDQWASPAPPNGGGMPGCSAALARPQTRVSLRSEGWELLGFGEAGHAVEWPRAVSEEWRRGVEGKGREGRQSCVLALL

SEQ ID NO: 56777 - protein, 148 aa, Sorghum bicolor
  unsure (1)..(148): unsure at all Xaa locations
  Clone ID: 30948617.pep
GPPARLVRVGVGRPPPASSFRRRPCEVRGPTPAPRLPVAGSLPLARQCQVAGHPAPAPRLAGLAQAPSGLGQAASCPGQVVGCLASRIDPRPDXIGDDEGNASGGGHCARYLFNVLTQRRLLRLKAHRAPAGPAPLLRRLGFGIRLVP

SEQ ID NO: 56778 - protein, 98 aa, Sorghum bicolor
  Clone ID: 30948631.pep
LGNLVKATYNLLGLRTYFPPGEKETKAWTIFSGMTAPQAAGVIHSDFQKGFIRAETVSYDDFVAAGFFGVAREKGLLRLEGKDYVVQEGDVMLFRFNV

SEQ ID NO: 56779 - protein, 70 aa, Sorghum bicolor
  Clone ID: 30948639.pep
AASLSISKECRFFTIHGSADKIIPVEDAHEFARLIPNHKLCVIKRANHGYTSHRRQLCDAVIDSITSNVV

SEQ ID NO: 56780 - protein, 162 aa, Sorghum bicolor
  Clone ID: 30948657.pep
KWHGWCWTGACRTRSCRLRHWICLSARRASETQEQWPMLVSSISSTALLYYPSSMRSFVCSISCRFAWYCTSIFLQLTSRQFLFLVGVILFVNGLFLISHRFCCASFGGHVSCNLSCSSKLACSFLCVCVCVCVCVMGAMYPCAWPGMTNKKCNVTDFSELR

SEQ ID NO: 56781 - protein, 42 aa, Sorghum bicolor
  Clone ID: 30948751.pep
KGKETNHAEAELSTTDTVSLVYTLQTMPMHDSTVCSNIKETT

SEQ ID NO: 56782 - protein, 93 aa, Sorghum bicolor
  Clone ID: 30948803.pep
MSKRKRWSCSYQTAPRRDLPTTAMVEDNAGRQSGQGVVVLALRPAGTSLISACFPIQAAGCGAPDSGLLPLCFELPWAPPHFRGKMADKRKGG

SEQ ID NO: 56783 - protein, 200 aa, Sorghum bicolor
  Clone ID: 30948829.pep
TLLSSASAPLPLLSRFVFPTRGAPHPQNPNPRLREDMASKFGLAGGIPERRVRPIWDAVDSRQYKAALKLCTGLLAKHPTSPYALALKALILERMGKPDEALSVSLNAKELLYSDNIFHFDDLTLSTLQIVFQRLDRLDLATSCYEYACTKYPSNLELMMGLFNCYVREYSYVKQQQTALKMYKTVGEERFLLWAVCSIQ

SEQ ID NO: 56784 - protein, 129 aa, Sorghum bicolor
  Clone ID: 30948843.pep
CIQDFVFRGSLHNAQNIMQGPDRVIRHGVIFTSMYYGDRMKQPRSFAVATSSDEDAARVSSSACPPEKRRQRREPSRRRPAGPGRTAPWWPGMATVGVRAARALSPLLLSGGRGRPSERGGEGSRRRRL

SEQ ID NO: 56785 - protein, 157 aa, Sorghum bicolor
  Clone ID: 30948847.pep
MASSSALRSSASVVVVVVVAVVLLATMGAEAETRKYQFDVQMTSVTRLCGTKSIVTVNGQYPGPTLFAREGDHVEVNVVNRSPYNISIHWHGVRQLLSGWADGPSYITQCPIQPGQSYVYRYQIVGQRGTLWWHAHISWLRATVYGPIVILPPAGVP

SEQ ID NO: 56786 - protein, 162 aa, Sorghum bicolor
  Clone ID: 30948863.pep
MVTNFLRKYQLQNHHLVLPKKQFVTYALYALIALAFLHHLIFYPAPASEKSVVVAQVQDEVAAGVSAARVNAREHLLPPPPPPQQGDEVLRNQRAQGVVAKEVPSPAPAPPCDYSDGEWVPDARSPLYIGTSCGTIKDGQNCMAHGRPDTGYLYWRWRPRRC

SEQ ID NO: 56787 - protein, 149 aa, Sorghum bicolor
  Clone ID: 30948901.pep
AHFGMVAAARWIAKLSGPCLAQALHMYPDFKIKVVGHSLGGGTAALLTYILREQKEFASTTCLAFAPAACMTWELAESGVHFITTVINGTDLVPTFSAASVDDLRSEVTASAWLNDLRHQIEQTRILSTFYRSASALGSRLPSMANAKA

SEQ ID NO: 56788 - protein, 62 aa, Sorghum bicolor
  Clone ID: 30948933.pep
TCLILQSSLSRLIQQNLVTSFLTSHLHPFSQARVELHLNINTLVDSHAAIIYASMNILTLTR

SEQ ID NO: 56789 - protein, 59 aa, Sorghum bicolor
  Clone ID: 30948956.pep
MSMSWWWRGAIGATRRRQDEHATATAERRPFQSVALVVGCTGIVGASLVDILPLPDTPG

SEQ ID NO: 56790 - protein, 157 aa, Sorghum bicolor
  Clone ID: 30948958.pep
LNQKLAFKYFGPFRILERVGAVAYKLELPPSTSIHPVFHVSQLKGAVLDSSQVIHTVPNDLSSPRVPQCFLQRRLITRGVTAVHQVLVHWSGWPEALATWEDVDYMKQVFPYAPAWGQVVTQEGENVTTADAQHEDTRRSMRTTRPNPRCVGKEWSK

SEQ ID NO: 56791 - protein, 127 aa, Sorghum bicolor
  Clone ID: 30948964.pep
LQACSLWEKVDVPVMLRKFDSGVKVIQTKTHSDEEVFARISSLAQKPDALQKGISPSDAAFTLGIAPALAKEHLLNAENKGLLCRDVSPDGFRFFINLFNEIDAQNIYSQKPHGLYNAWISVAMASH

SEQ ID NO: 56792 - protein, 203 aa, Sorghum bicolor
  Clone ID: 30949031.pep
TSQIIAIILIALVLGQDRISLSARREQVIQELKRLPQLIHEALQLEEQIKKLALELSNVKSLFLIGRGFQRATCLEAALKIKEIAYIHSEAILAGELKHGPLALIDEHATVIFFLAQDSVHSKAQNALHQITARKGRPVVVCSEVDEHLAKTGLPIIKVPHTVDCLQTIVNIVPMQLLAYHLAVLKGFNVDQPRNLAKSVTVE

SEQ ID NO: 56793 - protein, 209 aa, Sorghum bicolor
  Clone ID: 30949040.pep
MVTLLDNHDLERRIMSHARTKHTGVGSGLSMAIKVAKLCLGALFTIRGIPQLYYGTELGLEGWKTEQTDCDLRRDFPWEMIGQNNQPMNQYQKEREIYDWTKALITMRKNNAAFRYGTTITLWADALVYAFLRISTHDVALVIINNGYLPMPEPIGLRLNHDQIPQWVISHIRNGNLKHWQTGQVLTVNSNDMVHLTVNGKTIDIYCTN

SEQ ID NO: 56794 - protein, 199 aa, Sorghum bicolor
  Clone ID: 30949076.pep
MSRTSSHSSGVQPVEHHEERIMTKQITQDDIIYFIVTDRFFGVNKRHNNGYVSDKSMHGGTLDGVIDKLDYLRELGVTAIWVTPAYQNIQKFGDTEPYHYYWPLDFKQMDSRLLDGSHLSRSTDLSTFKDFVTQCEKRGFKIILDMIVNHCGYGAEKNFPPNWFNPPGNNSNIFTKWVGGLPDFDQDKPEVLHYHIDQM

SEQ ID NO: 56795 - protein, 104 aa, Sorghum bicolor
  Clone ID: 30949097.pep
IKRLGFSLVPEVSCWTMAGERQSARIRSLYLNAVLRQDIAFFDTELTTGQAVSRMSSDTLVIQDALGEKVLHMFFPLIAYCKHKCIRPTSIHAPLPSAVQACRM

SEQ ID NO: 56796 - protein, 174 aa, Sorghum bicolor
  Clone ID: 30949123.pep
KNYPQSMRKISRPILPTHHAHVRRRRPTSSLGCAGTHHRATICTWPPLLSASRVPTRIPPQSSVRAHNVDALSRTSSSRSRHQQAVVSTPLPNFSSPSCRDDRLKDSSSTVPMPGPYFVSFGSRACNPASILIQSASSSSLQWHSPPISESRGGPRRRWLDPMEDNRILIPYAM

SEQ ID NO: 56797 - protein, 208 aa, Sorghum bicolor
  Clone ID: 30949143.pep
HSGIPSTYIRMKKLFAWTGMKAAVTSFVRACLVCQQAKSDRARLPGLLQPLPVPTTAWHTISMDFIEGLPTSGNANCILVIVDSFTKYGHFLPLHHPYTASSVTKVFLSNIYCQHGLPSAIVSDRDRVFTSKFWQELFRLADVQLCMSTSYHPQSNGQTERLNQTLETFLRCFVHACPSKWSNWLPLAAYWYNTCTHSALGRSPFEAL

SEQ ID NO: 56798 - protein, 227 aa, Sorghum bicolor
  Clone ID: 30949151.pep
LSHFTSSTDVVSVIRAVWVSVHEPWHPENFYIGCSFFLFILGMRFIGRKNKKLFWVSAIAPVLSVALSTLMVYMTRADKHGVKIIQKVDAGINASSIKQINFNGSYVSECAKIALICAVIALTEAIAVGRSFSVINGYKLDGNKEMLAMGFMNVAGSMSSCYVATGSFSRTAVNFTAGCKTTMSNVVMAVTVMVALELLTKLLYYTPVSILASIILSALPGLINFQE

SEQ ID NO: 56799 - protein, 114 aa, Sorghum bicolor
  Clone ID: 30949153.pep
RRPAARCFPLARWSGISSRSSTSSPRRTRASRRSAPASSRSLPTASSSSTSRPAPRGASRSPPPSMPILPTAGTATTPSAPSSPPRPRLPRRSITASASRSPCRPRDRRSSPSS

SEQ ID NO: 56800 - protein, 83 aa, Sorghum bicolor
  Clone ID: 30949172.pep
IRRGLKHRTCGQPFQLKQNPRQFREKKHKQVPKRQTTSDNWSTDPRKECLDFRDSKETNKTSNHPSNSNQSRVPHPTSKGGVF

SEQ ID NO: 56801 - protein, 134 aa, Sorghum bicolor
  Clone ID: 30949183.pep
RRQSAARSRCPPPPADTLRAAPGASIPTAAARSGVRPPTSRTSIPPAGRRESASPSASWTSCTRSMAPFPNQQLRPRLCSTRPLLGAWRRGRWSETKPGRCRGEGRSGALPLAPSHSYPPLLDAGRVVQFGYGA

SEQ ID NO: 56802 - protein, 103 aa, Sorghum bicolor
  Clone ID: 30949202.pep
EQVRRRMLLWPAGTRSSNGTPGLGSPGSRLGVAPPPPGLGACEHGGKPGAAEQRAASGSALAAGCDLTPPAWRSSAGCDVTYRNTTRLYHCACCCGSSLVGRP

SEQ ID NO: 56803 - protein, 167 aa, Sorghum bicolor
  Clone ID: 30949211.pep
MGKAKGKGPKFAAVKKIITKKTINKYKEDVLNHKKKDADKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQHKCYIVATCDTDLKRRI

SEQ ID NO: 56804 - protein, 173 aa, Sorghum bicolor
  Clone ID: 30949240.pep
MCGIFAYLNYHAPQTMQVILQTLLTGLRRLEYRGYDSAGLAVTEPKTNKIMVLREVGNVDKLAALVQQTIDAQQLQSAVFSNHVGIAHTRWATHGEVAVRNSHPQSSTPEHEFVVIHNGIITNYAQIRTSLEKEGYSFQSETDTEVVAKLALYFYRHQLGKLNHVPEFRAVIS

SEQ ID NO: 56805 - protein, 128 aa, Sorghum bicolor
  Clone ID: 30949246.pep
LIDTPLLLLDIRCTLVRDRGSEGARRWMAWSLTALCRELWGGRQTASRPSTFDLAVPCRPELDPYATPPSVSSSWSAATSPTHSRWWWAGWVRTLDQPFSSCGQRTRLLSVGGGVQILPPESSFSAWN

SEQ ID NO: 56806 - protein, 179 aa, Sorghum bicolor
  Clone ID: 30949255.pep
MAEPGKETAATPPPLPQETVPHALAGAAVAEPNLKFDTPFSASQDTETAGGGAATLDSALPKAESAHRPPPPPQETVAMAAVGAPEQTTTEADAQQPVTTMPQKAAALPPPAETPAQESAAPAAPTPPPQKQESGVPERASSVHEEEKDVEKAREEKGEEKPARRRWRCLRAAVCLLFL

SEQ ID NO: 56807 - protein, 63 aa, Sorghum bicolor
  Clone ID: 30949259.pep
KLEMWFVVCFVASSLLSCTSLVHTVRQAFEYHEHFQCLDSLIILCNELWASSVLLYQLYVYSY

SEQ ID NO: 56808 - protein, 81 aa, Sorghum bicolor
  Clone ID: 30949261.pep
EEVGKTAVCCWGHGHAPRKAEIPPSRMDRQGQIWGRYLTEDAFQERMALMPAWRQRMEERVGRGRRGLPDYAPMDLVRPIL

SEQ ID NO: 56809 - protein, 61 aa, Sorghum bicolor
  Clone ID: 30949265.pep
MMNAKKIKLHDYHRYGSPLCDPQLFPATAAAGLPFHPAPGLVGSLPQPHGGGWVHEEHTTT

SEQ ID NO: 56810 - protein, 198 aa, Sorghum bicolor
  Clone ID: 30949286.pep
ELPRDEQTGLLHQVGKKTYIESNISARMDRLPWSRWHTLIAVSLGISWIMDGLIVSSLSLVGSKLLAPDTLALTPGEVGWSGTTYLIGAVLGALIFGYLADRYGRQKLFIVTPTIYLLASQGAAFSWDFWSFIACTFVIGLGIGGEYSAMNSAINEFIPAKIRGTVDLAINGSYWLGVGMGCGLSLIFLRDDLFEPKL

SEQ ID NO: 56811 - protein, 148 aa, Sorghum bicolor
  Clone ID: 30949291.pep
MAMPLIKGGPTSPTSLAGDLRAVAEILLRLPSPAALVRAALASRRWLQVASSPGFLRRYRSRHASSALLGLYVPRAHTGLPSFQLADSVRSDRALAKFVRGGDFGLTGLESHPEWRLLDCHNGRLLLSRGESRAVFDPASAREPVWLP

SEQ ID NO: 56812 - protein, 60 aa, Sorghum bicolor
  Clone ID: 30949301.pep
KTIAYLQCPLGASIDHSGFWNMERSGTFTSHWGCPGSGSSGRCSAPAHPRRRPRQLRSPP

SEQ ID NO: 56813 - protein, 94 aa, Sorghum bicolor
  unsure (1)..(94): unsure at all Xaa locations
  Clone ID: 30949310.pep
MAGGFGGGGAAAGRAEFYEGKITGYFILACIVGSFGGSLFGYDLGVSSGVTSMDDFLKKFFPDVYHRKQAHLHETDYCKYDNQXLTLFTSSLYF

SEQ ID NO: 56814 - protein, 121 aa, Sorghum bicolor
  Clone ID: 30949336.pep
NDAGSPAGARRTEARARGGRGSRRRSRRAWDCPSVAGRRRGEAADARKIQSLGPSLSASGGRRSAARTMRAGAEGEPRSGRPRKPKVLSFSPESGAGKEVRIRGCGGGEGREAHHDGDGGG

SEQ ID NO: 56815 - protein, 62 aa, Sorghum bicolor
  Clone ID: 30949368.pep
PASPTTVGKEMANFAARLSDIGKSFSEVKILGKFAGAVGNYNDDVVAYLEVDWLKVAEEFVR

SEQ ID NO: 56816 - protein, 179 aa, Sorghum bicolor
  Clone ID: 30949377.pep
SMTEPALKKRKLDPVEATYVFSPLKFSTLKEDLDDVPQSILKDALLSIVKNDAKLLVELNKAIPAAMANWKKESSEIEFIAEKPPQTDLRSSLGVQSALTAPLVTQYKIDEKLNVEELRSYIRGLFLVNPWVSDRDEHEERRRRRRRKNYDSDDDSDSDNDSSDSSSSSDSDDDDSDES

SEQ ID NO: 56817 - protein, 191 aa, Sorghum bicolor
  unsure (1)..(191): unsure at all Xaa locations
  Clone ID: 30949381.pep
RTVTPPPRPRHRIPLTTWDVSMLSADYIQKGLLYSRPPFRLLDHLEAALAQALVSYYPVAGRFATDQHRDADGNVVGCSVSIDCDGQGVDVIHAVADGVSIADVIPADADVPRLVRSFFPLDGAVNHDGHHLPLFVVQVTDLTDGVFLAFVYNHVLSDGTAFWHFLNAWAGIARGRSLSVSPPXPLLERWS

SEQ ID NO: 56818 - protein, 67 aa, Sorghum bicolor
  Clone ID: 30949400.pep
PSKHVITTDLPQEALMVQEFARLVQEIRDAGCKPEGKWPAITRKTQLVLDAVKASIDKGSEPVEVAS

SEQ ID NO: 56819 - protein, 82 aa, Sorghum bicolor
  Clone ID: 30949417.pep
QTLFISYLIIESLYCRFNNRFRQRMSKEKERSRHIARIFINKHQLNTTLSGDQRWILLPSDSRDHIRISYPFAITTVIHIQG

SEQ ID NO: 56820 - protein, 142 aa, Sorghum bicolor
  Clone ID: 30949423.pep
KDKGTGKDQSITIQGSGGLSQADIEKMVKQAEELREEDKKRREGIEIRNQADTTIYETEKSLNEHKAKLSEDVVSEIERDMQELRDAIAQNDSQKMKEGVEKVRNGAMKIGQAMYANANQNSGSSGSQEANQSESNQQQQSQ

SEQ ID NO: 56821 - protein, 61 aa, Sorghum bicolor
  Clone ID: 30949438.pep
ELFQEAILIVCRHIFLLIFPLGFYRSFSDISLNMAPHIFPKRFLEELSLCRISNIFPHWGF

SEQ ID NO: 56822 - protein, 156 aa, Sorghum bicolor
  Clone ID: 30949452.pep
DIHDDQLKSLLDEAVSQLKANTRRLVRRQRRRLHRLGKDFGWNLHHFDATEAFCCATGDSWQKKVVEPCVDVVKRFLSDDSTVLPSTSASDGVVGSVRGPSRELWTQYVCEACDNRVLRGAHEWEQHKQGRGHRKRVQRLKQKSLRPRPLLSQDCN

SEQ ID NO: 56823 - protein, 87 aa, Sorghum bicolor
  Clone ID: 30949458.pep
SLRNFPEEATDPDVLLPLAFSFKVSTRLEELHKEYQNPGAGTSETSSSKRLQPLIAKTMSRVGSRVVSNLTAVSNLTAVSNLTADRK

SEQ ID NO: 56824 - protein, 125 aa, Sorghum bicolor
  Clone ID: 30949488.pep
GLVYLWLKRALNGPDPVTLLMSSIAKVVTWPVRFAQNLLWSAHSQGRFTGRGRVGRRQSARDAPRRLWRCSTCTYDNSASTDICEMCNTAREDNAFSQRQDHQAGGNGELSVNEIRRRRLQRFDR

SEQ ID NO: 56825 - protein, 107 aa, Sorghum bicolor
  Clone ID: 30949527.pep
ENRRRAWEMHRVQSLERENYLQGQIEAGLVEIHRLNNLLHPIPRPIPVYPEVGPQVIVADDDGMEVDGPAAAAPPLHEDVEDEELEPVSDEDGEAIFDADSDDEPGV

SEQ ID NO: 56826 - protein, 150 aa, Sorghum bicolor
  Clone ID: 30949531.pep
KRTQTVKNQIAAGQFAASQGSWNDLLAFIDTKSGSVDVYNFLLDSGMDPVSADTPAAGSSSSSAAAASNVQALRYSTYLGSQDSAGSSNTISGIMNGVIKEKLKIVPKDLKWVEVSNAVYYALVNDFMKPRIDEASNLARRLYMNKKLKR

SEQ ID NO: 56827 - protein, 75 aa, Sorghum bicolor
  Clone ID: 30949533.pep
VPRLSVLVCPLEEWSPSLFLFFPLFAPSHGLHHSFVGIIVQLQYTPPGVSEIQSSASQKIKRKLRATSVRPRVLQ

SEQ ID NO: 56828 - protein, 238 aa, Sorghum bicolor
  Clone ID: 30949549.pep
MPIIHESNTDHTMTAKGKDKSITSNNSSSSSPSSEMGSTPAVRRKKVKDVSEYMISAAKENPQIAEKIHAVLLESGVVPPPDLFSEESKEQPKDLIVYDTSMFQTKDEMIRTMNELESTAQDGCAGLGPSLPHHPGQELQTKIVPYRPPPDLKPVQGLGVYHQIDFRDNVNPSIPLYEPSAPQENPLQLIKQMPVTAAAVATAAVVSSSMVVAAAKSNGDIKLDVPVAAAATAAAVVA

SEQ ID NO: 56829 - protein, 64 aa, Sorghum bicolor
  Clone ID: 30949556.pep
QPFCQVFDLSVVKPSDFVHYGLSCLEKLADQGDNHAKAVRERMRIVVAGGDGTVGWVLGCLSDL

SEQ ID NO: 56830 - protein, 190 aa, Sorghum bicolor
  unsure (1)..(190): unsure at all Xaa locations
  Clone ID: 30949560.pep
MQSPVSRDEGTFRSGTLLCSLKPEQLTPDNILVPIDLVGGRERHDSQRTGSDLVSVLSLLQALQGGRDASGASTTEFIAQFLTIWHMISTVHLQPSVQDQLLWRWTANGHYSSALAYRAFFIGRMPLCGAKDVWAASTPPKAKFFFWLALHGRLWTAXRRRRHGLQAIDDCALCDQQPETTDHLLVACVF

SEQ ID NO: 56831 - protein, 180 aa, Sorghum bicolor
  Clone ID: 30949578.pep
VESEEFQGGVPACRESSSRSTSAEAGLLMDAPASPRPSDTFLHEFGTPTLLWRVLQTIGYTEPPQYSWWEMESTGGIQWFAVQGVVPPHGGKPAWTGWTCSSDGQTPWEAAQVAAQTILLDICQRCGDELTGGPAASIPSADPAAAEWKQADGCALVRGRGERAESSSPAMSAMMAVLKL

SEQ ID NO: 56832 - protein, 187 aa, Sorghum bicolor
  Clone ID: 30949579.pep
MSSPSPLCAASCSTALRAPPPLLRFRRSSAPVSASVARAAPAVSDDLVLRIAEQLEDSVTSTSQLLDPLRSASALSLLSTPWPTRRSSEAFRFTDISYLRSLPISLPSREPDLALPSSPFSSHVLFSDGILLSSSGAHVSTLADLPPGRTRDRAAAALAASAEFAHKDLFYDFNAVGARDVVVVHVP

SEQ ID NO: 56833 - protein, 179 aa, Sorghum bicolor
  Clone ID: 30949581.pep
MDRSYCALVLLCLCLGTLRSGSAASVTTGTPDGSELWGYVEVRPKAHLFWWYYKSPQRTSTPGKPWPTILWLQGGPGASGVGLGNFMEVGPLDVDLKPRNSTWLQKADLIFVDNPVGVGYSYVEDDSLLVTTDWQQAEDMTTVVRALVKEVPTLQSSPLFLVAESYGGKYAATLGVSVA

SEQ ID NO: 56834 - protein, 119 aa, Sorghum bicolor
  Clone ID: 30949582.pep
LKSMAPRQRSRSLPRRRQCPSSPHCTCHDQINNCNDDSFLIFGPDVALLACACAALADHCKNVQSSHLSIHRLTNQNAPWIGFTCAQLDPDYGRSPLSLSSENEEARRAASHFLHSLSD

SEQ ID NO: 56835 - protein, 146 aa, Sorghum bicolor
  Clone ID: 30949603.pep
DPTRRPSPRRPDAASLSPDASTPPPAAATLSPDGPAPPRPDAPAPPRPDAPAPPCPDALAPPANPSARNKFGRRRRTRWSTPSSPASSPSRSPPTADISMDGSASSGGFSGAGLPPRPTVSTMRRRPFVAPHSRAATSSSLDANLP

SEQ ID NO: 56836 - protein, 70 aa, Sorghum bicolor
  Clone ID: 30949616.pep
TKHILPQVSSMSLDSSGQITKEELYYIGRTLVCRCSSKHICHPQSRYISWPTLPTVDSAPASLSFIHSPS

SEQ ID NO: 56837 - protein, 203 aa, Sorghum bicolor
  Clone ID: 30949624.pep
MLKVLSSKSLSKTIAAQSSRFFSSTGGAPKNVIGIDLGTTNSCVSIMEGSQPKVIENSEGLRTTPSVVAFTNDGQKLVGTPAKRQAVTNPENTLYATKRLIGRRFDDPDVQKDMKHLSYKVVRDKNGDAAVEARGQTYSPAQIGSFVLNKMKETAEAYLGKGVKQAVVTVPAYFNDQQRQATKDAGKIAGLDVLRIINEPTAA

SEQ ID NO: 56838 - protein, 185 aa, Sorghum bicolor
  unsure (1)..(185): unsure at all Xaa locations
  Clone ID: 30949632.pep
TDAEMLRTYAIGLLAMALCSGGQLVEDVLTLGVSAKLMRFLRIRVLGDSSSSQRDANHPQDTKYPRGRDDSRGKSRLAQDGSRLDGTRVGYGVLLTNPTAEKDNEPGVGMRQAYGERSLDDTVASLDNSDVPEADWTNDRCYGTSVCDTKSKYGKKNSVTRLLKDEEISEXGEVLKRKLGRAPSR

SEQ ID NO: 56839 - protein, 240 aa, Sorghum bicolor
  Clone ID: 30949645.pep
CSSKRPRIPRTRSSKSVNPSQPHVARHPNSDPQPGSTVHPNSDPGTSEHPDSIVLGNVESNNGVKEISINYIDSGESYDRKTTVVDMYFSAAIAEIFLNDPDPKTMAECKKRSDWAQWKEAIQAEIASLTKRGVFTKAMPTPSKVFPVGFKWVFVRKRNENNEVVRYKARLVAQGFTQRPGIDYNETYSPVMSGITFRYLISLAVQNHLSMQLMDVVTAYLYGSLDSDIYMKVPDGIQIP

SEQ ID NO: 56840 - protein, 208 aa, Sorghum bicolor
  Clone ID: 30949658.pep
MADPSAAAAAANPSPGAGEEGAACSPPSPSQRGRGKVVIVMGATGAGKSRLAVDLATHFAGVEVVSADSMQLYRGLDVLTNKVPLHEQNGVPHHLLSVIDPSVEFTCHDFRDHAVPIIQEILDRGGLPVIVGGTNFYIQSLVSPFLFDDMAEEMHDCTLREHIDDDRGLTNDDEGSGYERLKDIDPVAAQRIHPNDHRKIKRYLELYA

SEQ ID NO: 56841 - protein, 168 aa, Sorghum bicolor
  Clone ID: 30949671.pep
LFAQPRVGTRIDISILDFRNSQHASDPDRDRALAQPPPPPPPPPHPHFTRLARSRGAMSPESKQLLDEMNRLFTDQKAQFDARIAESERKLDARLSDSDIMLERRFGAIDTRFTEFDASITQRLLESDLDLERRVTDSELRQINRFTEFEQRQDSRFIALENSAGVFE

SEQ ID NO: 56842 - protein, 72 aa, Sorghum bicolor
  Clone ID: 30949702.pep
FIYHGISLCCCFSTCTPVQFDVYVRSGAVLLISYIVERIELQGSLLLLWKAILLLGNNCGQCISAYMFVKSL

SEQ ID NO: 56843 - protein, 175 aa, Sorghum bicolor
  Clone ID: 30949707.pep
MGSGMSRGRRRSFGAGASGGMLPLLALQVLIEYGRAGASRPPVTAALLAANALIYLRPGALDGILPSLTRVSFNPWLIIEYGDLVRFFLSPFYHLSESHLFYNMTSLLWKGIQLETSMGSVEFASMVAALLGLSQGITLLLSKGLLLLGDYTAYYNQYAVGFSGVLFAMKVVLNA

SEQ ID NO: 56844 - protein, 118 aa, Sorghum bicolor
  Clone ID: 30949719.pep
SFNSVMNKKKGNARTKPLPPSKRLRLEAQRVLKERVQDIADKKGIKLRFCNLKECESHIQSLDSPCENTRTEIGWPQGVPFVHPHDLPNKAKLGFLEAYEPGWTASQHEMELSFTESS

SEQ ID NO: 56845 - protein, 121 aa, Sorghum bicolor
  Clone ID: 30949737.pep
HGSINGALMGAKTFFLANANASLTTTTSSLVTTNASLTRSSSGSLIGRRSTRGERRRQLASVVGGRLRARPDEPQVVEELLGAGPDHVPERAPAAAAAHRRLGPGTGAGPGPGGGVVLLPD

SEQ ID NO: 56846 - protein, 96 aa, Sorghum bicolor
  Clone ID: 30949747.pep
ELWHSRLGHPAPAIVTTFNKLSAIQCNKAARHTCHACQLGKHVRLPFASSVSSTSAPFELVHCDVWTSPVLSISGFKFYLVMVDDYTHYCWMFPLR

SEQ ID NO: 56847 - protein, 124 aa, Sorghum bicolor
  Clone ID: 30949803.pep
PISSGCEHGNTTELQELLRPILEARGVDMYVNGHDHCLQHISSRNSPVQFMTSGGGSKAWAGKFKTTSDKIEFIYDGQGFMSMQLSNTEAHLVFYDVAGNVLHTYDSTKSDEEEEEEEEEEDVD

SEQ ID NO: 56848 - protein, 75 aa, Sorghum bicolor
  Clone ID: 30949809.pep
HCNPLNGSRQNEDHELVPNSGKESPDSQSGGIIGQGGASLATSGAVSPVASSLPTVEELSAEDSGEKASSDHPAN

SEQ ID NO: 56849 - protein, 69 aa, Sorghum bicolor
  Clone ID: 30949825.pep
KLHGFRHCTCGYPSHGHGHVKRPPALAAGLHAATLANTTLGSHRSHAHEMAECPLPHAPLHLLGGSSMG

SEQ ID NO: 56850 - protein, 175 aa, Sorghum bicolor
  Clone ID: 30949877.pep
CVKVLRGRVGAGTAICVRTETCLDKDSPVPAGLQRHTDAPRVQLETRVYIHWGCAIQRSYQLFSIVLAEMDRPEESIPDSMGLAATPRREGGEEEEEKRKRMAAPVVAWSRQPSLPQPCPPWWAAAPGLPRPSATSAAGWGEGCAGAAVPPVLGRRRRRVSCAVASSGSDGRGRE

SEQ ID NO: 56851 - protein, 193 aa, Sorghum bicolor
  Clone ID: 30949908.pep
MRAKLAVLATGAPPPPRPPRLHPSRHQRHIPRRRSFKPPHSLLDGGQPSPPPPVPASSSRRRAWPAVSAALFGAGFLLGPLLDGIHSRVDLQVYGNGALDAGPLHTHVLVPPLLGAFYLTVGLLHLFLDQRAPAPPRSKATGTARKTATSLLVLALFIELSAELYRAGLPSNVEAYILFAAAEFVWVFLDASW

SEQ ID NO: 56852 - protein, 119 aa, Sorghum bicolor
  Clone ID: 30949916.pep
MMACGSRTRSRTNNEIVDEYQKLVLRMNPPRVTVDNDSDMTATLVKVDSVNKYGTLLEVVQVLTDLKLTINRAYISSDGEWFMDVFHVEDHDGNKLYDGQVIDRIEQSLGAGSLSFRGP

SEQ ID NO: 56853 - protein, 56 aa, Sorghum bicolor
  Clone ID: 30949928.pep
KQTFLSHADRQTTIMFHFQPLKRSAQVSIKSVPWRAMKMQLYYCRMQMLLFVLCGC

SEQ ID NO: 56854 - protein, 210 aa, Sorghum bicolor
  Clone ID: 30949946.pep
MMEVEWPPPLELKEEQQPHLLLLMEAEAEEEDTSSALLHTRDREKKKKMTTTMDLDPSHSSFSSSSDSDSDAAAAAAATENEEDAAPHHQSIFLDPTQVSDHAENQVTEVGGHKENANGTSGEQGKEIDKQDNVSAQETNHSSNNGKLENGSHSNGVHEISSSSETVTIADGLKLITTIRDARHILPNWSGSVDVSTATASTSEVHEIEV

SEQ ID NO: 56855 - protein, 222 aa, Sorghum bicolor
  Clone ID: 30949956.pep
QSRQMGKAHSLQATKGSPSGLRPTSSPQIWHTWPFRWSIGFGPGSPSRRMTTSSFRLCEPATSPALASIPLALPDLQISGRAAGACGGGGGGCLGEGNGTGVKRRGRACASLLCSGWGGFFLCCVARGALRCPCPLPFPCGAFGSSFSVDWWVGVGLAGWRLGGEDGRRREAEGASNKMRRARRYCYCLPSHAQLIGTTTVSPSLTCARPPLSLSLPSGLFG

SEQ ID NO: 56856 - protein, 69 aa, Sorghum bicolor
  Clone ID: 30949991.pep
MVPAAPRLLAGIVAAAAALLLLLVAPTAAELTRVEHPPKTEGSLAILAVGDWGRKGQFNQTLVAQQMGV

SEQ ID NO: 56857 - protein, 149 aa, Sorghum bicolor
  Clone ID: 30950015.pep
TWEDLGRMRYTWAAALETLRMVPPVFTMMRKTVDDVEYGGYLIPKGWQVIHAANMTQWDPAIFPEPGRFDPARFENASAVPPFAFVPFGGGARVCPGNEFARVETLVAMHHIVTRFRWKLAAGCDRSFSRFPLPYPSQGLLIDIEPIQK

SEQ ID NO: 56858 - protein, 127 aa, Sorghum bicolor
  Clone ID: 30950035.pep
SELTGSWKVYEVSATPIFSDERQELEGGSPFVYLCMETVKKRTLPESSVLFGEEEMLDMQDVPVLWLPGGVTAYVDISEDGILCIGVGWYSEEGINLVMERDYGTDGRLREVRSKTEVKRRWYQSVP

SEQ ID NO: 56859 - protein, 98 aa, Sorghum bicolor
  unsure (1)..(98): unsure at all Xaa locations
  Clone ID: 30950037.pep
REVVEGLRQATRHTEMDGXVVVVGAAAAAECQRSPPRAEEEEAPGAEDASAVAVAVAAEARKRRMLHLAALGGAAADAHARRRLMLMRAATTAAAAPT

SEQ ID NO: 56860 - protein, 69 aa, Sorghum bicolor
  Clone ID: 30950039.pep
RTWNTNSQRRMKPQYLNTCLSLHNGILSILPSLIKLFILLFNGVKTEQNRMTNSPGTHRFPNNKNLVKH

SEQ ID NO: 56861 - protein, 130 aa, Sorghum bicolor
  Clone ID: 30950045.pep
PDGYMEIRDRSKDVIISGGENISSVEVESVLYSHPAVNEAAVVARPDGFWGETPCAFVGLKEGASAGAVTAADVIAWCRQRMPHYMVPRTVVFRDELPKTSTGKIQKYVLRNLAKEMGSTRKGGSSISKM

SEQ ID NO: 56862 - protein, 90 aa, Sorghum bicolor
  Clone ID: 30950047.pep
DAYRMGDKLKFANHAPDPNCYAKVIMVAGDHRVGIFAKERILAGEELFYDYRYEPDRAPAWARKPEASGAKDDGQPSNGRAKKLAQNTRG

SEQ ID NO: 56863 - protein, 95 aa, Sorghum bicolor
  Clone ID: 30950100.pep
KKSSRKDRNNTPHLSSHSAQSTAVQFSFLTPSRGMLLLSPSPPAFLWVGPTAQMLGLSFTMLGMGMTLTLDDLKTALLMPRELAAGFILQYTVMP

SEQ ID NO: 56864 - protein, 157 aa, Sorghum bicolor
  Clone ID: 30950108.pep
EYGKFLWEGVAGANRTQRDYFLRLVLDSIYDSAARGGPLVGGAFWQLLDGGMDTLRDGYEIILPEDRLAATIIGNHSRQLAQLSLVTFTGEDVDIEAAALRRRSRRSPHSNRKIRVRSVGGPSDSDSYYTQTQRLLHILLVRFMSLFTSIFSLFSSV

SEQ ID NO: 56865 - protein, 88 aa, Sorghum bicolor
  Clone ID: 30950112.pep
KGNHSGSKFERKRRALLPPARRAMLPPRRRHILGFMGTRCWSPSCGREVGTESYQGPMTYLKEKGLDQAYMTIQTIYLILFWSNCNTA

SEQ ID NO: 56866 - protein, 141 aa, Sorghum bicolor
  Clone ID: 30950126.pep
NPWLGAAVAGPELDGFFVAWAVLDAVVSVLFTVVPWVVVMDRDPRPPGRNAVKEGCYLVSLMATDATLLKCWETVMCGSMGRLIMVTFCGKVFGGFLHSTAQVYFMVVWLLFYFAARCKEVRLGGRQFGLEDVAAALDGFR

SEQ ID NO: 56867 - protein, 84 aa, Sorghum bicolor
  Clone ID: 30950146.pep
TVRGLMYPQRQREGRKSLKGHVEMTVGFDLPPVLALVPESIIRGVGETVLRKMAEQMKQDMDTGLAADFKKYSREKLTERRTSP

SEQ ID NO: 56868 - protein, 182 aa, Sorghum bicolor
  Clone ID: 30950160.pep
MAKAKPRPAAAILLLLISFLAAAASAAAGGGSDAETTGGGGGMVGVDGTRFVVDDGRPIYFSGFNAYWLMLVASDPARRGKVVAAFRQAADHGLNLARTWAFSDGGDTPLQAAPGVYDEAMFQGLDFVVAEARRHGIYLLLCLTNNFHDFGGKRQYVQWARDAGHRLATDDDFFNSTVVKDY

SEQ ID NO: 56869 - protein, 74 aa, Sorghum bicolor
  Clone ID: 30950168.pep
WFLYIVFMYFDFLFLCFLSQPYNQEIIWNCIYIVGAYFIYYLEHGFEFITFCVVFFSRNYSHKISITFLLVTFY

SEQ ID NO: 56870 - protein, 113 aa, Sorghum bicolor
  Clone ID: 30950182.pep
FPFPFGRPSPPLPLSNRIRPSPFHPVPVPVPIPPDPHPPPILTPLAPHHHPHSIPPRTNGGQNPNPRGGRGRGRGHRGSIPNPSRRGARLGQAVQAPPALLVARAHARRVPRL

SEQ ID NO: 56871 - protein, 58 aa, Sorghum bicolor
  Clone ID: 30950184.pep
TRLEASKGKFMQYFRNTTNKCTITSAFYYDRLINETPTFGCIPTCRCKWTRQTVECLD

SEQ ID NO: 56872 - protein, 169 aa, Sorghum bicolor
  Clone ID: 30950192.pep
VWHAITGYWGGVRPGVAGMEHYESKMQQPVSSPGVQKNEPCDALDSITTNGMGLVNPEKVFSFYNELHSYLASAGIDGVKVDVQNILETLGAGHGGRVLLARKYQQALEASVARNFPDNGIISCMSHNTDNLYSSKRSAVIRASDDFWPRDPASHTIHIASVAYDTVFL

SEQ ID NO: 56873 - protein, 105 aa, Sorghum bicolor
  Clone ID: 30950196.pep
GTTHDLLIILNDVLFMPSYILIDDYFLRFVVFGLGVICDLLQVFILQKKPLYLSTEYGYYFYWFHFIYYTFCSGSIMEIYCLVFQEFFPLQTKTMMSVFAMVVGI

SEQ ID NO: 56874 - protein, 111 aa, Sorghum bicolor
  Clone ID: 30950198.pep
MGVDSDDEDLVVYGTPIEREEDTSARKRRAVAEAGQLRALPAWKQEVRDEEGRRRFHGAFTGGFSAGFYNTVGSKEGWTPQTFTSSRKNRAELTKQSIYNFLDEEDIKDMG

SEQ ID NO: 56875 - protein, 193 aa, Sorghum bicolor
  Clone ID: 30950200.pep
MYRGAGSGGSTPLRSAADQRPSSDSRRSRKGLALSSPSSLTTTCALKTPSSYGGSREKVNNPRDLFTFSYKFSTDIPMSETQGASIDEYLQNSPRIVGAVFPDQRKRRKINDEEWSVQLLPIQFLFLSASPVIVMRFVSKSGGKEYPPNVPVHATSLLLMEVTDYKLNGLDSNAMPSHLALTVRGLMYPQRQR

SEQ ID NO: 56876 - protein, 169 aa, Sorghum bicolor
  Clone ID: 30950227.pep
MDAAPATLVAAVAVVLAVVASVPVLLRLLSASACGKKTNPKAPLPPGSFGLPFIGQTLSLVRALRANTADDWLRRCVATYGPVSRLRLFGCPTAFLVGTSANKFIFASAAVTAKAPESFARMVGRRTIRDVDGDEHRRVRAMMVQFLRVDAVKRHVASMDGEVRRHLDA

SEQ ID NO: 56877 - protein, 155 aa, Sorghum bicolor
  Clone ID: 30950233.pep
QLLRDSQIGHKSKITIQSVGLKRGKLLEMQMGIPLRKMTAYGRGCQDLAVLCSCLVISIQHQQSIWGTRIGSGLAILVAPVAKYAATSAGTHASAWGGAWVDQYGELEGLARGERCAGVGTVPVIWATEGRRHTGPKVGAGRRTWGGHGSWLLIR

SEQ ID NO: 56878 - protein, 158 aa, Sorghum bicolor
  Clone ID: 30950252.pep
MALSPTSPIPVSTLAERHRAGRPSKQSMPPSCLGACSGGGLALSAPRRRAPSYCSIAPHRASVSCSAAGGKASPRGKDNVWSVDNDRAAKEAVRSPKHRRRRRPSGRRLPPPKRKGKDAESRVLVSGAMLVEVETVLQTQEPVIKPSWDTFASSLSGN

SEQ ID NO: 56879 - protein, 184 aa, Sorghum bicolor
  Clone ID: 30950254.pep
RSKSCKRRPEATAPAPAPAALSSTEARSFASAAAAASCASFASSSANVSEASGARPAASGSSGSGSAASSARSIPELYEERGALWEFGLRELRVATRDFSPLLMVGEGGFGCVYRGVLRLPGGGPGGTPVAVKRLNLNGRQGHKEWLAEVHFLGVVEHRNLVKLIGYCASETDRGPQRLLVYEF

SEQ ID NO: 56880 - protein, 135 aa, Sorghum bicolor
  Clone ID: 30950256.pep
MDPAPQTHPILSYVLSRIPTLAKPNKAPTTSEFDIEQPPPVHTPSPRTAPSSPSAGEFELVERMPGLRHPSVLRAMTRAVADVSAARAALQVLGPRPDHELVVSSRAIVAAAEAGDARIPEGDAEACRAVGRLEQ

SEQ ID NO: 56881 - protein, 98 aa, Sorghum bicolor
  Clone ID: 30950263.pep
MDRLGSNPANSCPLTPLGFLERAATVFGDCSSVVYHDTVFTWSQTHRRCLRLASALVSLGITRGDIVSVLLPNVPAMYEMQFGVPMSGAVLNNINTRL

SEQ ID NO: 56882 - protein, 172 aa, Sorghum bicolor
  Clone ID: 30950265.pep
MEAAAAAPPAVASSASASASAGRSRPSTSAAQDTTITAVQAGEENAASPYVLSVIDSLKKRITADRLTYIKNRIGENKINLSSYTQRTYNLSKNRQINTSKGTDLASNLLTKRQDDALCTLHSYDITPVDKDGGNFQDENPFSSSNVIFGGNLGPKNAIRPIKLPEVPKLPP

SEQ ID NO: 56883 - protein, 188 aa, Sorghum bicolor
  unsure (1)..(188): unsure at all Xaa locations
  Clone ID: 30950282.pep
GLPVQNALKNNRLFILDHHDSFMPYLNKINKLEGNFIYASRTLLFLKDDGTLKPLAIELSLPHPDGLQHGAVSKVYTPAHTGVEGHIWQLAKAYACVNDSAWHQLISHWLNTHAVIEPFAIATNRQLSVVHPVHKLLSPHYRDTLNINALARQTLINAGGIFERTVFPVPXVYKSWNFNEQALPADLV

SEQ ID NO: 56884 - protein, 192 aa, Sorghum bicolor
  unsure (1)..(192): unsure at all Xaa locations
  Clone ID: 30950299.pep
ILTRLKQKQEEWSRCRSDFNKVWAEIYAKNYHKSLDHRSFYFKQQDTKNLSTKSLLTEIKEINEKKRKEDDVLLAIAAGNRRPIVPNMSFEYVDSEIHEDLHKIIKYSCGEVCNSSDQLDKVMRIWTTFLEPILGVQRKHGSEDPDLVKPKSRTTKLGLANAGESNTGAGIVSXQNNGDESEQGLSSRARLA

SEQ ID NO: 56885 - protein, 218 aa, Sorghum bicolor
  Clone ID: 30950315.pep
ERLRVVSIVGFGGLGKTTLANEVYRDLRDNLSGNPEKSFSCKAIISVSQRPDMVNLLKSLFTKVSGQTADHTYDLPGLIDIVREYLQGKRYLLVIDDLWDPSAWEIIKCAFPESHCGSRVLTTTRIVSVAVACCNYQWKFVYRMKPLDDYHSRQLFLRRIFGSGDRCPEPFEVLCEKILQKCGGLPLAIITIASLLASQQTRSIEQWEYVLNSIRHNL

SEQ ID NO: 56886 - protein, 56 aa, Sorghum bicolor
  Clone ID: 30950327.pep
ALLFYYIKLLKSMCDKQAAMVYISIAIMYSIHQLHYPSPTKPSSRDLQKRNEPLAA

SEQ ID NO: 56887 - protein, 80 aa, Sorghum bicolor
  Clone ID: 30950363.pep
GDWGQGKPLKCPDLNLDLCISPPAAPCQEEKAMVTMKPVKREAGLCFSCSLGLPKSADCKCSNFLGLRTAMLDFRSLEMK

SEQ ID NO: 56888 - protein, 48 aa, Sorghum bicolor
  Clone ID: 30950374.pep
AKFFVLNSKVLQKMSFGLANRRQDKWMVNQRRRLQLDNKASRGAQFAL

SEQ ID NO: 56889 - protein, 178 aa, Sorghum bicolor
  Clone ID: 30950416.pep
YEWGFIVCGMIMAIVWIYLIAAELVGIITAAGLILGISNAIMGLTIIAWGNSVGDSVSNIIVSRKGHPQMAIAACTAAPLTNLLLGQGISNLLLALKKGGVILLVNTAGEKVLTNNMFLAFLFLMITLLLNITLIPLFKFQFKKQFGVLLVVNYIAFTILSFLTEFGYLFDREIWFEH

SEQ ID NO: 56890 - protein, 112 aa, Sorghum bicolor
  Clone ID: 30950422.pep
VFALFNEDQKPGPASERHYGLFKPDGTPAYDVGVKAPTITLPKGNGSSGSGNNGTGGLVVAQGPGGADGAGPGTGYYTVSAAAMNKVKSRRRRCMESLVAAAAVLAMVSGLC

SEQ ID NO: 56891 - protein, 80 aa, Sorghum bicolor
  Clone ID: 30950429.pep
RHMWNSFVRKQRVLADGHIPWACEAFSRCHGHQLVQNPALLWGWRFFMIKLWNHSLLDARAMNTCNTILQGYQDGSSDPE

SEQ ID NO: 56892 - protein, 74 aa, Sorghum bicolor
  Clone ID: 30950434.pep
KPSQERVYGNRTVRFMLSRMEKQAQRPWPKDRIWVFKSDPRFFGSPMMDAVLNNSPLDKEMVHWLKTRPNVFLG

SEQ ID NO: 56893 - protein, 94 aa, Sorghum bicolor
  Clone ID: 30950440.pep
FNYFHFRFLKKSINVFRLASLYTTVVGNGSAGVGRCLWWPTIPYPTIPETAVANAPLTMSVHIIMLCCCGKNCSSCCTYISGKRPHKCKNVSLC

SEQ ID NO: 56894 - protein, 90 aa, Sorghum bicolor
  Clone ID: 30950471.pep
SMMDHHVVLTGIRAPTDSIPYGDHILGGGNSTSVPGDMQQLIDFPFYGDQDKFVGSSFEGLPLDYISISSPIPDIDDLLHDEDLMEYLGT

SEQ ID NO: 56895 - protein, 66 aa, Sorghum bicolor
  Clone ID: 30950494.pep
SMTTESEMQANCIKDSHVGCKVTYSLVASCLCWEGFVVHLSAFQHLCSHLRWWDVSCNADNYQTIM

SEQ ID NO: 56896 - protein, 212 aa, Sorghum bicolor
  unsure (1)..(212): unsure at all Xaa locations
  Clone ID: 30950524.pep
MAARNLLRRAAYAAACGHRFPVPVPSGALAGPGSRSIGAAAQGLRHYAAPSSVEDAVENLEMHAPKANRRSNIPKKNGTAMMLPLHFHYEDVLRQDLLLKQNHANIMQVPGLFEIKLAPKAGSDLKIPIGKMAMEVSSGQRFKEAKSDPFAKARKSSRTNPFIGADKDSSTAFAQPTVLRGHAMYNFLVRMLTVMSMLDSRAEIRXNTIKFF

SEQ ID NO: 56897 - protein, 84 aa, Sorghum bicolor
  Clone ID: 30950533.pep
MDQLAMLATELGDSSDFEVEGIQNLTENDVSDEEIEPEDLARRMWKDRVRLRRIKERQQKLALQQAELEKLRPKPISDQAMRKK

SEQ ID NO: 56898 - protein, 194 aa, Sorghum bicolor
  Clone ID: 30950543.pep
WIGRRRNVVSWNSLISGYGMHGFGSESIQVFEEMIQEGISPSIITFISVLGACSHAGLVEQGKKLFESMVEYNVTPRAEHYACMVDLLGRAGRLDEAVELIQSMRIQPSPQVWGSLLGACRIHGHVEYAEMACSHLFDLEPRNAGNYVLLADIYARAKLQNQVDVLKELLEEHALEKVPGCSWIEVKKKLYSFA

SEQ ID NO: 56899 - protein, 144 aa, Sorghum bicolor
  Clone ID: 30950545.pep
MGEYAAVKASVWWDIENCHVPRYCDPHLIAQNMSSALAAAGYTGPITISAYGDTNCVPNHVQHALSSTGIALNHVPAGIKDASDKKILVDMLIWAIDNPPPANYLLISDDRDFSNALHKLVMRRYNILLAQPPNVSQALTAAAK

SEQ ID NO: 56900 - protein, 143 aa, Sorghum bicolor
  Clone ID: 30950589.pep
CKLNLCHQRYKRQESPPQRKTRQELRLHWQLFQSMSRQKTYEPSLQMIVRRGFACINSSKISPSLWPYDFRFQKAWRPALSEPVAATPLHGREGRGPAAAPTDDSTVVFSCGREGQERGEGETRWPVDTAAAGEAGRWAIGFC

SEQ ID NO: 56901 - protein, 231 aa, Sorghum bicolor
  Clone ID: 30950597.pep
RPPFAVGLGIGKGEDVVVVHPDLISCLPDEILHDIITLLPTRDGARTQAISRRWRPLWCAAPLNLQVDHRGLCGQDRKRVTLVAKILADHPGPARRLAIPWFRLRDRYAKVDGWLRSPALAGLQEIQISYAPDGGPRSLPPSALRFALTLRTAEFCCCDFPAADEEMAAPPSLHLNFPQLKNLTLRSASVSEATLHRLLSGCPALESLRLETNVGVGSLRVSSATLKSISI

SEQ ID NO: 56902 - protein, 204 aa, Sorghum bicolor
  Clone ID: 30950637.pep
MCSETEGFVNYLELHYCTFQDKAWLSLSILLILMLVYFYMLGSTAERFFCPALARVSEGLNLSPNVAGVTLLALGNGSPDIFAQVAAANNGVFSTAMGTMLGSSLFVCTVVVGLITLVSKSAVTVTRRPFIRDVLFFMISVVFLFLVCWDNKIYVWESASLIGLYISYVLVVVIARIIYQRSKQRKIEKRENTEASLLDNDSLR

SEQ ID NO: 56903 - protein, 174 aa, Sorghum bicolor
  Clone ID: 30950641.pep
MALHLMLAAAAAFAVLAPPAASSGPTPAPPALGINYGQVADNLPPPQAALLLLRALNATRVKLYDADARVLRAFAGSGVDFTVGVPDRLVPRMATDPSAAASWVRSNLLPHLPATSITAVTVGNEVLSGTNAAMLRSLLPAMESLHAALAACNLTSRVSVTTAHSLAVLSSSFP

SEQ ID NO: 56904 - protein, 132 aa, Sorghum bicolor
  Clone ID: 30950649.pep
KFGELFRPTPASSAETVTARRRGHSWTSPFIISIGRPRYPSGQRRQASCLLSASHLPAQPTSPGPTRGCRPRAATRCAHAPAVRGLAPRARARGPAWVRASPPSGRTAGQGPTPEASVPLHKPLDESSSGQP

SEQ ID NO: 56905 - protein, 202 aa, Sorghum bicolor
  Clone ID: 30950653.pep
MKTLKQIGDGNNYTSKVARNFTSQLDGSDELDGYFADISNRENANLSFGQGFYKRSKLLDARKSSAVLSRDAEMRRLMQRQAENSYRKMEEFVINRLREIMRSNRFDFFIPKVAKIEGRLKNGYYARHGFRTIKHDIRTMCQDALRYKDGNDSGDIKQIVVSFIQLARLGNPRHISERNGAAAHDSLDISQYSFDTKLKKKQ

SEQ ID NO: 56906 - protein, 89 aa, Sorghum bicolor
  Clone ID: 30950691.pep
SCIFCKAFSRSSRSRRRARARERRGSGRRNGNQANLENFNLEVPTQSVELREIRFDEIDDEYIVTGAIPSIAAPGRMASFHYRDTRYGR

SEQ ID NO: 56907 - protein, 173 aa, Sorghum bicolor
  Clone ID: 30950695.pep
RKDEGKIRAKLGKILKGKEGVRFEDSIATGDGIKISTEGMRSSKFCLHPAGDTPSSCRLFDAIVSHCVPVIVSSRIELPFEDEIDYSEFSLFFSVEEALRPDYLLNQLRQIPKKKWVDMWSKLKNVSHHYEFQYPPRKGDAVNMIWRQVRHKIPAVNLAIHRNRRLKIPDWWG

SEQ ID NO: 56908 - protein, 107 aa, Sorghum bicolor
  Clone ID: 30950735.pep
SHSTLCQEDSLIWLGAQSADCASPNATMSQHLQLPWCLPLLLLVLQLLYLQLPLLLLPLLVLLLLLPPPPPPPPPPLLQLVVVIGRELKLLASSVAPWQPSSAYCHS

SEQ ID NO: 56909 - protein, 157 aa, Sorghum bicolor
  Clone ID: 30950752.pep
EDDDSGYQSDKEIVWEDDNYIKPVRDVRTQDWDASVFTDFGPMIVLVHNRYKRPRENEMARAELTKAIEMFWEHNLPSPRCVAVDACAEPDLVDALKVSGFPEILFTNAGRIIHREKVVRSAEAWSRMMAFFYYKAARPPFLCEADGKGQEKVPLMS

SEQ ID NO: 56910 - protein, 128 aa, Sorghum bicolor
  Clone ID: 30950764.pep
REELGLPHRFTRLFTRYPGVFYLSLKCKTTTVVLREGYERGKLVEHHPLAAVRDKVHYVMRTGVLYRGKGLSKLVLDEDGTEEEGALNEEEFEGEGMDEDADVECFGMEIVDDDGPVGDVDDEGDSDG

SEQ ID NO: 56911 - protein, 73 aa, Sorghum bicolor
  Clone ID: 30950774.pep
LHLGIQNTDLERGRTPAHLWTAYQEVGARMRMDIPDHPKGRDLFLSADEAVLQFRATAVNLRMVAYLLCLFEP

SEQ ID NO: 56912 - protein, 166 aa, Sorghum bicolor
  Clone ID: 30950803.pep
MQKVRLKWVKNRGLDHLIERTTSIRASCLLLDHLSRLPGSSPVPARSLARLQKPLGLTVPVLRFLRRHPTLFSEQPHPRFPTLPSFSLTSASHTLLARLADASAHDAHLRLARLLLLTRSRSLPLASVLPLRFDLGLPFNFAAAFPASHPGVFAVANNRISLRSAS

SEQ ID NO: 56913 - protein, 61 aa, Sorghum bicolor
  Clone ID: 30950807.pep
EQEEDPSREWSRGRAAKKVELETAYHLGRVGSDRGRHLALICGRVPGGWQAEKRGAWRRRR

SEQ ID NO: 56914 - protein, 75 aa, Sorghum bicolor
  Clone ID: 30950817.pep
MRRGYSYSPSPPRGYRRRERSPSPRDYYGGRGRDLPTSLLVRNLRRDCRPEDLRRPFGQFGRLKDIYLPRDYYTG

SEQ ID NO: 56915 - protein, 167 aa, Sorghum bicolor
  Clone ID: 30950824.pep
ALRRAPAAFRRSRAPSTHAGAEEEQLHSRRAIDCITFLREGEEEGGANWWSSTPWERRPARRYWPHRRHRVQERRHRHRIWDKWWPAARRAGRNRLLGLATLGDGRSGAGNGRRRGASSGATADGASITARGIPKERRRPGGLSGEGRRALDPKLGATGWGGSGGSV

SEQ ID NO: 56916 - protein, 181 aa, Sorghum bicolor
  unsure (1)..(181): unsure at all Xaa locations
  Clone ID: 30950865.pep
MPSTSRRRRRNKPATPAPHPEAVEPARGTPSRGPTWVPRFPPPAAFARSLHLAPDAAAVEQARGPVPSPRPPPLAVFAHKPDIAPRPSPPNPSPFEPEARAPMPPPPXPRPPPPPPXSPPPPQSRPRPEEGRGPGGDEGLGGAAAGRDIGHPPQARPHRDPLGRREGVPLLAPRRARRALT

SEQ ID NO: 56917 - protein, 78 aa, Sorghum bicolor
  unsure (1)..(78): unsure at all Xaa locations
  Clone ID: 30950873.pep
MASPAGANSGASSSRGTPLPLPFPFPAAAHFPSRGAGPFLSQHHHPPVTSEGDDEVEEDEGSMDDDSAEEDDAELXDG

SEQ ID NO: 56918 - protein, 164 aa, Sorghum bicolor
  Clone ID: 30950887.pep
MGSGNLIVKKVVKHSSFDLDIQLDKSWMEDVTCPICLDYPHNAVLLRCTSYEKGCRPFVCDTDQTRSNCLERFKFAYELPSNAKVSSLAVPPLDSIIHIVPSNANNRPSCPLCRGDVIGWIVIGEARLHLNQKKRCCEEDCCSFVGNFNELQKHTQQKHPDSRP

SEQ ID NO: 56919 - protein, 191 aa, Sorghum bicolor
  Clone ID: 30950892.pep
MGAPSSRALALGAAFLLLLVALPSAFLYLTTSAAPAAATRATLLNLKPFSAKCAPAAAPLRVFMYDLPARFHVAMMGADDGAGFPAWPPSAGGIRRQHSVEYWMMASLQDGAAGPEGGREAVRVRDPDAADAFFVPFFSSLSFNVHGRNMTDPDTEADRLLQVEIVDILWKSKYWQRSAGRDHVIPMHHPN

SEQ ID NO: 56920 - protein, 191 aa, Sorghum bicolor
  Clone ID: 30950914.pep
DGSVCVSDDAQNDLKFSKCNLEDASKEPSTVQGADRSDSFANVNADAQNGSELTTNELAVITISNDKENESKLFTCNSEEADHDDSSVCLSYGAQNEYVVTTCHSDVTQEDEDEGKTAGAEKKLEASGGASLKSAMHQEAAGDINTTDASKDTHVTEETNQSFNMQMPAEFTDAKEPSIDDICGAFSGMNL

SEQ ID NO: 56921 - protein, 117 aa, Sorghum bicolor
  Clone ID: 30950934.pep
MAWRLAISKAARPQSDLQQRRTSPIIIRDTPHDSNLQLCSEFLPAHLIQAPRLRSANAVCNQLVASSAFIAPRIDNAAGGMLRNLQERYRSSYTGSFPRWIRELDSPSEASLLKQIY

SEQ ID NO: 56922 - protein, 206 aa, Sorghum bicolor
  Clone ID: 30950944.pep
PTGYYPHAPRSTKLPRPRPAPSRSRGWAWRPRPWPWSAPPISQLGSGPRGEGYALRECALGRTMPLHCSLPATCSALCLRAAARPDPRCPSSHARLVGLALSRPRHQRLVHTGCARAGTSDSKAVQLVLGGRARGDDDDTDSESSDGEDSQDRMTDEERKTLRRKIREMMDRVPETARLTDPEERRAKMRELLTKYELVVEEEDPD

SEQ ID NO: 56923 - protein, 60 aa, Sorghum bicolor
  Clone ID: 30950958.pep
CLVILLLLLSLRQNSVKKNDYIFTPYLCSVMSAIHLVYILIYMYHNLSCGHSPYPISLKT

SEQ ID NO: 56924 - protein, 104 aa, Sorghum bicolor
  unsure (1)..(104): unsure at all Xaa locations
  Clone ID: 30950971.pep
ADKDPLAQETGGLSGKPLFDLSTNILRXMYMLTRGKIPLIGCGGVSSGEDAYKKIRSGATLVQLYTALAYGGPALIPRIKTELAECLERDGFKSVQEAVGADFR

SEQ ID NO: 56925 - protein, 38 aa, Sorghum bicolor
  Clone ID: 30951010.pep
LVIRTQCDVYVGDGSAIDSFILCTRCNRFIYVKSKYLC

SEQ ID NO: 56926 - protein, 138 aa, Sorghum bicolor
  Clone ID: 30951024.pep
KVEENRWHERFTSIFGASKFPKERHDGWMEAEMGGFHNDEGKDGEVSVRFRTLPYAKIGLVALGIEIRPKGLLSTSIAGKRVAIWPAFRAPCHLPLLADGEVLQPLASMKALFLRLLDGPVLLADGLTVCDFASACIY

SEQ ID NO: 56927 - protein, 196 aa, Sorghum bicolor
  Clone ID: 30951030.pep
EASGAVLSGNSVQLTLTRQSALADGSYIMFGRPSDGGDLYATPFNTNYTMFSRAWFVTIAVQGQATADVSFDVSSVKDVMSANNGSYLLLYQLPSASGSHDIIAENGVVSSDNNTVTFAGVTLTTGFITVGSTASIPRAPQAPQAPTSGPVAGPAAGPASPTPYAYPSPGIVRRSDATASTVSVVSAVVLAASLMF

SEQ ID NO: 56928 - protein, 135 aa, Sorghum bicolor
  Clone ID: 30951032.pep
SVLWLVPQFALMGVADGFALVGLQEYFYEQVPDGMRSLGIGLYLSVIGAGSFLSSLVITAADRASSRGGRASWFAKDLNHSRLDLFYWLLACIGAVNLAFYAVVATKCSYKQTVRAGRVGDDKSAAAAGDVECAA

SEQ ID NO: 56929 - protein, 82 aa, Sorghum bicolor
  Clone ID: 30951046.pep
LTPRPFPRADDLGSIISSRCSRASFRCMGFLPFSSEFPGSLIHTLHSTPWLIYQWTMLWQCQRKRGSILWWLIIFLSWLIFF

SEQ ID NO: 56930 - protein, 84 aa, Sorghum bicolor
  Clone ID: 30951055.pep
FLCFLNCALFLFLMLLISQQRKPPTYVSILIINMYVLLPINMYSFILINLYMFILISMYVYPHTPTIYVCAHTLFIGIPVYPPV

SEQ ID NO: 56931 - protein, 88 aa, Sorghum bicolor
  Clone ID: 30951069.pep
MMPNVEMAYKLNWASGSAGDKRGDSGSDHTIFVGDLAPDVTDSMLEDMFRANYPSVRGAKVVVDRITGRPKGYGFVRFGDLNEQARAM

SEQ ID NO: 56932 - protein, 66 aa, Sorghum bicolor
  Clone ID: 30951088.pep
QGSCCYTLNVNVYSPTDSIYPPCKICLPMPPTLDPENHSCTKHTYSLFCSIFNYQLCARWRAPFLC

SEQ ID NO: 56933 - protein, 56 aa, Sorghum bicolor
  Clone ID: 30951096.pep
GSAVLYLIAKDDLPEKTNSHNKNEKNTFQVIRNREQFSHTISNNAVITHVSTGATS

SEQ ID NO: 56934 - protein, 118 aa, Sorghum bicolor
  Clone ID: 30951098.pep
KKKTNLTCSRPFPSLPAVGLQLLGRCVQQPGSMPAPRHATAAVALCRCRSCAAPPPAVALRPQLSARRVDSLMDSSASETYRRPRHTLLMRVRDPAGRVFSEGHHDLAGKELLQRGHC

SEQ ID NO: 56935 - protein, 187 aa, Sorghum bicolor
  Clone ID: 30951121.pep
AGFIYSGFNGANLTLDGMATITSSGLLQLSSGNGEHKGHAFHPELLRFHKAPRGKVQSFSVSFVFAILSIAPNLSSHGMAFLISPSTNLSSSGTRGFLGLFNRQNSGNASNHIFAVELDTIQNTEFQDISDNHIGVDVNDIRSVRSNYTGYYDDSQGRYQNLTLNSHEPMQVWVDYDEVTTKISVTI

SEQ ID NO: 56936 - protein, 101 aa, Sorghum bicolor
  unsure (1)..(101): unsure at all Xaa locations
  Clone ID: 30951163.pep
MSSSAAALAWRRTLRDALRRGGRXAATAAPKKVPPPPRKGRLLTGAMIALAIGGGAYVSAADEGKFCGWLFKSTELVNPLFALLDAEFAHSLADKAAAHGF

SEQ ID NO: 56937 - protein, 148 aa, Sorghum bicolor
  Clone ID: 30951197.pep
MCNSSYLGLPISMASKILPAVSELFPALVRAGGGTTTARRPPPPPAARSSPSPTTVHRHAPPPAARLAGGSGTTTTTLVVDVDGALLLSRSLFPYFMLVALEAGSFLRGLVLLLLYPAIRCLGAGDLAVRAMAAVAFCGLRAPTFRAG

SEQ ID NO: 56938 - protein, 172 aa, Sorghum bicolor
  Clone ID: 30951205.pep
MATTTTVTTTVSARGKRRGGCCALAAAADVVPLPASREEEQQQRPAKAAEEAQLLPRLVRFEELPDYLRDNEFIHAHYRCEWSVRDALRSAFAWHNETLNVWSHLGGFFLFLYLAVAEPTAKVTAAAGASAAHGIVTFVLASANSSWSSWETSSNSSLTLSKGLTTAMFGSS

SEQ ID NO: 56939 - protein, 163 aa, Sorghum bicolor
  unsure (1)..(163): unsure at all Xaa locations
  Clone ID: 30951222.pep
PHHTSRASNRSADGSGQNEPESKTSTYIYEYVYSVYANRSSPRTQLRTVRQSARRTGPSESRMNSSFLDGGGGESSLSANGGRSWGRKQAQSASVSAAAWKAWQTAAARQAATGPARASDANRRSSGSRVFSGXXLAEAPGAATVVSIDHRGFLPLWVDFGWG

SEQ ID NO: 56940 - protein, 174 aa, Sorghum bicolor
  unsure (1)..(174): unsure at all Xaa locations
  Clone ID: 30951232.pep
LHPGXLPNVSERFFSGMSXGHTLSTSGSAPTLLANKFNTNNPVPGVSFSGSQCLTSTAISAPSSAAYSVYVVAQLPGVGVHVLAAQEQSTSVGYALILTLNGTTIELGFYADGALVGSIVAESGNYIQGDAMIFWYTQDASYGTIGFDTMYNSFASATASFTATLITAIGCNLN

SEQ ID NO: 56941 - protein, 207 aa, Sorghum bicolor
  Clone ID: 30951237.pep
MNNAGTQLLAQTNPSSSSLAKGARPHRLLSECLVARMEKKSFEVGVEDHEVWVDDSSVDHRGRSPSRATTGSWKAAMFIILIEFSERLSYFGIATSLMIYLAKVLQEEMKVAAKNANYWMSVTTLMPLLGGFLADGYLGRFSTVVVSTAVYLMGLTVLATAQLAPGLKPDRSPRLHEALFFVGIYLVSVGTGGHKPALESFGADQFD

SEQ ID NO: 56942 - protein, 58 aa, Sorghum bicolor
  unsure (1)..(58): unsure at all Xaa locations
  Clone ID: 30951243.pep
FFGFFFFFFFFFGFFFFFFFFCFFLFFFFFXVTAPIFQLSCFNSNTTNHKLPATIHHT

SEQ ID NO: 56943 - protein, 169 aa, Sorghum bicolor
  unsure (1)..(169): unsure at all Xaa locations
  Clone ID: 30951295.pep
HQILKLPSIIFREAATIHQQSSTTFPSKNVQPPTPFIWIWDSKCSNKLRVFAWLLLMDRLNTRNILKRKSTSXEGSNYNCVLCNNNIEETAFHLFFSCSFSQACWRFLGIHWNLTSXLFQMTMQAKQHLRNPFFMEIFIIEKQRSNFIFDRGCPSFISWKTSFHEEAKL

SEQ ID NO: 56944 - protein, 84 aa, Sorghum bicolor
  Clone ID: 30951300.pep
LYSVHMSGYGYGQQSGGYYIPNAAYAYASANELAQRMNGLSVQNGDPNGITANKQSRPEDSLFGDLLSIAKMKQNKPAAGKVGG

SEQ ID NO: 56945 - protein, 132 aa, Sorghum bicolor
  unsure (1)..(132): unsure at all Xaa locations
  Clone ID: 30951306.pep
TCLGQRVVKEGSSGVVSVGFLSQGAPLSVSLTDQQDVQHPANGSLKVDNSTRATPPQGGXGNQIHMPKIIKIIKPVRYFATVMDGVQQVAITFKALRSDGEEVFVDDKQLKAKEPLVLINYYEQHLRYNPTS

SEQ ID NO: 56946 - protein, 78 aa, Sorghum bicolor
  Clone ID: 30951358.pep
QYGRGILYPTKQLFSPVCNLQKCGKCFWKLGTGPKGALINHLHKILKKKKHFFWWLFSCTNWSLFASKYMTSSISPLH

SEQ ID NO: 56947 - protein, 185 aa, Sorghum bicolor
  Clone ID: 30951366.pep
LTELGTFELSDNLGNPAKEDYSIQENQASDSVLLDSEEMPRHDCVDGESTHSCVDIYQEERVSTREDQTSEETLSVSHDHNDVGQEASLSLAEPSSIDEHAQSSANNFYYDYGEWRVVWDPFYSRYYFYNIQTQESTWCPPEGLEDFASYCSPDTTKELVELGSQCTSIAPQENSKTLRIFGLSL

SEQ ID NO: 56948 - protein, 177 aa, Sorghum bicolor
  unsure (1)..(177): unsure at all Xaa locations
  Clone ID: 30951368.pep
DVTQHHRLGPNFKQIPINEPKGIVPNTVYTGGAHRHDLKPNGGWPHYSPSLFGGLQPAPQYIDPPMRTDGPADFYDVPGEGSDADFYGQAREFLKVTTPXDRKALIENLSTSLHRVADRVVTAVLAHFNQIEPALATAVREGIMLRKNGSKVTPGNPVLKQFNQELLGNANMDINAA

SEQ ID NO: 56949 - protein, 186 aa, Sorghum bicolor
  unsure (1)..(186): unsure at all Xaa locations
  Clone ID: 30951374.pep
SELSXSNDPHLEGCISDFPVPEELANLDEDFLAKSCNLGYRAKRIVMLARSLVEGKVCLQKLEEMCKMFVPAAEDAYSIGSTYERLNKELSMISGFGPFTRANVLMCMGFSHTIPADTETIRHLKQIHKRATTISSIHQELDKIYGKYAPFQFLVYWFELWGFYDKQFGKISDMEPSNYGLFTASH

SEQ ID NO: 56950 - protein, 58 aa, Sorghum bicolor
  Clone ID: 30951378.pep
SSRAPLTEKKIKPEDYQRKENQKVWKVSTRKFLEFGCLILFILPTGHTFIPTFQAFGC

SEQ ID NO: 56951 - protein, 215 aa, Sorghum bicolor
  Clone ID: 30951400.pep
METIKKAAASVVHAVTENRNTMPDVMTMATGCPIAHNKNSLTAGPTGPVLMQDTVLQEKIGQFAREKIPARNVHALGFGAHGTFTVTKDISNHSYAKVFAGIGKKTEVFVRFSGVFTEQGDPDTLRDLRGFAVKFYTEEGNWDVLCVNTPVFNARDMKVGPDAIHAFKRDPRTAEWNPTQTWDFIATHPESLHNVLMIYTDRVGTPLSFRQQNWF

SEQ ID NO: 56952 - protein, 68 aa, Sorghum bicolor
  Clone ID: 30951402.pep
LLRHVHHHHRVLLRQPPVERRHAHLRRNPNPRSGGRGRGCGRGKRRRATPSWRAGAGAGTRTGRRSER

SEQ ID NO: 56953 - protein, 55 aa, Sorghum bicolor
  Clone ID: 30951408.pep
SIRTENSCLNILSRFTKILLLTTAFSKSANDTLLEFIITLPHLRCNIKCHLFVLN

SEQ ID NO: 56954 - protein, 81 aa, Sorghum bicolor
  Clone ID: 30951416.pep
ARPLASRESESRPVRLCGCGTAGCGLRESGRRGRDLWSARRAVVGGDRPPEPAGRTADGVVATLGGWRGRSAVVRWTSSGA

SEQ ID NO: 56955 - protein, 166 aa, Sorghum bicolor
  Clone ID: 30951458.pep
RADGAHPPCSLKSTPAMVKRSWNHGGRPAAAAPRREGRRTESATAHGGRSAAAAPQRLLMEAQWPSGGTGSFPLVEKHRGVAGSSSCRARRWHGLGLACRRSPSQPDRENSGGGRGNRSGRWEGRYRRGSACASPAAKGMRSGPARAWRRRREGRRTDPEGRKVTS

SEQ ID NO: 56956 - protein, 164 aa, Sorghum bicolor
  Clone ID: 30951464.pep
MSSAMVERATSDMLIGPDWAMNLEICDIVNREPGQAKDVVKSLKKRIAHKNPKVQLLALTLLETMIKNCGDIVHMLVAERDILHEMVKIVKKRRAGVVFPQRSNGSVPIITPPQTQPLQNYPSSLRISQQEELDSPASDFPALSLTEIQKARGIMDVLSEMLDA

SEQ ID NO: 56957 - protein, 181 aa, Sorghum bicolor
  Clone ID: 30951470.pep
DMLELEPVLAPCCRNSYSSPPSTAARIPLLPLPPPSVPTGDASIATVEDLASPVDLAATPPSLPKAVAGPLPWRISSAAAKLVILTNGGASTQRQCSLLALFHGVPSPHPMDLAAPPPPCPSIWRRAAPGAVAAGLPSPGCSCGGFLISPDGIHLKELASGGSIPAEQFRALCWPHASSLS

SEQ ID NO: 56958 - protein, 145 aa, Sorghum bicolor
  Clone ID: 30951513.pep
TKGNFAPLIRPPGSFATPPILRGRHRHRAGTLILAPHAAGHRRSYPPLPIVTLTRSSLRRRRMPHGSWRGGHDTAAPLRPCHGDRPRRGMLGCWQQLGRSTVWPSLGVAMWGSRRRWNQLRRDKGAGMRQRRQCWSKLHRSFKDE

SEQ ID NO: 56959 - protein, 142 aa, Sorghum bicolor
  Clone ID: 30951528.pep
MAPGGGDGRRNGEGQQQANGNNNNNNNSNAKAKHGCVCGFPVCACAGAAAVASAASSADMDRVAAAQTEGQIGAVNDESWIAVDLSDDLSGDGGGADPGVAIEDRPVFRTEKIKGILLHPYRVLIFVRLIAFTLFVIWRISH

SEQ ID NO: 56960 - protein, 195 aa, Sorghum bicolor
  Clone ID: 30951542.pep
RIKRLEAGTAWPGAVRRWVVAPTPAKGWTLWHVSCFRNDQDGPTTSDEGDGFKYVAQSQSSGGVEVKEEEVSTSNEEQVQNFKDRDWFLQLQKIKENLLGRIVRFQTERWTVPWTGQTIAQVMILWIATFWFVGSWIVPFLAHAAGFSKETLTHRGRALYSLLTDITEGLAGIAILHQCLGRFRPLPPGWFEFNL

SEQ ID NO: 56961 - protein, 93 aa, Sorghum bicolor
  Clone ID: 30951562.pep
YLFMSCALFWVYILVHQLCHWLFTEHMFMRWFLEFHFCTSCSAFLSDLLRSGIQRLPHLGDQMDYISKKEVHLHRELTTSWTRGIYTDAVAST

SEQ ID NO: 56962 - protein, 172 aa, Sorghum bicolor
  unsure (1)..(172): unsure at all Xaa locations
  Clone ID: 30951574.pep
SKSAYAAFFLGTVRFAPWKRIWKSWAPLCCKFSIXVETIQHILISCVFGRQVWTLIFQKLSLSAVAPLIKATHFSSWWVSTIRNVPKEIRKGLNSLIILVAFEVWKHWNACVLEGVLPNIQVLLQTLVDGWGFCSMARASNLHFLRLPAPDFYLLGGWLVFLSVMAVCVMCA

SEQ ID NO: 56963 - protein, 89 aa, Sorghum bicolor
  Clone ID: 30951586.pep
RFPIESKGRQKKLYEVGTVTAICVTCFLIRCVVVALSAFDADVSLEVLDHPILDFFYYMFAEILPSALVLFVLRKLPPKRVSAQYHPIN

SEQ ID NO: 56964 - protein, 117 aa, Sorghum bicolor
  Clone ID: 30951614.pep
ISVEIHLKYCGICDSVQWTKKQGKQFIYIYMYIYTEIYTLHDSKIRHGYNNLFLVKNQFIVHAQIHQAKKNIFLKTLRQTHAGSAIPLISNKTRYRIVICMDAHCATHCAKRQCIYS

SEQ ID NO: 56965 - protein, 163 aa, Sorghum bicolor
  Clone ID: 30951615.pep
NLLIDRRTNTLKLADFGLSRAFGIPVRTFTHEVVTLWYRAPEILLGAKQYSTPVDVWSVGCIFAEMVNQKPLFPGDSEIDELFKIFSYDCTPNEQSWPGVSCLPDFKTAFPRWQAQDLATIVPNLEPAGLDLLSKMLRYEPSKRITARQALEHEYFKDLEMVQ

SEQ ID NO: 56966 - protein, 72 aa, Sorghum bicolor
  Clone ID: 30951625.pep
HACFLNCSYGGQSYKYNGVAPLPAQRNLTPPPTLYPQQPMSFSSENYRYPRFSSSSIPDSSGGRTSRANLDI

SEQ ID NO: 56967 - protein, 135 aa, Sorghum bicolor
  Clone ID: 30951635.pep
AGSKQFRSRSAVQATRRSAFGRRYDPVVPIDDEADDETLRDEMVAASDISSFSSDLDDDDTIIKEEENSCEDNGVDEDDEDGNSCDEELFELAMRPGPETETETEVEDEVDRKADEFIAKFREQIRMQRVEPARR

SEQ ID NO: 56968 - protein, 95 aa, Sorghum bicolor
  Clone ID: 30951641.pep
QFHTEAVHMTSKLDKRYCALVEVQACGSLVTEEQPHAMLIPMEYFFMGYGLYRPSQLDCSPRSPLSPFCISPDLLSPESMGVKLKPIKTRVRLEV

SEQ ID NO: 56969 - protein, 80 aa, Sorghum bicolor
  Clone ID: 30951673.pep
CFAVLKTVDDHCGLWLPYNIFQHLFQNNTAYHDIHHQLQGTKYNYSQPFFSIWDRILGTHMPYDLVSRKEGGFEARPLRD

SEQ ID NO: 56970 - protein, 96 aa, Sorghum bicolor
  Clone ID: 30951677.pep
PVSLSRDMCIQIHTPVVSSTHINTDVTNLVDASRQVAKHQKPSYLFTLDKTHRRVAKQHRPTWLTIAAASVLLYRKKHPMTEESTVCHRPVDPTID

SEQ ID NO: 56971 - protein, 82 aa, Sorghum bicolor
  Clone ID: 30951679.pep
VESKHEDKIRDAHDEAIFGVPTISFVDTETGGDELKTNHEDGKVEDIEADEPSSSLISDKVLAMQKGSWRDRAQKLRQDSNT

SEQ ID NO: 56972 - protein, 91 aa, Sorghum bicolor
  Clone ID: 30951695.pep
MSFRSIVRDVRDGFGSLSRRGFEVRFLSPRRGKSHGAVHELHDPVPVVQSSCWASLPPELLRDVIERLETSEDTWPSRKHVVACAAVCRTW

SEQ ID NO: 56973 - protein, 98 aa, Sorghum bicolor
  Clone ID: 30951707.pep
SFPSYFRAKEKPFLCAVLFCHLCSSHRLESPFSPTEWPLASQNKNTTGSYSLDLRRGGETPESGKRVRCLIGKSAGVRRQNPILAPEQPCAIIFSVCC

SEQ ID NO: 56974 - protein, 149 aa, Sorghum bicolor
  Clone ID: 30951711.pep
MPRITADDIRTAVQQIVPYLEDTSNNAPRVIYFDGWYGLAASAVLRAIAEHPPQSLREKFDKIIHIDCSMWKSRRALQRVITEELKLTQQVAAIDMEDKENDFSGVDQGSRAEIRDITGVIGRYLVQYRCLVIFHNGSSSTVDLTDFGI

SEQ ID NO: 56975 - protein, 161 aa, Sorghum bicolor
  Clone ID: 30951753.pep
EIKSGGEEGEGANPRSGGRAHGKRASGEEEVGHQPRRDPPRGARGRAPRVRRGHPRRGERPRPRAIAVFPPARARVTGTNRVGGGAGTGNRGEIEAGGRVGRERVRRRRRRRGMGIRRCECGVAWRGEGEGGDGDEDDAETEEREREREREREERKGKKGR

SEQ ID NO: 56976 - protein, 218 aa, Sorghum bicolor
  Clone ID: 30951755.pep
SDPTITDDGAALPCGRASGACPAVPYPSFRCTSQALFRPTRLRCSQRCFSRVAGERWGWRSVFVARLARLLTLLRLIAIILFFIWRIRHPYADGMWLWWISIVGDFWFGVTWLLNQVAKLNPIKRVPDLTLLSQQFDLPDGNSNLPRLDVFINTVDPINEPMIYTMNSILSILAVDYPIDRTATYLSDDGGSIIHYEGLLETALLTNAPFIINFDGDH

SEQ ID NO: 56977 - protein, 137 aa, Sorghum bicolor
  Clone ID: 30951763.pep
MRRELASSFATAAATAGASSSAADALRGWWDDVNESPQWQDAAFFSLAAAYALVSAVALIQLIRIQRRVPEFGWTTQKVFHLMNFLVNGVRALVFGFHAHVFLLHTKVYKLVLLDLPGLLFFSTYTLLVLFWAEIYH

SEQ ID NO: 56978 - protein, 217 aa, Sorghum bicolor
  Clone ID: 30951779.pep
DGLFSPSSCCWLWCHSSFSLSSACCRRRGGGGGGGAESKEEQQQQNAAANDLHCCSRPNSPGPRMLSYDFLDVAFSPYSDYWREMRKLFILELLSMRRVQSFAYARAAEVDRLVSSLAVASSSPPGAAVDLTEKLYALSDGVVGTVAFGKMYGSAQFERSSFQQVMDETLRVLGSFTFEDFFPASRLARLADVLTGAAARRRRIFRQIDRFFDSVID

SEQ ID NO: 56979 - protein, 180 aa, Sorghum bicolor
  Clone ID: 30951785.pep
MPIPKADELVVHAVKEQFVGLDFCITSPPPWLTAILVGFQHYLVMLGTTVLIATIIVPLMGGGHYEKAIVIQTILFLSGINTLLQVHFGTRLPAVMSGSYTYIYPAVAIILSPRYALVIDPLERFIFTMRSLQGALIIAGVFQAVVGFFGIWRVFIRFLSPLAAVPFVTLSGLGLFYFAF

SEQ ID NO: 56980 - protein, 109 aa, Sorghum bicolor
  Clone ID: 30951803.pep
MMFWKDGGGTGGGNGRDLSGGPPCGQVRVLVVGDSGVGKSSLVHLLLKGSAVARPAQTIGCAVGVKHITYSSPGSSSNSIKGGAERNFFVELWDVSGHERYKDCRSLFY

SEQ ID NO: 56981 - protein, 188 aa, Sorghum bicolor
  Clone ID: 30951815.pep
MNASRPSLLASFLSPPERQGSVAPSFPIPTPPHRSQQPSYRDPEQTHSLGTTQEARARASSAMAEAAAGTAPAQQQQAAARVATTTAAAASDVSASAWLQQVLALLFPSSLAAKAALFALVVALLPLLPSGQAQEAPRIWELPHLLLLGIILSYGVFGQKNADDGAEVAAAAAGAAADDAKLLPGVVD

SEQ ID NO: 56982 - protein, 98 aa, Sorghum bicolor
  Clone ID: 30951819.pep
NLVNFSTTMLDGSNHVKEKKKHQRAKTCGEKNKQESHRTCEEKKLKKNQENGRNDHPAVPATSIASGGGGELEKKVSDRHGHGSGSTHKKPWSLVDLG

SEQ ID NO: 56983 - protein, 144 aa, Sorghum bicolor
  Clone ID: 30951820.pep
MGDSGGSVVSVDVERISFGGKEHHIQTSHGPVSVAVYGDHDKPALVTYPDIALNHMSCFQGLLFCPEAASLLLHNFCIYHISPPGHELGAAPISPNAPIPSVDDLADQVADVLDFFGLGSVMCFGVTAGAYILTLFATKYRERV

SEQ ID NO: 56984 - protein, 124 aa, Sorghum bicolor
  Clone ID: 30951830.pep
ESGPYKYIFSTEGHLLPVTPEIALVDEHCSYFGAFCNGGADHGYGASASSTKHQNGNYTQLDDIQTHSSLYSTSNVLFKTGGYIKVTLMWFLINIFYSLVTAYVTFVDRKWNNSGLQCVKSKLF

SEQ ID NO: 56985 - protein, 64 aa, Sorghum bicolor
  unsure (1)..(64): unsure at all Xaa locations
  Clone ID: 30951855.pep
KKKIKSKQGLIRGSDDPLTMXRGETKKGTVHSKLFXLLVGIIQSSCKQCSTVPCTVVLLSYFGQ

SEQ ID NO: 56986 - protein, 76 aa, Sorghum bicolor
  Clone ID: 30951892.pep
RGKLQLSSSKSSSNYLLRTALQSNGIIINFCRAYCPRHREMCTPNSCGGTIGFYLSLVNCGMYAYVRCLTLPKVVV

SEQ ID NO: 56987 - protein, 154 aa, Sorghum bicolor
  Clone ID: 30951894.pep
KTLAETEAFDYAKRTGLDVVSVCPSLVIGPLLQSTVNASSSIIVDCLKGDHEVKLKLRNFVDVRDVADALLLVYETPEASGRYICDANARQVSDVIALLKNWYPAYNHATKLVQVSDEPLFSSKKLEALGWKFRTFEETLRDSVESFTAAGVLD

SEQ ID NO: 56988 - protein, 189 aa, Sorghum bicolor
  Clone ID: 30951900.pep
VIEKREYKMKNSFLPQETTSTLKTMQKLENQRWGETTGFHHLLRIHCTSRHHAVGCARRREGCAILAQPAPAVGKCRGLSGLVAAAGRSPRPPQPVGPYRSPPPPPLIICLFHARWSSLAEAGLHDEHRLHAALHREVEAKRSPSRGGGQAKIICFRACCPCPLAGATMLARHVCSARATSCSPAVSTR

SEQ ID NO: 56989 - protein, 81 aa, Sorghum bicolor
  Clone ID: 30951903.pep
RTTMESTALQCWPHRSAILLSILLALCLGRAQDVGNLLEEIEQHRGDNVPLYQQHSQAHDLLDKVAHEMICFMSPFSVNKC

SEQ ID NO: 56990 - protein, 228 aa, Sorghum bicolor
  unsure (1)..(228): unsure at all Xaa locations
  Clone ID: 30951904.pep
MDVLLSWLEQRDNYKRNHQAIQDAFNSQDQQEEDISAITKKPGWSQPQATSQGKYQSDFNHRQPXXRELILEQARINESIYKKLAFNDEMLEGINSKLDNFSLAAKQXIMFNKKIESXITHLASMLSATNHEQIKGIFTRGGKVTRDPPYPKGAHRPSQSVQVDKEAGENNKEKEVEVPSPPVDAQEPKLMKDFPDTTLLPFPQRRSTTTDERFSKFVDVNQKLYVNI

SEQ ID NO: 56991 - protein, 133 aa, Sorghum bicolor
  Clone ID: 30951912.pep
PHGVRGDDGADVGGYKVPRGAEVNFLVAEIGRDETVWTAAREFRPDRFLDGGEGCDVDITGSREIKMMPFGAGRRMCPGYSLGIHHAEYFVARMVRDLEWRPPVDGAAVDMAEELDFTTVMKLPLRARVVSRH

SEQ ID NO: 56992 - protein, 88 aa, Sorghum bicolor
  Clone ID: 30951918.pep
ELQKLSQKYKIYFRLLSPPSAPSNHAWPNRPLVRWAAHHGRGTSRLRPLPLARKLQVPAVRRSLLDVSLGFKFLGKDLKTVEKMFPLV

SEQ ID NO: 56993 - protein, 55 aa, Sorghum bicolor
  Clone ID: 30951931.pep
FSVSIPSLLALPFFFPFPARRCFRHGVLGRCHPPDDVRDFCFLFILFIFIFFYLL

SEQ ID NO: 56994 - protein, 143 aa, Sorghum bicolor
  Clone ID: 30951972.pep
MTSGGAAGAAAGGGGGGKAAAVPLRLHHYLVMAGVAAAVVLACLRYAPDAAAGYGFLAVAPQQPVAAVAVAVARAADGGDDAHRPSSSSSSVIIFNFGDSNSDTGGMAAVNGMNLNLPEGRTFFRRPTGRLSDGRLVIDFICE

SEQ ID NO: 56995 - protein, 209 aa, Sorghum bicolor
  unsure (1)..(209): unsure at all Xaa locations
  Clone ID: 30951994.pep
SGAAAVEHAPLSSLSAGRVEAAAAVLLPSLAFLPRAAQRRLRPWQLLLCLGSPDRAADTVMALFLGLLRRTHLLSRHASSSSPTAGWLGXVLGIIGVNAAARCLATRSLAFRMSVLYFDPIFEVTGKVKRPSIVFPSAARRMDTLNDLLAASDLVSLHCALTNDTTHILNAERLQHIKPGAFIVNTGSCQLIDDCALKQLLIDGTIAGC

SEQ ID NO: 56996 - protein, 117 aa, Sorghum bicolor
  Clone ID: 30952075.pep
SVPMEVAAGRTRPGTAVCVTGAGGFVASWLVERLLAGGRYVVHGTVRDPGDAKNAHLAAMDGAAARLRLFRADLLYYGSVAAAVAGCDGVFHVASPVPSTYPIGRAAGSGRDGHHER

SEQ ID NO: 56997 - protein, 88 aa, Sorghum bicolor
  Clone ID: 30952083.pep
SEHVMHLTLGWCRMLNKTRRRIQFLPLPSSITAVPMMQKARRWASVVQASALQHTSTRECKANGVRASGLQRANAGKSMDNAASMHSV

SEQ ID NO: 56998 - protein, 206 aa, Sorghum bicolor
  Clone ID: 30952089.pep
RHSFLPARDSLLRLDPLDPQPSRVQARSCRCSPVARNVGGRVRPLPLEICPRRRCPLPAPPPPRPHCSSNYDPPLTALRPAARANSGTVAASECDHGGRVRRRVNSGGHVRVRLRWPRSPAARANAGGHDQRPCPPASCTPAARPLPERPPGRAANAGGHDRVRLLVPHLPAQSLHMRPTFHNCALLQEISGPTTPPSPFPVSTSI

SEQ ID NO: 56999 - protein, 85 aa, Sorghum bicolor
  Clone ID: 30952122.pep
GNAFARLPSSRASPEWLRVERRRSTFASALLPPSRASPKGSAWCGGGRLSPQSRVGLWRLCNGSRRKLSSNFLSQVRDSPSWSRH

SEQ ID NO: 57000 - protein, 87 aa, Sorghum bicolor
  Clone ID: 30952124.pep
KWALQRCKAGEAVVAMDPRMRRSPASVPAVERMLALAAQCVATARDDRPSMRRCSELLWAIRRDYRRQEEPRCAAVAEERSDEWVVR

SEQ ID NO: 57001 - protein, 99 aa, Sorghum bicolor
  Clone ID: 30952162.pep
GTAYTMKRTVLHLCDFGHELLLQALLSQGSRSNVIFEHLLGYCLTASLVEEKDSKFCPLYTSVKSLRMRVWNFCRKQSDSALFKWGLRFLNSKAANSRF

SEQ ID NO: 57002 - protein, 179 aa, Sorghum bicolor
  unsure (1)..(179): unsure at all Xaa locations
  Clone ID: 30952195.pep
TDGWKVMRRVNPTMEQELLESLVETDTKRQERAKRMEEKKVYLQLYEAMEALVHICRDGCRTIGPRDQALKGSLAAACKFPACKGIELLVRHFSTCRVRVPGGXENAESGEEGRDQMEPFGVQGTGEQRNHGFYARKEKKIINPNTSWELPRGSSCRTYLKHRKFAGVLCKTGRGSGGA

SEQ ID NO: 57003 - protein, 72 aa, Sorghum bicolor
  Clone ID: 30952199.pep
YHCSLVLDSWIFLSLSRTPCNHQDTFYFTRLLQFHTSQARMCDDYFFGARVYSIRSFFSSWLLQPLCIPLFW

SEQ ID NO: 57004 - protein, 149 aa, Sorghum bicolor
  Clone ID: 30952203.pep
GSFVCEYIGEVLEDEEAQKRTNDEYLFAIGHNYYDESLWEGLSRSIPSLQKGPGKDDETGFAVDASEMGNFAKFINHSCTPNIYAQNVLYDHEDISVPHIMFFACDDIRPNQELFYHYNYKIDQVHDANGNIKKKKCLCGSVECDGWLY

SEQ ID NO: 57005 - protein, 139 aa, Sorghum bicolor
  Clone ID: 30952205.pep
REGKLRAICGGGRYDRLLSTFGSEDIPACGFGFGDAVIVELLKEKGLLPDLSRQIDDIVFPLDEELEGPASSIASSLRKKGRSVDLVEDKRLKWVFKHAERINASRLILVGNSEWERGMVRVKILSTREEFEVKAGELE

SEQ ID NO: 57006 - protein, 79 aa, Sorghum bicolor
  Clone ID: 30952214.pep
CGVPLAILHIRQQRGLEKDMQNLWLHLCSSSSCHATAGCSSGAHNIDPMGTKLICSSRSSMNSTTSECARIRPTGSCLQ

SEQ ID NO: 57007 - protein, 204 aa, Sorghum bicolor
  Clone ID: 30952237.pep
MGCYPPLGKFVSKALGKCNGRQRWREGRLDFDYALAYPPTETHYMRPVARTVTFASNNSIYVIPPSSPPPQPQPQQQNAPEPQQPQTPPGHEPEQQHQQDPPESQPPPQPQTTEQPEQPDPPAQTQDDAPPQAEPKPPKGPKRGKKKQPGRVRFGPEPPPPPQQQQEQEQAQQSPGNIEKPPDHGPPHGAAPAPAATQGQQGYL

SEQ ID NO: 57008 - protein, 207 aa, Sorghum bicolor
  Clone ID: 30952241.pep
MECLEFDCSDLFLDGDAIDFPLEIHLESNSSAGAKAAPDHRRHAQLHRSKAPDPPPLPGTSYDAWRISRKAKACRRVPEGVVDSWDRLFLQGYQSDLRVWTDDDTEILSHSCVLGVKSPVLRAMLEEAKLKDGFRCIRISGAPSEAVCVFIRFLYSSRFEQEQMKKHVLHLLVLSHVFSVPSLKTVCIDQLERNFLAPDNVVDMLQL

SEQ ID NO: 57009 - protein, 221 aa, Sorghum bicolor
  Clone ID: 30952249.pep
SREEVLNMRPDLRAYKIFRERFSTEFDDEKYIGSVPGIYPGDIFHLRVELCVVGLHRPHRVGIDCTKKDDGTTVAVSIVSCAQSSDIKYNLDVLVYTGPVAVTVNQRIEGTNWALKKSMDTNTPVRVIHGFTTQNGKKKFPTYIYGGLYLVEKYWREKEHGDRYVYMFRLRRMKGQKHIDIQEILQTGNSGSKNNVIIKDLSHGLERVPVPVVNKISDECP

SEQ ID NO: 57010 - protein, 116 aa, Sorghum bicolor
  Clone ID: 30952264.pep
TFSGVLLLPPAAERSLLPCFPPSNSDVRAPPNHRQSPQSPERRPDPAIRPSIPPASWTAGLVPVRYAIHIPNYEVCNPSSYFPFHISDCMPPRTFEYCLFSPRRLELVDTAKIRTI

SEQ ID NO: 57011 - protein, 214 aa, Sorghum bicolor
  Clone ID: 30952288.pep
KTSENPLSDFSLMQESIDQRAGSSLDGRRLACKRKNIEGANGQSSAGASTSFSLRNDNAFYNIASSSYNPAPIRNSSSPNCLPVPSSIEDQLPQYGTNAGLSAGTYDLNGGVHNAGNSQRSFRARTTTSQQIAPCSVWPSSNAIRLSNSWNHQPPHFQNAFDGPQEVIPVVSSLNLQYQHPVNVSGVPRAANRFTGHGASSSRATSLENRNLGS

SEQ ID NO: 57012 - protein, 103 aa, Sorghum bicolor
  Clone ID: 30952297.pep
SNLDGYSFLAFFFIPNLPPSPTVKITSLLTQLQHCSCKGDEVTCGGTDQRRSNSTISQCFPPFTCLQSIAKRPVLKVNIWKKSEIKIFIKAEETKRGYGNSQG

SEQ ID NO: 57013 - protein, 179 aa, Sorghum bicolor
  Clone ID: 30952299.pep
MASWPAASRRQSSSSSSSRKSAELSGARAHSHSHHGRATSSPAAYGYGRQLSSYSTRSSQVSSSSSGSFSARVAGAFTSCFVPRRQVTTEEEEEKKSRRSECHVSIDSAGSWQEGRALTIADVSKATSNFSEKNMIRQGRSSTMYRGKLKDGSQIAVKCVKKLNGQNLTAELWRELETL

SEQ ID NO: 57014 - protein, 199 aa, Sorghum bicolor
  Clone ID: 30952309.pep
GEHVGIIGSAKELGSWKSPVEMDWTPNGWVCQLDLPGETLLEFKFVVFLNRGKDKIWEDGDNRVVNLPKNGSFDMACHWNKTKEPLNLLGTSEIKLSGDTEKEKDEDAKLSRNIALEEMGNISNAGDGDLTPKLESSTLGGLWQGSDTVFMRSNEHRNNESDRKWDMTGLDAVSLKLVEGDKASRNWWRKLELVRGLVS

SEQ ID NO: 57015 - protein, 216 aa, Sorghum bicolor
  Clone ID: 30952329.pep
LSRLANCSAAPPLRLPVRSSARTSRSAPPTRPPPPPPRPPHPPTATSTSSSLVSTAIKEPMERVSGTECREGMAVMSNKEEKECQITKVEKGRKNGKKHKDKGQGGDCEGKAVVMSNKKEKGCQITKGEKGWKKGKKRKDKGRGGDCDSSIHSGDRNHSIEMEQADVSATMAENPCLEHAEGAMSKSSVKKHRKKKKKDKEVETNGQNQVLDPDEN

SEQ ID NO: 57016 - protein, 212 aa, Sorghum bicolor
  Clone ID: 30952334.pep
GFASPRPSSPSMGPAAQPPDAGGGGDPEAWYGSIQYLINISAVGAASCVLLFLLVKLRFDHRRIPGPSALAAKLLAVYHATAAQIALHCGADAAQFLLFERASFLILAAVAAAAVAAALPLNLLAGDATVVDHISATTISHIPKSSPLLWLHLLLTAAVVAIAHLGISRMEDALRITRFRDGNGNPSDPNSSSVAVFTIMIQGIPKTLAADK

SEQ ID NO: 57017 - protein, 187 aa, Sorghum bicolor
  unsure (1)..(187): unsure at all Xaa locations
  Clone ID: 30952338.pep
MLRPSVVELPNAKGPRLKAQSHSPQSLPPSVAGRRPLPTLCSASEIAFFHTYSPRPAAQPPASPPSTASSAVPPPPRAAPSRSPTTSSPDAASPESRPSRHPKVSPASALPRSPMPCSPSWPALTSPAPTSPPSSPKIPDYSAPTWGRPWPPASPSXPQPRAVEPPGRPGSTRRSGPDPQPLAPPQF

SEQ ID NO: 57018 - protein, 86 aa, Sorghum bicolor
  Clone ID: 30952343.pep
RSCFPWWTSGRSRCPTWTRSPPPPRTPLRRGPAPTPTRSRPSRSTPPSSTRAPVPRSRPSPASASAPPPPGPAPRPPPPGTSPARG

SEQ ID NO: 57019 - protein, 92 aa, Sorghum bicolor
  Clone ID: 30952416.pep
GVRTTSVFHYVRLSASVYFFCMFLHLTLKSDARRAMSNTLRPYPSIRTHGIGASFSGANFAIASLSIASSAPLQAILSRRVGATGLELRFCG

SEQ ID NO: 57020 - protein, 144 aa, Sorghum bicolor
  Clone ID: 30952428.pep
YVCGDAKDDPPAEVQDFTAQVIILNHPGQIHAGYAPVLDCHTAHIACKFSELLEKVDRRTGKTQEEAPKNVKNGDSAIVLMVPSKPMCVEGFADYPPLGRFAVRDMRQTVAVGVIKKTTKAVKGAAAGAKGAKAAPKAAAGKKK

SEQ ID NO: 57021 - protein, 113 aa, Sorghum bicolor
  Clone ID: 30952457.pep
QQGMSSMQRMLEACMDMQLELQRSVRQEVSAALNRFAGPEGFSMDLSDDGSKCNQVRKGTCCICCDTQIDSLLYRCGHMCTCSKCANELVRSGGKCPLCRAPIVEVVRAYSVL

SEQ ID NO: 57022 - protein, 100 aa, Sorghum bicolor
  Clone ID: 30952471.pep
HSTGQRYIYTGSSDKTVHIYDVVSGETVKKLSWHDSIIRDCTWHPYYPTLVSSSWDGYVARWEASGDDKDPSMLVHNEKRAGAGTRYFRRYADPFTDAFM

SEQ ID NO: 57023 - protein, 123 aa, Sorghum bicolor
  Clone ID: 30952472.pep
IPRCPRSLHLRDVILAMSPHDHPKSYRDRRNFHLRSTPAARASGTMHGFVAQPANPGFCGVIRKPPSTSSRRVARYSRRTPHDRMSLKRKPRSTLLRPSGSSARHPILVLHSSPHVPCLHLSP

SEQ ID NO: 57024 - protein, 153 aa, Sorghum bicolor
  Clone ID: 30952502.pep
MVEGDARNFSDVKPDLIACMKSLSPALTCTVESVSAQLSDSAVTSTNSDQKFSSVEGLSSIKDCDFDQERNQATLLTSEEASIICGTDLTWLHDDLSGYQGVSFSNIGLNSIDLFQCNDTMGALPGLQNNWYDDIELSSETMEIQLLDGGLFA

SEQ ID NO: 57025 - protein, 168 aa, Sorghum bicolor
  unsure (1)..(168): unsure at all Xaa locations
  Clone ID: 30952524.pep
NKLWAAFPVQVQEPVKALFAAAMNTIVGDGNTTLFWTDNWLHGXVLAVLAPLIFSLVPKQRRNRRKVSEVLHEHQWTHDIXGALSVAGLAEFIGIVDLQEEVXLMLGVLDKHRWRFSATGQYLSKXAYETFIGAVHFEPWRSRDEAAVCTKIRMLEGKLFFPFSTCLL

SEQ ID NO: 57026 - protein, 74 aa, Sorghum bicolor
  Clone ID: 30952531.pep
MQDLTPNQLQQALSKTFSTKKRKSKLQKAWDGTKVVYNIASWSATAIGIYQNPAIVQAATAAFWTSCRVISKFL

SEQ ID NO: 57027 - protein, 89 aa, Sorghum bicolor
  Clone ID: 30952541.pep
TPANEGAPRHPAATHIKPLDLTARRRRPPDSSPPPQVPAREQLAHQEPSQRSPRTVPPMAVRRRPAAAAAGDPPPQGPPANAAAAAPEE

SEQ ID NO: 57028 - protein, 176 aa, Sorghum bicolor
  Clone ID: 30952579.pep
MALTDATAFPYGLRVLVVDDDPTWLKILEKMLRKCSYEVTTCGLASVALQILRERRNKFDIVISDVNMPDMDGFKLLELIGLEMDLPVIMMSIDGETSRVMKGVQHGACDYLLKPVRMKELRNIWQHVYRKKMHEVKEIEGNDSCDDLQIFRNGVEGFDERGLFMRADSDTMRKRK

SEQ ID NO: 57029 - protein, 104 aa, Sorghum bicolor
  Clone ID: 30952583.pep
MAEDAPPAAPVMTLEEVQAEAELRMRDISQRFGAIPEDDDELLRLLEEAEMWLSRVDQSPPESMYNALRPTMAVLITSELLEHRDPNIKVALTSCLTEVTRITA

SEQ ID NO: 57030 - protein, 64 aa, Sorghum bicolor
  Clone ID: 30952597.pep
YSAIDLICSLADSRHRAQREVAESPIRRARCRGITSTDAAGGLQYALSSCGQHNCLQSAQVSSR

SEQ ID NO: 57031 - protein, 78 aa, Sorghum bicolor
  Clone ID: 30952599.pep
GLYIFINLQLCDLLKSRVQSPEFLEKLDTLQKSVYQHGAVDETVSWDIISAADIWDDKSVNVSDDSEDGYVLVKQEDI

SEQ ID NO: 57032 - protein, 99 aa, Sorghum bicolor
  Clone ID: 30952615.pep
DSEQEIDRSSERLLTRTKRDVESRTFLVRPERRRLRVERRVVVRLCIVNHNPSVRKKKKQGENARQQHTRSMDRPNKRKEPVATLFTSEQALDGEEDGA

SEQ ID NO: 57033 - protein, 221 aa, Sorghum bicolor
  Clone ID: 30952624.pep
QETHKTICTNKLTLPQTSVQLLEEVDPWIRSPTQHFQLEQNATVTLGFNRTSNVLPTDAPESGHLPEFITAQDTNMISQPDSREAHLNALQHERGEKVNQDLEDVSASIWPVEKDHVHGDLTLQSAGVLLSVSCNGANQGSKSETNLQPGAAAEDLSQQDLCIKCGKDGQLLECSGCSLAAHDSCFGSSVTFEGTDLFYCPRCCYKKATEAYEKAKKTYYE

SEQ ID NO: 57034 - protein, 158 aa, Sorghum bicolor
  Clone ID: 30952631.pep
MGKEKVHINIVVIGHVDAGKSTTTGHLIYKCRGIDKRTIEKFEKEAAEMGKGSFKYAWVLDKLKAERERGITIDIALWKFETPKYNYTIIDAPGHRDFIKNMITGTSQADVALLVVASGTGEFEAGIAKTGQTREHALLAYTLGVKQLIVAVNKMDDK

SEQ ID NO: 57035 - protein, 68 aa, Sorghum bicolor
  Clone ID: 30952694.pep
HRRRRSHGFPTPPSLPPQPPLMASPLFPPPPIQALLPSSPAPVVPPPPVPAPAPPLPPLPKSRPGKEW

SEQ ID NO: 57036 - protein, 74 aa, Sorghum bicolor
  Clone ID: 30952695.pep
CHPTGSDFLSFKVTEAPRPWAHSLVVASSPLNQWQEQQQGEFRGCLYNSATKNELIKPPIGCLSFEVSSSPYKG

SEQ ID NO: 57037 - protein, 172 aa, Sorghum bicolor
  Clone ID: 30952706.pep
VLSRLWSLEFSQVPKNKKPPTNHQNPRASAESSQPPSRSPQFSAGVCRIDLIPPCSDSPAVARSERLPPRIPPSSGSSFTAGRCEECGGARAGNRPGRRRTGTGTGTRTWSGSRCAPRCPTSRGPRRSRAAGPAAPLGRDGAGPSRRSSWCRRGRPAARAAPGSPPPTEPTS

SEQ ID NO: 57038 - protein, 86 aa, Sorghum bicolor
  Clone ID: 30952708.pep
MRTEVIQADTVDAAVEQILRELREDTSTRIIRNRENVIYFDGWDGLGASAVLQAMGQRLDVDVASSEAPEGLQFDQIIYIDCSNWE

SEQ ID NO: 57039 - protein, 99 aa, Sorghum bicolor
  Clone ID: 30952722.pep
MEIPVIKMDQLHGEKRSETLSLLHNACAQWGFFWLENHGVNEDLMNKMKDLVNKHYEQDMEKNFYSSEKAKILDYEKASSNVDWECSFMYRHQPKSNSH

SEQ ID NO: 57040 - protein, 101 aa, Sorghum bicolor
  Clone ID: 30952732.pep
LAMLMDRKEDVHELRRRGLVHGALSNKQALGFFKGLGQHLRFGRRYFAALEEIDSYKRYRSVRIKVYKFVYNNYKFIAAFLSVTGVLIGIFKTLFSLQRHC

SEQ ID NO: 57041 - protein, 73 aa, Sorghum bicolor
  Clone ID: 30952734.pep
STSFSLVRGSDDHHPQGRVLWTHAHPGKGIRVQILSTSPRREAACGIQFRHSYYCLYAFNLPIPICFVLNIPN

SEQ ID NO: 57042 - protein, 89 aa, Sorghum bicolor
  Clone ID: 30952739.pep
KCCTLIVLRYKEEDKDELDPKDGLANRTTRVKKGPVQDLEDKLAKRTSRVKNGPVQRNLHNFLLIKAMKAHEDLLESLSSLFSSPNGCT

SEQ ID NO: 57043 - protein, 156 aa, Sorghum bicolor
  Clone ID: 30952743.pep
DQTRDITNNIIGTFGYMSPEYVMRGQYSTKSDVFSFGILVIEIVTGQKNAGHYFDEQNEDIISIVWKHWTEGTLTEIIDNSLGRNYSETEVLKCINIGLQCLQQSPMDRPTMSDVMVMLNDVDTISLPNAARPTFFLDASSDYSYTSGTISQPSAR

SEQ ID NO: 57044 - protein, 143 aa, Sorghum bicolor
  Clone ID: 30952745.pep
IQLAKHVYGASKVAATASTKKIELLKSLGVDVAIDYTKDSFEELTDKYDVVLDAVGQGDKAVKVVKEGGSVVVLTGAVSPPGFRFVVTSNGAVLEKLNPYLESGKVKPLIDPEGPFAFSQVVEAFSYLETGRATGKVVISPIP

SEQ ID NO: 57045 - protein, 141 aa, Sorghum bicolor
  Clone ID: 30952750.pep
RWPSSPAPAPAGTARRPRPSPAPSPSSNNKSSPAQLAAEYIAEAEKLPWLNLSSRVHSLPPKAPSCSSQGGCHLFFFCVFFIFSARAFLRFAIGTRSCDYERGFREPFRSAVGSRRGSDPTERSLTCALIWQRREMDENCM

SEQ ID NO: 57046 - protein, 191 aa, Sorghum bicolor
  Clone ID: 30952751.pep
GSVEEDEFWNVSFAGMQRVPLMFDDRPLFSEVLSSARDELKCNANEDDISVEGVLHYGKSGRIFRRLVPIASEAQWDKYVKTVMKNDFQCLDLVVRKLSNNLSIHGYASPNGRSPPHGLLPERDNLPISEPLLPNRKVDGEDVVVVPDAQSATDHPTQGAETRRRRPPSKYTPGTGALGHKGKVKRRLRSR

SEQ ID NO: 57047 - protein, 195 aa, Sorghum bicolor
  Clone ID: 30952761.pep
SGYEAYAWDPNYYAQYGANYGWDPSASANYADGTQYAAYAGGQSGGYAHSHGGEHGSGYEHVAAVPYGVDYTGGYGHEAAATTLPPVQEPVLPPEMGRIGGKRGRNDMPAQILEVNQAELMKNRPKQDKSKLTGLAFGPSYQPAPSAKGKPSKLHKRKHQIGSLYFDMQSKEMELAERRSKGILTKAETQAKYGW

SEQ ID NO: 57048 - protein, 100 aa, Sorghum bicolor
  Clone ID: 30952763.pep
WQETFFGAVVFCSPHYRIWQQQASLKGILVVMQQKWILFPSKAWVLVVKQLHNVYSEHAGLGRNRGTMPPQSCTFWLVERAISYQQIPFSRCNRCYETAI

SEQ ID NO: 57049 - protein, 253 aa, Sorghum bicolor
  Clone ID: 30952766.pep
IQSSNASRKNEGLVQQSINANQQKNGTSIRHSENFTTSAQRTAGGFPPALTTEEKFKAARPSSSTEAAPRKEGIGQRISNISILVQKRTENTNRDVAKKEVGTSSPLPPNPANAMHKGNGKVSRPVENTQASMQRFGSPSTSSAAGGVDRGTPRSSIPSPSITIRRPNGMVRMAENLSVSAKKPDAGGLSPAVGKEKEQVGRLLQANISNDQKLAMSKPPAVEKAADGRAERMEKVRDGAPDIAKKEDKKSDR

SEQ ID NO: 57050 - protein, 155 aa, Sorghum bicolor
  Clone ID: 30952788.pep
NEKGRLTKDEIDRMVHEAEMHKNEDDLQKKKIESKNALEQYCYSIKQTLKDDKIKEKLSGSDAENLEHLAEEGLKWIESNPNAEAEAYDSKRQEMENVFNPIITKIYQGGEDGQGQQGSEGSRGFPGGTTGTGASGFPGGTYASSSGGPRADEVD

SEQ ID NO: 57051 - protein, 77 aa, Sorghum bicolor
  Clone ID: 30952790.pep
EKKYVTGTVKSTIQCCFAIKSNLPAATDKLHLLSEQGVLGQLQLSAHQTTVASGFTLLGTSWGLQPGNGEIRREEHR

SEQ ID NO: 57052 - protein, 218 aa, Sorghum bicolor
  Clone ID: 30952826.pep
VEHSPRCKRVQMLRVVLTKSLRSKQGRNLISIQKARFSSSTVAKNTSTSLKATAISDDASFAVAAAPFDYEEVIDIKREYFGRALEEYKKKVEGPLINNYISQVTPKERKLMKQEILELAKQKKIIKQQQKEAAVKEKEENEHYKRNRGEDLKEIMTSQIPPLSEVFSSGAFEDALRRSPDVLKNINVEEYGEDPKFNRSIFETFNTAEQPPAMVVAA

SEQ ID NO: 57053 - protein, 55 aa, Sorghum bicolor
  Clone ID: 30952828.pep
MMKRCLFRGDIVSQQNDRHCSPITFCARAKKKKIMDACQFRPCLVSKKFLNFPSH

SEQ ID NO: 57054 - protein, 93 aa, Sorghum bicolor
  Clone ID: 30952844.pep
HHARDDVATIVAADSSQAAGEPVDLGLHLGEIGLQPRRRRGHPLGNGGKVVVDDEYRSCVSVHAAACWRIGLMGNWGTRVITRNSHFEFVVVM

SEQ ID NO: 57055 - protein, 104 aa, Sorghum bicolor
  Clone ID: 30952848.pep
MPAAAPTPKAVVHQRFGAKARYTVEEVREAVGGCPGLAPQTRSVYRCALDLPGLSDATPGTFLRKKDAEQAAAQIALDKLGIQPTANIPSTPQEAWDELIARIS

SEQ ID NO: 57056 - protein, 107 aa, Sorghum bicolor
  Clone ID: 30952857.pep
SLRSQIRAMEGASFFVREKKTKFAIPHNRCLICTVSLRNTHKKIEWKRLAVILEMKNWRHGVYYTIPPQEEATTCQRWIDETIKQIIIIGLNPLTPTQHQTQISLAT

SEQ ID NO: 57057 - protein, 169 aa, Sorghum bicolor
  unsure (1)..(169): unsure at all Xaa locations
  Clone ID: 30952861.pep
MRRAGGGDLQGDHGTTPRSAAAGQAMVELQANGSAAAAGGAMVVGLSPLSETLWRDSKALPPGAGPAALIGDVSARLTWKDLCVTVALGPGKTQTVLDELTGYAEPGSLTALMGPSGSGKSTLLDALAGRLGANAFLSGDVLLNGRKAKLSFGAAAYVTQDDXLIGTLT

SEQ ID NO: 57058 - protein, 178 aa, Sorghum bicolor
  Clone ID: 30952878.pep
AWVTVDNPMIPETIKKEKLFRRATLLVKVAALKLPKMVHSRLLEIVGSRYDPELDVLKITSTDHLQFAENRRYCLKLFQAALSDAWKADLNYVPAEEPIYPHQQVVRELHQEQERKKLNAEYGVEGVKNRTSQYPYVIFRYNPHTVPSDELMQQRQALLMRLLQVFGFSSAQKKKKKG

SEQ ID NO: 57059 - protein, 117 aa, Sorghum bicolor
  Clone ID: 30952887.pep
SQPVRPLLSSSSSSSSIPLLAAFPSLSLALGSHTHLINIASSLLLIHYILPDRDLALHPSPCRRRLYSCLIIYRSTSSSDLYLSQLIISPRIYIPIHLNLISVLNPIYTHIYRRIYL

SEQ ID NO: 57060 - protein, 171 aa, Sorghum bicolor
  Clone ID: 30952901.pep
RDGHDAREAERRGRRQGHLVGRGEVEEVVAGERRHRPRPAALSVGGVAEVEASAMAHEEMRREAPRTRRGVCRRIPPAGGQVPCVDGSITFGEASGDKNGRGWSRPRTEEERWYKYGKLDICVCVCPPARSVVVCEARKKERTGRPGVGGVTAWPSSGPWALSTWLARALK

SEQ ID NO: 57061 - protein, 118 aa, Sorghum bicolor
  unsure (1)..(118): unsure at all Xaa locations
  Clone ID: 30952906.pep
SRCSAISSSLPPPTPSPSPLPPPLEIAPARLPRPPRSCASSSCQRPCSPPPPPTPRPPSSSRPYRRSSSPRRSPSSPPPXPPRPALPPHPRRPRPLRPAWPVWTMGRPRRPPPDRRIA

SEQ ID NO: 57062 - protein, 115 aa, Sorghum bicolor
  Clone ID: 30952909.pep
MCVLGSIFEQSLRETLDLPRALKFAESILSGSRQTRNLPTVTLGEQILSANRSLHVVALAMSGARGGTRHVNSILGLLCREHFPGIVKFAGREEPAYTFAHYAAATDTQEGNVAN

SEQ ID NO: 57063 - protein, 115 aa, Sorghum bicolor
  Clone ID: 30952910.pep
EVFPHGCGHAPRGGVGANGGLRLRWSLAPQPLSNRWPHDPSALQEGVPQQPVMHPFHEPHHQFHHKSLTSLLPPGQIKSTRPTECRGARWNEGTETKTPLNWERQQRGTHGGAVC

SEQ ID NO: 57064 - protein, 100 aa, Sorghum bicolor
  Clone ID: 30952918.pep
HQERQYKLVHNIKLVFLFALTHHCITKLSVSLAQSNFRKREKKRVQQKEGKGSIATSMQQSYISKILYPLQSHATERKFEILSAPHFLAVEKRFRDTRDT

SEQ ID NO: 57065 - protein, 145 aa, Sorghum bicolor
  Clone ID: 30952926.pep
MFDELLRSTPASSAKIVTAARLSPAMAAALLASRLAPLPDPNHATTSSPALCVPPLRAAQTAAGAAHGRMAGSVWLVQVVVRALAPTLRVGHPAACRCAAGLVKSRPSPPFPVPSSCCFRSSNWPLRSRTGPKKKRGSSAVKITS

SEQ ID NO: 57066 - protein, 119 aa, Sorghum bicolor
  Clone ID: 30952927.pep
DGLPGTEANAAQSSTDGLPGPEANAAQSSTRGVERSALVALLSDPMSLPNHEQKNRRTNIRTNRNGSSHKINEIQLKSKELSPKLCTDEIHLGTNSSPKNHCLRLSQTPGNWDLSQERK

SEQ ID NO: 57067 - protein, 154 aa, Sorghum bicolor
  Clone ID: 30952932.pep
MAPPFACAMHSGRALLAAALLAASAAVTLTLLPSAAAQPWVGPWPTCDDTTGNYSAGSAYANNVKELIHNLQTNASNTPALFATGSVVGAGGADDAVYGLILCRGDLSLTDCFDCGTNAGQDVHRVCNGTRDAALVYNQCYVRISPTDFLATTN

SEQ ID NO: 57068 - protein, 195 aa, Sorghum bicolor
  Clone ID: 30952939.pep
IGGARGARTREQTWLMEMNAGGLDRNKDQTKESKLMEVNAGGLNRGKDLTKKRHWKDSVLMEVNTGVLGRGNEGKKRHRKDSEDGERKKIRKKNSEAESYKERGKRHMEAENYDWDNDKERGKRHMDHENKLNLRHGKDVKKEMSRKYDKHRHYGGHRREKGHLKEKDHVEEKGHSEDRDRHGERKGLGRKSESW

SEQ ID NO: 57069 - protein, 117 aa, Sorghum bicolor
  Clone ID: 30952948.pep
MAAAGAALRLRLLYRMLRVGELLALVAFLSWSSSRVPSAAAAALRLAGSLLLNARFVFVLGNAIVLLLLALSRHDLSASSSSSGQQTSTAAATSTSAAPPPQDAAPAAASDSFPSSF

SEQ ID NO: 57070 - protein, 186 aa, Sorghum bicolor
  Clone ID: 30952960.pep
MDIIGISSEEQEAIFRVVAAILHLGNVEFAEGDDGDSSKPKDEKSLFHLRTAAELFMCDDKALQDSLCQRIIVTRDENIVKTLDPEAAKGSRDALAKTVYSRLFDWLVNKINNSIGQDPNSKCLIGVLDIYGFESFKTNSFEQFCINLTNEKLQQHFNQHVFKMEQEEYTKEEINWSYIEFIDNQD

SEQ ID NO: 57071 - protein, 127 aa, Sorghum bicolor
  Clone ID: 30952963.pep
MAPMSSYEMAASILLCAEDSSSILDLEAEAEEEEVMLAPRSRTRTRGEPSVEFPVPSEECVDGFVEAEAAHMPREDYAERLRGGGMDLRVRMDAIDWIWKVHTYYGFGPLTACLAVNYLDRFLSLYQ

SEQ ID NO: 57072 - protein, 76 aa, Sorghum bicolor
  Clone ID: 30952965.pep
MPRSRFSDAMQPPMGNERPPPPPGRPVSAFVPGAAVPPPPFGAAAGGPFAPPPRQGVLPPPQSGATAPPFGAAPPA

SEQ ID NO: 57073 - protein, 91 aa, Sorghum bicolor
  Clone ID: 30952971.pep
PLAPTTPNPSAAGRPAGRRHALRPCTLASTPPNPSTTIVHHEVQKQHIDPPSSLSTHLSPILIFCCHPGSCFQPHRSEISCINNPSSSLAL

SEQ ID NO: 57074 - protein, 139 aa, Sorghum bicolor
  Clone ID: 30952972.pep
PPPPPPAAAGASAVAGAAAGSLVPRQGQPQACPPASHARRRRRNRGDLGPEFPSARGGSEDPIESGPPRDRDRIGRRDFLRFSSRLLPAACCCVVASRRSRVEEEGGGGGGEEGRRGGGLEHSTAPQERRGEGNGGGKP

SEQ ID NO: 57075 - protein, 74 aa, Sorghum bicolor
  Clone ID: 30952984.pep
KKKKKKKKKKKKKKKTLVSPPSAFANCKSPKFPTPGSSSLEPNPPQLSTVERKVLNLARGAAAAALKGVPFQGP

SEQ ID NO: 57076 - protein, 125 aa, Sorghum bicolor
  Clone ID: 30952991.pep
MARDDGGALVPAPAPAPAPAPAPGQVYLPEWRRAYDRLVKMLRQAYAQAEELCVEREHLITEIQFLESRRREREENFQARIQKMRKHEKLRKRVDEAETVVSLGGKDLQIHRYQKLAELAEDDLE

SEQ ID NO: 57077 - protein, 134 aa, Sorghum bicolor
  Clone ID: 30962912.pep
DHEKSADLVQESEPSVETAEPTGEEVSTQDASAEVDEEIADASVHVSSAEHSAEATLEHSTTLREVDEIVPVDETPILKEPERCGSARSLADCISTNEEEEWSALEGVTRVNSLLNLPRILSGDKRSTSWRKRR

SEQ ID NO: 57078 - protein, 160 aa, Sorghum bicolor
  Clone ID: 30962938.pep
EYLENGWISVSGPLMLIHAFPIIEKKGVTPNSIQQLESYPKLVQMVSKIFRLCNDSATHSEELKRGDAPSSIAIYMSENRATEHDARKAMRDLTMETWKTVNQDAFSNCRFPLPFANACVNMARISHCIYRGGGDGISAPDDEKVMEIKELFLQPFKVEN

SEQ ID NO: 57079 - protein, 98 aa, Sorghum bicolor
  Clone ID: 30962959.pep
TVEAVRRGGDVGGRCREVIFSIEPFSDQLLPSTSSSSAAATASVASGRCCCCMKRLQENKDIFIYLGEKAFCSSECRKGYIEEADEEVMMILDPARNL

SEQ ID NO: 57080 - protein, 83 aa, Sorghum bicolor
  Clone ID: 30962970.pep
EDVTGLRLVDADAFPRFHAWLRDFEALDEVRDTIPAVDRLLDYARGLRHMLLGLAGAGAAAAPSAPDAPTTAAAPAADIAVDI

SEQ ID NO: 57081 - protein, 201 aa, Sorghum bicolor
  unsure (1)..(201): unsure at all Xaa locations
  Clone ID: 30963013.pep
MASPELAAGDGSYDFHLRSLSAASRDSAAAFDPASDPNLLQSVRRVCEMCRTAKEAKDEMVARAFPVMGKLFQRCAAAPTQAVASTGVLLLTILQFFLDFGEAVLHDADGSLKTFFRSCLSREFADPIVAECTVEFLVTNKTKILSSFPNLIPQFYPLLLKLVASNGEXLVVALEKVERSSGTLIGSSIATIQKSAAPEML

SEQ ID NO: 57082 - protein, 218 aa, Sorghum bicolor
  Clone ID: 30963014.pep
TQQGRKGTNQDAMVVWESFDSSESIFCGVFDGHGPYGHFVAKKVRDSLPVKLRTQWQTSANGGSSPHQNGSISGSINSEETGSIVDDEWGDGDDTEKLPEMFLPLKESYLKAFKLMDKELKLHPTVDCFCSGSTAVTLVKQGLDLVIGNLGDSRAIMGTRDASNNLTALQLTVDLKPNLPREAARIQQCKGRVFALQDEPEVARVWLPNNDSPGLAMA

SEQ ID NO: 57083 - protein, 54 aa, Sorghum bicolor
  Clone ID: 30963026.pep
STTTLLLNSCNCASYGLLDSKKKHVPYYLAMETVRHEQVKVSIWFPPTTSFPVC

SEQ ID NO: 57084 - protein, 115 aa, Sorghum bicolor
  Clone ID: 30963037.pep
SICSTCLPKQNQGKEPDLGTGRVAPSRSALQAAAGLLGVWDSGRVGRRGKWLLGGGSAGRPPPRRRKLEEEVADYAVRRLGRRPTGARRAPSSPGAWSRSRGESQEVARRDSNRG

SEQ ID NO: 57085 - protein, 134 aa, Sorghum bicolor
  unsure (1)..(134): unsure at all Xaa locations
  Clone ID: 30963045.pep
YMHIGSACTVRGAAMATTPKWVQQQQQQQPCAPAARRAAGYTVVRCSSLPEGPAPQLQLPPPIXRSANYQPNSWNYDSLESSLAGCNKRNREGDPSSFDKLKFRVRHLLLQQEVEILTKLRVIDTVQRLGVAYH

SEQ ID NO: 57086 - protein, 118 aa, Sorghum bicolor
  Clone ID: 30963047.pep
MRTRGVPGRGRASRGGTPRWPAPATASSPPTPGTAGGAGGGATATAPAPTAAATACPTRTQTRQSCSSSSPARPAATPAATAPPPPPRPRTAAPVSGCSPAAAAVVPRAPATPSLPGS

SEQ ID NO: 57087 - protein, 208 aa, Sorghum bicolor
  Clone ID: 30963055.pep
WIKSDIWSLGCCMFEILAHRPAFKATDMAALVNKINRSSISPMPPIYSSALKQIVKSMLRKNPEHRPTAGELLRHPHLQPYLAESCSCSPIYLPVKPNKSNLVDKQSKKPSSGRKRTVKANGSNETLDTAAEHTVEARDSSTNFSDVSTIGTQEALILQMPVDLDARSKEQQNSDVLSIQHAAENLMATTDQQINATIRLAIRTSNVK

SEQ ID NO: 57088 - protein, 153 aa, Sorghum bicolor
  Clone ID: 30963068.pep
MVESSGHRSATAPTAVGFFRVPGLFVRLSSSKGGGVSNAVDADSVWSPTSPLDLKNHLRSSPPRVGLGLVDALTADDETGCSMHFGGRSSFLDSIKPFLDLALPKAAAAPVCGNKAAAAAPASSAGGVAARVDEVNEYPYADCEEYTCVISRG

SEQ ID NO: 57089 - protein, 151 aa, Sorghum bicolor
  Clone ID: 30963075.pep
GGGGSEKQDWIVSFDLETERWRPNIRGPQGLIIHNGLVVEKNLSLVNLNGSLVIVHVRYPCMDLWCLLDFDKGHWVRQHSISIKACICHSLLSFTPLIVLDDGRIVIHINGLGLGMFKIYDPKINKVSSVVETGLSSAVSVYTGTLLSLEW

SEQ ID NO: 57090 - protein, 62 aa, Sorghum bicolor
  Clone ID: 30963085.pep
VKLGGLIVFAFATAFILLMMETLSAFLHALRLHWVEFMNKFYHGDGYKFKPFSFALLADDED

SEQ ID NO: 57091 - protein, 138 aa, Sorghum bicolor
  Clone ID: 30963087.pep
QVERVRQRISAERVRMRSALLGPTGSGLPGGSSTMPSNPAGMSPRPIGVPGSMPQTSMAATYANNMQGHGHPPMPQMPFLHQRPQMLSFGPRLPLSAIQTQPSPQASNIMFNSGMPNSIAPNHHQLLRSSSGNNSSAG

SEQ ID NO: 57092 - protein, 54 aa, Sorghum bicolor
  Clone ID: 30963090.pep
AMAELKVLLALVLSRFHISLSPAYVHSPALRLIVEPEHGVRLVLRNVEPSPGAS

SEQ ID NO: 57093 - protein, 143 aa, Sorghum bicolor
  Clone ID: 30963104.pep
ALVTVAYFRDRYSAKKHIRYRLVQAIIVGSTVAAIVVLLEFTKFQFVDTFTSLLAFLPTGWGIVSIALVFKPYLRRSEMVWKTVVTVARLYDILFGVIVMAPVAVLSWLPGLQEMQTRILFNEAFSRGLHISQIITGKKAHTF

SEQ ID NO: 57094 - protein, 94 aa, Sorghum bicolor
  Clone ID: 30963112.pep
KKRKKGKLPKDARSALMDWWNTHYRWPYPTEEDKVRLAAMTGLDPKQINNWFINQRKRHWKPSEDMRFALMEGVTGGGSSSGTTLYFDTGTIGP

SEQ ID NO: 57095 - protein, 61 aa, Sorghum bicolor
  Clone ID: 30963114.pep
RIVCHCRILCHHRSLCSNQDRSAHQGTKGVSRSPPSSYHKNHHSSPPQRTTYLHLLMKGRA

SEQ ID NO: 57096 - protein, 150 aa, Sorghum bicolor
  Clone ID: 30963123.pep
VLHADAIHRGGGQIIPTARRAIYAAQLTAMPRLMEPVYLVEIQAPERATGSIYSLLNKKRGSVIEERQRPGTPLINFKAYLPVTESLEFSEKLRAETSSEAFPQCVVDHWEAINSDPLEEGSMAAKLIAGIRKRKGLKNMIPLSEFEDRL

SEQ ID NO: 57097 - protein, 108 aa, Sorghum bicolor
  Clone ID: 30963128.pep
ATIGWVGGYAVPIFARMVMREDDFRPGPFYLGRASRPVCLVAFLWICYTCSVFLLPTVYPIKMDTFNYAPIALGVVLGLIMLWWLLDARKWFKGPVRNIDEHNNGSKV

SEQ ID NO: 57098 - protein, 115 aa, Sorghum bicolor
  Clone ID: 30963132.pep
RQRGPVFVTAFNPLCMIITAIMGSIILKEEITRGSVIGAAIIVLGLYALIWGKSKDEVNQVADVSASGGCGSKGGELPITLAQPNGNGKHELGSGRGVVFDVETPAANGHSSSYS

SEQ ID NO: 57099 - protein, 172 aa, Sorghum bicolor
  Clone ID: 30963147.pep
LQLQQAVIMASLSADLFYDILKRLDAAALARAGCACADFRAISNEEDLWENACTSLWPSTRQDDVRSLIVSVGGFRKFYADCFTLILNKDVPVVQTNESNFFAEEWAESDYYYYDDMDELETSLPSDFVSLIDVWYKDRALYSKVIWGIPNSDSANGWFYNYPFRIDLFQHS

SEQ ID NO: 57100 - protein, 175 aa, Sorghum bicolor
  Clone ID: 30963148.pep
MAGGERDDAVAMDSGEKRLNELGYKQELRREMTLFKTLAISFSTMTLFTGITPLYGSSLQYAGPAPLVWGWVVVSFFTWFVGIAMAEICSSFPTTGSLYFWAAHLAGPVWGPLASWCCAWLEAIGLIAGIGTQAYAGSQVLQSIILLCTGTNTGGGYLAPRWLFLVMYIGLTLIW

SEQ ID NO: 57101 - protein, 217 aa, Sorghum bicolor
  Clone ID: 30963153.pep
VGKALNDVKPYLAMILLQVGFAGMYIVAVASLKRGMSHFVLVVHRNLFATAVMAPFALWFERKSRPRMTIKIFLKIMGLTLLEPVLDQNLYFMGANLTSAGFASALINILPAVTFVMALVLRMEKVRLRSVHSQAKIVGTVLTVAGAVLMILYHGPVVQFPWSKGHHHDAGAQGAASSGSFLTGIITIIVACVCWSAFFVLQANTLKSYPAELSLTT

SEQ ID NO: 57102 - protein, 172 aa, Sorghum bicolor
  Clone ID: 30963174.pep
MASSSEPFAGQGRRVEPVRAATNIGALPLDALYDILLRLPAKELCRLRLVCRSWRALLSDAAFAAAHAARYPEPLILVGYNNDPVLESSGDWKYQGVISVMDLSGHVVKNLRVDGHITNMSLHLACVKKTGDGSCRCRLVNPATGAVHHVPRKDPAYDGYSYSLCPFGQVAS

SEQ ID NO: 57103 - protein, 215 aa, Sorghum bicolor
  Clone ID: 30963184.pep
PCWRRWCPIFAKSQIKDCLQRATLHSNSQVGTIFHEMDTIESPPTYFRTDKFTNAFQEIVDAYGVARYQEANPAVYSVVTFPFLFAVMFGDWGHGICLLLGALVLIVREKRLSSQKLSSFMELAFGGRYVILLMAIFSIYCGLIYNEFFSVPFHIFGKSAYECRDKSCSDAHTIGLIKVRDPYPFGVDPSWRGSRSELPFLNSLKMKMSILMGVA

SEQ ID NO: 57104 - protein, 224 aa, Sorghum bicolor
  Clone ID: 30963186.pep
LLFQRVDGDNDGSENDSDKWTDEETLLLLEGIEKYNDNWDDIASHVGTKSKAQCIYHFIQLPVEDGLLENVEIPNVPIPFRPQSNGYQHSDSNGSTSGAPVQNIQQGNQLPFINSSNPVMSLVAFLASSIGPRVAASCAHAALSFLTRDDDSRVSSEGMHADGMGNGANPNFRNHYGASPSISPENVKHAAMFGLSAAAMKSKLFADQEEREVQRLAATVINHQ

SEQ ID NO: 57105 - protein, 186 aa, Sorghum bicolor
  Clone ID: 30963191.pep
LPYSIGSMVFLHASRADVVRDLGRCGTSLDLGKSSYMKVTHRPLFGDGILKSSGEAWAHQRSLIAPEFCPNKVKGMVDLMVGSATALVASWEDRISSGGGGGGAELELKIDDDIRAYSADVISRTCFGSSYVKGKRIFAAIRELQKAVSKPNLLAEMTGLSFLPTRTNTEAWRLNRVVRDLVLDVV

SEQ ID NO: 57106 - protein, 137 aa, Sorghum bicolor
  Clone ID: 30963204.pep
MALSRRLLPLFLRRGARVPARALSTAAAPAAVSSEGEDEEAITVKGVRISGRPLYMDMQATTPVDPRVLDAMLPFYLSRYGNPHSRTHLYGWESDAAVEDARARVASLVGADPREIFFTSGATECNNIAVKGVMRFY

SEQ ID NO: 57107 - protein, 223 aa, Sorghum bicolor
  unsure (1)..(223): unsure at all Xaa locations
  Clone ID: 30963209.pep
YWFRMLSFFYTTVGFYFXTMMVVLTVYAFVWGRFYLALSGLEDYISMNTSSSNNAALGAVLNQQFVIQLGLFTALPMIIENSLEHGFLTAAWDFMKMQLQFASVFYTFSMGTKTHYYGRTILHGGAKYRATGRGFVVEHKKFAENYRLYARSHFIKAIELGVILTLYASYGSASGNTLVYILLTLSSWFLVSSWILAPFIFNPSGFDWLKNFNDFEDFLNWIW

SEQ ID NO: 57108 - protein, 95 aa, Sorghum bicolor
  Clone ID: 30963216.pep
QQQQQQGLQCKRQLLVPLPPMISPTFSCSCLPLFFFCASCRRFFLFFFVFLELPASTHAPRTRQINYTEPSGVFFYYYFVPAILFLLYGCVHRCM

SEQ ID NO: 57109 - protein, 151 aa, Sorghum bicolor
  Clone ID: 30963222.pep
MAALLALVVLLLSGGGAAGDDVAALLEFKKGIADRDRDRVLGSWSPPATTESGSGGGGCPASWRGVVCDGDAVVGVALDGLGLAGELKLGTLSGMRALQNLSLAGNAFSGRLPPGIGSLSSLRHLDLSGNRFYGPIPGRLANLSSLVHLNL

SEQ ID NO: 57110 - protein, 168 aa, Sorghum bicolor
  Clone ID: 30963230.pep
MVKVTAGQLRASMNEKHNIRNISVIAHVDHGKSTLTDSLVAAAGIIAQDAAGGVRMTDTRADEAERGITIESTGISLYYEMGAARFGGGTSSYLINLVDSPGHVDFSSEVTAALRITDGALVVVDCIEGVCVQTETVLRQALAERIKPVLVVNKMDRCFLELQQNGEE

SEQ ID NO: 57111 - protein, 85 aa, Sorghum bicolor
  Clone ID: 30963234.pep
VAWLVDACMGTAVPARVDGEGVVERGEVHRSVEMVMGDDGEAAPAAIRAQAGRWREVSRQAVARGGTSERNLRAFALGTAAVTDP

SEQ ID NO: 57112 - protein, 104 aa, Sorghum bicolor
  Clone ID: 30963248.pep
GKAPSKIVASYQTTKGETKTSLLLTSGWWGLSRHFHYVPEILSAFFWTVPALFNHFLPYFYVIFLTILLFDRAKRDDDRCSSKYGKYWKTYCNKVPYRVIPGIY

SEQ ID NO: 57113 - protein, 76 aa, Sorghum bicolor
  Clone ID: 30963260.pep
RLGAPGIWAGMLCGTALQTAILLLLIWRTDWEAEAALAKERISAWSGECRHVDVVKQQQGDTGSDSDSDLKANLRV

SEQ ID NO: 57114 - protein, 75 aa, Sorghum bicolor
  Clone ID: 30963262.pep
CPRHPKYHTPYSSLRALNCLIRSCCSRCIDGKQRQQSSPATGKRRSLGAKPFIYRVCECKKIHTNDTINIYLARG

SEQ ID NO: 57115 - protein, 59 aa, Sorghum bicolor
  Clone ID: 30963274.pep
KKKSRKKMCRHLGQNTVDLRTFVFNCRNASFGSVSVWWSYIGRSLGSGFLSKKKSKSKL

SEQ ID NO: 57116 - protein, 146 aa, Sorghum bicolor
  Clone ID: 30963281.pep
LKWGPGTERHWGLFYPNGSAVYEVDLTGRRRSLPSYPPLPPASNDRPYPGPLWCVVATDKGPVNETAVRAQVAAACADVPGLCDPVRPGGSCFLPDTVSAHASYVFSAHWNRFSEDYGGCYFAGFAVETTVDPSHGSCKFPSILLK

SEQ ID NO: 57117 - protein, 113 aa, Sorghum bicolor
  Clone ID: 30963286.pep
SQMEELKADLSKAKKGKPLGYDKEGKQKRNLAPEAIEKKIAMVEGKIDKMEMDKKIKEDLKTVALGTSKINYLDPRITVAWCKRHEVPIEKIFNKSLIAKFGWAMDVDPDFRF

SEQ ID NO: 57118 - protein, 217 aa, Sorghum bicolor
  Clone ID: 30963329.pep
ASSKFNAVPYLANLSFLAVYVRASPACKSTWTCFSAEAFRGVPDFLKLAVPSAVMVCMEWWSFELLVLLSGLLPNPKLETAVLSICLNTSSLAFMAPLGLGAAVSTRVSNELGAGRPQAARLAARVVVLLALIVGMSEGLVMVLVRDLWGYAYSNEEEVARYTARMMPVLAVSVMLDSQQCVLSGVVRGSGRQKTGAFINLAAYYLAGIPAALAFAF

SEQ ID NO: 57119 - protein, 154 aa, Sorghum bicolor
  Clone ID: 30963347.pep
MPPKPAKPPPAAEFEYCELCRHHHDHGRRHRYVTKHRRNLDAALSSFRSKLSDLRRAFLHGSPSSQPPRVRLWCPFCSTDLVDLDSRSAGKNGIYHLASSEHLKGVKDFLRKHGGGMDQVDSLRISDDVLAKWEKGSDSLSTGTKKGTEGLIGP

SEQ ID NO: 57120 - protein, 55 aa, Sorghum bicolor
  Clone ID: 30963363.pep
SFCSASLLRSTRLSWLLLAQRSSLLSGLLVSSTTGSGCSARNGLPIDRNPATPDP

SEQ ID NO: 57121 - protein, 188 aa, Sorghum bicolor
  Clone ID: 30963370.pep
MATPLHLLLVLAAIVTAATPSCVAAAASSAASTAEHILGVNYGTLGDNLPLPQRGLELTRSAGASAVRFYDANATMLAAAAASGLEFVPSVPNELIPSLAASQRAADAWVATTLLPFRGNPRLRYLFVGNEVLSDPTARSRWPRLVPAMANVHRALHRHGLGSVKVSTTFSMHELEGQNVFPPSAGAF

SEQ ID NO: 57122 - protein, 50 aa, Sorghum bicolor
  Clone ID: 30963395.pep
KLQITKAVSGVLYFGYMLIASYAFFVLTGTIGFYACFWFTRLIYSSVKID

SEQ ID NO: 57123 - protein, 101 aa, Sorghum bicolor
  Clone ID: 30963417.pep
AYVAQLARQCPQAGGDPLVAMDYVSPNAFDEGFYKGVMANRGLLSSDQALLSDKNTAVQVVTYANDPATFQSDFAAAMVKMGTVGVLTGASGKIRANCRVA

SEQ ID NO: 57124 - protein, 125 aa, Sorghum bicolor
  Clone ID: 30963420.pep
VLSLQSPHGQRPVSASSAERERNSAWRSRELRYQFSSPGVQSQADNSREWPRRSVHERLSSVEDGVGSAERRPWMEHRQISLINRTLNNDMNSLSLTSRESGDQSRASARTLYNKPRRTRVILED

SEQ ID NO: 57125 - protein, 171 aa, Sorghum bicolor
  Clone ID: 30963432.pep
DRPDADAAGGDAADAAVGRCWARQRPRRAGRDAGRQLVARQPRHGRRVVRAVVAAGAPGLAPRSAPAGRPAAAAAGAIVPGYQPTPSQVCEAKVLVKERSGRARHGAPAQSEAVRSASRRADADAELPCPDGMEGVVVGVARRGAVPPPVRAGFVRGDDMISFDQDRITPL

SEQ ID NO: 57126 - protein, 161 aa, Sorghum bicolor
  Clone ID: 30963458.pep
CFVRSLHASYQLARVCAIANLFSSLSAGTRHSHRIHTHNTYIHTHGNSRRRPGHSSLSCSCSSAAGTRRRAAGRRRGGGRAAAAPQGRATPVRARHHYEAPRSLRPAALRPSITRRRRAATTQQLRVVPRHRPGPAARAGGARRRPGRAGRGLQGLRHLPG

SEQ ID NO: 57127 - protein, 172 aa, Sorghum bicolor
  Clone ID: 30963479.pep
MEHDAHAVPPSEDATVDDWARDDAEPMSVESGVAPAELAAADSGADAPHAPSPSAAVAAEGVKEIQSSLQSLDLKTNVATQEDAHVVEDDVDETKRHLNVVFIGHVDAGKSTTGGQILFLSGQVDDRTIQKYEKEAKDKSRESWYMAYIMDTNEEERVKGKTVEVGRAHFET

SEQ ID NO: 57128 - protein, 195 aa, Sorghum bicolor
  unsure (1)..(195): unsure at all Xaa locations
  Clone ID: 30963480.pep
MATTHPALLFLLVLACTGAASGFYLPGVAPADFRKNDLLAVKVNQLSSVKTQLPYSYYSLPFCRPDTISSSAENLGQVLRGDRIWNSPYLFEMMEPKLCQITCXIVLTEQEANDIKEKIEDEYRVNMILDNLPMVVPITMLDRNAPPYYQQGVHVGVKGMYAGSKDVMYFIYDHYSFLVKYNKEAQTDLARIVAF

SEQ ID NO: 57129 - protein, 165 aa, Sorghum bicolor
  Clone ID: 30963499.pep
NLFPRTPSPPPSTRAQRRRRPPSSSTSSPLASQHAGQASTPAHRPRRCQGATAPPGCGAAPYVGLGGGRHQSWPPPRSSPPLASRCIGLSTSSPVTSSYVLLGAAGRRFFVFVNGDASLCSASGSGGGHHQAFAGGEHPPGTHIPSLPCLLCSTQHSNPSLIHSY

SEQ ID NO: 57130 - protein, 203 aa, Sorghum bicolor
  Clone ID: 30963506.pep
MAVQRMEVLYLQVAAVAALLMATELRAQLRVGFYDNSCPAAEIIVQQEVSTAVAANPGIAAGLLRLHFHDCFVGGCDASVLIDSTKGNTAEKDAGPNTSLRGFEVIDRIKARVEQACFGVVSCADILAFAARDSVALAGGNAYQVPAGRRDGSTSRASDTNGNLPPPTANVAQLTKIFGNKGLTQKEMVILSGAHTIGSSHCS

SEQ ID NO: 57131 - protein, 127 aa, Sorghum bicolor
  Clone ID: 30963509.pep
WAAPWASPPRPPRPHPRQPRPPRRPPPPRRARPPAPCPPTTSSASQPAPAPARVGADPNPNRSARKEGSAGAPDPSPTLTAQSDRPAAAATAAAATPLLGGAGSRRGRGARRRRKGRGRRRGRGARW

SEQ ID NO: 57132 - protein, 107 aa, Sorghum bicolor
  Clone ID: 30963520.pep
KMHSLSMKEDNFTCFVTEEILMREVEDGGAVNIQERPLLMVEKVEKLPGYHPCCWGIHFKAYIMHGQDASKETKEATTKTTESHKKIKSGHEEDVGEEDPPRAAQWA

SEQ ID NO: 57133 - protein, 111 aa, Sorghum bicolor
  Clone ID: 30963533.pep
DTFNTAVVSPIYYAMFTTLTILASAIMFKDWSGQRASNIASEICGFLTVLAGTVVLHSTREPDQTVSADLYAPLPPKIYWHIQGNGDVGKQREDDPLTCEFITVVRQDYFV

SEQ ID NO: 57134 - protein, 195 aa, Sorghum bicolor
  Clone ID: 30963539.pep
DSGECDPRAMVFPGDDGEEEERMGWKADMDVDSSRQLSPVSVLDLHSDDDDESPVHSHWGDEKPSTSGSSPPSESFLGPASPCFSYNLHDKFCEMEVDDEADEETTVRNGSRSIEEQISSWEKIAGDIPRIPAMMELDLSRSARQWREPRPEVREIGARVETLIFDDIRREAVCDMLASHCRLAAGAAATSCCSG

SEQ ID NO: 57135 - protein, 159 aa, Sorghum bicolor
  Clone ID: 30963571.pep
MLLQKEKGSRPWRDKVFLESDYYFEGYWAEIVGRLGNMTERYEAMERRPGAAALRRRHAEREHAEYAAARDAALAGAGLAETGVHGWRRPFVTHFTGCQPCSGQRNEHYSGDSCDQGMRRALNFADDQVLRAYGFRHAGPLSDDVEPLPFDYPAKAVTS

SEQ ID NO: 57136 - protein, 184 aa, Sorghum bicolor
  Clone ID: 30963593.pep
RERRAESTRCRRALRRRSRRGSATRSSSPRAPWWPPWRCSRSPTRSFSLRVTTATQQPCPPALLAHHPRVGGGAARTFYDDPALAYTVDRPITGWDEKRAGWLRAHPELAGGGEERVLMVSGSQPTPCRSPGGDHTLMRLLKNKADYCRLHGVQLLSNMALLRPSMDRYWAKIPVIRAAMVAHP

SEQ ID NO: 57137 - protein, 63 aa, Sorghum bicolor
  Clone ID: 30963600.pep
HSMKYAPSASASNEGASTSGAASQTASGVLSGSGVLNLRPGSTTSSGPLAQMFSSMSADVARE

SEQ ID NO: 57138 - protein, 159 aa, Sorghum bicolor
  Clone ID: 30963620.pep
ACRLRVVSSSTGEVAQELDLTVQPKRRGCNEIRCVRRELLVQALEEELPRGTIRYSSRIVSIEEDGDLKVLQLADGSELRAKVLIGCDGINSVVAKWLGLAEPTYSGRMAARGLARFPDGHGFEPKFLQFNGRGLRSGMRPCNDTDIYWFFSWTPTENG

SEQ ID NO: 57139 - protein, 103 aa, Sorghum bicolor
  Clone ID: 30963637.pep
MAAARRLSELLQEQQEPFLVEAARGRRPRRGRGSSASGAAAAAAAAAGGGGTGCCPAVACRRLLRLCNHGIKKRSSPGGVASGLRSALSKVLGSRAMRRVLRW

SEQ ID NO: 57140 - protein, 115 aa, Sorghum bicolor
  Clone ID: 30963666.pep
EYLIKTLPGWHVEDFLVDEAAAGAATNIAGVSADASYQGGLARIGGLQDGYGYSAWMAPEQLFYEDSSAAGGARGIREQWVPQMAMYSSSTGLSVAGAGSKRSRATSAASSYSYW

SEQ ID NO: 57141 - protein, 43 aa, Sorghum bicolor
  Clone ID: 30963707.pep
TCGLCYELLVYVELYVRFVISMWICDICGLRYVSCVIYMWIVI

SEQ ID NO: 57142 - protein, 104 aa, Sorghum bicolor
  Clone ID: 30963714.pep
RRENRELKLEISRMRVRLTELEREQGLMKQQGRMRGGDGGGRHGGEQGRAFLASLSRGFGRITMFGVGGGPAAADRRRKKSGGRSSQCSDGKARRRHKASFAYD

SEQ ID NO: 57143 - protein, 72 aa, Sorghum bicolor
  Clone ID: 30963720.pep
ISVEHAREYGHTHLYEYLPLETQIASQSDKLGNKAILLIHFSARYTTEEIDAAINRLPPSFRSRVYALKEGF

SEQ ID NO: 57144 - protein, 46 aa, Sorghum bicolor
  Clone ID: 30963737.pep
KYFFITGTIYSVCAKHSLCLVKKIIDSRAWHDPLFPVSVKRFYLFR

SEQ ID NO: 57145 - protein, 170 aa, Sorghum bicolor
  Clone ID: 30963741.pep
FVRETLFCNPSPITIYPLPGSHSNHSRSSPRTPLPIPAPCGRTRRCSPSPDLVSLPQHHPLPCRGSPHLQIPCPALPRTAEDAQLVDPGTAAFVPPPAPSVEPPSVGARESAYPTPATLARGRRSRSSWIQRQRRATARVNPPSPLCLSHLASRALGKRQRRSSGGDNGG

SEQ ID NO: 57146 - protein, 127 aa, Sorghum bicolor
  Clone ID: 30963743.pep
MAKSGESTVEVASSSSSPLTPASASATRPKAKHRMEIEGYPVDGVSIGGQETCVIFPTLSLAFDIGRCPQRAVSQEFLFVSHGHLDHIGGLPMYVATRGLFRLRAPTIFVPACLRELVERLFEVHRA

SEQ ID NO: 57147 - protein, 191 aa, Sorghum bicolor
  unsure (1)..(191): unsure at all Xaa locations
  Clone ID: 30963763.pep
MSTSSEQRHCAATAAATVVINPRAAAGGVPDPDADHATHLAAAEAQAAASTTNLLRAGMERQPRGSRSPTRRHASSPSPECSRGRGGCHGSPAAIQTTYKDSSVGAPWSMLTRTDYHEWRLLMKVKMQARXVMSYHDDQRALEAILTAIPLEIGAPLADXVSTKEAWDSIAATYINIDRVRQATLHWLCRD

SEQ ID NO: 57148 - protein, 140 aa, Sorghum bicolor
  Clone ID: 30963769.pep
MKVQCDVCAAEAASVFCCADEAALCDACDRRVHRANKLAGKHRRFSLLNPAPPSSSGSGSPAQQQAQPPLCDICQEKRGLLFCKEDRAILCRDCDVSVHTASELTMRHTRFLLTGVRLSAEPAACPAPPPPPSGSEDENS

SEQ ID NO: 57149 - protein, 220 aa, Sorghum bicolor
  Clone ID: 30963790.pep
VGLLEDEESKMIKGPGGYMRGRGKVKITDVVEAASLAASGQPFEVVYYPRASTPEFVVKAASVQNAMRNQWCPGMRFKMAFETEDSSRISWFMGTIASAQVADPIRWPNSPWRLLQVTWDEPDLLQNVKCVNPWLVEIVSSIPPIHLGPFSPPRKKLRMPQHPDFPFDGQLLNPIFHGNPLGPSNSALRCFSDIAPAGIQGAWHAQFGLPLTDHQLSKLH

SEQ ID NO: 57150 - protein, 214 aa, Sorghum bicolor
  unsure (1)..(214): unsure at all Xaa locations
  Clone ID: 30963816.pep
IAHTHHTPARRRRRTPSATAAAAPHPPPPLTRSGATGPHSPCPWPAPPHAPHSAAASPRTAAASPHPHGRRFAYATYELLLSPDRIELLLSGRCVSLLLWLEERYEVVYSRHPEFQAGTRPLLALDNPFPTTLPENLFGDKWAFVQLPFSAVREEVESLXGGTRLDLDLLGFELDDSTLVPGVAVESSRAKPLAEQDLSEGTRSTLGRCELSTP

SEQ ID NO: 57151 - protein, 120 aa, Sorghum bicolor
  Clone ID: 30963818.pep
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVK

SEQ ID NO: 57152 - protein, 144 aa, Sorghum bicolor
  Clone ID: 30963824.pep
MGMGSDAAAVLFPFSTTTTTTTSPRLCGTAVSSHRRIFSDVAEDVTVSVDGQSFLLHKFPLVSRCGRVRKMVVDSKDPDLLKLELVNVPGGAFAFELAAKFCYGSNFEITTGNVAHLRCVAEYLEMTEDYQEENLIFRTETYLN

SEQ ID NO: 57153 - protein, 119 aa, Sorghum bicolor
  Clone ID: 30963830.pep
KAGNLFFAEVSQIEGEGAWKVTCCCIIDSNENGQCNTCRNDGCPDMKHPNNTGAYTAGRLNGYFQYGEGELSESDDDDVEAETVRLRVLLKDLDDPDAMKRIYLRAVQRLRSSGSDAQV

SEQ ID NO: 57154 - protein, 89 aa, Sorghum bicolor
  Clone ID: 30963854.pep
SVSLAAWLCGLGSSSSGSQKNSWKNLFSYIYGMDFSISVTYIDPDKFETDLQTGAQYKYVVWLLLLSRISTCMLFSSFFLFRMPFLSSF

SEQ ID NO: 57155 - protein, 159 aa, Sorghum bicolor
  Clone ID: 30963868.pep
LKKQWLREQELIKNAPLSITYSYWDGTGHRRVIQVRKGDSIGEFLRAVQQQLAPEFREVRTTSVENLLYVKEDLIIPHQHSFYELIINKARGKSGPLFHFDVHEDVRTIADATKEKDESHAGKVVERHWYEKNKHIFPASRWEIYDPTKKWERYTIHGD

SEQ ID NO: 57156 - protein, 130 aa, Sorghum bicolor
  Clone ID: 30963890.pep
ESGSANNNRGENGSALTEADEEEAMELLESLTDEKQVPSSSSSAQEPHQLYPPGKILHMVGLPAAEEATTSQQGAQEEVVALYETPRHLYSKIRLARSMIGEHYMPKYIKTMEQLIDKLAEDIDDQLDSL

SEQ ID NO: 57157 - protein, 43 aa, Sorghum bicolor
  Clone ID: 30963898.pep
LKNDISINGPFPPHEFEQCRRPSRNEPSNRELSAKLPIFSEDI

SEQ ID NO: 57158 - protein, 103 aa, Sorghum bicolor
  unsure (1)..(103): unsure at all Xaa locations
  Clone ID: 30963916.pep
CKQAIPCLSKAMEQFPEYEVKIIGHSMGAAIATILTYILRENEKLSSSTCIAFGPAACMTWDLAESGKXLVTTIVNRNDVVPSLGIVSAAKLRIEVPLGQFIC

SEQ ID NO: 57159 - protein, 221 aa, Sorghum bicolor
  Clone ID: 30963935.pep
CRRTAMPQPPPYLEATGTRPYGQIRIPSGLVISVFRAPDGRLYTDDPDLGGPFRHSRRLLSAIYCRFGCQPQLEVTQDGSPSPALAEDPLPLPPPPPPPSDKLLVVSVAESASALTLQEPEVSSSEALLDFVSSEEFDSDDSTDEEESVDDLSLGPKILIRDPPKWYQVYFIRTDRSGLFHMYPDLGGPFQSLDEVDCAISHHLAELQSRSVLKEPETHST

SEQ ID NO: 57160 - protein, 159 aa, Sorghum bicolor
  Clone ID: 30963959.pep
QSIKAAQMCGKMEHMHMEHKGILGGEFKEGICASIPKPPPSTSSRPNSMVVKKVCPREFIPAHIIAEAISTLHGLDLRWSGPITPSERQYVEQYVLAMYPQYSHGLIEDGSCDKDDLYSTYYGNGSTASSPEAGGSERRRSSPVGSPSSAAARPDMVDM

SEQ ID NO: 57161 - protein, 64 aa, Sorghum bicolor
  Clone ID: 30964001.pep
ADVSCQTIQLALTTLLLSGCRWSRPVGATSTTSELLHPLLEELWIITTLLILLPVRIAFFKSPF

SEQ ID NO: 57162 - protein, 138 aa, Sorghum bicolor
  Clone ID: 30964014.pep
KINVTDVIMEDRGDGELEKQTVQMPSDVQQISKGDEDHQSIKRNSPLTGDRIAKHKQTSTFIGGTSNWDPYCKGVSLSSLRLSDLPDPPTIVKMSSQEDAQPMTESSNAEVNTSSAVAAGESDESQEIGSPKSLKDAS

SEQ ID NO: 57163 - protein, 115 aa, Sorghum bicolor
  Clone ID: 30964024.pep
GARPRELVHPCTDHPNPRRKYLGVGVINGINQTHFTFRYSWVAVPSLVHQPYEQKPPPILLVVYTEMATVCSFEIRHQNFNSASNRHLFTTFKTGNRMTTSCTVERLQTRVPCDI

SEQ ID NO: 57164 - protein, 35 aa, Sorghum bicolor
  Clone ID: 30964044.pep
ARLFFTKNGQFACTSSYTRTHARAWTERLRLAVTT

SEQ ID NO: 57165 - protein, 125 aa, Sorghum bicolor
  Clone ID: 30964050.pep
RCIMSSKDRALARSKSCRATFMVIPNSWFDDFENTSTTPPDEIFRYAPRRLDKVRRSLYDDNGDCQNEDFKTSPLIPEKNDYQNEDCLLDCSTVSCEVASDVLTCFYVCPCVCVRARGRYIFFLV

SEQ ID NO: 57166 - protein, 146 aa, Sorghum bicolor
  unsure (1)..(146): unsure at all Xaa locations
  Clone ID: 30964074.pep
MGAAGEEMAAEAKEERIMVSVRLRPLNGREAGDSSDWECISPTTIMFRSTVPERAMFPTAYTYNRVFGPSCSTRQVYEEGAKEVALSVVSGINSSIFAYGQTSSGKTYTMTGITEYSMLDIYDYIDKHPEREFILKFSAIEIYXEA

SEQ ID NO: 57167 - protein, 142 aa, Sorghum bicolor
  Clone ID: 30964100.pep
PCRAANSLTPSWAAAAAAERTGTRGPPSSVWLPSGTAWPPSGAVSPPPSRARPGPSPTPTSNPSPPRSPPPRNSSSSTPRSSSLAPSPSPPHFHLLPPPLLLPLPSERSPLWPPPSKSSNPWRPPRATAAATRSWSSTPPSC

SEQ ID NO: 57168 - protein, 164 aa, Sorghum bicolor
  Clone ID: 30964114.pep
TADQVQVSLADTVIPVPAIQEYATGYSQLSKTDTTNQTQTNQEYIADQVQSNLTDTVIPVQGIEEYTTDYSHIGKADIMNQIQANQENTEDHLYLSQVDCVTEMQIIEENLSKQPQLSQSETGARIQIDLESTTDHLQPNYDENSMLQSGFSWAPEQNGGAPTT

SEQ ID NO: 57169 - protein, 201 aa, Sorghum bicolor
  Clone ID: 30964121.pep
TSYWDEFVWGSSWMYLATGNSSYLTLATHPKLAKHAGAFWGGPDYGVFSWDNKLTGAQVLLSRLRLFLSPGYPYEEMLRAFHNQTSIIMCSYLPIFKSFNRTRGGLIQLNHGKPQPLQYVVNAAFLASVFSDYLEAADTPGWYCGPHFYSIEALRSFARTQIEYILGKNPLKMSYVVGFGNHYPKHVHHRGASIPKNGVHY

SEQ ID NO: 57170 - protein, 224 aa, Sorghum bicolor
  Clone ID: 30964126.pep
GIKDLNNVVFLSLTTARVLSESDMISILHIFRRVTGFMKDIIFSRNSEPDLEPKLIVVSLLTTRNHYDESVSTVQEGFLSSLAFHFPFISSFMGGDIPEQKQIRSKHSFNRLPENRTNSVEQDEFSQLSNWSSDAATVPKLFPEEFEDLESVSNDRNERIKPESLEDNLAVTGEMSKDDDREHLASQQEHRFLSNSPGFDIAQLWAKQRAMANGSSENDELDIV

SEQ ID NO: 57171 - protein, 220 aa, Sorghum bicolor
  unsure (1)..(220): unsure at all Xaa locations
  Clone ID: 30964130.pep
WVPDDTGRHPLYXSSECPFAERGFDCLANGRNDTGYLKWRWKPRRCDVPRFVARTALERLRGKRVVFVGDSMSRTQWESFICMLMAGVDDPRTVFEVNGNEITKTIRHLAVRFASHGLTVEFFRSVFLVQEHPAPRHAPKRVKSTLRLDRMDNFSRKWVNSDVLIFNTGHWWTATKLFDMGCYFQAGRSLKLGTSIDAGFRMALETWASWVQKRVDLNRT

SEQ ID NO: 57172 - protein, 204 aa, Sorghum bicolor
  Clone ID: 30964136.pep
MYLERSLYSEGDRKLADLDKASELDPTLTYPYMYRAASLMRKKDAKLALEEINRLLGFKLALECLELRICLYLALEDYKSAICDIHAILTLSPDYRMLEGRVAASKIGTLLGAHVEQWNTAECWLQLYERWSSVDDIGSLSVIYRMLESDAAKGVLYFRQSLLLLRLNCPEAAMRSLQLARHHAATEHERLVYEGWLLYDTGHC

SEQ ID NO: 57173 - protein, 105 aa, Sorghum bicolor
  Clone ID: 30964153.pep
KEIPSQVVYEDEKVLSFRDVSPQAPTHIIIIAKVNDGLSRLSKAEERHVEVLGSLLYAAKIVAKQEGLDDGFRIVINDGPKGTQWVYHHLHVHLLGGRQMNWPPG

SEQ ID NO: 57174 - protein, 97 aa, Sorghum bicolor
  Clone ID: 30964164.pep
MSTVPTAWVEVKKLENYSLFIGCDVRSPAFSCASLGRWSGRSNCLYYGYYDPPLVLHGLGDDADAVWNPDNDDYLEFKRNWYTQLQVFWVYPSLLYR

SEQ ID NO: 57175 - protein, 70 aa, Sorghum bicolor
  Clone ID: 30964176.pep
KIHYQQHAAQASDDMLKDGESQEFLALLLLMQIVSMPLEFHVQVQSVDKVAIMKISCSRNHIINCTICSY

SEQ ID NO: 57176 - protein, 73 aa, Sorghum bicolor
  Clone ID: 30964182.pep
LAVEGYPTIYFYSTTGDLYSYNGGRTAEDIISFIKKNKGPRAGAVDEVTQTDAGAVEEGTAPSSTSELPKDEL

SEQ ID NO: 57177 - protein, 81 aa, Sorghum bicolor
  Clone ID: 30964191.pep
LLIVNTVLIASGRRSHASTRRTASSEFLLTFLVAIILSLQGQRSIGLTREPVHTILGCYQEFPRISAQLSTSPCRYSDRLN

SEQ ID NO: 57178 - protein, 150 aa, Sorghum bicolor
  Clone ID: 30964208.pep
TKRLNDEKALTLAVGDEDTDMLADVKQMAAAAAAAGQASSSFENQLRPIDRYAMRFMELWDPVIDKAAVNHQVNVEEEEWELDRIEKLKEDLEAEIDEDQEPLSYESWDVDFATTAYRQHVEALTQKQLLEEQERQAQEAAKEWRRRMII

SEQ ID NO: 57179 - protein, 180 aa, Sorghum bicolor
  Clone ID: 30964220.pep
VIDGEALSSFELLKIHGTQGSSGSKISSETASSSRTNMSRELTTEDGALKDIGIDSSTIKPFPRFSTTSELSVDPILSSKVSTPSKEIPSTLRRLDKSKMPALIPGDGSLNLSLKQVRKVTQNFSPLFKLGEGGIWTVYRAVLSDNQFAIIRRAKKGHVQEAKHLMKVKFLTEINHWSLV

SEQ ID NO: 57180 - protein, 155 aa, Sorghum bicolor
  Clone ID: 30964223.pep
MASLAAAGEALPFSDDMLAEMFIRLPTLEDLGRACASCPAFRRVITSHSFLRRLHALHPPSLLGFLSFSSLFHPAESPHPSARAASAVAEAADFEFSFLPTKGFWMVRDARGGRFVLDCDDDTGSTFTTIAVCDPLFRRHVVLPPLPQDLAAAVE

SEQ ID NO: 57181 - protein, 168 aa, Sorghum bicolor
  Clone ID: 30964229.pep
MQLIYSVCMLLDKSPFSQVDLSDMNFVFTQNEFSMSSWEADEVISAFPSSITSRDCDLGIFCSNKDHQGSNLTNIFEDIQKALQEERIKESRERAASIAWWNRVRCQKRPIYGTNMRQVLTVNHPVSNILDKRNNPLCHMDYSSSLADLVLPSVERFQKMLDIVESFT

SEQ ID NO: 57182 - protein, 184 aa, Sorghum bicolor
  Clone ID: 30964235.pep
QNVTGSSKSLCFSCPSGELPHRAIYINVRGGATETPCPYRCMSDRYRMPHCYTALEELIYTFGGPWLFGLLLSGLLILLALVLSVARMKFVGTDELPGPAPTQQGSQIDHSFPFLESLNEVIETNRAEESHGHVHRMYFMGPNTFSEPWHLSHSPPEQITEIVYEDAFTRFVDEINTLAAYQWG

SEQ ID NO: 57183 - protein, 229 aa, Sorghum bicolor
  Clone ID: 30964236.pep
KEHAVVSCRKVEVTERTRHLVWDHEHFTMEMKFPGQLKRACRARTFRSKFSYGIVSKSFLEDLFSTFRHLRVLVFNHAEFEELPNSIGNLRHLRYLDLQWNIKIKYLPNSLCKLVNLQTLLLARCHQLVELPRGVHGLVNLTFLLLTSKQKHLLRHGFCGWASLAHLHLSGCLELTSFTEGIGSLSALKELRIFNCSKLASLPSAMRQLSKLQKLVINNCAELDLMEPK

SEQ ID NO: 57184 - protein, 92 aa, Sorghum bicolor
  Clone ID: 30964245.pep
KWSSPHLWTRRSEGAREFTGNERSTSSADGERQPPRGHRVPLIMPSARQSGSHVRGEGSRPRRRAHRHRHPYHVSSLDSLQILYRQFDFVAS

SEQ ID NO: 57185 - protein, 81 aa, Sorghum bicolor
  Clone ID: 30964252.pep
HVGLHGTLPILRLSVGKSSKRIKVPFTFTATVAPLTFPCDPNASFQFHLWYWDTCLDLLSPMISSCSLSHCCYCHSCNDYS

SEQ ID NO: 57186 - protein, 146 aa, Sorghum bicolor
  Clone ID: 30964257.pep
MQGPSKMICASASSMPPAVYGLEGWADLPEGLLHSIIPLLSSFLELHAFAGTCRSWRAAFASYPSKSTFCTLLPPLLILPHIKVSAPNLPSRSDDGHELRTCQVLDPSNLKSTLRCQIPEETFQKLHFAGSSYGQLICGRGRNCVI

SEQ ID NO: 57187 - protein, 48 aa, Sorghum bicolor
  Clone ID: 30964260.pep
RGEMLCSIITIGRQLPNPILSGHFPMIVTHALQEEFQYDVYLGFRDNN

SEQ ID NO: 57188 - protein, 161 aa, Sorghum bicolor
  Clone ID: 30964265.pep
MPRLSPPFPAVAAVTAVTCPVQSLQRSQARSLLLSFPSHLAKLAHFCVRTILSNLVESWGLGTSLPFPGSAAAAMLAQVLLVHLLLLLLLAATSSADHHRRHYWGRRALHEPLFPLESTPALPPPPPPAPFFPFLPGAAAPPTVTPDVGSASTPADTAGPG

SEQ ID NO: 57189 - protein, 75 aa, Sorghum bicolor
  Clone ID: 30964267.pep
RRSGPWGTLGGASVRRRRERGGGRTGGGGGDASGPAGSRRTGGVVRSRWWASASLRGWGIADAEYCAEENWRREN

SEQ ID NO: 57190 - protein, 69 aa, Sorghum bicolor
  unsure (1)..(69): unsure at all Xaa locations
  Clone ID: 30964271.pep
QQGLKPGSXDXDAAWFRRRXSSMALQLGSNLXLSXAPSMLIRHWARGWKRHRSEASFPYGALVNCFLVF

SEQ ID NO: 57191 - protein, 178 aa, Sorghum bicolor
  Clone ID: 30964276.pep
LAVCRNTLTWLRSRTRLGAAVPFNDNINFHKVVAGGVAVGVALHAVTHLTCDFPRLLHASAAAYEPMKAYFGQRRIPDYWWFVRGVEGVTGVIMVVLMAVAYTLAHPWFRRGKLSEGNPLRRLSGFNMFWYSHHLFVIVYVAFVVHGVCLYINRTWYKQTTWMYLAIPILLYAGERLF

SEQ ID NO: 57192 - protein, 88 aa, Sorghum bicolor
  Clone ID: 30964286.pep
MQAMSKLHQKVTKRSPMVNDFSRRILSITEGDAIIQIEKKWIGDQHVCQNDGAIASPSSLNFRSFSGLFLVTGVASTSALLIALVMFL

SEQ ID NO: 57193 - protein, 70 aa, Sorghum bicolor
  Clone ID: 30964293.pep
AIRKRNGIHPGSKLSIVKAEGDVYVAMIDDKVITKIGTRYDVGSVIPSGFSVAAHGDGYCIWEKRDYHYH

SEQ ID NO: 57194 - protein, 64 aa, Sorghum bicolor
  Clone ID: 30964311.pep
VQHLIERCMTFGMSMEECMEALAKRADVQPVVTSTVWKELEKENKEFFDKYKQWISEKRSASTS

SEQ ID NO: 57195 - protein, 115 aa, Sorghum bicolor
  unsure (1)..(115): unsure at all Xaa locations
  Clone ID: 30964320.pep
PINDDGTVTVKATXSIKWKAGMDIVNGKTCDKKGDKRLLVDESFFTWFSNTEDKSFAHGEMDQVADVIKEDLWPNPLKYFNNELEGEFELEDDEEEGSDEEAEDEDEDKEDEEEP

SEQ ID NO: 57196 - protein, 63 aa, Sorghum bicolor
  Clone ID: 30964324.pep
CAHEHAYYTWIASICVYDGFVIWQYISCCAVSSAGAAGLILVIAPAKVAPSHAAVQLNLLGLH

SEQ ID NO: 57197 - protein, 155 aa, Sorghum bicolor
  Clone ID: 30964345.pep
ESFEVIFISIDRNKEEFQASMSSMPWLAIPYSDTARQKLTRIFAVKGIPGLLILGLDGKVLKTDGRTAISTYGATAFPFTESRVSEVDEALRKEGDKLSRQVNDPKHRHVLELDMAKAYVCDECQKKGRYWVFSCKQCNFDLHPSCVLENKIDII

SEQ ID NO: 57198 - protein, 90 aa, Sorghum bicolor
  Clone ID: 30964364.pep
MIWDNRGAAFSTPRNPSYVYSSFVMPCPGRDRGLKRAAVTDMTGAEAPSPAPAPAPLPPPPAWRHRPRGRELFWGLRLMLRGAGSERLTT

SEQ ID NO: 57199 - protein, 76 aa, Sorghum bicolor
  Clone ID: 30964380.pep
MSLVVKRYRCTHSASCACLKGQVREDAMYLVFKHMNWNPKMIAILSSVCKWFDEFAKRVLWKEFCNARAPKMMKDL

SEQ ID NO: 57200 - protein, 141 aa, Sorghum bicolor
  Clone ID: 30964387.pep
MANHLAAGLFGLLLAVAVLCLLIGSNTARAQVLFQGFNWESCKKQGGWYKFLQAQVDDIAGAGATHVWLPPPSHSVAPQGYMPGRLYDLNASRYGTEAELRSLIAAFRGKGVEAVADIVINHRCADQKDGRGVYCIFEGGG

SEQ ID NO: 57201 - protein, 53 aa, Sorghum bicolor
  Clone ID: 30964403.pep
LPCSSSIPFPSPAPLAVAAVVRCLVAADSACFGWGCFGGYCRPSRRSIPAAPD

SEQ ID NO: 57202 - protein, 130 aa, Sorghum bicolor
  Clone ID: 30964406.pep
TGTPAALRGCEVGERERERERERGDWERSRDSGGAPALEDLAAAAAAAAAAQRRNNEDTTATERAARPRRGRRTEEEEERRGDLWLSSRSSVHGAGRRHRRPGSARGRRLRGPCQLGSITAGPWRNQQCS

SEQ ID NO: 57203 - protein, 57 aa, Sorghum bicolor
  Clone ID: 30964409.pep
MRTAEEKGKRARTDGAEEDGGQPIDRALLISIEKLQEIQDQIEKVNEEASNKVLEVE

SEQ ID NO: 57204 - protein, 64 aa, Sorghum bicolor
  Clone ID: 30964413.pep
RRRSNRRPRIMCQEIYHFIHSTFCYGSIMEIYCSLLVEVPFPLQTKTYDAFFCMGSWNLEIDDT

SEQ ID NO: 57205 - protein, 144 aa, Sorghum bicolor
  Clone ID: 30964424.pep
LYFLLIIVAAMTSFKVHQDKSAFTGKSILYLNRHQTEEWKGWMQVLFLMYHYFNAKEIYNAIRVFIAAYVWMTGFGNFSYYYVRKDFSLGRFAQMMWRLNFFVIFCCIVLNNDYTLYYICPMHTLFTLMVYGALGILNKYNEIR

SEQ ID NO: 57206 - protein, 69 aa, Sorghum bicolor
  Clone ID: 30964427.pep
YPFSAQRRRELEAMDDARRKGGKLQELLGCKERDYVISADDIKVNKKTHEIPLLIGNMFDTTYYICKFD

SEQ ID NO: 57207 - protein, 161 aa, Sorghum bicolor
  unsure (1)..(161): unsure at all Xaa locations
  Clone ID: 30964430.pep
RANELSSAQFNTWRKNPFXHIRSKRYIASPISNSTTVEGKFKEDECGHRRSFSSVIIRYSSSNKTSSVSSSSCSSSNSSSFSIPSSNDSGVGPVLRRSSSASSEMDNPIQGAIAYCKKSQQLASVRKSASDAGFRFMSSSASKIAAESEDAEGIFEPEIQM

SEQ ID NO: 57208 - protein, 115 aa, Sorghum bicolor
  Clone ID: 30964432.pep
HPTAVFSSEQAVQPATIASIVFPLQQPLVPSAMTGPPYAAPPLELKLFPEVASAEGHEPCEDQEAPNHVARPQARYPTQSASWPVSLFFGLPGMEDEQCSSSTTGSSKTVSTDIE

SEQ ID NO: 57209 - protein, 61 aa, Sorghum bicolor
  Clone ID: 30964443.pep
NYPTKTLFRCSRIHINPHMLRWIGVELELNSSPTHTNTYGIEVNLTTSKQSLTDRSISKRQ

SEQ ID NO: 57210 - protein, 155 aa, Sorghum bicolor
  Clone ID: 30964444.pep
IVGFRGVPELVLPAGYYGNACVPVAAVTTAGPLLAGSLGAAVELVRETKAAVTAEYVRSTVDLLVLRRRPCVALGNLFLVSDNRHAGFHRVDFGWGEPVYGGPAATLFGPSFLVHVGDDGGAGDGKGMGKVGVLIVLPRPAMERFASEVETLLKS

SEQ ID NO: 57211 - protein, 124 aa, Sorghum bicolor
  Clone ID: 30964453.pep
PMTKQIMILHLPDRPSACTQRSADGGTKHLPKSRNGKESQAKAERDKEKLRPRAAPLGGSLSAVDGRTSSAPFRPPRHEDRALDVDAASAPLARGRVPRPVAVVAAGPAGGCRRYLIEWTGEYN

SEQ ID NO: 57212 - protein, 125 aa, Sorghum bicolor
  Clone ID: 30964483.pep
LINCCAKSRRFDLIPAVLDEMSYLGIECNSVIHNAIIDGYGKAAMFEEMEGALSAMLESGSNVPDIYTMNSVIGAYGNHGRTDEMEKSYSEFQLMGVEPDTKTFNIKSYGKAGMYDKMMSIFSLV

SEQ ID NO: 57213 - protein, 61 aa, Sorghum bicolor
  Clone ID: 30964498.pep
ITYLPLYRECVSAGGQLLPQRLRGELLEAVHRLGEPAGTESQGKDLVRTLERHMPSFLVGS

SEQ ID NO: 57214 - protein, 87 aa, Sorghum bicolor
  unsure (1)..(87): unsure at all Xaa locations
  Clone ID: 30964524.pep
FPCEHHPTSXGRSRQPLPPRTAISSPSPGCFVVCLAQTFDARKVQAVIQSHTILLPAKIIRQLLIIHSRRTLNQEQYRAVATKTVPI

SEQ ID NO: 57215 - protein, 173 aa, Sorghum bicolor
  Clone ID: 30964532.pep
MAKHSPQIHDQPLQEEDYIDMDLSSPAASEAATTTASFLCYNSPMAASPQHSREFEFHMSAPPDLWEPVASPADELFYKGKLLPLHLPPRIQMVEKLLESAAEKGLLSASTAPATPYQSCNVSAANSCYASGELDAEYYFHECISTGSDAAEEEAACEKKPWSKKLKFIRHLN

SEQ ID NO: 57216 - protein, 213 aa, Sorghum bicolor
  unsure (1)..(213): unsure at all Xaa locations
  Clone ID: 30964535.pep
VAATPAAARQEARAPSRGGARGRRERRRVPPTRPRVALRPTPPPPARPHRHPGPRGRRARPPPNGTARAVTWPARVPTALLFFCFFFSSSAPPPPPPAARRPLREEEQRTTTRRTPVLTLGPPSSPPSRRETQARQPRRRALAPFCSATLCVFELNPGLCRRRVERRXRVGXLLAGFAQPNGSVREGERRHRRQHACRRQAAPWAYLWQEEVQ

SEQ ID NO: 57217 - protein, 161 aa, Sorghum bicolor
  unsure (1)..(161): unsure at all Xaa locations
  Clone ID: 30964543.pep
MDEAFARAVEDGLKLTKRLVLPNGGGLPPPRPHLAMDRDNDPAAALLQLMPASPMAYAVVVDPGAVDSPDVPSYQPHVYGRLDPPALIPLQXAXVDLRVDCAAAGCATAEVALRARWWVHCITRSRACHCRIVVPMGHQGSILGAEVTVGKRSYNTHVIDI

SEQ ID NO: 57218 - protein, 180 aa, Sorghum bicolor
  Clone ID: 30964548.pep
MPEATEHYVQPPAMTTTPLAFAVRRREPVLVGPAAPTPRETKRLSDIDDQETLRGHVPFLFLYRGGGGARADDGRDPASAVRRALGEALVPYYPLAGRLREVEARKLVVDCTGEGVMFVEADADVRLAELEAASSGELRPPFPCMDQLLFDVDGSGGVLNCPLLLIQVTRLLCGGFVLAL

SEQ ID NO: 57219 - protein, 142 aa, Sorghum bicolor
  unsure (1)..(142): unsure at all Xaa locations
  Clone ID: 30964557.pep
TASAPAPAPSPPPATASAPSTSLPLATSSAPSPPAAIAASRLPRTASXLSSAPIPTDDGEDDDVGTSASTGIAPPPVPVPPSREGGGGGDDAPSPEPSPMWSFLRKFFMPPPPPKPGGRRRSYRLACYYWRWWWVGGSDMAT

SEQ ID NO: 57220 - protein, 157 aa, Sorghum bicolor
  Clone ID: 30964561.pep
MVGRMERQTASSSASCSPSAAAAASSSSSSVCGGKKRPDILNMIRNAACLNSSSTDTGKGRGKLSTNKVAHGFHLVEGKSGHDVEDYHVAEYKYVKNHELGLFAIFDGHLGDKVPCYLKANLFSNIMKEPLFWSSPQEAIKNAYCSTNKFILENAKQ

SEQ ID NO: 57221 - protein, 78 aa, Sorghum bicolor
  Clone ID: 30964585.pep
LIRFCSTGLARASFASCSGSGRIRYGQWWSGVAWPSRRLAGRAGAAAPPPRLRGAQGGPGGVPRRGARLRPRGARRRR

SEQ ID NO: 57222 - protein, 132 aa, Sorghum bicolor
  Clone ID: 30964614.pep
IEDMEPVVFRSMLHFIYTDMAPELDGDEDPQAAAIMAQHLLAAADRYGLDRLKLICECKLSGGIGIGTAATTLVLAEQHHCSLLRAKCIEFITKSPETLDAVLATDGYAHLVASCPLVLAELLRAVAHGRKI

SEQ ID NO: 57223 - protein, 49 aa, Sorghum bicolor
  Clone ID: 30964626.pep
DSKMLGSIVTDLEVDALTNVVAKLKIEVCLLTAWCLLSLTVLVATSNFN

SEQ ID NO: 57224 - protein, 113 aa, Sorghum bicolor
  unsure (1)..(113): unsure at all Xaa locations
  Clone ID: 30964643.pep
DLLVTNPKXRISEAIGKKACNALLLKVNQIGTVTESIQAALDSKAAGXGVMVSHRSGETEDNFIADLAVGLASGQIKTGAPCRSERLAKYNQLLRIEEELGNVRYAGEAFRSP

SEQ ID NO: 57225 - protein, 151 aa, Sorghum bicolor
  Clone ID: 30964644.pep
ANRQLEQTLSGILHLSLEEEEFGITGVPAHLTPDEKFTLDVLRGRDLCLTSHTDDTLFIWILPVADKGLNTLWEWHYAIQLSGLCRTMALPPFSDGIILYDTENICCYDLATLKLRVLCKLRHMRYQGARNWKNLFNFDVEPFTESLIRIT

SEQ ID NO: 57226 - protein, 94 aa, Sorghum bicolor
  Clone ID: 30964651.pep
RASTPRRPARPPPSSRHRTAPRPRRPSRRAGSASGSPASRRCRSRRPPSPSPATAGTWPPSPPCPPPSASPTTGRRPPCPAPPAAGPSCSCPGW

SEQ ID NO: 57227 - protein, 148 aa, Sorghum bicolor
  Clone ID: 30964662.pep
RHHHITCKVVVQDAKKQRDPRTVLSSPFFYRKRKKKPRKKSVFCCLSPDTAWSQNCCQACARCGELAISGRQLQAQADEARCGAQAQPAVVVAARRFGLLLLLLPLPDERLQPERELQPNLLFLVVPISLLLGAAGWRRMALQLGLGL

SEQ ID NO: 57228 - protein, 153 aa, Sorghum bicolor
  Clone ID: 30964666.pep
VVASIDHVNAPLLWDKKMVHKQFKWSWYHVPTFAPYKVEGVFYPLILASGGHAQTTKTALVVLQSLTPNAQSVFRVLAEYQLANEKEEGMPVNSLYTKCRERFLVSSQVTLNSHLTEFKDHDLVKIRKHSDGQDCLRIPLVSDALEKLLQELA

SEQ ID NO: 57229 - protein, 225 aa, Sorghum bicolor
  Clone ID: 30964677.pep
MQQRAPPLRLPLHPLLLLVPALAEVPDRYASPRAGSGTRTRLSNAPAQVYLDPTYPVPRPPPAAPICVVPVLSYSFANTYGAPPAKATYAPPAGCPAPWSLVVLSFSVAIAGDQYDRVAAVWLDGAELLRTTTAEPTPDGVRWTVRKDVTRYSALLRSPPGGVLSVMLENLVNDVYTGVYNVSVSFEFHGAPAYLVDDAGSSSAAGSADPGQATPKLPASYFQPA

SEQ ID NO: 57230 - protein, 205 aa, Sorghum bicolor
  Clone ID: 30964686.pep
LEIGMVSSILAYKFGSTFAWITSASVATYIAFTLAVTQWRTKFRMAMNKADNASSTVAVDSLLNYETVKYFNNEQFEVEKYDKYLRKYEDAALKTQSSLAYLNFGQNVIFSSALSAAMVLSSYGIMSGALSVGDLVMVNGLLFQLSLPLNFLGSVYRESRQSLIDMKSLFQLLEEKPGIKDEPHAQPLQFKGGCIEFENVHFGYV

SEQ ID NO: 57231 - protein, 179 aa, Sorghum bicolor
  Clone ID: 30964687.pep
MAASSALRLILGSSSASRRQILSEMGYKFTLLSADIDEKAIRKEKPEELVVALAHAKADAILEKMQNNGMMKEIVDSQETTLMITADQVVIHDGVIREKPSTPEEARKFIKGYSESHAATIGSVLVTNVKTGARREGWDKAEVYFHKIPDEVVESLIEEGNVFYVAGGLLVEHPLTSPL

SEQ ID NO: 57232 - protein, 68 aa, Sorghum bicolor
  Clone ID: 30964691.pep
WRPVQRLESGWVEQQAAHSEESLAVRRRQRLRLRLRGRQGGNSGGGAGEQEEEEEQAGGGVRRRRRGE

SEQ ID NO: 57233 - protein, 219 aa, Sorghum bicolor
  Clone ID: 30964693.pep
MAPRGGRPAASSGSEDEEEEAGFSRSYFLAKEKEPSSGKKRARAAAGKLSDLNLVDEHVLRASLAEIPPKHEEEVEALTRSYKEQYHNWWFELRCGFGLLMYGFGSKKQLLEDFASTTLTDFTVVVINGYLPSVNLKQVIATIAEMFWDQTKAKRKRQPGTRAQLSQQFPSQSTEDIISFLMRQTSDDVDYPVCLLIHNVDGPALRDTESQQCLAQISC

SEQ ID NO: 57234 - protein, 221 aa, Sorghum bicolor
  Clone ID: 30964696.pep
KLGHTFSRIITSKPPFAFSRPRPRPRPTPPVGPPPPPPPPPVSIPPQPPEEELPPPFGFGFAPTTTTTMPHHGSHRPPAHAPGGPVFPRATSTVVPDPSRFFAPQLLAAPLPTNSFFQNFVLKNGDQPEYIHPYSVRSPGGAALDVCYPTRNHSPSFVIQTFVPDLTVSDAAGTAAQRHHVSAFDDLSVTLDVSPSLRAHLVRGCPYVTVTTTAGPVDISV

SEQ ID NO: 57235 - protein, 228 aa, Sorghum bicolor
  unsure (1)..(228): unsure at all Xaa locations
  Clone ID: 30964702.pep
LPPSCLLSPSVPSSPLEPRRWWRPLRTASSASCTQPEVLISDGASRSHGWCPRALVPWWPRQQPARAAARRARRWRHRFGSSHGRQQRKLRQNGSGRQRHGSGRHQHHGSGRQRHGSGRQRRIQRGPSVASPSSRRRRSTSAAPWPRRRSWRSRSRRFAVVATSARFNDGHSNSVVAAFINGRGHGRALLVLDLXRMQPAVVFLSLLHLGAALLKSKSLTMICILFHT

SEQ ID NO: 57236 - protein, 118 aa, Sorghum bicolor
  Clone ID: 30964735.pep
LLSILGQEPPLPEKPWIEIQEARTAHVASPGAGCFHPKQSVTNGLPASGFVSTARPPPPQPMRHHPWPSPHIVQASAPRRATTGMWNHRRGVSGSKMVSGWSGEGDGWCSGGAKGAGT

SEQ ID NO: 57237 - protein, 143 aa, Sorghum bicolor
  unsure (1)..(143): unsure at all Xaa locations
  Clone ID: 30964747.pep
MALEAVVFSQPQAAGHFGYAMPWCDLQLLQGXGGGGGFGDLCAAAGEWDHDLDTCWAAPTMAAVGGDDWDWEALSRDQSSDASTDHGNXGRAAAAPEPEAAAAGRRKRRRTNVVKNNEEIESQRMTHIAVERNRRRQVNEYLA

SEQ ID NO: 57238 - protein, 200 aa, Sorghum bicolor
  Clone ID: 30964754.pep
MAHPRLVLSSPKPLLPAAATAIPSRRAVAVRAALSTASPPAKAAAGAEAVRSIRARQIVDSRGNPTVEVDLVAGDGRLHRSAVPSGASTGIYEALELRDGDKAVYGGKGVLQAVRNINEVIAPKLVGVDVRNQSDVDAIMLDIDGTENKSKLGANAILGVSLSVCRAGAGAKGVPLYKHIQELAGIKELVMPVPAFNVIN

SEQ ID NO: 57239 - protein, 110 aa, Sorghum bicolor
  Clone ID: 30964755.pep
PVYPTRSRRRTTDPATGGGRELEEKGHPPARPQEAAAARRLWPPRSTPLPWVLGATRGGGGGPDCRSRGGLLDAAVGVAACRSRPRGCSVLRTARGEGGVKGIAVGSLAF

SEQ ID NO: 57240 - protein, 162 aa, Sorghum bicolor
  Clone ID: 30964764.pep
NVLYIFGFVRNVVVWMWKVLVSFHLKTWKGTQWQADQVLASRLTTHLKPLPPFTDTSATVLDRAGGGGDAWSRGWERRCMALRMAAVARGRARSGAGKGDQAWARSGLGAGGGAGMGMCEPRGPRARFGDFSIYFFHTAEFISLGREREVWAFIRSVAGAQL

SEQ ID NO: 57241 - protein, 86 aa, Sorghum bicolor
  Clone ID: 30964774.pep
VGNKVPLYGGGPTLTAAPAAGGKGAQATTTTVASVPMVLRTTLHSRAYVLGALVKPKFTLAVECRVVMNPSKQNKPISLEKACHYS

SEQ ID NO: 57242 - protein, 125 aa, Sorghum bicolor
  Clone ID: 30964775.pep
KKVYSAKARFLDIGQIHHISIEGDTAGARDPSLEIRIGKKKVLQVKRLAWKFRGNQTIYVDGLPVEVLWDVHDWLFGSSNGCAVFLFQSGHSMEKSLFRTCSQNEKEAQAHRFGFTLILKAWKTE

SEQ ID NO: 57243 - protein, 141 aa, Sorghum bicolor
  Clone ID: 30964804.pep
RGVRALCPRVVTLVEQELNANTAPLAARFADACAHYGAVLESLDATLARDSAQRARGEAALANKAANAVAREGPDRVERCEVFGKWRARFGMAGLRPVAIGQGIADRVKARLRPGFDVKLDSGRLGVGWKGRVVTVASAWR

SEQ ID NO: 57244 - protein, 160 aa, Sorghum bicolor
  Clone ID: 30964809.pep
SAGKQNCNNHKDSPSFVRGAVPCSHTASTPTGLEEEVNSNKIVDNGSKVRPILPGVLLSCHDINSQERHPSSNAPQSYLPAANGRPLETIEFGSLGPFALPLSTLKSNGATNTQTTSKVFTDASPFVLQRSRASATENRPPGLCKVGDEDEFPPLRAGIR

SEQ ID NO: 57245 - protein, 124 aa, Sorghum bicolor
  Clone ID: 30964814.pep
EIKEQRHWDITSGERLNILKDFVRFGLEHWGSDSKGVETTRHFLLEWLSYTCRYIPVGLLDVIPQRLNWRPPSYYGRDDLETLMVSDSAADWIRISEMLLGKVPEGFTFAPKHKSNAYDRAENG

SEQ ID NO: 57246 - protein, 161 aa, Sorghum bicolor
  Clone ID: 30964834.pep
MGCYGDFFEKAKPYIAMTSLQFGYAGMNVITKVSLNHGMSHYVLVVYRHAFATISIAPFALILERKVRPKMTWSVFLQIFVLALLGPVIDQNFYYAGLKFTGPTFACAMSNILPAMTFVMAVIFRMEKVDLKKVRCQAKVAGTLVTVAGAMMMTLYKGPLM

SEQ ID NO: 57247 - protein, 129 aa, Sorghum bicolor
  unsure (1)..(129): unsure at all Xaa locations
  Clone ID: 30964843.pep
MAGAAVKRARAGGGSISDRLSALPDELLLRVLTFLPAQQVVRTTLPXVLSKRWRDLWRSVPGINLSLSDFGRNSGEDWTAVWERMEDFVNNLLMLHRAPCLDAFXVGHDPRRHIDRWVRRAIKDNPLML

SEQ ID NO: 57248 - protein, 177 aa, Sorghum bicolor
  unsure (1)..(177): unsure at all Xaa locations
  Clone ID: 30964856.pep
MEFDEYEYLEKAVEPAAPPANGSGEKDRGSRRREGGEDRISKRSRSGEDRDRDRDRHRSGREHRDRDRDDGKEKERSRDSRGKDRDREGREREKDRGDRHRLTEREVERERRSRSRSERRRAEEEEMVRELERERERSERHLFRGDVRRTKDDGAEPEVDPXRDQRTVFAFQLSLKA

SEQ ID NO: 57249 - protein, 208 aa, Sorghum bicolor
  Clone ID: 30964865.pep
DFGVDLFPPQSEECVAGLVEKEREHMPRSDYGERLRGGGGDGIDLCVRREAIDWIWKVYTYYNFRPLTAYLAVNYLDRFLSRYELPDGKDWMTQLLSVACVSLAAKMEETAVPQSLDLQVGDARYVFEAKTIQRMELLVLSTLNWRMQAVTPFSYMDYFLNKLNGGNAAPRSWFFQSAELILCAARGTCCIGFRPSEIAAAVAAAVVV

SEQ ID NO: 57250 - protein, 184 aa, Sorghum bicolor
  Clone ID: 30964868.pep
MSAAPAAAAAAPPRRVVICGGGVVGACTAYFLSTHAGSPTVPTLIEKCAPACAASGKAGGFLALDWCDSTQALSSLARASFALHRRLADALGGADAYGFRPVHTLSVLLPTHPGPAPASSPHPRLPPWVDPSASAAPPRELGTPDTTAQVHPGLFTKAVLAASGAEVVIGEVERVVARDGRVAG

SEQ ID NO: 57251 - protein, 216 aa, Sorghum bicolor
  Clone ID: 30964876.pep
ASPCSSSSPLLCRPCSRLPASACRCCSSPPLAFTTHPLTFFPSLPFHLLARILLDAALNRRPALGVACPPSRRPQSARSVLPPPLLLRRCSPPSTTRVEEMQIGGCNGKERKGGDQKAALKKKKLKAKTFKWRSSNGDMNNKVEAGGSDQVCDDAVLCSLSTASFGGLVSWKRVRTLGKVTEQCDAVDPPVPRKLRSAINKRAGRFASTSPRHVKK

SEQ ID NO: 57252 - protein, 172 aa, Sorghum bicolor
  Clone ID: 30964879.pep
MASYDKAFESYKKALTTAASVAASMMLVRSVVNDVVPPELRDLLFSGFGYLRSRTSSDHTIIVEKKNDGFANNYVYSAVKTYLATRMNTDIQQRLRVSSMDENDKMMVSMDEGDEMLDVYEGTEFKWCLVCKENSNDSLNGSQNESQFFELTFNKKHKDKALRSYLPFILAT

SEQ ID NO: 57253 - protein, 103 aa, Sorghum bicolor
  Clone ID: 30964883.pep
MSSSENGDSSDDDEQFFSLIQGCAKLAEAYVFNYMDKAPPRTSQLSGMGWVIETLNTPGECNTMLRLNQYIFLDLHDKLEQVRFIGKTGIPTQNVLAICDFDM

SEQ ID NO: 57254 - protein, 138 aa, Sorghum bicolor
  Clone ID: 30964887.pep
PKIRCRVVGAYFEKLGSKSFAVYSIAVTDADNKAWFVKRRYRNFERLHRQLKEIPNYSLHLPPKSFLSSSVDDYLVHQRCILLDKYLQDLLSIANIAEQHEVWDFLSASSKNYSAGKSTSVMKTLAVNVDDAMDDIVR

SEQ ID NO: 57255 - protein, 108 aa, Sorghum bicolor
  Clone ID: 30964888.pep
MKFMKLGSKPDAFQSDGADVRYVVSDLATDVVVHVGQVKFYLHKFPLLSKSSKLQRLVLKAAEEVTDEVRIDDLPGGAKSFEICAKFCYGMVVTLSPHNVVAARCAAE

SEQ ID NO: 57256 - protein, 178 aa, Sorghum bicolor
  Clone ID: 30964891.pep
TLSNSFFIRIRYQLKFICTPFLCILSKVHSFDGYAVPLAVPPSTTTTIPAAHPLCGPHLIAIWEPQGMLHPHVTNEPATPMCPLAACHQRITCMFADSVGGEFLWVGSNAVLAPALSDGPRRRRRGNSPCSLVPWPGARRCWQRGVAGVQLRRRGCGSAEGIRRLRVRAARLGRVGFF

SEQ ID NO: 57257 - protein, 178 aa, Sorghum bicolor
  Clone ID: 30964908.pep
MEPPPASSSATSSYATPPQPSYAPSSYPSSYTKFNSALNAGLLNPMSPPPLPLDKTRSSPTLFDMMANEQDYHPRSAAAAAGVHSIPAPPHQPHHQLQPVRSMDRQMLLQDRIADLIGSCSPGNQFNDADSSDVRLTLSSKDGLSVTLCVHRHILVAHSRFFAAKLSDRWSKQQRTLP

SEQ ID NO: 57258 - protein, 158 aa, Sorghum bicolor
  Clone ID: 30964916.pep
VERQIAEEFLRTWAMQTELAAMHRKVPAIHRYEVSRVTARLFVGVGKGQILVSKEARCQLLSTWLEPFYEDFGWMRRACKGLDRRLIEDGLANTILTLPLATQQEILLAWFNRFLNSGEDCPNIQRGFEVWWRRPFWKRNSEPELPSRLRITAICENS

SEQ ID NO: 57259 - protein, 173 aa, Sorghum bicolor
  Clone ID: 30964921.pep
HAMAVDAQFFPHPPEGKYYVVDAGYPNRPGYLSPYKGERYHLPEWHRGIEPNTPKEKFNRIHSSVRNVVERSFGLPKMKWQILYKMPSFSMLTQKKVVAATMVIHNFIREHASGDVDFAKFDRDPNFVPTIPARYNKYAVSRHASDTSTTEASFVTMDTFRDSLATSIALAWN

SEQ ID NO: 57260 - protein, 138 aa, Sorghum bicolor
  Clone ID: 30964938.pep
QQLRAGSSKELALIDNGEQACTRPMEDQCDPCERRIPKHPNSLNKQVTSLSARESQHHRISQHRGGRNSFKDQIGGILLQSRSRRIFDKLWSSKGQGEHGGKGSETSGSSQSPPLSAKPAEVKPSPLPPLRNRRYSVS

SEQ ID NO: 57261 - protein, 125 aa, Sorghum bicolor
  Clone ID: 30964955.pep
YSKIGRSVPSSPTYCLRPGPSRPFTTFILIISFIDLLQLCVPTKPWGALCGTPSLGLPVCLPPLLRALQRKAQQFRGCPPHIFIHQLLALAQTPLVMSKSPPFSPLNAHPSHTAQPPPPLQSGAI

SEQ ID NO: 57262 - protein, 60 aa, Sorghum bicolor
  Clone ID: 30964978.pep
MFQLLTVYLTIGVYFVIVVFTYMLLWFVGLGTSIDSSAAINVPKNCLEVLIASQVSSACS

SEQ ID NO: 57263 - protein, 62 aa, Sorghum bicolor
  Clone ID: 30964985.pep
AKLKMLEVKKISLYAASSAVREIQRITLDPKFNLDSSFEDQNLTRAVSENLARVTKQKVSCS

SEQ ID NO: 57264 - protein, 205 aa, Sorghum bicolor
  unsure (1)..(205): unsure at all Xaa locations
  Clone ID: 30965002.pep
MAATAPATDPPDASPAVTEDAPTPARPTPAELVARAVAPVKPAFLRPPPVREAPKEEGGGGGAVVKVEKKSKRQLKRERHQEQKSTSHLCIQVGKSGNVDSCKYGTSCRFSHDINAYLSQKPADLEGTYPXPXNHPEGNHERNPLSKEIQKLLWKSKYKFPKASAQIKLLGLKDGNKNKAEAANDNPDETCELNGDEKTSLSSIP

SEQ ID NO: 57265 - protein, 152 aa, Sorghum bicolor
  Clone ID: 30965008.pep
CLELKMSEANTTQLDLEKGFSQVSNDNDSSSPATVHKMKAETEDGGSEIESPTPEKRESRSKGVVVSSLARNLLAERYKDRFAYQLVEDEGETDEEDYNESVSPSGRRSLFPESIELLEKHKDLLNLFNRMESSIRLLHLRKKMATFNNIAT

SEQ ID NO: 57266 - protein, 207 aa, Sorghum bicolor
  Clone ID: 30965009.pep
GGICALCFLELVDRKVGKNHLFKRSIILIKAWCYYESRLLGAHHGLISTYALEVLILYIFNLFHKSLHSPLEVLYRFLEYFSKFDWDNYCISLNGPVALSSLPNLTVEATITHTSDLLFDKEFLKSSMDKATVPPKNSDSCYTRFRPKHLNIVDPLKEHNNLGRSVNRASFNRIRTAFLYGARKLGHILMLPSEVIPDEIYGFFKNT

SEQ ID NO: 57267 - protein, 183 aa, Sorghum bicolor
  Clone ID: 30965012.pep
MDPAGAPWCDPRRGYAYAYGAGSAAQAPALKRQPRPLLPPRQDVAAVASGGVLKRSHGEVERWQQALYLREVRQRVAAQSQIAHPPIDIGSVLAGAVVSRAPGSSRPPSSGFAGLSPQPSSTLSSLTTASHLETPPSHMLPLLQRQMVSAPPQAVARVPAAGRSAARELVLLQELEKHLLGDD

SEQ ID NO: 57268 - protein, 199 aa, Sorghum bicolor
  Clone ID: 30965016.pep
MAGTSTPARSSAHPMAATSTPARYRSSARSSLPVRIVLRVRPFLPSEAASATAPCVSLLSGHPGGEVTVHLKDQHTSRSELYKVDSFFGQEDSVSQIFDQEVRAVIPGIFEGINATVFAYGAIGSGKTYTMQGTEDFPGLIPLAASTILAHCTGTWCSVEISYYEVYMERCYDLLEPKAKEIMALDDKDGNMQLKGLSW

SEQ ID NO: 57269 - protein, 108 aa, Sorghum bicolor
  Clone ID: 30965028.pep
EDDGSVPRLLRSLEELGVLVESKCRNQSPDKERAVAHVVFVEKPHRTEGNCHIRHNERFCILPKSKCRSGCAFLFLKWAELGAVCIPGTPSRQALRGHRHLEQGGVGA

SEQ ID NO: 57270 - protein, 180 aa, Sorghum bicolor
  Clone ID: 30965029.pep
QQDLPFFCFACASVALQAGRQASRMPHAKTDSEVTSLAPSSPPRSPPRTRGAVYYVQSPSRDSHDGETKTATSVHSTPALSPMASPRHSHSSVGRDSSSSRFSGHGHHKRKADKGHHHGSSNKGAPGGKGWQEIGVIEEEGFLDDEEEHTRIVPRKGYYFLVFVLGFVALFSFFALVLWG

SEQ ID NO: 57271 - protein, 123 aa, Sorghum bicolor
  Clone ID: 30965040.pep
MGLSRRFLNLIVQSHAPTIRSLRCIDLKRLQLFYPTPPSPTNPAADTMETFGLPGPTPIFRACDSDADCQWRVACYPLSQRRVLCTDQCRRNLLYDACTHEVAAIPEFYRPRMDSLSLFVPAS

SEQ ID NO: 57272 - protein, 73 aa, Sorghum bicolor
  Clone ID: 30965070.pep
GVRAFTDAGICRMQCPDSAKACYLQGAANMLLKDYKKACDAFLDGLKLDPANVEIEKALRDAVNCLKTLDTAK

SEQ ID NO: 57273 - protein, 56 aa, Sorghum bicolor
  Clone ID: 30965077.pep
SMERAFNFADNQVLRLYGFSHKGLESPKIKRPRDQTTRPINDVENLDMKAKISTVS

SEQ ID NO: 57274 - protein, 48 aa, Sorghum bicolor
  Clone ID: 30965088.pep
AIGESKIYILLNSWCYMLEDMITRMEVKIPLESLPPHQLAIKSFQDEF

SEQ ID NO: 57275 - protein, 129 aa, Sorghum bicolor
  Clone ID: 30965133.pep
AIKVALSDTGIPKVNVSVNAASDEEPEVDVSDEEFLQFDTSSVPVIITLTKVGRHYIVDATSEEESQMSSAVSVSVNRNGQICGLTKRGGAGLDPSVIFDMISVAKHVSQQFISLLDSEIAAAEAEEAE

SEQ ID NO: 57276 - protein, 77 aa, Sorghum bicolor
  Clone ID: 30965142.pep
ASYGPRCKLLGLAPTVPSPLPPIPREKKHRRLPLLVSLSLSLLPLLCGHGRRRLLRPVRDGGARSPPRPPPPPRPPP

SEQ ID NO: 57277 - protein, 110 aa, Sorghum bicolor
  Clone ID: 30965151.pep
TGFPCPAFPQIVALVAFLFRCLVLGLLRTQRTAGHLPLQHHPLRSSSWKASSWPPLPALRFLALLLSRVAAEWTVWSGSAVRWKALVLFWFFGEQGEDEEEQEEDGGRRG

SEQ ID NO: 57278 - protein, 123 aa, Sorghum bicolor
  Clone ID: 30965156.pep
MVGLSEGEKHFICGGIAQDLRTDGRRRLQFRALSVQTGVIPQANGSARVKLGATEIIASVKAELGKPSILHPDKGKVSIFVDCSPTAEPMFEGRGSEELSAELSVSLQRCLLGGKSGAGAAID

SEQ ID NO: 57279 - protein, 190 aa, Sorghum bicolor
  Clone ID: 30965167.pep
SRELTRILSVQKSPVIHLFSESIAGAATIRGFGQEKRFMKRNLYLLDCFARPLFSSLAAIEWLCLRMELLSTFVFAFCMAILVSFPPGTIEPSMAGLAVTYGLNLNARMSRWILSFCKLENRIISVERIYQYCKLPSEAPLIIENCRPPSSWPHNGSIELIDLKVRYKDDLPLVLHGVSCMFPGGKKIGI

SEQ ID NO: 57280 - protein, 145 aa, Sorghum bicolor
  unsure (1)..(145): unsure at all Xaa locations
  Clone ID: 30965168.pep
MAPPQTSGLGAPQRRLLQAAADGDLQLFKRTASALDAGKGRLREAVEAVKSRGAGALHFAAGRGRLAVCVYMVEELHTDVDASDDKGDTPLAYAIQGGTVDTVQYLLDHDANPDKPIGKGSTPLHLXAAGGNCEMLKALLSKGAN

SEQ ID NO: 57281 - protein, 109 aa, Sorghum bicolor
  Clone ID: 30965175.pep
PIPSCPIPATENGILGSLLPAPGSPPDAADWGLGLLTGGGARLASVTWAGRAAPRGALELECATRGDGEWGMGIVRWDRRMRGCVGGVGSGRGQGEEEEEGETRRRCVV

SEQ ID NO: 57282 - protein, 94 aa, Sorghum bicolor
  Clone ID: 30965205.pep
HCRVRQGISSARAYTTRSQNSLDSSAGAPPAEERREKEATRGHCGLCGGAREGKTRGMDCGLRGNGTSDWQEIIAGAMRTGRKGGPAFGPGPHA

SEQ ID NO: 57283 - protein, 55 aa, Sorghum bicolor
  Clone ID: 30965228.pep
VNDNYTCTSTSPKQRISTPNHHVHQNIPVPVKLSCHCSQTSHRPTGLGRPDALSS

SEQ ID NO: 57284 - protein, 72 aa, Sorghum bicolor
  Clone ID: 30965232.pep
PPWKVMLLSAISCSFVLWYADADADADAENTSPETQRSRCRQATSMSQLGVLCCNEPEEDLQAVTSRCYLSI

SEQ ID NO: 57285 - protein, 142 aa, Sorghum bicolor
  Clone ID: 30965239.pep
DTWALGCIMAELLSGGAPLFPGRSEMDQLNRVFDTVGMQDMPSWPGFALLPRAGSPLCKRGRPPSRLRELFPALSADGFDVLAGLLACRPDRRLTAADALRCPWFADAAAAAPEALPDQPRASCCAAGFAAGVAGVAEGIVA

SEQ ID NO: 57286 - protein, 65 aa, Sorghum bicolor
  Clone ID: 30965243.pep
QVALFTQHFTHHCLFTRCQRCELQNIAPVRGVPPMSPNGNPASNEHHIIIFVIRCFIEFGNCIKQ

SEQ ID NO: 57287 - protein, 112 aa, Sorghum bicolor
  Clone ID: 30965256.pep
GSRSPRSRSPQDQVMSPPPKDNGEGNGSDRGESPRGRETSRSRSRSRSPSGDNRSPAANGRSPSPRGDRSPSPRADRSPSPKADRSPSPKGNGNNDDDDAARGASPAGSKSP

SEQ ID NO: 57288 - protein, 148 aa, Sorghum bicolor
  Clone ID: 30965300.pep
VHVTAQPLRLHLPPPGAAKTKVVAPTQVPNRIQRDTRATSWWWKWAPPWGHEPPPLGLQVQPPGAVHGARSSPSPSPSPSPPSRPAGSGSGSGAARCSRRSGGRRPSARSPSPSPTSGRRTRTSAARSRKAWVPMGSASSPLPIYLSF

SEQ ID NO: 57289 - protein, 156 aa, Sorghum bicolor
  Clone ID: 30965305.pep
MDSDVEMNAASDEEVMDDEDYYDYCDSDMGDDGDGGSEEEEELVAGDYDEGIEAEGTDEVVSRREQTFVVLNEGVISERQAEDVSKVSAVLLITREEACALLHHYKWNISKLSDEWFADEEKVRHTVGLLLNGNHDPCSRKLTCGICFEGYSSDMM

SEQ ID NO: 57290 - protein, 170 aa, Sorghum bicolor
  Clone ID: 30965321.pep
GQPVVRLVGCLSRGSSKLHPSLPARGGLLRTAPVREVHLDLVRVSTGKLYRLRNPSRKYLASLSTYDSSNPTKDWGFPDIYANPDINLSKQSTAKCQSEVLTDESCIGGSVSAANTMEPKTKAYRDRAAERRILHRGLGVGPGQKQSNTNNFDEYEESIEDIDSMGTVSV

SEQ ID NO: 57291 - protein, 89 aa, Sorghum bicolor
  Clone ID: 30965326.pep
MGTTTTTPVAGAVVLSLKYLDTVKRSMLPLVLATLTTVLLLGPVSDRGAAFASPPPDPVQCSSGGGTSDCTVSSAYGVFPDRSTCRAAG

SEQ ID NO: 57292 - protein, 175 aa, Sorghum bicolor
  unsure (1)..(175): unsure at all Xaa locations
  Clone ID: 30965328.pep
PLYAASAALPTPKPQQAKNPSDPPALRLPVAMEHYERLGKIGEGTSGIVYKARDRRTGETVAIKRLRVATGDGYGDAFDETFRRELRCLEACRGHPCLVDLRAAHLDPSRGAFLVMEYAGRSLAEAMRQQDHRAERRTFPEPEARRVMRRLLEGAXAMHARGLLHRDLKPDNVLL

SEQ ID NO: 57293 - protein, 97 aa, Sorghum bicolor
  Clone ID: 30965334.pep
QPVPASVLRRRRRIRSRLRRPRPFPAPPPCVLRQLLPAAAQLSPPHDYSDHETSNASFHQREGSIQPVHAHRVFDSHSASRSRRTGRGTMNGGAAPP

SEQ ID NO: 57294 - protein, 145 aa, Sorghum bicolor
  Clone ID: 30965340.pep
QQSSSQLSSPPRPRRHRRGRAEDEEREGAAAAAHGGRRRRCLATPTAASVGKGREGERRRVAPAAAAPLAPGAVARSVGRTRERGSTREKEKRKESGRRSWSGAIYLICRILKRSRGSGREAREKLMRSRRSCHRRESASKDLDR

SEQ ID NO: 57295 - protein, 92 aa, Sorghum bicolor
  Clone ID: 30965361.pep
MMDGGNHLRRGQRDEGWGPPPRQRCSTSGPFELSTGSPGHAMAPPADIRPRQQTRPVFGATMNNPSSALRNFIISPVKRPQVSRNRQHIFTL

SEQ ID NO: 57296 - protein, 71 aa, Sorghum bicolor
  Clone ID: 30965373.pep
MKKPQTLDLDLVALIDSCIGCTRSWVTQDTFPSIRSLSCYTKHLKVPKMTYVDCYTKYLKMSKMSCVMNSL

SEQ ID NO: 57297 - protein, 107 aa, Sorghum bicolor
  Clone ID: 30965392.pep
VNLIKDLVPKKVAKFIPIPMAVAIPFYVGAFFTIDMFLGCTILFIWERKNKAEADSFGPAVASGFMCGDGLWALPEAILSLANVKPPICMKFLSRSVNAKVDSFLGN

SEQ ID NO: 57298 - protein, 151 aa, Sorghum bicolor
  Clone ID: 30965403.pep
SDELQRTWLCRATLKGIDSNKGWSYQSCFHCHHSVSWDGSKFLCNYGCPNNKLSVRYKLDAVIKDETDSMNVMIFDGPAQKLVGVPAEELNGEVTGDDISAVISSQHRRAFVMTSSAVIKFLCRTEGGCSGSVPPKKHLGLVVPSTQCSHV

SEQ ID NO: 57299 - protein, 159 aa, Sorghum bicolor
  Clone ID: 30965405.pep
KPWHCAAAELIGRLIINPDNEPFLLPVIPQIYKRLVDLLSVPAYDAQAAAVSALYNVAEVNMDCRLKLASERWAVDRLLKIVKTPHPVPEVCRKTSMILESLVSEPQNRMHLLVHENTFAEILTSEGKYSDTFARILYELTARPSNKVTSGQAIWGNIN

SEQ ID NO: 57300 - protein, 130 aa, Sorghum bicolor
  Clone ID: 30965421.pep
YSNHLLLLDFFSSKVKSPKHIQIILILLEAKCGVLGDTLNSLEPSRRVLDKEISTNKQNISHLQKKALHHILPSFPHFHSMIIVMMGGQFLFSNAFIIGTTSPFMTQVCKNYYNKALMCIAIWVKLSCVQ

SEQ ID NO: 57301 - protein, 146 aa, Sorghum bicolor
  Clone ID: 30965441.pep
MKCNACWRELEGQAISTTCGHLLCADDAKKILSNDGACPICDQVLSKSHMKPMDINPSDDWTNMAMVGISPQILMKSAYRSVMFYIGQKELEMQYKMNRIVGQCRQKCELMQAKFTEKLEEVHTAYQKMAKRCQLMEQENENLNRD

SEQ ID NO: 57302 - protein, 114 aa, Sorghum bicolor
  Clone ID: 30965451.pep
GAGERSSRRSGGTQFLFLLARAWTLEMAESSSVAMGGESATRAATHSYDVLRGEPAARAAALRDGEQERTGSRCVSTASNAGETFIGRGHHWPGLGEMIARWLENRAGLGEVIG

SEQ ID NO: 57303 - protein, 135 aa, Sorghum bicolor
  Clone ID: 30965456.pep
YWVVAHLLVFHSPLSLSLPRPAWSPFFHEHDLLQWTRSPALTLSCSPSPPPCTATWIVPWASPHPWTGGLDPGSDALDPRSSGLAQCYSVVRSYIPQPDLHCQGPELLPTRLRLGPSLADRWPQPRSRRSPPPPN

SEQ ID NO: 57304 - protein, 173 aa, Sorghum bicolor
  Clone ID: 30965461.pep
MLLRKPPSLHQASPGLGMRTSLSPHAGMRGPSQGQGDFTPLSQLTLGYHGRSCRVLVRVSRIWVASNPITGEVYGLHCLLIDGEGVVMQACARPWDMERLKHQLVEGKVYALSNFGVREKLDKYMACSNGLVISMGAQTVVNEITDHAGSSIPLHSFEFVDFGDLPSRNNDRS

SEQ ID NO: 57305 - protein, 197 aa, Sorghum bicolor
  Clone ID: 30965501.pep
MQKQSGKSGGTGGGTPAKRGRPFGSTTGGGAAAAAAAAAVVDPGASAALVGPSLQVLSALSDQNNKRIVLALQSGLKSEILWALNALTVLSFKEKDDQRRDTTPLAKVPGLLDALLQVIDEWRDISMPKDHLKPPRVRTLGANTTLSGFGQENMEKVYSDTATTSNNDQSKTEDSSVTKKRAASFWFDEDGLFNNDD

SEQ ID NO: 57306 - protein, 206 aa, Sorghum bicolor
  Clone ID: 30965511.pep
VRVISYKWLSRNFSISSNDAKRLLQEFVNKHGTNLQVIYSVSGWLKNNPQNYCIKLISGTKLEEGRQGFKDSCSVQIYSIQACIPKDTAVLWNPEFVQAEELFNQPFDDENCLRDNRFCGVLNSSVKRTSNGKHVSSLPPKPLNSAAVVAQSKPSVTPKEQFVTAQQQDLPVSSKQGAGNKSEKDNSTVLDKAGSAPVVKEQSIDA

SEQ ID NO: 57307 - protein, 200 aa, Sorghum bicolor
  unsure (1)..(200): unsure at all Xaa locations
  Clone ID: 30965528.pep
DAVYININDHLVQFSKSDENDAPEKQGKGKDVGAALVKTLQNTRYSLDEKLEXSFINFFGGRPAAQSKDSDAEGNVISASQDDQGDTNLQQVDDGNNSNAVTMERNEHSEGSSDSEEDNDDIQLRDRDVELREEVEICNGRVRRKAVSANFLDDVDDEGTDEDGDDEEDSGDDQLSGDSVSADDSGEASDSEDEIENTSK

SEQ ID NO: 57308 - protein, 72 aa, Sorghum bicolor
  Clone ID: 30965535.pep
KIPGCNSKWSQQEGGEVWCDTGYPRLVRRPGDIALTGQVSQRCACFQENELDKAGLVVYEGCDYLSKSCKVN

SEQ ID NO: 57309 - protein, 120 aa, Sorghum bicolor
  Clone ID: 30965536.pep
DLIVELSSGKEVADIIPNIHEIKICSGRGIIVTGPAPAGSGYDFFSRFFCSKFGIPEDPVCGSAHCVLAPYWGGKLGKHKLTAFQASPRSGILYLELEAAGRRVRIQGEAVTVMTGTLLA

SEQ ID NO: 57310 - protein, 192 aa, Sorghum bicolor
  Clone ID: 30965551.pep
FHGETKFFACTGFFINYDGCPTILTSASLVRDPDGANEIVSGLRIEVLLPNKDHTVGELEHYSLHYNVALVSVKNYNVDCPKLECELMRYCGTVVAVGRCFESGILMATSGEFIHDCDEESIDSDCEYFSYTTCRTTKVAPFPFLFKLPTQPTPTCLGLKDFVYFYQNMMYLTLLLELIAIYCNHLVTCVIS

SEQ ID NO: 57311 - protein, 173 aa, Sorghum bicolor
  Clone ID: 30965554.pep
RPYGTLQAIQEVYCESGIRGFWKGLVPTLIMVCNPSIQFMIYETLAKRLQSKHSGKQLPKRNLTAMEVFLLGAIAKLGATVVTYPLLVVKSRLQAKQEIGSNAMSRYTGTLDAIIKMVRYEGPHGFYKGMGTKIVQSVFAASVLFMVKEELVKLAVLLVARSRTMLITTSKKQ

SEQ ID NO: 57312 - protein, 156 aa, Sorghum bicolor
  Clone ID: 30965585.pep
MRSEILQLSDKASSFLSSGNKAEAGSVYKTIEQLERNLYHAFSTTLLHTCETLLKIYMELQDWRTALAYCRLTVPVYERVYPPFHPMIGLQFYTCGKLEWLLECTEDALKSLTRATDILKVTHGTKSQFMKELFGKLEEARAEVSFRISSRHGHDE

SEQ ID NO: 57313 - protein, 102 aa, Sorghum bicolor
  Clone ID: 30965609.pep
FNLFSGFFIPRPKIPRWWIWYYWICPLAWTVYGLIVTQYGDLQKLITVPGETDKQTISYYVTHHFGYPRDFMPVVAPVLVLFAVFFAFMYAVCIKKLNFQQR

SEQ ID NO: 57314 - protein, 94 aa, Sorghum bicolor
  Clone ID: 30965617.pep
MSHSHEMTSRKPPGLQLLGGAGSLRTYQTLVLVLTFFAYTCFHMTRKITSIVKSALDPQTKVGFSHWGRLHMSKSNALNTGWLPFNTVDGSALL

SEQ ID NO: 57315 - protein, 208 aa, Sorghum bicolor
  Clone ID: 30965620.pep
LECRAMAALTEDRKKMLTPTIRLMVRLVLKRKLQNEKVIPSSSIDNYNLVDALESHIWKVDENHLVLYAQMANLVSLILPLIELDLKEIAHTFSKFACNAHTICDPELRPLGTGLYPVISIINHSCVPNAVLIFDGRTAYVRALQPIGKNEEVSISYIETAAVTKKRHNDLKQYFFTCSCPRCVKGPEEDALLEGFRCKNQTCDGFLL

SEQ ID NO: 57316 - protein, 217 aa, Sorghum bicolor
  Clone ID: 30965623.pep
TGYNPPTWMLEVSSVAAEVRLKMDFAEYYKTSDLYKQNKVVVNQLSQPEPGTSDLYFPTEYTQSTIGQFKACLWKQWLTYWRSPDYNLVRFTFTLFVALLLGSIFWRIGTNMGDANSLRMVIGAMYTAVMFVGINNCSTVQPIVSIERTVFYRERAAGMYSAIPYALSQVVIEIPYVFVQTTYYTVIVYAMMSFQWTAAKFFWFFFVSYFSFLYFTY

SEQ ID NO: 57317 - protein, 160 aa, Sorghum bicolor
  Clone ID: 30965640.pep
MSSAAVNGLAGAGGGIIAQIITYPLQTVNTRQQTERSAKKRKAGSGGSATHTSTLFQMLQLIQTEGWGGLYSGLKPSLIGTAASQGIYYYFYQILKNKVEDIAAARSKKGHGDGTVGMLSWLGIAAVAGSINVLLTNPIWVLVTRMQTHTQAKRKILESK

SEQ ID NO: 57318 - protein, 151 aa, Sorghum bicolor
  Clone ID: 30965647.pep
MGPPHAAQDPVPSPSPSDGSGSGSSRRRLRRLDRRNASKHIGYTAPNYCQYPPSPQPAASAPGSGPASLAASVACSLDLVNSFRIGGGGDGGGDLRFLCESLGLSGPDDFAIPLADWEAHKAVRSSASASSSPSSARPNHDSPQRDSPLCQ

SEQ ID NO: 57319 - protein, 129 aa, Sorghum bicolor
  Clone ID: 30965649.pep
MARGARFLLVLALLAALLAVVLQLYRLRKPRLWTVEELSPYNGTNEGLPILLAILGSVFDVTKGRSHYGPGGGYHHFTGRDASRAFVSGNFTGNGLTDSLQGLSSSEVNSIVDWRKFYFERYIFAGKLI

SEQ ID NO: 57320 - protein, 112 aa, Sorghum bicolor
  Clone ID: 30965693.pep
KMILTCNVAFVDPTISSFNQFCIYSGKMLPSKRGADDLSRFSTDSSISGFWSELSDEAASKLSKSVVSIALTHGDLVGQNVLFASSGIAIECQPNFTKFVTSAILVRALNAE

SEQ ID NO: 57321 - protein, 211 aa, Sorghum bicolor
  Clone ID: 30965699.pep
MYMDDQGLLSELHLAVDLRPSQTARGTSTLGRDEKRRRLTGPSPASPMDLDDPLSEILLRLPPLPSSLPRASLVCTRWRRLVTDPSFLRRFRAHHWKPLGVFFGGDRDLSFSFFLGPRDSAPSERFSLRVPRECHEGGGGGQAGRNDCFWEFFGCRHGRVVLANRSGYGYGTRQILVWNPVTGEDHLLGVSQFSDSNQSPYGLHMQAAVIC

SEQ ID NO: 57322 - protein, 64 aa, Sorghum bicolor
  Clone ID: 30965705.pep
QDYKYMKYLFERNIGAALYRRYLHVQEMKFRVGRAPHTETGHETSYSLDKKTATILIKCRNPAN

SEQ ID NO: 57323 - protein, 165 aa, Sorghum bicolor
  Clone ID: 30965712.pep
KLRYLKAVVKETLRLHPAAPLLLPRETLRQVSICGYDVPAKTRVLVNAWAIGRDPRSWGDRPEEFDPDRFNDGGGVGFNGTHFELVPFGAGRRMCPGMGMGVATVEFTLANLLYCFDWELPDGVGVDDVSMQEAGGLSVHKKTPLLLVPTRYKCRSRDQTVVSTQ

SEQ ID NO: 57324 - protein, 98 aa, Sorghum bicolor
  Clone ID: 30965718.pep
RSSILNYECGSKEMIHLYEILLKAPGVLGARFSGAGFRGCCLAIVESERAEDAAAYVRAEYEKARPELVSRIPADRRVLVCEPGDSARVILPDPHMRS

SEQ ID NO: 57325 - protein, 76 aa, Sorghum bicolor
  Clone ID: 30965724.pep
FDNQTLRLFKMEDVSMGMWVEKFNKTRRPVEIRHDVRFYQSGCYNGYFTAHYQSPQHMICLWRKLQSGSARCCNVR

SEQ ID NO: 57326 - protein, 88 aa, Sorghum bicolor
  Clone ID: 30965756.pep
ANHTKYGIEWPFMVCCGNGGPPYNMDQGKPGCGDLCPPEAKVVSWDGVHFTDFGSGLAAKLAMSGEYSKPRVKLASLIHGGSKKASDS

SEQ ID NO: 57327 - protein, 106 aa, Sorghum bicolor
  Clone ID: 30965757.pep
AEVEEGICQVMSYLWLESEILPSSSRHAQPSSSYASSSSSSYPPTSSKKGGISHTEKKLGEFFMHQIANDTSTAYGDGFRTAYAAVNKYGLRQTLNHIRLTGGFPV

SEQ ID NO: 57328 - protein, 141 aa, Sorghum bicolor
  unsure (1)..(141): unsure at all Xaa locations
  Clone ID: 30965795.pep
MGMRSRHPKALGFRCYPASHRSLTLVLWSLAALVVVVNFHLLIIHKEEAESMSTHEIRRSIMRELEVVEXEEKFRLSPPRSRRNPRAVRRKGEKKPPTIVDEFLDQSSAVHDMFFPELNTAVDPINGGNDSMYFYYPGRIW

SEQ ID NO: 57329 - protein, 166 aa, Sorghum bicolor
  Clone ID: 30965809.pep
MASTVTLEKTTTILSDDAGAVGSPKTAMRSRLLMKKGAAGGAKAKGRCCGHRCELVSYDKLPEFLKHNEFIVHHYRSEWPIKEALLSAFSIHNETINVWTHLIGFFVFLAFAVCAATVVPAEYESPHMATTGLGNITGNAVVLRSYYSADGAILASTMKAFRNVSV

SEQ ID NO: 57330 - protein, 61 aa, Sorghum bicolor
  Clone ID: 30965819.pep
MSSSSSSSSNPHSGLKVPKKLGKSNYPLWKAFVRSAIRGARLQGHLSGDAKAPNKEIITTE

SEQ ID NO: 57331 - protein, 149 aa, Sorghum bicolor
  unsure (1)..(149): unsure at all Xaa locations
  Clone ID: 30965827.pep
MAHEMACFLGPAPPVPALSPFHEGQAESHGHGHGSSRSGHSRGHWRPAEDAKLKDLVAQYGPQNWNLIANKLHGRSGKSCRLRWFNQLDPRLNRRRXREEEEERLLAAHRAYGNKWALIARLFPGRTDXAVKNHWHVLMARKQREHLSG

SEQ ID NO: 57332 - protein, 199 aa, Sorghum bicolor
  Clone ID: 30965843.pep
MTMVPLDPSSKPTSQRLITEGDTVVVYERHDAMRAVAVRAGGVLQNRFGVFRHDDWIGRPFGSKVFGSCGGGGKAKAKAGGGGFVHLLAPTPELWTLVLSHRTQILYIADISLVVAYLELVPGCLVLESGTGSGSLTTSLARAVAPHGQVHTFDFHQQRAASAREDFEKNGLSSLITVNVRDVQGEGFPEEHCGAADAV

SEQ ID NO: 57333 - protein, 165 aa, Sorghum bicolor
  Clone ID: 30965848.pep
SPPILRRRAPIPAIRSNHRRDRHHERLRPPVATSPSALAKRRLGCPDPLFLGCASIPSLDVRASDVILAAAASSQTPSQPPPRAPASHDLKSDEAGAGSDEVEAADPCEIRQAGVGFGEDEADPVRRTPVFSSALCSVPAPTPSSLLLVVLIREVHHLRGYQGCD

SEQ ID NO: 57334 - protein, 190 aa, Sorghum bicolor
  Clone ID: 30965884.pep
PKRGIRLDYGTLIEYDMKIKTGEQEKDDLQLIDGVSVIGLMGTVDRSVFTSRIIGDYGAIDISASRLDRAVEVTVEVTVSEVQDIFHLCLGCFISGLHEEIRLFDGTIGEPRGLKRYVVAVVMGTQMDLKFKVDAESSGCSEHCCSFTAHQHGHADQLIKTDFASFLVKVTRSVLPNKKNLFGAPAKRVE

SEQ ID NO: 57335 - protein, 154 aa, Sorghum bicolor
  Clone ID: 30965885.pep
QQVAPKSYIWSKSRFFRISSVTTMVLSLIIPLLTMGMVWPWTGPAASATLAPYLVGLVVQFAFEQYARHRKSPSWPVIPIIFKVYRLHQLNRAAQLVTALTFSVRGTETTNQTLAIMNSLGALLTVLQILGVICVWSLSSFLMRFLPSSDIPDP

SEQ ID NO: 57336 - protein, 129 aa, Sorghum bicolor
  Clone ID: 30965890.pep
MAAHQAPASSGAGPRRRPRVLLAASGSVAAIKFEALCRSVAEWADVRAVATASALHFIDEASFPDGVPLYTDDDEWSRWRRVGDEVLHIELRRWADALVIAPLSGNTLAKVRTHASCRLSARRSPPAPD

SEQ ID NO: 57337 - protein, 169 aa, Sorghum bicolor
  unsure (1)..(169): unsure at all Xaa locations
  Clone ID: 30965895.pep
TRYASVQIRTTKRLSQMRLVSCKSDGEMGGGLFLRWRWLLPPRDASSPDPSVAFHLLIHHRRLLADGTSAGPTTPLLIVRVGALERRRRQRGAPAAGALHDAAAEVLLILHGEVAEPAAQFDPGRFLLFVLVPVLVRAAAGRETAHQATAPTRLGAAPARATTASRXHR

SEQ ID NO: 57338 - protein, 50 aa, Sorghum bicolor
  Clone ID: 30965905.pep
QINHSLKQKDSLSYINLIVHSKGNSRLAHLCYCSVCCLNCSSAALASDLI

SEQ ID NO: 57339 - protein, 89 aa, Sorghum bicolor
  Clone ID: 30965915.pep
MDNKMWHIEREEFDNAVANKGPIDGDRLKLLDTFELSLLRPDGHSGPYRAYHPYEKGMTAKVQNDCLHWCLPGPIDAWNDVLMKMLAKD

SEQ ID NO: 57340 - protein, 59 aa, Sorghum bicolor
  Clone ID: 30965918.pep
DSSMLKPRRPPRRPRPATEPTGGLVGLQPPYGGKTHGVPFSSSYKFLLLMVFKKELKLS

SEQ ID NO: 57341 - protein, 105 aa, Sorghum bicolor
  Clone ID: 30965932.pep
EVINPKKMYGPSADIWSLGCTVLEMLTRQIPFPNVEWTNAFFMIGRGEQPTIPNYLSKEAQDFIGQCVRVDPESRPSASQLLEHPFVNRPLRASFESASPPAIRL

SEQ ID NO: 57342 - protein, 60 aa, Sorghum bicolor
  Clone ID: 30965938.pep
PNANLADHLLELGWDCTCDFLAFMVREESPKIQEKAAVIDCKNLFQIISIRLFIFFFILK

SEQ ID NO: 57343 - protein, 216 aa, Sorghum bicolor
  Clone ID: 30965991.pep
RTPAKPNPGGTQRRRRRWIPSPCSATTPPATSWTRSSSPATRSTSAPTTPSRPPPPPPSHPSSPAAPTRSPPPSSWRSTTTSSTPTSSRPRASAASRPFPSPTARPSSTSSASATTRSPPPTRSSPPPSSRRSPTSTRPRRRPRTPRPPRRPPRGSKSARSSGPSRTATPSSTPAAATSSPSSRPPCAARTSSARAAARTRRPLPAPTLAPPLQPW

SEQ ID NO: 57344 - protein, 157 aa, Sorghum bicolor
  Clone ID: 30965992.pep
RRRRTVETRAAVAAVGRVAQLGRRRRRRPSSPAGAPPAAGNERSPVPTAAGCGHQGRRRAGGQGPRSGRPPALATGARPEEDLAPPPAPRPTGEGEEVEGGRGAWGRRSVGEGGAGAGGRAAAAARRAATAAGASRRGLGSGQRGDGARVSSNDCSH

SEQ ID NO: 57345 - protein, 181 aa, Sorghum bicolor
  Clone ID: 30966008.pep
MNIMDSEVVQVVESSFVVPNEPTPREGLWLSPLDLILANRGHTPTVYLYSSSNVAAGDDGFFDVARLKEAMAKALVAFYPLAGRLGVDNHGRAEITCNGEGALFVVARADLTVDDIKDDFKPSPELRRLFVPRIEPASVILAIQVTFLKCGGVVLGTALHHAAIDASSAFHFFQTWSAISK

SEQ ID NO: 57346 - protein, 106 aa, Sorghum bicolor
  Clone ID: 30966011.pep
WYYRNLTVSCVSWCRCVLLGASCGANIADYVTRKVVEDGKPFDPIKVVAQVLMYPFFIGSVPTHSEIRLANSYFYDKSTCLLAWRLFLSEKEFNLDHPAANPLAPG

SEQ ID NO: 57347 - protein, 122 aa, Sorghum bicolor
  Clone ID: 30966025.pep
MCPMETEEDDSGGCDFLDWLGPDTSTTVFELLDDPADLARVGAVSRSWRRFVTENEFSKRLCRRICPEAASFTRAVVVTRSPPPPQPAASASESSQDAECRAREGEHAAYSYLAGAIVSAKP

SEQ ID NO: 57348 - protein, 154 aa, Sorghum bicolor
  Clone ID: 30966028.pep
MGFFGRTPPASCPATRHCAEWARIYLKYCLCSQKEGAALALGLISVISWGLAEVPQIITNYRQKSTEGLSVAFLMTWIVGDLFNLVGCFLEPATLPTQFYMALLYTMTTLILTGQTLYYSHIYHRLKAKKSRAASKPQKHHRGDASLREKLLGA

SEQ ID NO: 57349 - protein, 69 aa, Sorghum bicolor
  Clone ID: 30966033.pep
SCKIIPKQQCFSELVQLYKSNAHIFVRHKSTKHVSCKSANNNMTIWSRAIIIIIVKDIWLPILARKISA

SEQ ID NO: 57350 - protein, 135 aa, Sorghum bicolor
  Clone ID: 30966044.pep
CLLKLQLCSFRWMLCHRGVSGGCFAAEVRCFATKDASPAGGSLRLLRWGRMLGRRMVALPLRTRLRLSWSSRLLKWRRMLGRRLVRFATEDASPAGLVVEVEEVGTDAWPSVVLYVAATNTAAYLGVELFFLFLA

SEQ ID NO: 57351 - protein, 159 aa, Sorghum bicolor
  Clone ID: 30966087.pep
PVVSQKLYEHFKTQQYPSRSVKESLAEELGLTFRQVSKWFESRRHFAKVASSRKGITPDKHSPENTNSPVTPSMQPKEPEGTVMEESNVCINRDATISKKAASSKVGSRKNLGKNSPGSDVGGSKVDSAEDQNPGPDLAAEKARQKAVQQELKKKKMGR

SEQ ID NO: 57352 - protein, 120 aa, Sorghum bicolor
  Clone ID: 30966101.pep
PVQKKLIRTERAGGAGGAVSFEVRDKPASLKSDDWGRVVAVFVLGKEWQFKDWPFKDHVEIFNRVIGFYVRFEDDSVEAAKVVKQWNVKIISISKNKRHQDRTAALEVWERLEEFMRART

SEQ ID NO: 57353 - protein, 51 aa, Sorghum bicolor
  Clone ID: 30966117.pep
LYKLSVKLKIIFVGGLQLQLCLFEVPISFPAYNCTLLIGATCAVLIVQLIP

SEQ ID NO: 57354 - protein, 212 aa, Sorghum bicolor
  Clone ID: 30966119.pep
VTVCSCSSSSLAGFCCAVRALLLRAPSSLSHTTSLDRSIDRSGCVSVSWRGDHAYERTQRGADQGKVIDRMELELGLALPNPYQSPMAAGGELVGLLSGSAGACGKKRVFGDAFGAAAKATLLPLFVHEDGDGGSGDHDDVDHDPSNKKKRLVGWPPVKCARRRSCGGGGGYVKVKMEGVAIGRKVDVSLHGSYQELLRTLERMFPSANQQG

SEQ ID NO: 57355 - protein, 101 aa, Sorghum bicolor
  Clone ID: 30966151.pep
YSSRRRRRSSLRVTESSSAPVHARSERFDSSIPNSSPRCAVAVDFMLRHAFLYLFLFASFDSCVSVLNPLALRACSGSMDIMRWMSIVTLDFLILYVGCCV

SEQ ID NO: 57356 - protein, 179 aa, Sorghum bicolor
  Clone ID: 30966152.pep
MAAVASPALRLRPRAASTSAPSSSSAPPRCRFGTFSHSCFKFARPFPVQRVNGSAPQHLGTLKAGQVLSSIGDHDGRLHIKRTICFAATDKQEPVVSITSDMPVLQETESGIKVSPASENSYFAGRGAGKPGFISFHGSSFQKTTVESVPHPGKEASRLVWFIGPTILVSFLVLPSLYL

SEQ ID NO: 57357 - protein, 150 aa, Sorghum bicolor
  Clone ID: 30966154.pep
TLDTPMAVDELLGCVTILNIFHNIPGRRYELSVVWFTRLLLASYSTAAGLVLRSITKSGNTTDGGIGSRHEWEPPPAKRSRCHREERSRSRNEAVHREFGAVPARDSAMLGRCMVELTRRLQLPTRQRKKRRRGRARSRATAAGSTRAGS

SEQ ID NO: 57358 - protein, 95 aa, Sorghum bicolor
  Clone ID: 30966164.pep
KKKKKKKKKAKTASAQSDNAPQTSSPPLAPVPAMSRFFRGAALTAAAVGGLPSALSWKLSSPIPTYFETSPSSSPSAPVGPAAVTGHLALVRAHP

SEQ ID NO: 57359 - protein, 223 aa, Sorghum bicolor
  unsure (1)..(223): unsure at all Xaa locations
  Clone ID: 30966177.pep
NEVEDGVAAVEGELKELRIGETFEGFTGTSSLSTTNDDDASSTTTEAMFIISPNGKFKRKIKSWMRGALLGSGSFGMVYEGISDEGAFFAVKEVSLLDQGSNAQQSIVALEQEIALLSQFEHENIVQYYGTDKEESKLYIFIELVTQGSLSSLYQKYKLRESQVSAYTRQILNGLVYLHERNVVHRDIXCANILVHANGSVKLADFGLAKEMSKINMLRSCKG

SEQ ID NO: 57360 - protein, 154 aa, Sorghum bicolor
  Clone ID: 30966185.pep
MAATMVAMTARSKNSALSVEKKQVWSIQLPELRFPWDSHEDKGFSLSLQGSGPAHGGLFASVGLKVSTGAPAVAPGPGDKDIKIPFADHCMKYVSEAVGYKVITTKAEPVEEEVVDAKAKKAAKKRGLKLKIKIGNPHLRRLVSGAFAGAVSRT

SEQ ID NO: 57361 - protein, 56 aa, Sorghum bicolor
  Clone ID: 30966187.pep
TILCCLRNEGTHGSCLHGLQHDCTRHGIVFFDLLLIANASVFLTFCCSTQPLLQAS

SEQ ID NO: 57362 - protein, 219 aa, Sorghum bicolor
  unsure (1)..(219): unsure at all Xaa locations
  Clone ID: 30966192.pep
NSNFPRGGGRGSYNRSRTSPSEEDDRPLCQVCFKLGHTADRCWHRYDEDYVPDPKHVAAATKSYSVDTNWYADTVATDHITSDLDKLAFRNKYHGGDQIHTANSTGNEENNSRGXCHKGLYPLPAPPIKQAHGVSRVPMSRYHSRLGHPSTSIVKHVISHNKLHVSVESSKESVCDACQQAKSHQLPYKKSDSISTAPLEHVFSDVWGPAPESVGRKRY

SEQ ID NO: 57363 - protein, 30 aa, Sorghum bicolor
  Clone ID: 30966223.pep
LPCFHKFHKECIDEWLKRKKLCPVCKFGIN

SEQ ID NO: 57364 - protein, 81 aa, Sorghum bicolor
  Clone ID: 30966226.pep
DRISGGLHADGHIPCPGWGPIEANWDHTNQFSVALEFSWGTLFSLRCRVCMELVPWSLSLEYIPTLQAWHNPTFHSMAKLF

SEQ ID NO: 57365 - protein, 94 aa, Sorghum bicolor
  Clone ID: 30966249.pep
CIEQVQRACEAMKTSFTDIRPFEILLRTYEVRDVALKSVTSEEACVGPLPQKRRMLTSPGENTGCTQRSSSILVRPCSTVKGHTGYLTFARLCV

SEQ ID NO: 57366 - protein, 147 aa, Sorghum bicolor
  Clone ID: 30966253.pep
LKPGPGTERHWGLYYANGTAVYEIDLTGRRPLWSYPPLPAPENNTPYKGPIWCLLSAAASNKLNETAVGNALTYACGQGNGTCDAIQPGKNCYMPNTTVAHASYAFNSYWQQFRKIGATCYFNNLAEQTIKDPSHGSCKFPSSLESP

SEQ ID NO: 57367 - protein, 108 aa, Sorghum bicolor
  unsure (1)..(108): unsure at all Xaa locations
  Clone ID: 30966268.pep
VIYRVESENLPLIVLANLVPFLQCERLVLVLCFPACLFLCADQTGCWTTILCLMLHTKVCLGESLGTHELNPYLXGIGSDYSNGVNFAMAGSTVTHRASDYSLNVQVD

SEQ ID NO: 57368 - protein, 137 aa, Sorghum bicolor
  unsure (1)..(137): unsure at all Xaa locations
  Clone ID: 30966276.pep
MAAASFALALLLYLGLDLPEAAPAQSYAVDPGTVVEITYGSVIKLMHERTKFRLHSHDVPYGSGSGQQSVTSFPNVDDAXSYWIVRPQPESSAKQGDPITQGTTIRLQHMRTRKWLHSHLHASPITGNLEVSCFGDE

SEQ ID NO: 57369 - protein, 182 aa, Sorghum bicolor
  Clone ID: 30966285.pep
LAVAAVHVIVEGGSSSSPQHQHQQWRLTLVLAVVVPLVFLILLARTRTRRRAKSGSSTEKGRRLLHLPPGPPTLPILGNLHQLGALPHQSLRELARRHGPVMLLRLGSVPTLVVSSAEAAREVMKTRDADCCSRPDTPGARRLSYGHKDVAFSPYGDYWRDVRKLFVVEFLSARRVRAADYA

SEQ ID NO: 57370 - protein, 141 aa, Sorghum bicolor
  Clone ID: 30966292.pep
IQNYEFLTTSTTRPINEPSAGWEMAARTLDELLEVGGVERGWRRRWDYAAGVRAPRLRRRRCPAPDPVGKWWIRSEAASSASRSRSRSRGRRHRCPAPDPAPVSPSVSRSRGRAAPPREQVRAGKERRQGVREKRERRVWV

SEQ ID NO: 57371 - protein, 202 aa, Sorghum bicolor
  Clone ID: 30966293.pep
AAASSASLFLPIFSSLLLLPRPNATATPFDTTAADAFAAAKPHLAHLQSIPNPASASTSASAPASSSPPPPTCPASISVHREQLPYDGVRVVELPCGLAVGSHVTVVARPRPARPEYDPKIAERKDGEAAVMVSQFMVELVGTKAVDGEAPPRILHFNPRIRGDYSRKPVIEMNSCYRMQWGQSQRCEGFASRPAEDTVDGQ

SEQ ID NO: 57372 - protein, 147 aa, Sorghum bicolor
  Clone ID: 30966299.pep
MVAPGGGAGGGPSRWPAAEELDIVRKKVVDISGRDEQEVRVAACPYRICPLGAHIDHQGGVVTAMTINYGVLLGFVPSNGSEVLLQSGQFEGVIRFRVDDLQKPIDKPENINWESYARGAVYALQNSGYDLRKGIIGYISGVKGLDS

SEQ ID NO: 57373 - protein, 158 aa, Sorghum bicolor
  Clone ID: 30966310.pep
YITQSFHAQVQANRHAADSRIPFEYCYDLSSSEARFPIPDIILRTVSGSLFPVIDPGQVISIQEHEYVYCLAIVKSRKLNIIGQNFMTGLRVVFDRERKILGWKKFNCFSSSTTENYSPQETRNPGVSQLRPLNNSSPAALYDSLLMMLILVHLAITF

SEQ ID NO: 57374 - protein, 215 aa, Sorghum bicolor
  Clone ID: 30966324.pep
MKWLCNFLKGPKPGEPNRRRPQVTAGEEEDALWHQRPVRPKNDPPRNDNEELDRAIAESLTEDVKPPKEKNHKGDNNDEDLARAIQDSLNMNPYTPYNPYAPSQAQPRGHRVCGSCKHEIGHGHYLSCMGIYWHPQCFRCSSCGHPIRETEFTLLGTDPYHKLCYKELHHPKCDVCLQFIPTNRSGLIEYRAHPFWGQKYCPLHEHDRTPRCCSC

SEQ ID NO: 57375 - protein, 188 aa, Sorghum bicolor
  Clone ID: 30966359.pep
MDMKVENTKETREGIEDDDDAKNDNKEEHENAENDDVVAKTSTSDQAETTDEIRKEEIEPGLVSSVQEASDPAPSKDKILENDLVHVIQASEKEIADEIEESKEIHEDNAICHDELQTNSEKEESPQLRSNEPYNVDAKIDATPLCEEIIHDNASIKPRETEEIGENKGLDSTSEPSVESSIQNNVED

SEQ ID NO: 57376 - protein, 161 aa, Sorghum bicolor
  Clone ID: 30966369.pep
SDYLAEAGAPTVSCAGGETVAPEEVFALARAQVDYVLGTNPRGVSYLVGYGSKYPNRVHHRAASIVPYKHSKEFIGCTQGFDHWFGRRSSNPNVLVGAIVGGPDRQDRFRDNRENYMQTEACTYNTAPMVGMFAKLHRMARQEREHGSPAPVPVTSTAAEV

SEQ ID NO: 57377 - protein, 155 aa, Sorghum bicolor
  Clone ID: 30966390.pep
DQAEELFDVASRYLLFPLKRVVADMLLPYLEHVSPAELCHWLMLSDIYGVMKIREYILDIIACNFEMFADTREFRALLLTLPPPSGDDSLRTTRPSAPGTGGNTDQGNILDDLREKWLEAEGAELDERDESAALFDRRLEMLMLVAEKEADDVDA

SEQ ID NO: 57378 - protein, 170 aa, Sorghum bicolor
  Clone ID: 30966406.pep
VVRCQHFAELMYVHCLDIGLLGMPRTDSPVNVYSYGAVDPGMSTDTECGASCILCSNEVPSSDAGDEPALILSDGVEVLKLSGLMAMAMASSSAAACTGPFPPRPFLTDSNSAHLCVWFPSLMESSFPVLNVGHLRSFWSKCRSQARSRRIDELPDPSSSGSGRISPRSR

SEQ ID NO: 57379 - protein, 138 aa, Sorghum bicolor
  Clone ID: 30966430.pep
RPFKRRTRRRWTSSFALPATLSVLLLPPDSSHTLGARVLPPVRRFDWFGCPGLQQWRRRHVCTGSREYVIVYLPEKKKKKKKKKKKKKKKKKKAPKARPHSHTKMPHTGAMKTKVLGLLLLLSGGSSLALKWQTDTGS

SEQ ID NO: 57380 - protein, 190 aa, Sorghum bicolor
  Clone ID: 30966431.pep
MGTLLRYYSSCSHSDSVPSLRHRHHLGLVLAAALLVWCQASLLPVATAQQQQQQPAPAPRVRVGVILNLTSLVGQRRKVGIEMAVEDYYAAFPGSSTRVALRFRDSDGDVVGAASAAVDLIKNEQVQAIIGPQTSAEAEFVAYLGNRTHVPVLSSSATSPALSPSQTPFFVPEQKADIVVGDVTITASRM

SEQ ID NO: 57381 - protein, 142 aa, Sorghum bicolor
  Clone ID: 30966459.pep
FRYNHIIKLSALSEEQTCSSMKFFFLLYYMSPWSDLFFMFNHYCFQLLSLGSGFILRFTHYVHCSLIFIFSLFLFLPFHSINGMLIPCNCTSPLNCTSDSIFFDCPLLHTLVDGAIIFLKTFHAVHLSILLSLHLSLNSHLL

SEQ ID NO: 57382 - protein, 206 aa, Sorghum bicolor
  Clone ID: 30966460.pep
MLSRLAAARRQQLLLPARGAPAVAFAYRSSSTAAAAVHGAAAPAPASASVLPDTLDRGSDAYQRNAAAVGGLLSDLRARVSQVLRGGGVEAVRRNAARGKLLPRDRIDRLLDPGASFLELSQLAGSDVYGEALPSAGIITGIGPVHGRLCMFVANDPTTKGGTYYPLTVKKHLRAQEIASECKLPCIYLVDSGGANLPRQADVFPD

SEQ ID NO: 57383 - protein, 207 aa, Sorghum bicolor
  Clone ID: 30966468.pep
GQLPEVEDNKAIEVDEASKQSNIATPDNAAGERNELESDPDSYAQPAEQVELSIDNENNKLVKAEETSDQSSTVALEERTEDSVASEIDPPVDIKQEQPVEEIKGVDATEAEEDFHTSQADAIEKLASDNNIATIEPTYDIQQVDDLEATEEKQRVEAINDGEQSNIAVSEEPTPTDNGATPEDQHVESNEGTMGNETDNVILAHGI

SEQ ID NO: 57384 - protein, 125 aa, Sorghum bicolor
  Clone ID: 30966473.pep
SPAEGPNLSASASRKPTGLGVTTESPHPSPSPSQIAVDPGSGHHETALWKASKSEDPPRRGASSSAAQSSRRPPPPSMLMQPGSGGALSCYRSRIAAAPEESTAPGLKLGARVSSSQNCVASSRC

SEQ ID NO: 57385 - protein, 148 aa, Sorghum bicolor
  Clone ID: 30966480.pep
MREGAAARRQQPRRAHAKAPRGDSPRAMSSAAATATSCHRLGVALPLLLLLAAAAVLGGAEGKAHSYEDALQKSLLYFEAQRSGRLPHSQRVAWRHHSGLTDGLEQGVDLVGGYYDAGDHVKFGLPMAFTVTMLSWSLIEYGGDVADA

SEQ ID NO: 57386 - protein, 214 aa, Sorghum bicolor
  Clone ID: 30966511.pep
MAPIGVNSNSRTAEAVDSRHLHKVGSGNLSGHSFDRVGEGAMGFSRSGSGPVRGHQLMWNNSNNFHRHPNSPVLWQNPGSFVNNVPSRPPAQMHGVPRAPSHMIENVLPMHHHHVGSAPAINPSLWDRRHGYAGELTEASSFHPGSVGSMGFPGSPQLHGLELNSIFSHTSGNRMDPTVSSAQISAPSPQQRGPMFHGRNPMVPLPSFDSPGER

SEQ ID NO: 57387 - protein, 124 aa, Sorghum bicolor
  Clone ID: 30966514.pep
HGVDDGSSGRGGGGGGGDGDATHNKTPRSLYGDSPRVDVACMHCRRGRCRRQVVMSSEGVVISTITSAAHPLETTMVEDCTAWTNQVDVEAAQHHVKLEGQEVSTRRELRPQLKSHRSFPHSPH

SEQ ID NO: 57388 - protein, 101 aa, Sorghum bicolor
  Clone ID: 30966517.pep
ESFIMQETRKLSTLKVSKGASTVKVKQNLTTSVAYPFTLIKPSWEEGDVTLQDINKRIHAPPKKAPEILGTSAFSGKPVIGKTRIRTEGGRGSITILRTKG

SEQ ID NO: 57389 - protein, 57 aa, Sorghum bicolor
  Clone ID: 30966529.pep
GAAGSGTGRTICRRSQRGASTLLPRASSRVQASVCNQGMTTHCAYAYVMSDVLYLSC

SEQ ID NO: 57390 - protein, 187 aa, Sorghum bicolor
  Clone ID: 30966625.pep
MDQSYHGGAAAAAAGGSDGQILWDWQTGEHCEPSDGSHDATKFLWDCLNQDDNELLGLLGNRTPLRDCCDFFADLGDITCKETLDLEESRESKRRRILEYPSESSQSEVASHETGSPFVTSEVAEVSLLCTDEPESLNCDMQYTSNNLDTNSNEAPYEQEDNHFEHCSYGTPVYIEPDQVPCSWESI

SEQ ID NO: 57391 - protein, 213 aa, Sorghum bicolor
  Clone ID: 30966633.pep
NVRAERNLLAEVDSAYIVKLYCSFQDDEFLYLIMEYLPGGDMMTLLMRKDTLTEDESKFYVAETILAIESIHKHSYIHRDIKPDNLLLDRSGHLKLSDFGLCKPLDSSSFPNLSDLDYAAGKSTNPSSDGDKQSSNSTAPRRTQQEQLLHWQKNRRMLAYSTVGTPDYIAPEVLLKKGYGMECDWWSLGAIMFEMPVGYPPFYSEDPMSTCRK

SEQ ID NO: 57392 - protein, 151 aa, Sorghum bicolor
  Clone ID: 30966635.pep
PLIPELNEGYTLTDWCSREVIQRKVFTDHIQIIALVRALGVPLRVEYLFQEVGQDLYTGQTSEDDISICICLPCHHHVLPPAHQVPRVTVLYSDQHYDVIYPYCADGKVILTDVRSSQQSDKIECPTAAKSPSQHQGSSYSDEKSSQRLTG

SEQ ID NO: 57393 - protein, 83 aa, Sorghum bicolor
  Clone ID: 30966640.pep
EEEDEEEEVTGGGGPGSSSSSALAAAGNGHGPHQQRRLWVKDRSRAWWDQCSSADYPEADFRAAFRMGRATFAMLCDALGSAV

SEQ ID NO: 57394 - protein, 202 aa, Sorghum bicolor
  Clone ID: 30966666.pep
METLQAHDGLFSCVFLVIVTTITVLYLKQLLLAAFKRRASSPSLPCPRGLPLIGNLHQLGTAPHDSLAALAAKHAAPLMLLRLGSVPTLVVSTADALRAVFQPNDRAMSGRPALYAATRITYGLQDIVFSPPDGGFWRAARRASLSELLSAPRVRSFRDVREGEAAALVAAITDMSRSGSPVNLSEELMATSNKILRRVAFG

SEQ ID NO: 57395 - protein, 58 aa, Sorghum bicolor
  Clone ID: 30966672.pep
LVFHPKTSSSLIFLLFAYMSFLMAFLKSFMRDFLFVAIYCTSVCEFHVDSLPDRIQVK

SEQ ID NO: 57396 - protein, 146 aa, Sorghum bicolor
  Clone ID: 30966694.pep
VNPNEPGGKAVSEVITEMTGGGADYCFECVGSTSLMAEAFKSSRKGWGKTIILGTDAGAAPFSISSSDIKRGRSVTGGLLGGIKPKNDIPVLAQKYLDKELELDEFITHQVGFEDINRAFDLLQQGRCLRCIIWMDDGAKENGALA

SEQ ID NO: 57397 - protein, 114 aa, Sorghum bicolor
  Clone ID: 30966711.pep
MPWSLRKENWLPFGLIKTGVTSGASTPDKVVEDALQKVFEIKREELDGAPQALEPILPYFSKQREPRAEKGQQRDCFFQHVWIPDDAAYYLWSCGLWIVIINRRVFVLLVSERS

SEQ ID NO: 57398 - protein, 64 aa, Sorghum bicolor
  Clone ID: 30966731.pep
AQMEAYVAQPIEEGQNPKTPVEAVAHVLPKSTFLRNVLYFKTCGMLVILQSYVVMFIHLNQIFV

SEQ ID NO: 57399 - protein, 76 aa, Sorghum bicolor
  Clone ID: 30966743.pep
AYQPNLSAIQQYFSLNKSANSTLCHGLSAKRCYCLNFRISHINNCLNFRLVSGIKNATIVDQFYDKSNWCIVLEKL

SEQ ID NO: 57400 - protein, 103 aa, Sorghum bicolor
  Clone ID: 30966745.pep
MDPSSTGNWELIDTVSLRQVFGPNADPTWSSQGADVRVAAVGDNADFVFLRIQKKVFYLHISSRTVEEVYELAQHESLFGIYPFMMVWPPTFPTLNGGHDNDE

SEQ ID NO: 57401 - protein, 101 aa, Sorghum bicolor
  unsure (1)..(101): unsure at all Xaa locations
  Clone ID: 30966748.pep
RIFLHWCTSXIGISCHLSCELNRVKFLLYCYQYISLIEACXFVAIPVKNSTVCSPVLAEVFFMLCTHFSKLRHQIFLISPRLDRQVYVHYHPGVVRWRPGS

SEQ ID NO: 57402 - protein, 41 aa, Sorghum bicolor
  Clone ID: 30966751.pep
FRVQQFQFPQGTVLKCSTVIRQCRCRVLVNWIVPPRSCRLV

SEQ ID NO: 57403 - protein, 209 aa, Sorghum bicolor
  Clone ID: 30966759.pep
NDNFADPEESNMLNVFEVASKLIKRELDQEMHGSLGHGEEENMEEGMDAFVSDINGKDADETALENSEWTGTEEGSARVNQEDQNSSGSTNRGKNDVDANRDTTCDEVGSEPLSGDEVVIKATIDSIRGVSSRGERELPTERSTCEDHRKASIMEEKDTTARISKAEHVPSPLETMCGVTNSAEAPTSVENMTRADSACEKDKGPSQRV

SEQ ID NO: 57404 - protein, 167 aa, Sorghum bicolor
  Clone ID: 30966768.pep
MILVFSTITARSLHKAIPASHSHSSNFWNKEFFSCKPTFQHLSTDNPMSPNDLLEAQDRVPAEGNHSCSSSVQSTPEIEKKYVHRVYDAIAPHFSATRFAKWPKVAGFLNSLRPGSIVLDAGCGNGKYLGFNPDCLFIGCDISPPLIEICAGRGHEVLVADAVNLPY

SEQ ID NO: 57405 - protein, 53 aa, Sorghum bicolor
  Clone ID: 30966773.pep
FLISPIVATQGVIELEVKQHFCLFTYGLLCLFCVTYVVTKHNHLNGTQQIYDP

SEQ ID NO: 57406 - protein, 214 aa, Sorghum bicolor
  Clone ID: 30966776.pep
MPRPNPVLLLAILALVLSSCPASCAAPVLLPVAKDAATSLYTIPTRDGAHHVIDLAGPLLWSTCDHIPAKISCRDPVCKLANAYRAPSCGIAGAGQQCSKRCKAYPYNPITGRCAAAELVHTRLIANTTDGKNPLSQVSVPAVAACASATLLEKLPRDVTGVAGLSAAGLALPAQVAASQRVAKTFLLCLPRSGGRGDGVAVFGTRGPFYLKLF

SEQ ID NO: 57407 - protein, 99 aa, Sorghum bicolor
  Clone ID: 30966777.pep
KKELTQIDNYLVCLTTELAVFALSLKIQCAMLEKCGLSSHYKNVVYIPTCEEAFWPMPDWCITGTAWPMHLQRLLRVSEIAMISIFRFEPFSFQPCMPF

SEQ ID NO: 57408 - protein, 84 aa, Sorghum bicolor
  Clone ID: 30966782.pep
GTSRRPPAPPVGSHQQPPPAPATPPPPVPAAGRRRRRGRRRRRPGRRRPPRGEGRGPLLPRPQSPPLPWRCWPGWRLTANAHSL

SEQ ID NO: 57409 - protein, 195 aa, Sorghum bicolor
  Clone ID: 30966809.pep
MQPPHQPPMNGQHGPPPPQGSGVPTPPQQQAPAPPYYQQQAPPPPQYYQQAPPQPWGQQQQYAPPPQQYAPPPQHYAPPPQQQYAPPPPQQYAPPPPQYAQPPQYGTTPGTGEVRTLWIGDLQYWMDENYLHYTAFAPVCQQIASVKIIRNKQTGHSEGYGFIEFYSQAAAEHTLMNFNGQMMPNVEMAYKLNWA

SEQ ID NO: 57410 - protein, 105 aa, Sorghum bicolor
  Clone ID: 30966841.pep
PRRCASTSGVRRRPPSIAPPRPILLPLVASGRLGLGMGACARHGHALADAAPPLPTKQDTEHHHQRSEMQCPALPRLRCLVAFILKHELKRISLVAFILKHDLST

SEQ ID NO: 57411 - protein, 163 aa, Sorghum bicolor
  Clone ID: 30966851.pep
MSVAACPPSSEQSRQHAYVQAAAIMGQCCSKGAGAAADDAAAPDAKAEAPSRAASNGGQERPSASSSAAPAAGTNNKQAVAASPSGGRASTGTSSSKPPGPLGAVLGRPMEDVRAAYSMGKELGRGQFGVTHLCTHKASGEKLACKTIAKRKLATKEDVEDVR

SEQ ID NO: 57412 - protein, 205 aa, Sorghum bicolor
  unsure (1)..(205): unsure at all Xaa locations
  Clone ID: 30966862.pep
MRFRVPTDRSPERPTDTAPLSSPVRRWWWRASRFRRLGLGRPGQGRRRRLPTDHHYAHQAIMRPTRRHVTSCPPRRRGRSGVPPPRAAAGHAAPRSTPSPSCPRRRRTAAGAAACAPPSCRWPRARRPRTRRAAPRAAPAPRAPGSAPRXTPARPAAAARSSSARRLPRPLPAPAPSTCRRGRPPRSAPRTRRRARCWPWPRCPR

SEQ ID NO: 57413 - protein, 63 aa, Sorghum bicolor
  Clone ID: 30966866.pep
NYEAREVSKRRAHGGVDLSLHNRVATLFLESCWTRRLMWWGASHGRGNGGKGRISVVLMKPWG

SEQ ID NO: 57414 - protein, 70 aa, Sorghum bicolor
  Clone ID: 30966868.pep
AFLAYVCVVAGWRVFALAGGLTALGVGLHGAMRLCRSRKWLRFKTGVVAAAEDHPQQQGDVVVVSAGDRV

SEQ ID NO: 57415 - protein, 107 aa, Sorghum bicolor
  Clone ID: 30966874.pep
RYFIEHRHCQRRRRRDVDISFGDAATTMPPWPIAVGVQAMNGGATMAVETASAAIAGTGHDSEVGPSAARSFRLFGFNVECSGDDAPAAPASAEVEYVDVDGDDDYS

SEQ ID NO: 57416 - protein, 36 aa, Sorghum bicolor
  Clone ID: 30966900.pep
HIMGLYFTMIYTLFDPNNNTNTMYRIVNLPSPKPIG

SEQ ID NO: 57417 - protein, 77 aa, Sorghum bicolor
  Clone ID: 30966903.pep
KEEDIPIEEFEKRNFPYLLNEPRSIGGYQCLFAVDGFSRVKFKPQIPPLFLVKEPKVFAHGNMRDPDIFSLNWPGCP

SEQ ID NO: 57418 - protein, 125 aa, Sorghum bicolor
  unsure (1)..(125): unsure at all Xaa locations
  Clone ID: 30966905.pep
AANALAKGFNDALRAALANLTASGALPGARYSVGSSYSVVSHFTAHPAAAGFREVASAXLGGGRLNAQTGCTPNATYCSDRGEYLFWDGVHGTQATSKKGAVAIFSAPPQMGFAAPINFKQLVSS

SEQ ID NO: 57419 - protein, 111 aa, Sorghum bicolor
  Clone ID: 30966932.pep
LAKAKAQTALAESREAAAIEASKQAEDRHAQKLKDFYLATRPKRRADTLEQREWDLPLAPPPNNASYVIFETRSSVDGKEILSLTQAWTDNGVSFRAILWKDCSSPEACDQ

SEQ ID NO: 57420 - protein, 163 aa, Sorghum bicolor
  Clone ID: 30966939.pep
MAGRYDRNPFEEDDVNPFAGGSVPPASNSRMPPLPHEPAGFYNDRVATVDIPLDSTKDLSKKEKELQAREAELNKRERELKRKEEAAARAGIVIEDKNWPPFMPIIHHDIANEIPIHLQRMQYLAFSSLLGLTACLFWNIIATTAAWIKSEGVMIWLLAIIYF

SEQ ID NO: 57421 - protein, 125 aa, Sorghum bicolor
  Clone ID: 30966950.pep
MNFFSSVFSAPAGEDGEEPRQEGEQEPAAQESGGGWIFGSLIDTLKEEIEEQRKVNESAAAAEAEEAHSGAEGEAGPGGGWIFGGLIKTLAEEIEAQRKEQEAIAAAAAAAAAEEEEEEEEEEEE

SEQ ID NO: 57422 - protein, 196 aa, Sorghum bicolor
  Clone ID: 30966955.pep
RSPLTTTTLVFIVGLVQLAKMADEAWTSSYCLTTPGFPKLLYATMTRLGILDHPEYVGREYEEYGTERCDVVIFVGPSKEFPDTIPWVVSTTGFRFEDTYQVAARKALRYLWQIYEEHVGRTPMRFFPPLERNSPVWVDRMRTLKGTRLREDDPTIVFMSEYLLSLDEQYDRQANSLRECICRAEEAEKQIRSLEV

SEQ ID NO: 57423 - protein, 198 aa, Sorghum bicolor
  Clone ID: 30966972.pep
MNQEIQITKLPSQRQQQQELPLPPEGVTIVQDGTSQDQQQQAAQGRHGAVQGGGHGHHHHRSSRKLTVLPLIFLIYFEVAGGPYGSERAVRAAGPLFTLLGFLVFPFAWGVPESLVTAELSAALPGNGGFVRWADLAFGPLAGSLLGTWKYLSCVINIAAYPALVADYLARVIPAVAGGRTRTGTVVGMTVFLSFVNY

SEQ ID NO: 57424 - protein, 125 aa, Sorghum bicolor
  Clone ID: 30966978.pep
MYMDLSLGTLVQDTQEVQEEDQEDNLDQQRAIGQDLHQQGGGGGGEPSHGVEREHMFDKVLTPSDVGKLNRLVVPKQHAERFFPAAGAGTQLCFQDCGGALWQFRYSYWGSSQSYVMTKGWSRFV

SEQ ID NO: 57425 - protein, 174 aa, Sorghum bicolor
  Clone ID: 30966987.pep
MSPTMASSLCVFAAMSGATGRPSSTGGSVVPPGRLSSTAQGTKGKRAVVQPLAASVVTDTPTPTPAIAPAAPPARPVVDAPRRRGGRGTGEHAAWKSVRQERWEGALELEGELPLWLDGTYLRNGPGLWNLGDYGFRHLFDGYATLVRVSFRNGHAVGAHRQIESEAYKAARAN

SEQ ID NO: 57426 - protein, 195 aa, Sorghum bicolor
  Clone ID: 30967003.pep
MFLGCSCSRPPLCPFSPATRTMGRAMRWLKKVLTGSSKKEADCRDRKAHNAAACAGGGGGGGVGLGPPPQAEKRRWSFAKPRNSVADSGRRPSSVTAVAAGELLSQVRPCNCGQEREVEAAVVIQKAFRGYLARKALRALRSLVKLQALVRGYLVRKQTAMTLRRLQALMRLQAKTASSRKSVEQERIVARGVKP

SEQ ID NO: 57427 - protein, 183 aa, Sorghum bicolor
  Clone ID: 30967006.pep
MPRPKPGSGGGGGGWLSGWGWDLMLGSIAAFYAVMAPYTKVEESFNVQAMHDILYHTYHIEKYDHLEFPGVVPRTFIGAFVISILSSPAVFVLRLLHVPKFYSLLTVRLTLSCVTLMSLRLLRLQVKKKFGHQAEAFFVILTAIQFHLLFYSSRPLPNIFALALVNLAYSFWFKGSYLCTLQA

SEQ ID NO: 57428 - protein, 48 aa, Sorghum bicolor
  Clone ID: 30967038.pep
SSPQKESIYNMIITVTYAAFSYKMTNGGAYMLFSFFSTSLRSMPFPIQ

SEQ ID NO: 57429 - protein, 172 aa, Sorghum bicolor
  Clone ID: 30967049.pep
MLPSKFLFLKHLRIYLGWAFSSGYDFFSLVSFLDASPCLENLLLNLQVSQHASVFDGSSQLRQMPEQHHGCLKSVKFIGFNSEKSLVELTCYILKNAKSLGCLTLDTTYGDPKCDNKIMTGGMCAPMNKGFLMEARRGVAAVRTYIEDKVPSTVKLTVVEHCTRCHADNLSE

SEQ ID NO: 57430 - protein, 138 aa, Sorghum bicolor
  unsure (1)..(138): unsure at all Xaa locations
  Clone ID: 30967060.pep
DKDSKKNTSPFSSFSWSGQRKVPSYLHKNVFPQEFMSTLRTIAMQEHELEXLLVDLLGVKMAELDEGSGTEASDTELLEQFDSIQSEDCASESDEKHKRKSKINYRSCIVYRRGQKQLTRLFLREAEYLLELSAKEQT

SEQ ID NO: 57431 - protein, 103 aa, Sorghum bicolor
  Clone ID: 30967083.pep
RAPQGHAQIFCVSASTTWMLHAVMQIRTASSSSVQSMAMFKHHMPSQVSSSTLVGTGSMELARWCLDPSIWESFVAFRDRLTVPFFVRCLPASEPMPGKENLL

SEQ ID NO: 57432 - protein, 123 aa, Sorghum bicolor
  Clone ID: 30967110.pep
GGRSGGAMGISARWLKSLVGLRKVERQQQHRKEDADVGRMKGDVADQFHFQNQRSQEDSSIAAQEEIPEVPYGNDPPEVDSNAPSCLEPTCDSAHVPLSQTEEELEEIWAATIIQTAFRAFLA

SEQ ID NO: 57433 - protein, 208 aa, Sorghum bicolor
  Clone ID: 30967141.pep
MLRGAISRLGARLRLHADPSPVSPYLRALSTRRGKRSSPTVSPADSDDEGPLRGLFVLSRDPECPPRLLVVQPRLRPGSLLDSKLAEALNLANSLEEPRDGFYHSEFGAKGAPPHLVVQNPASRGRSHADTYFGPGTVDNVKCYLRASESEEDVDAVFVNAILSGIQQRNLEVAWGKPVLDRVGLIIEIFNAHAETKEAKLQSELAAL

SEQ ID NO: 57434 - protein, 130 aa, Sorghum bicolor
  Clone ID: 30967146.pep
MGSSKRVPPYLLLVLLAIGAAAVSVGILHKMRERRVLTVLLQERDQTAHLLPSTPREKRKEIIKEMRRKVDELEAKTSVLSIERAELKNKLMDSETTTTYLTNTQKELEAALVEKESHINQMIENAAASY

SEQ ID NO: 57435 - protein, 213 aa, Sorghum bicolor
  Clone ID: 30967169.pep
HSSNSNTAMAAAAADDDAKLESFLQWFQANGADLRGCTIRACGGKGLGVFSTAAPEPGANDGVAMVVPLDLAITPMRVLQDPLIGPRCHALFEEGRVDDRLLVMLFLMAERRRPGSLWKPYLDMLPSTFGSSLWFTEEELAELEGTTLHRATVIQRKSLQSSFDEKVKGLVEELLHVDESESSIEVLFEDFLWANSIFWTRALNIPLPHSYVF

SEQ ID NO: 57436 - protein, 108 aa, Sorghum bicolor
  Clone ID: 30967177.pep
TSNALLPISEDVYAGCLPACYCSCICSHKPTATVTIARHLATILWVTSHDRATVVATLCHLDQIFFGTYAHPFIFTSLICDTEQPNHGSHMGWTQDPWVLDLTGCGGF

SEQ ID NO: 57437 - protein, 115 aa, Sorghum bicolor
  Clone ID: 30967202.pep
ERLPTSSATLVTLESTEVFGLDAADVKYVTQHFRYTFTNDKVRRSARYYSPGWRTWAAVAVQLAWRRYKHRKTLSSLSFIRPRRPLSRCSSLGEEKLRLYTAILTSPKPNQDDDF

SEQ ID NO: 57438 - protein, 184 aa, Sorghum bicolor
  Clone ID: 30967223.pep
CDIKPENILLDASFVPKIADFGMAAFVERDFSRVLTTFRGTAGYLAPEWLGGVAITSKVDVYSFGLVLLEIISGRRNSPEAYSSNNYHIEYFPVRAISKLHEGDVRSLVDPQLHGDFSLEEVERVCKVACWCIQDNELHRPTMGEVVHVLEGQQEIDMPPMPRLLAAITQGAGAITEISNASSM

SEQ ID NO: 57439 - protein, 207 aa, Sorghum bicolor
  Clone ID: 30967251.pep
NNLFYFSFQEQDSPDSLFSFAIDISEDEGEEASSSRAVGITSAEIRAKLEELSALLHQDTAQLVDDSDPAKALFKTLRGQIPTDAEEILFQAAHLESRQLQYQKAAQRLADRAAHAQLSEEMMKVKLLADEKNKSIDILTSSGDVLKQKISDLSARREALLAELKQVEEALSQAQQEESQLPETIKLLEQERNIQARKALQMKKKLK

SEQ ID NO: 57440 - protein, 150 aa, Sorghum bicolor
  Clone ID: 30967255.pep
IKSDVFSFGILILEILTGRKSSGSFNIEESVDLLSLVWEHWTMGTIVEVMDPSLRGKAPAQQMLKYVHIGLLCVQDNPVDRPMMSTVNVMLSGSTFSLQAPLKPVFFIPKSGYYSTVYSESYPTASQSTANVMSGALSPNEVSITELEPR

SEQ ID NO: 57441 - protein, 222 aa, Sorghum bicolor
  unsure (1)..(222): unsure at all Xaa locations
  Clone ID: 30967266.pep
GAAEQALLMKNLDEFYNRKEIPWVNLVWERHYKNDKLPGAVKKGSFWWRDVLKLLPQFKQMASIKTNSGITCHFWKDSWDSQLLEIQFPXAFSFARNKNITAHKALSFNNISVMFNLPVSQVAYEQMAIIQQKMEVLQLDGSIQDVWTYQGGSTSFKSENTYRRLLGHQQTEPALTWIWKSACQPKHKVFAWLLLKDRLSTRNILRRKQTNIASFNCEFCLQ

SEQ ID NO: 57442 - protein, 225 aa, Sorghum bicolor
  Clone ID: 30967279.pep
FRYEVYSFFSGSPSLRLPAASPPAASPTTPFNGTPTATPPPPGRTRNKTGIALAIVLPIIAAVLAISTVCLCFFWRRRKQAREQTPSYSTNAGDMESIESLLLDISTLRAATDNFAESNRLGEGGFGAVYKGVLPDGQEIAVKRLSQSSGQGIQELKNELVLVAKLQHKNLVRLLGVCLQEHEKLLVYEYMPNRSIDTLLFDAEKNKELDWANRVKIIDGIARGL

SEQ ID NO: 57443 - protein, 168 aa, Sorghum bicolor
  Clone ID: 30967283.pep
MQRHTGRDMWDVEECQSPRMGSVILGVDGGASNTVCVCIPAAMPFNDPLPVLSRTVAGCSNHNSVGEDRARETLERVMSQALLKARRRRSNVCAVCLAVAGVNHPIDQQRMLDWLRDIFPSHVKLFVENDAVAALASGTMGKLHGCVLIAGTGTIAYGFTSDGREARA

SEQ ID NO: 57444 - protein, 102 aa, Sorghum bicolor
  Clone ID: 30967312.pep
PPSHCTRWLRQWLPRRPLLLPLPLPLVVACRPCSFRRESSEGDAVEEESADERAERSLDMAMAIQLSILVWHCLLPLNPRVVKLTVATSPASRRLAPLDRKH

SEQ ID NO: 57445 - protein, 216 aa, Sorghum bicolor
  unsure (1)..(216): unsure at all Xaa locations
  Clone ID: 30967332.pep
TPPYSSSAAAAAAATTTTTTVTDTLAAGQALAFGDXLVSRNGKFALGFFQPTAVISKSRNITSPNWYLGIWFNKIPVLTTVWVANRDTPITDPKRKQTHLKISSDGNNLVIVTQASPETETLVWSTPTPSVNRSGASLNSTTTTAVLLDSGNLALLELASPSSSNVTLWQSFDYPTDIVLPGAKFGRNKVTGFIRQGITWKSRIDPGLGSYSVEID

SEQ ID NO: 57446 - protein, 122 aa, Sorghum bicolor
  Clone ID: 30967356.pep
ASYENVLKKWMPELRRFAPNVPVVLVGTKLDLRDHRAYLADHPGASTITTAQGEELRKQIGAAAYIECSSKTQQNVKSVFDTAIKVVLQPPRRREAMPARKKNRRGSGCSIMNLMCGSTCAA

SEQ ID NO: 57447 - protein, 185 aa, Sorghum bicolor
  Clone ID: 30967359.pep
QLSLPVSHSAPVAVRIADGHTMHCSSVVKSVTWTIQQYQFQHDLKVLPIPQYDIILGMDWLQLFSPMKVDWNAHWLSIPYHGHTIQIHGNSDSEGDNPFQFLIQLLSLEVSDRPDSSVCPSAVSDLLAEFPSVTTPPDSLPPRRQCDHVIPLVEGARPVSIRPYRYPPALKDEIEAQVATMLKQG

SEQ ID NO: 57448 - protein, 129 aa, Sorghum bicolor
  Clone ID: 30967388.pep
VIASARTSGWAGDYYAHHLQYRYAVAVNVIVCAYSIAQSFGEIRRLISPRFIFRSMSSYYCSLFLDQALAYLLMSASSAAASRNDLWVSRFGTDAFNRKITSALWLSFIAFLMLALNALISTANLFSML

SEQ ID NO: 57449 - protein, 211 aa, Sorghum bicolor
  Clone ID: 30967413.pep
KQGSLSVDEYYKEKEKAMIRANVIEDEEQTIARFMSGLHRKIQRIVEFQQYRNLVELVHQASKAERQLQQDMKSTRGVSFSTKSAASGSKFSPKESESKGTFSSSNGGARTSNLGSSSSKELAAQNEKFKSANSVGSSSKSSGIQCFKCGGRGHVARECPNARTIIVNDQGEYESASEEEQEDSGSESNLEDIYEFESGTALVVTQILRYK

SEQ ID NO: 57450 - protein, 71 aa, Sorghum bicolor
  Clone ID: 30967433.pep
NLIYCTLCKLRLDLGEDKMMLEFLRERLANAHTDHFDRGCKSAPKFCLQTMFGLTALYIQCEECSTFDIVV

SEQ ID NO: 57451 - protein, 161 aa, Sorghum bicolor
  Clone ID: 30967455.pep
RRDRASMDSAGPRRVSLKARRPDWKSELRTNCLRRVRKDRTDLLWKIREQGQLPANDMEKVESAVRNIISDEIEKLKQSNEGKEDQEMDVIWEYQGPQAAEPAEVESEDILLEMERLLYEDIREEQIRKQLEALDEEDAYLAQTVFDHMQLNDNEAAETAK

SEQ ID NO: 57452 - protein, 188 aa, Sorghum bicolor
  Clone ID: 30967459.pep
MGTVGGELPLADPAADADRARLQQLGYKQELKRGLSVVSNFAFSFAIISVLTGVTTTYNTGLRYGGPASMTLGWLVVALFNGCVALSMAEICSAYPTSGGLYYWSAKLAGKEWAPLASWVTGWFNIVGQWACTASVDFSLAQLIQVIILLGTGGANGGGYLASKYVVLAIHTAILVVHGLINSLPIHW

SEQ ID NO: 57453 - protein, 129 aa, Sorghum bicolor
  unsure (1)..(129): unsure at all Xaa locations
  Clone ID: 30967466.pep
AIEVFSDLDPAVPPPPPPPLPPKPPIRHHYTRRPKQSTSTTAAAAMNPDTQLQLEEIRKLSVEQTVIQQKLTEQKDFLERRFTEVDDNIDLRFQEAELVVEQRIIDSELRQDVRLXAIEKTTADLGEWR

SEQ ID NO: 57454 - protein, 202 aa, Sorghum bicolor
  Clone ID: 30967494.pep
MFGTPSTTPVFGNPSTTPVFGTPSTTPAFGATSSTPAFGTPSSTPAFGTPSSTPAFGTASTTPAFGASTSAPAFGTASTSSAFGSLNFGTPSSTSAFGTPSSAPAFGALNFGTPSSTSAFGTPSSAPAFGETPSPSPFGFQQQQATPSPSPFGLLGGGGAQITTQMAPVAPLPLSPSDRDIQAIVDAYKEDPGNPRYAFRHL

SEQ ID NO: 57455 - protein, 194 aa, Sorghum bicolor
  Clone ID: 30967497.pep
MASTPRTPAPVRSPPPVPTPTHPTPPPPPLETPQPPLPVSTPPPALETPPPRRVRTPPPPLETPPPPSPSSSQPGDEYHTPAPSLADGSPREEEASFPSDGREGGGAPAPPKSPQLSPIRLAAARLLLPPPSPRTPTGQNGQEEQEGGAKAAAAGTGTGMGTAAPARQQLRLTGLARSPSSQRSLATTNSSPSP

SEQ ID NO: 57456 - protein, 88 aa, Sorghum bicolor
  unsure (1)..(88): unsure at all Xaa locations
  Clone ID: 30967523.pep
FFYSKMSEHPEIDDCVTVAQFNEMKQSMETLTNNVQALMNRLQIHPHHNAXGSHHEDEVEESEGEAARRAREWPRERAAANARRPPFS

SEQ ID NO: 57457 - protein, 75 aa, Sorghum bicolor
  Clone ID: 30967551.pep
MVYGFLVISRNQNFLECPNAYLAGQVLNGISFIIRFNPRVRWTFVHSSSFLLNPLIDYPCCFLAIIQNTDAIDFG

SEQ ID NO: 57458 - protein, 75 aa, Sorghum bicolor
  Clone ID: 30967568.pep
TSACAAGRICSRGSHERTEHFCSRKLVATSCRKYDKAKCHDRSQHPCTDSPDAEQGYELRPKFTCAGAVGQHQIL

SEQ ID NO: 57459 - protein, 71 aa, Sorghum bicolor
  Clone ID: 30967582.pep
LRDQRRIHPVSVLARGFHGIPDEKDVFLSLPARLGRAGVQGVAEMELTEEEAKRLRRSAKTLWENCQLLAL

SEQ ID NO: 57460 - protein, 60 aa, Sorghum bicolor
  Clone ID: 30967593.pep
QFGPCHHGSIQPYIIQPFITSITPLSSQTLQFMVGIMTIAMKFSKHLVGNNLTCPIYANP

SEQ ID NO: 57461 - protein, 166 aa, Sorghum bicolor
  Clone ID: 30967626.pep
RKKKLGLLRVPSLLPPSSPDAATRATVMAMSASSAPWPPSSTPPLPLPLPLPSPPPPPSPLPFGGGGGAPGDPSVCGAPPEFACHADRWASLHAVSPSRLLPSWLPQHSRSRIWCLARRGTTVHPTLAHAALRRLPSSRAPTLCSLELRPHQATPQRCLSRALPCP

SEQ ID NO: 57462 - protein, 150 aa, Sorghum bicolor
  unsure (1)..(150): unsure at all Xaa locations
  Clone ID: 30967636.pep
MPPFPAATTASTTSHLALLVLLSSSSLFFLYKSLRLRRKPSPAPALARTATPTLLYASATGTSKTLAEHLSARLTADAGFPVRASDAATFDPDDLPSVPLLLLVIPTHDGGAPPPSAAFLSRWLEESAADFRAGALLLSXLRFAVFGVGS

SEQ ID NO: 57463 - protein, 173 aa, Sorghum bicolor
  Clone ID: 30967647.pep
NGGLVVLQPNPLSLSVPDPALDRWLRDSGYLDLLDSTTTGAPSSTSAPSTSASAAARPGTGPVSSGVAADVLAFARTLASLLALNPFARLSTADLAAPTPSWSLAFVGPPGAASYSWPPTPTQARLRVQENVRRYARNYAALTILVFACCLYRMPMALLGMLASLAVWEGVRY

SEQ ID NO: 57464 - protein, 91 aa, Sorghum bicolor
  Clone ID: 30967661.pep
LILQGIDPKGTYNASLPLISVLLFLRKTPSSRLETVAPSSREATMRARAPRLNRQPEHRCTSRLLNSSTHMDPAWVHAETSIGAREVPRPP

SEQ ID NO: 57465 - protein, 156 aa, Sorghum bicolor
  Clone ID: 30967677.pep
MAGYRGGSSTAASAGGGGGASAAAFATRMLLLLTLLPLALAAFAFALQWRGGMRDPAGAAWPADTQRFPGMENSPLGSSSSSHGGGASYFAVSSSSSSSPGADCAEILGRSAASSSNGISLYRGWNFDSESSITPKICITGSTSAGLHQILPWLYY

SEQ ID NO: 57466 - protein, 116 aa, Sorghum bicolor
  Clone ID: 30967679.pep
FSAGLVDRQIHRCSEHKDYYKILGVPKDASQDDIKKAFHSLAKKYHPDTNRGNTAAKRMFQEIRDAYETLRDPSKREQYDMLFSRGSRMEHDTFSSNNQRHDPFTEFHRQNDGRFS

SEQ ID NO: 57467 - protein, 142 aa, Sorghum bicolor
  Clone ID: 30967682.pep
MGSESEPAKGLLPYLQRADELQKHEPLVAYYCRLYAMEKGLRIPQKERTKTTNSILISLMNQLEKDKKSLTLGPDDNLHLEGFALNVFAKADKQDRAGRADINTAKTFYAASIFFEILNQFGELQPDVEQKQKYAIWKAAEI

SEQ ID NO: 57468 - protein, 162 aa, Sorghum bicolor
  Clone ID: 30967691.pep
MSAGAQLQRRSSVRRSRSMAKEEDRGQPPDEEVMSRSQGSSTAPVLDKDSATAPKSRPAEQSAGPSEMDLMKEKFAKLLLGEDMSGSGKGVPSALALSNAVTNLAASVFGEQRKLEPMAPDRKGRWKKEVGWLLSVADHIVKFVAKKQVLDNGVEMEVMGTQ

SEQ ID NO: 57469 - protein, 90 aa, Sorghum bicolor
  Clone ID: 30967706.pep
CPAGLAVRGAGEGGRGCVVGCRSACAAYGAPQYCCTGQFGSPQQCKPTAYSRLFKSACPKAYSYAYDDPTSILTCSAGASYVVTFCPHHR

SEQ ID NO: 57470 - protein, 143 aa, Sorghum bicolor
  Clone ID: 30967713.pep
INKPNKFKARYHVIVYPPGTTNFCSLLSLPHLRLFTDSAILYVLSILIITPRCRSACLQIQSFFLCSAFPLLLADAAAPRCTICSWICNISIWLLIKFSCAFCNEFSRSLVLVPEPTAPFALTCRGTKPSLLFCNCISWSFCD

SEQ ID NO: 57471 - protein, 115 aa, Sorghum bicolor
  Clone ID: 30967716.pep
RTRRDTFLVTGEDEGLGFAAVEDYRLRLWSWSEAVWAPWRDISLETMIPLTIGDPTTELKVIGFAEMSGVIFVMANGIVSALELMSGEISEVRETLNSSTIFPFESFYTPGMGGA

SEQ ID NO: 57472 - protein, 66 aa, Sorghum bicolor
  Clone ID: 30967740.pep
INKAQGQTIPNVGIYLPEPVFSHGQLYVALSRGVSTQTTRILSKPNKELDSTWRSTKNIVWKDVLN

SEQ ID NO: 57473 - protein, 108 aa, Sorghum bicolor
  Clone ID: 30967785.pep
MAGLDLGTAATRYVHQLHHLHPDLLLQHSYAKQPEPSEDDPHGSGGGGGNSNNGGPYGEHDGGSSSSGPGAGDAPGGSGGNGEMVARRPRGRPPGSKNKPKPPVIITR

SEQ ID NO: 57474 - protein, 121 aa, Sorghum bicolor
  unsure (1)..(121): unsure at all Xaa locations
  Clone ID: 30967811.pep
ITGDVILGKLPLSPXSLSADLEIFLSWVDEVKQIKVMVNADTPADALTGRKNGAQGIGLCRTEHMFFSSDERIKAMRQMIMADTAEQRQKALDLLLPYQRVDFEGIFRAMDGMCSQTCIFV

SEQ ID NO: 57475 - protein, 198 aa, Sorghum bicolor
  Clone ID: 30967820.pep
MAAPPAPGEGELTEVLIGEIIHRFPPNNPACLFRASAVSRAWRAFVTSDDVLRRYREFHGAPPVLGLLQNRDPADEPEPPAQVQPRFYATATPPPPINLPNIQGDYSLLLDCRHGRVLVHTIFPHGLIVCNPITGEQQVLPDYHVFPFSCFGGAVLCAVDDCDHLDCHGGAFRVVFTGTINTDAEADEHIDEVFTSAI

SEQ ID NO: 57476 - protein, 220 aa, Sorghum bicolor
  Clone ID: 30967845.pep
QIGRIVYANPSEGERYYLRVLLNHVRGPTSFEDLKTVAGILCSTFRESCEKRGLIETDNTIDDCLVEAATFQMPYALRRLFATVLVHCEATRIRALWEKHKESMAEDYSRNQCNSELVEQMVLRDIRDLLQSMGKDIKNFDLPELSDAADYSNDKMRLVREELSVGVDPEHLQIKGSLNREQLAGFHEIMNHVLNKKSQVFFVDGPGGTGKTFLYKALLA

SEQ ID NO: 57477 - protein, 60 aa, Sorghum bicolor
  Clone ID: 30967870.pep
LIAGLLDFGRLTEVERRPDEMIDMRVELSRSTMDNMKRAFAKAQRPQSYARIARRLKRPP

SEQ ID NO: 57478 - protein, 134 aa, Sorghum bicolor
  Clone ID: 30967872.pep
EITRISNIAPGIFRKTLTDVQVNGYTIPAGWLVMISPMVGHLNPTLFEDPLKFNPGRWTTQDKEKQSIQQRNLMPFGGGIRLCLGAEFAKLFISLFLYVLVPNYRWIEIKGGEVSRVGEMVVPHGYHIQLVPRT

SEQ ID NO: 57479 - protein, 162 aa, Sorghum bicolor
  Clone ID: 30967873.pep
DVGGQRNERRKWIHLFEGVNAVIFCAAISEYDQMLCEDETKNRMMETKELFDWVLKQRCFEKTSFMLFLNKFDIFERKIQKVPLSACEWFKDYQPIAPGKQEVEHAYEFVKKKFEELYFQSSKPDRVDRVFKIYRTTALDQKLVKKTFKLIDESMRRSREGT

SEQ ID NO: 57480 - protein, 100 aa, Sorghum bicolor
  Clone ID: 30967882.pep
QQPGSTLTQLSNYHYEATSALGTLSGTSSLQLLERGSCKGRHVPSNDVGNGKRPPVTKAPQIYITTISTQTNGNQKNKLQVSHTKTSQLSTGNSKHCCST

SEQ ID NO: 57481 - protein, 167 aa, Sorghum bicolor
  Clone ID: 30967973.pep
MIAAAAAAEKSPEREAEESNPRAEAFLEIICRVPAGEVEAALSACGIGPTAEVAELVLKSCECYKRPKSAVRFFRWAGLSLSHTAYAWNLLVDILGKAAMFEPMWDAIRSMHQEGGGRLVSVATFASVFASYCASGNLKDAIAALDVMDRYGLKPDAVALNSLLSAI

SEQ ID NO: 57482 - protein, 193 aa, Sorghum bicolor
  Clone ID: 30967975.pep
MEGGLLANNPSSYALLCCVTVGIAWLLHWVYRWVCPPCKGRLPPGSMGFPVIGETLQYMKLSPSIDIPSFFRQRLKRYGPMFKTCLAGQPIVVSLDPELNRFIFQQEGKLFRIWYPQTANTIFGKKSITTFTGPVHKFIRSFASKLFGPENIKESLIHELEDAMKQHFAAWAAKPSVEVNDAIADMIFGLVAK

SEQ ID NO: 57483 - protein, 105 aa, Sorghum bicolor
  Clone ID: 30967999.pep
SFAELRRPPAVTSGHGGAFRCGPARGDGVVLPPRVPYAAAAAATARGGPATTWNSTFCSGCSSPYPPVKCPAFLPRLPAGLDELNPFQRHPGFQDIGVLCHATFL

SEQ ID NO: 57484 - protein, 120 aa, Sorghum bicolor
  Clone ID: 30968038.pep
AAAARYGVRLVQDAKECVDDDYVRSMVDLLEERRGARPDLAASLVISAWTRLGLEDLDFGAGKAAHMGPLTREIYCVFLPVMGDPQGVTVLLSVPQAAADKFQHCCLEFLKDTDVDAKLS

SEQ ID NO: 57485 - protein, 119 aa, Sorghum bicolor
  Clone ID: 30968039.pep
TQAMWPFPSDKVMQGYAYILTHPGNPCIFYDHFFDWGFKDEIAALVAVRKRNGITPTSELTILEHDGDSYVAEIGGKVIVKIGSRYDVGHLIPAGFEVAAHGNDYAVWEKAGTEQVTRA

SEQ ID NO: 57486 - protein, 52 aa, Sorghum bicolor
  Clone ID: 30968045.pep
QVVEKKGIIWPVPQQITWGKQCNLVLDQLLPFLLHMCAHGIQMAERVYLLNF

SEQ ID NO: 57487 - protein, 144 aa, Sorghum bicolor
  Clone ID: 30968056.pep
VESMMMVIAAIVPDFLMGIIVGAGVQGVMMLNGGFFRLPNELPKPVWKYPSYYISFHKYAVQGLYKNEFMGLSFPSDQLIESNVTISGIQVLKKNLQVEMGYSKWVNLAILCGMMVIYRMMFFAIVKITEEIRQKRGGKRGCVR

SEQ ID NO: 57488 - protein, 108 aa, Sorghum bicolor
  Clone ID: 30968073.pep
SKEEIRRAHAAAFHLKKHETGQSAELGPFSNCKVWGTVDPDYGPVSGTSDMSETRKNSNYSKWELLPLEKLRREAQEHHIQMGGVSLYKMDGNKLDDLVCVRHQRSSS

SEQ ID NO: 57489 - protein, 60 aa, Sorghum bicolor
  Clone ID: 30968080.pep
DKEIVKDEEVAAKVKWLMESDGGRELRERTRAAMRKAKEALSTGGESSTALLELVRQCKM

SEQ ID NO: 57490 - protein, 186 aa, Sorghum bicolor
  unsure (1)..(186): unsure at all Xaa locations
  Clone ID: 30968098.pep
MATPSESQDKKALVVIYAPPMMISHLFSLVDLGELLAAHSLDVAIVLGGRTDDTATGGGAAAGSFAEGLAAAHPQLSFHLLPHVTRPRDVPAHDYVAQTFXLARASDSDLREFLRAASPSPAALVLDFFCGSALDVCTELGIPTYFFFTSSIAGLEELLYHPLIHEQTSISLRHLGGELLRVPGVA

SEQ ID NO: 57491 - protein, 130 aa, Sorghum bicolor
  unsure (1)..(130): unsure at all Xaa locations
  Clone ID: 30968110.pep
REPPGHGRSAAARAGRLWIWPHGGLPSRRRRRPRPRRPPTRXTLPPPAPSPPPRPPPTSTRPPPPPRRRAAGSSYGRTTRRRSTTTTSTRPTSSASPMTPRRDPRAAAGAPPPAPAPAPSAARTAATRPR

SEQ ID NO: 57492 - protein, 219 aa, Sorghum bicolor
  Clone ID: 30968132.pep
IAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLCDVAEAHLTDDTVKAYAISAILKIFAFEIALGRKIDLLPECQTLVDELSAS

SEQ ID NO: 57493 - protein, 188 aa, Sorghum bicolor
  Clone ID: 30968135.pep
MAAALSSSRRALHTLHRRLLLHPSPSPAAARRALPTLTPTRTPIPAHSPTPTFSFSSSSRFSTTARPDARLRHGVLPQGPQQRLVGGVRSVASGGSKLAPLGQGVKGLGRPVEAARSAAARYRAAVGLQVEAFWRRNYMVLVGAGAVIVCVALWRIMFGIASTFVGLSEGMAKYGFLALATAIVAFAG

SEQ ID NO: 57494 - protein, 51 aa, Sorghum bicolor
  Clone ID: 30968142.pep
IYCIKLYPWLYCYLPFKHHLGTGFLAVIWITSDQVKLNLFGAIGVLGDFVS

SEQ ID NO: 57495 - protein, 220 aa, Sorghum bicolor
  Clone ID: 30968149.pep
HNFSGPIPGSLTRTFNIVGNPLICAATMEQDCYGSLPMPMSYGLNNTQGTLMPAKAKSHKVAIAFGATTGCISLVFLAIGLLFWWRCRRNRKTLYNVDDQHIENVNLGNMKRFQFRELQAATENFSSKNILGKGGFGIVYRGQLPDGSLVAVKRLKDGNAAGGEAQFQTEVEMISLAVHRNLLRLYGFCMTASERLLVYPYMSNGSVALRLKGKPPLDWI

SEQ ID NO: 57496 - protein, 43 aa, Sorghum bicolor
  Clone ID: 30968164.pep
ASGVYVNNVINYYRTSCCETTGPPFLLPLGCWTTNLPVQVWIV

SEQ ID NO: 57497 - protein, 73 aa, Sorghum bicolor
  Clone ID: 30968166.pep
VWQQCHAQKKNSILKKIQKHEQEYYTWIWNINETYHGFCNGFHAQATNNLDMPTNHKAMKNRELGNSPSYSTL

SEQ ID NO: 57498 - protein, 149 aa, Sorghum bicolor
  Clone ID: 30968170.pep
RVICSLRRETWVRKVALFQSFGVSEAHLLRAFKTQPTILLVGEETLKKKFRFFLDVMKVEMDDVMAQPLTLALSLEKNIMPKCAVLSVLMREGKIRIERSQKLIPPLLSNSKVFSQRYVLRYAKDVPDVVKAFEGKIKFQGFGCLGIRS

SEQ ID NO: 57499 - protein, 64 aa, Sorghum bicolor
  Clone ID: 30968172.pep
PFDCSLQATPSKPNDPALADLMEKKLSNSIEQIEKMVRRNLKKTPKAAQPSKRTIQSRILMSMR

SEQ ID NO: 57500 - protein, 100 aa, Sorghum bicolor
  Clone ID: 30968174.pep
VAGKKIIRKVCLKSYEGRHVNRQVTVPLAPEYNKSYRLGHGRNPVLPKERTDGWMELEMGVFYNKEGDDGEVRFSLLQTSGTSKEGLIVQGIEIRPKKLG

SEQ ID NO: 57501 - protein, 64 aa, Sorghum bicolor
  Clone ID: 30968197.pep
MVKLWDLSKDKPSCIASQNPKLGAIFSVSFSNDSPFLLACGGSKGKLKVWDTLREPAVAHKFSK

SEQ ID NO: 57502 - protein, 115 aa, Sorghum bicolor
  Clone ID: 30968208.pep
ILPLALCSSCLNPACGCHCWMLILPSEGELPLGDIQRVGESGIDGKLLVQGIGPTATTMATRLSFVPGAHVENGRQLCPGPYRGCKLVLGALDVESPLTLHFLTGCNAKRPRANE

SEQ ID NO: 57503 - protein, 113 aa, Sorghum bicolor
  Clone ID: 30968215.pep
SRGGRFAIDLTAAQPFGSPGCSPRGSGDLGHYHGGGVWPFGTFRGFVMSAAVQGEGRCSRPTVEVGVAHVGCAEDAAAFVALAAAVDLSMDACRLFSCKLRRELSASRAELVR

SEQ ID NO: 57504 - protein, 220 aa, Sorghum bicolor
  Clone ID: 30968220.pep
VTDNGANFKLAGRLLMERIPHLFWTPCAAHCLDLLLEDIGKIKEFSTCINMAKKVTRFVYKHGRVLDLMRDKIGGDLVRPGVTRFATSFLTLASMHRHKNALRSLVVCDEWHNLSFSATQEGRRVENIILSAPFLSKVELCLKASQPLLIALRIADGDETPAAPEIMAAMEVAKATIKESLKGKPTLLNEVLKYYDNRWENQMEQDLYGAALYLNPNKFL

SEQ ID NO: 57505 - protein, 124 aa, Sorghum bicolor
  Clone ID: 30968234.pep
MCDPQGVDYCVRIISLLVAANRYPRDRLKLMCEDILPKMLNKEAAGTTLDIAQSHSLHKLKEDCIEFMASQCERDVVQACPLLKRSCPSFVTAVLTRKEKLELVNKDAVIILKCPLTRGSLGFY

SEQ ID NO: 57506 - protein, 153 aa, Sorghum bicolor
  Clone ID: 30968240.pep
MDPCPFVRVLVGNLALKMPASTTAPRSTAASGSGVRPTTAPCYCRIRLNKLPYQTASAPLLPPTEEGPASCTGAFAAAFHVSKADLDRAAAKPALLLGARLRRRTARLKVAVYAGRGGGASCGGGGGGVNSGRLIGKLVVPLDLGAAMAKPVV

SEQ ID NO: 57507 - protein, 204 aa, Sorghum bicolor
  Clone ID: 30968242.pep
MARPSASSKASSSSLVILAIVVAAASLAQPGAADLKLNYYASTCPNVETIVRGAVQQRVQATIRTVGSTVRLFFHDCFVEGCDASVLIDSTPGNQAEKDASDNKSLAPEGFDTVRSAKAAVEAACPGTVSCADVLALATRDAISMSGGPFFQVELGRLDGLSSRASSVPGQLPEPNQTMDQLLAVFKAHGLDMSDLVALSAAHS

SEQ ID NO: 57508 - protein, 125 aa, Sorghum bicolor
  Clone ID: 30968245.pep
SVDVDRRCANVEVIMPVPDLEEVQPQPESVGSGAATVASASSAIDIPSLIERAIAKLPPDLAAQAVDKKRKARSQDPGWQYGWWPDPSKKDFVQCIFCKKVVPSGISRFKQHLAGGVWRCYWLSS

SEQ ID NO: 57509 - protein, 129 aa, Sorghum bicolor
  Clone ID: 30968246.pep
MEAAAAAAVADYGKLFVGGISWETSEDRLRDYFGRFGEVTEAVIMRDRSTGRARGFGFVVFAGPAVAERVTMDKHMIDGRMVEAKKAVPRDDHSIVSKSNASSIGSPGPGRTRKIFVGGLPSNVTEADF

SEQ ID NO: 57510 - protein, 223 aa, Sorghum bicolor
  Clone ID: 30968250.pep
TGCTALLSNIPDVSSYADIPQKIADLQKQALTNLNKVGEVTSRLKELEVALEFADLSKQRAEGEATLAKERAETATREVKRLELMLAAISEERDKLRKEHPTESDQSGMEKTIRELESIIHELKELISHKDTELNIMNERLSLETRKVKSLEREGDQLRSQVALLESKLGHGDYSASSTKVLRMVNTLGVDNEAKQTIEALQAELKKTKERLQAVEELKGQAD

SEQ ID NO: 57511 - protein, 165 aa, Sorghum bicolor
  Clone ID: 30968256.pep
MQGEGTSRMSQTPRRTASSHNIKAHTSTHVFEIDDYSQKKETNVGEFIRSSTFTVGGFDWSIRFYPNGIDENSKDDIIVFLELMSSDVKLRAHYNIQFIGEDDGAKKDSMISWYSTGGMHLFKSKGGEYRPRHMGYLMRDSLEEEFVKNNHLTIQCDLTVIRLYS

SEQ ID NO: 57512 - protein, 90 aa, Sorghum bicolor
  Clone ID: 30968257.pep
MGSWVRTITSPFRKMLNPQRDGKKTPRHHRHHHQQRHQQQSPSPSSSAMEHSGEMERSQLYGEVMACTYEDVQVMWSMLDKARICSAAAS

SEQ ID NO: 57513 - protein, 199 aa, Sorghum bicolor
  Clone ID: 30968265.pep
VAVVNTKFPEIGRLLLVRVVLQLKRAYKRNDKPQLLAATKFIAHLVNQVVAHELVALELLTVLLENPTDDSVEVAVGFVKECGAMLQDLSPQGLHAIFERFRGILHEGEIDKRVQFLIEGLFAIRKAKFQGFPAIRPELDLVEQEDQFTHEISLEDDLDPETNLNVFRANPNFVEDEKAYENLKRSILGAESSEDEEGS

SEQ ID NO: 57514 - protein, 138 aa, Sorghum bicolor
  Clone ID: 30968270.pep
RSLARSPLGRCHPRFLARSSCASRRVSAPTDPPLRALGVPCSTTTPTHPNRRPAARRRTLLGFRPGPRTRRRRWIRVSGRGASSRTGNLGPDTLAALLQSEGLGLQHAQFFFSLLDCSHAQTVADAKENRKCYFDQIS

SEQ ID NO: 57515 - protein, 177 aa, Sorghum bicolor
  unsure (1)..(177): unsure at all Xaa locations
  Clone ID: 30968276.pep
MGSATGTCEIARLPEDLLSAALALTTPRDACRAAAVSRAFRDAAGSYAVWTRFVPRDLPPIADGELAGPAPPSKKERFLRLSDRRCPVLLADGLRIQPVPKNPLLAYGLKSMWLDRGSGAKCYMLLERGLHISWGCTPCYWHWMNLPDSRFEVAELMSVRWFEIRGKIHSXMLSRDT

SEQ ID NO: 57516 - protein, 102 aa, Sorghum bicolor
  Clone ID: 30968278.pep
MEDLGIEAKEAAVREVAKLLPLPELLSSIASIKSDYLARQQTNDAQLSTMVAEQVEQAHDGINALALSQETINKLRENFIDIDKLCQECQTLIENHDKIKLL

SEQ ID NO: 57517 - protein, 185 aa, Sorghum bicolor
  Clone ID: 30968284.pep
MEMEQGGKTAHGWAARDASGHLSPYSFSARVQGDGDVTIKVLFCGICHTDLHVIKNEWGNAMYPVVPGHEVVGVVTDVGHGVTKFKAGDTVGVGYFVDSCRTCESCSTGHENYCPDLVLTSNGVDHHHHGATTKGGFSDVLVVSQDFVVRVPESLPLDGAAPLLCAGVTVYSPMAQYALNEPGKH

SEQ ID NO: 57518 - protein, 68 aa, Sorghum bicolor
  Clone ID: 30968289.pep
GLFEKGVFHCIAFKFIIFIITTVPSFSLLCLVYTIRMFFSCISFMALIWFNKKTRLWGYKIGFYFSLF

SEQ ID NO: 57519 - protein, 168 aa, Sorghum bicolor
  unsure (1)..(168): unsure at all Xaa locations
  Clone ID: 30968299.pep
MEEDSLTGMISAISWVPRGAAKSMPVVADPPTQEEIAEAMKTFALGGGPGSDAVEDDDAGTMELDGATEVEEVDEAARAKAVAKALGKGSSKVDDVADGLRELNMDAYDDEDEEIDVIGSGLGDLYYPDNGMDPYLKKNNEEEEDDDDXYYSDIEDKMIMPTDFVIVC

SEQ ID NO: 57520 - protein, 167 aa, Sorghum bicolor
  Clone ID: 30968310.pep
MAALADGDAAYSSLDSDDEYEKFIQKMNPPRVTIDNTSCPNATVIHVDSANKYGVLLEVVQVLTDLKLIVKKAYISSDGGWFMDVFNVTNQGGHKIMDESVLEGIKDCIYKSIGPDSCFLPSRRRAIGVEPSSDYTLIELTGTDRPGLLSEVSAVLTNLECNVVNAE

SEQ ID NO: 57521 - protein, 96 aa, Sorghum bicolor
  Clone ID: 30968345.pep
HRRASTPAPTPPWTPSSASSTRPSACSRPTPPPTTARAAAASWLAGQLVPTTNAWLPRRAWARIPKHGGTYINNIYSCYCQSLSCGPGSFTAGLHV

SEQ ID NO: 57522 - protein, 74 aa, Sorghum bicolor
  Clone ID: 30968387.pep
VEKGQEQKQEQSAQNKVEAEEEDSESCSSSDEDDSWHEVDPKMGPEERKAARKAIQKKVKEEKREARKTKIPKA

SEQ ID NO: 57523 - protein, 169 aa, Sorghum bicolor
  Clone ID: 30968437.pep
MPLHLLSSPAAAAKLAAGLRAAPLRRCHSFAPAPRHTDRVALASSLSVAARSASPAVAAAQTELSVSGKKQVLISLSDKTDLAYLGNGLQGLGYSIVSTGGTASSLEAAGVSVTKVEEITHFPEMLDGRVKTLHPSIHGGILARRDQEHHLKALKDHGIGTFDVVVVNL

SEQ ID NO: 57524 - protein, 86 aa, Sorghum bicolor
  Clone ID: 30968456.pep
MAVEPDSGSRAVVQPAAAARGGGGSMEPGLGKRLMTVLRAVYHMLRRGLCRKRLMMDLHLLLGRGKLAGKALRDLLAAAHHSHSHH

SEQ ID NO: 57525 - protein, 38 aa, Sorghum bicolor
  Clone ID: 30968492.pep
CHSATKLISKVYNREIVVRDRNRFHHFKDGTCSCNDYW

SEQ ID NO: 57526 - protein, 142 aa, Sorghum bicolor
  Clone ID: 30968493.pep
HGFTYSGHPVSCAVAVETLKIYKERNIIEHVNKIAPRFQEGIKAFSGSPIVGEIRGVGLILGTEFVDNKSPNDPFPAEWGVGSIFGAECEKRGMLIRVAGDSIMLSPPLIMTPNEVEEIISKFGDALKATEERIGELKSRKN

SEQ ID NO: 57527 - protein, 73 aa, Sorghum bicolor
  Clone ID: 30968502.pep
SGSWCQRRPSSSMVTSPSTAKRRHKGVLGGGVQASYAGLPAGRTTMQKCEYRRITVMDPGSDGRLLQQWQIRK

SEQ ID NO: 57528 - protein, 110 aa, Sorghum bicolor
  Clone ID: 30968505.pep
EVREGEMLFGYQPMATKDPRVFARAEEYVPDRFLGEDGAQLLRHVVWSNGPETVSPTLQDKQCAGKDFVVLIARLLVAELFLRYDSFDVQVGASALGSSVTITSLKKATF

SEQ ID NO: 57529 - protein, 156 aa, Sorghum bicolor
  Clone ID: 30968527.pep
LPDPLTFSFKLAKNGTVINDDSSKDFGSVLRCKDPISAHEMTHMEVQIRNNTKEIIQMNLSISCKDVAGENCFDENSATVLWAGVLSDIHLEVPPLQEVIHPFSMYFLVPGDYSLQAASVIIDATDVLRARAKAESPDEPILCRGSPFHIRVVGTA

SEQ ID NO: 57530 - protein, 58 aa, Sorghum bicolor
  Clone ID: 30968530.pep
PHIIAHLRADKPKRKNSIMWSTLTKGVSRKRHLLRCPRQLCRTALPSPPASGRASPGD

SEQ ID NO: 57531 - protein, 108 aa, Sorghum bicolor
  Clone ID: 30968539.pep
DDDDADGKSSVRSQSVKKRKTSSSGWAYTGHEYTSKRASGDLKKKDKMEPFAYWPMDRKLLNRRSDRKASARKGMSSVMKITKGLQGKSASAALSANRSGKMKHKKNK

SEQ ID NO: 57532 - protein, 148 aa, Sorghum bicolor
  Clone ID: 30968558.pep
MAAAQHRQAWWPGRMAAAFGPSFLCLVCLIYFIQGFRSFVWTAVSYQMKDVMKLSPSTSQFLVSLAYFPWSIKPIYGILSDCIPIKQRKRIPYLIISSCLSLLPWLILGLSQSLRSSANMLTALLVVQNLGSAMADVVIDAMVAEAVR

SEQ ID NO: 57533 - protein, 217 aa, Sorghum bicolor
  Clone ID: 30968563.pep
FEGSSTVRKREVISSFITEILLALKEANKKTRNRAYDLLIEIARACENAGNDERKEGLHQFFGMVAGGIVAGQTPYAISAVVTGLARLTYEFSELIGVAYKLLPQTFLLMQRNNREIVKANLGFVKALVAKSKADMLHEHLSGVVEGLLSSQSDTKNSFKAKVKSLIEILVKKCGLDAVKAVMPEEHMKLLTNIRKINERKMRKTKSSEDGDAMSMA

SEQ ID NO: 57534 - protein, 161 aa, Sorghum bicolor
  Clone ID: 30968574.pep
GPLHRVPSVKKETPEPTSSRPRASPSPPSALPSILPRRRYLRSPPSSPAAASPGPRDSSNDGGHDPRRRLNPYRSCAITRSISVGRAPRRELGARGALRPPRAAASCGIYWREFEKDGEGGGGRGRKPTGSRRPPQPPPPRQQQQEQEQQHWRAEMWTEPQ

SEQ ID NO: 57535 - protein, 202 aa, Sorghum bicolor
  Clone ID: 30968596.pep
MATAVPTAALPTPAGAGPAPPHAPLRTDPRYLPQLHAALIKSGELTGSPKCFHSLLEAAAASPTLLPYAVSLFRLGPRPPLSTPCYNVLMRALLHAGHPEDALHLFVEMLDVASVCPDQHTVACALKSCSRMCTLDVGRGIQAYAVKRGLMADRFVLSSLIHMYASCRDVAAAQLLFDAVEENGVVMWNAIITAYMKNGNWM

SEQ ID NO: 57536 - protein, 202 aa, Sorghum bicolor
  Clone ID: 30968597.pep
MIAQGLRRSSAASSQVSRLVKYIASAGRLQGGHSFSESPARCYSSEPSLQATEENGFKGHSMLAPFTAGWQSTDLHPLVIERSEGSYVYDINGKKYIDALAGLWCTALGGNEPRLVKAATEQLHKLPFYHSFWNRTTKPSLDLANEILSMFTAREMGKVFFTNSGSEANDSQVKLVWYYNNALGRPDKKKFIARSKSYHGST

SEQ ID NO: 57537 - protein, 179 aa, Sorghum bicolor
  Clone ID: 30968598.pep
MSKLAVLVPAVVAVIVLCACTTPARGGDDYTAFVYAGCSQGRYDPGSQYAADVDTALSSLVNSAGFTAYGNYTSPPSSSTGQLAGVYQCRSDLPAAVCGVCVKSAVSKLSSLCNTAAGAAVQLRACFVRYGNDSFLGKQDTTVLFKKCGGDSGGGDTGVVAMRDAALGALVAAAAAPAD

SEQ ID NO: 57538 - protein, 214 aa, Sorghum bicolor
  Clone ID: 30968633.pep
CWPLAWYSTKVGQISIPGCIVHCFGVITEHLFKEVGCLLLGAAQGLVLSDPFRCCGSSKFKSVNFPSISVVPPLPLLVANVVGGDGSILLYEGEIRDVLITLTNAGTVPAEEANVALSGKNHDSVISIAHSTWKSALPIKPSGEVTFAVTLRAWHLSSSDLETDGSRSPANSRRIAREGINPFLDIHYAGPAANLENGDVSLPPGRRLVVPLNI

SEQ ID NO: 57539 - protein, 136 aa, Sorghum bicolor
  Clone ID: 30968636.pep
VPAMASAELPEVVERKKKSNVMYAFMCSILASMASIILGYDIGVMSGAALYIKKDLKITDVQLEILMGILNFYSLIGSFAAGRTSDWIGRRFTVVVAAAFFFVGALLMGLAGGYATLMFGRFMAGVGVGYGLMIAP

SEQ ID NO: 57540 - protein, 121 aa, Sorghum bicolor
  Clone ID: 30968646.pep
KQILTANPDINIIELCDDDEFMVLACDGIWDCMSSQQLVDFIREHINTEESLSAVCERVLDRCLAPSTMGGEGCDNMTMILVQFKKLTAQHKDASGAQQPAGDAGCSETHGAEENGSGKQV

SEQ ID NO: 57541 - protein, 72 aa, Sorghum bicolor
  Clone ID: 30968703.pep
ILIYSQSRGYSKVDDNIWYYLHLQQDAFFVLMLHLNCLFYMHFLDLLSLLVCLFCPLCVSVVTFDSKRQGQV

SEQ ID NO: 57542 - protein, 185 aa, Sorghum bicolor
  Clone ID: 30968720.pep
CRRSSPYRRRLRPVRAAAEGKSVPGTSQRPSLRPRASPPPPRPPPRGRAPRRRRLVDGSGRPRPSPTRTTRRRLLRAPSRAGGPSRSFSMRRAPATRVPRWSPTPLPPPSQHQLRGRSRAPPAGRPRPPRGEGTRAFRRPRVLAPPALPPPRWNPTPPRAALRLIRRPRPLSSLRPMWRSGWPQP

SEQ ID NO: 57543 - protein, 127 aa, Sorghum bicolor
  Clone ID: 30968729.pep
LDGSSAFQLGSPGTFWTQLIQMGIGEFLVPSEAIGYVLELHSRALWSKLLAVSTLLGIHGDRRDRGARTGPGGTRRLLLSGADDDRRSEGRKWGDETGRTGAATSARLPVKSPRTNYFHSSVAGKWD

SEQ ID NO: 57544 - protein, 166 aa, Sorghum bicolor
  unsure (1)..(166): unsure at all Xaa locations
  Clone ID: 30968749.pep
MGVYLSTPKTEKVSEDGENDKLKFGLSSMQGWRATMEDAHSALLDLDNDTAFFGVFDGHGGKVVAKFCAKYLHREVLHSEAYAAGDLGAAVHRAYFRMDEMMRGQRGWRELQALGDKINQFTGIIEGLIWSPKASDSXDRHDDWAFEEGPHSDFTGPNCGSTACVA

SEQ ID NO: 57545 - protein, 170 aa, Sorghum bicolor
  Clone ID: 30968832.pep
IEAMLALQRAQVGQRKLRKRVRKHRKAFMDAQAEIQNYHTALQARRNQVANAVRERNEAQARMMQMTRERDEAMRLAENRETARVRALFHAEMREEELITRIAELHLDVHRLNNIINPIPQPAPFDHEEALSEEDQGDGIISNGESEEDMKPSNDFMTMYQFPSLCVMDM

SEQ ID NO: 57546 - protein, 84 aa, Sorghum bicolor
  Clone ID: 30968855.pep
TEEIPTVKFPQQRRSSSDCQQEGLFCGAGEMCLGVFCGSVSWIAFGVEGGLLTARFVHYIICLPNPVLLLTLCSCNLIHSSLQQ

SEQ ID NO: 57547 - protein, 156 aa, Sorghum bicolor
  Clone ID: 30968870.pep
INSYLNYVCFDLICLQSLNDVPSGNVDPKFWKEEAGCIDCVQRHVKRFVFQEFRGKRSELAFLKFIAERAQVLEKMVVTVASKCFSSADAVNAKLKPLISAIWASKDCKLIVFKSPSSDLASPVWASKMASNFSCRDPFDLLTANAELCSLCASTF

SEQ ID NO: 57548 - protein, 196 aa, Sorghum bicolor
  Clone ID: 30968879.pep
TVQVLKSADKLEKDLVNIAVEDSVDSDDGGKSLIREMPPYEAENAIANLVKVWIKERVDRLKGWVDRNLKQETWNPGANRENFAPSSVEMLRVIGETLDAFFQLPIPMHPVLLPDLTAGLDRSLQLYVAKVKSGCGTRSSFMPQLPPLTRCEVGSQLLFKKKEKPQNLQVRVSQNGAANGNDPLGLPQLCVRLNTL

SEQ ID NO: 57549 - protein, 75 aa, Sorghum bicolor
  unsure (1)..(75): unsure at all Xaa locations
  Clone ID: 30968882.pep
TGDNLQTARAIALECGILDDPNVSEPVIIEGKTFRALSDLXREEAAEKISVMGRSSPNDKLLLVKALRARGHVDA

SEQ ID NO: 57550 - protein, 169 aa, Sorghum bicolor
  Clone ID: 30968896.pep
MEMEEQQFQTNVDVSVSNMERDLQRHLRRKGVDVPDPLTMGTALVLMYAYDAIPDPPVSPAAPLSSAFAARAPADGVDRISLLSDALLRNVVSRLPAKDAARTAALATRWRGLWRSVPLAVVDAHILPDWIPDDHAMPGGEDILSWAVAVVASRVLDAHPGPFRCVHLS

SEQ ID NO: 57551 - protein, 156 aa, Sorghum bicolor
  Clone ID: 30968914.pep
SGCFCFSIFLSLALSLSLPQRRRWRRRRRRRPHPSQVTRVPPVAHPRHEDARLGPAGGRRHGFPSALHPPVDPHCLGETLAASFRSSRPSQGLHGAIVRAWPQHERCAGVASESLGAHQRCLHPRPRLRRAGNVRPAARQRHKTSWNRSMELLACR

SEQ ID NO: 57552 - protein, 91 aa, Sorghum bicolor
  Clone ID: 30968915.pep
GLEQAAYVTTPRAPRRPGHSVKRAAEAEALSEATIGGRRLDGGKGYAAPFLRSLKLTAAAGWTKQPPSSPTLAGYPDRKFTTICWNERCRQ

SEQ ID NO: 57553 - protein, 99 aa, Sorghum bicolor
  Clone ID: 30968930.pep
LLLLQHPQEALSVEAVARHSPRQSRVVGEWWRRQCGLRVRWAAREAADDPEERQSLRDRQGEEAKDESQAQQQEGHRHGCGVAVAGKGPRPAVLQKRNG

SEQ ID NO: 57554 - protein, 66 aa, Sorghum bicolor
  Clone ID: 30968936.pep
FLSLYQQSKLVIRPEPKKDGAKSRDTSSRHSQIHGDTKNSVDLLVTRLVASLCLPCRRIFFNTYLH

SEQ ID NO: 57555 - protein, 171 aa, Sorghum bicolor
  Clone ID: 30968940.pep
PCWSTSCRSRKNSKGSYLMELRRRRTCRSALTIVPLPTSKMAAPHASETFLDMFGTPTLLWRVLSSVGYEEPPRYTWTESEHAGALPWVDVQITVPPCPNNPQWLGWLVDCDGQTPWEGAQVAALEVLLEICQEFGDELVNGPVGSIPRVSVTDTFVSQIGNESLEMREIL

SEQ ID NO: 57556 - protein, 104 aa, Sorghum bicolor
  Clone ID: 30968955.pep
MLQRSERHNRRPAMDRSLDRNSSIKDVTYSCGYCGYALNLSSSARDTEGIGCSKYRKQIKKGVVAFVAVDETRFTLADEVTCMPYFRSARSWGLFRRRARLLCR

SEQ ID NO: 57557 - protein, 121 aa, Sorghum bicolor
  Clone ID: 30968960.pep
MREGMRERDRGGSPDASGPPPFRGPAYKTKLCALWRGRGGCPRPNCGFAHGEAGLRRPPPRASFQPRPRPGRRDYRDHEFRLRPERRHSPRYSPERDARRRSFRDKRPSSEERGSSRSRSP

SEQ ID NO: 57558 - protein, 139 aa, Sorghum bicolor
  Clone ID: 30969017.pep
HPSKHFNPIYQTSANRSPFSAKASVSEAPICEVTNAGRGRSYPPPQADRSSRSSVYWDQEAGRFVSAQANQGSSSRSGHLDLLYTGQSIFFGGPLIADPAARSFRDPGGSSQRSAGPRPHQLPVFDPSNPQKDQLSRLP

SEQ ID NO: 57559 - protein, 163 aa, Sorghum bicolor
  Clone ID: 30969024.pep
MTMAADQGQEGLEQQLLHELTTVKGASFTFTLRALYSLFRLVQRMGPLGHLVSFLPAGLLGDKGKQEEEGQQDKIKRYMTIMDSMSAAELDGADPMKLMMTKQQQSRINRVARGSGRPVSQVVELLQEHKRMAEMLSELAPAHVKRKRPNNKHIKRRLFNTSC

SEQ ID NO: 57560 - protein, 140 aa, Sorghum bicolor
  Clone ID: 30969045.pep
MVLAQLGESLVGALAQMAKSTVVDDKVVVDCLNDVSRALLQADVRFETVRAVQASIRSAVVNLQSLAAGTDRRRAIKHAVVDELRRMLDPAAGGGTGKPPPFFVPRKGRKPASVVMFVGLQGSGKTTTCVKYADYHRRTG

SEQ ID NO: 57561 - protein, 162 aa, Sorghum bicolor
  Clone ID: 30969095.pep
MCGGAILSDLYSPVRQKVTANHLWTESGSSKSGKNWKRKSSWEFGEDDFEADFEGFEDGDSEEDVDFVHEGQEFQTNSSNLVVGSNVHTAKVASRKRRTQYRGIRRRPWGKWAAEIRDPRKGVRVWLGTYSTAEEAARAYDTAAWRIRGKKAKVNFPSAITN

SEQ ID NO: 57562 - protein, 68 aa, Sorghum bicolor
  Clone ID: 30969120.pep
ARCSRSGGGGRRRSGWSPARDQRRVSCIVVRREIPSPRPKWRENPSARTAAAVRGCVRRHGSRSRGLD

SEQ ID NO: 57563 - protein, 86 aa, Sorghum bicolor
  Clone ID: 30969127.pep
SDVEEGGETIFPDANVNASSLPWYNELSECAKRGLSVKPKMGDALLLWSMKPDATLDPLSLHGGCPVIRGNKWSSTKWMHIHEYKA

SEQ ID NO: 57564 - protein, 145 aa, Sorghum bicolor
  Clone ID: 30969145.pep
FSASSDLSPGVLAPLQFDPCHDGFGEWSAAGGPVGSTGPSSTASTTAATTMLCADVSVQAAFGELNFAMDQSCFDSLGLPTDDVVGNLSSSWCSIVPGLSTLEDTKYDSLDSFPDDALSLHEDMISGTDHDWSVDCQGLEALYMP

SEQ ID NO: 57565 - protein, 49 aa, Sorghum bicolor
  Clone ID: 30969149.pep
KKKLVMCENMQACRACKTPVTTCKGPMCMEGHGGHLLHPPFAKKFGSKP

SEQ ID NO: 57566 - protein, 102 aa, Sorghum bicolor
  Clone ID: 30969203.pep
MAEDAAAGSPLLDLPEPLLLHILGFLTDARSRHRVALACHRLLAAERATRAALSLRGDPRSDVFLYLIRPTFCFPALERLDLSLVSPWGHPFLSSAAPSADA

SEQ ID NO: 57567 - protein, 159 aa, Sorghum bicolor
  Clone ID: 30969230.pep
LLRRPSRHHQQPRQPLLRRRRRASAPASAARTAAAARRWSLPWASAGRRATASPRSAPRSAASPAGPASGTPRPSSATSSLPALLLLLLQHHCHLRHHLGFRPRIEPAAPEPVREICVRASSDNFFSSFLSPHSPAAGLVFSPRRERERNGGRRREWTG

SEQ ID NO: 57568 - protein, 209 aa, Sorghum bicolor
  Clone ID: 30969232.pep
MAPSRPLMRGIRPPRVFPTRGGRASPYAVALTALLLVSAALLALIAFGVFSLPVSAPNAATTGAGGETESADARPARPRARRDLGEGLGERGAQWTEVISWEPRAFVYHNFLSKEECEYLIGLAKPHMVKSTVVDSTTGKSKDSRVRTSSGMFLQRGRDKVIRAIEKRIADYTFIPADHGEGLQVLHYEVGQKYEPHFDYFLDEFNTKN

SEQ ID NO: 57569 - protein, 159 aa, Sorghum bicolor
  Clone ID: 30969234.pep
MQEALISPGNACRFRSALELKPFAFGDQRLASPPGYLNLAAVGGGDDALFRCSSPFSPSLGFSSPSPLATTPSVSLSPSSSASLVDDCDDAAAADVDAFATGHRLQLARLALQYQEVADRYELCLARLADAADEAAALHRENAELRVANADLTRRLALL

SEQ ID NO: 57570 - protein, 215 aa, Sorghum bicolor
  Clone ID: 30969240.pep
RNPLPAPLLISQASPLHLTQCDPPLTTNTLVTRRHGHAPLRAHAPPPTRHPSPSRRRSRRRRQAPPRVRIRPSTTRLLPPRIVGKQPHAPGLRLPPPGRHSRRAHHPGVDFRAGVPITAWVEYRAPRRRLSVWLSYSSFRRPEKPALSADADLSGLLRTYMYAGFSASNGNGAALHVIERWTFRTFGFANSSRAPPPAQPNKALLPPNKPLLLTG

SEQ ID NO: 57571 - protein, 167 aa, Sorghum bicolor
  Clone ID: 30969253.pep
MLSSHHEAMLPYAPGPPPSLLVDRRYKQGGEAAPNCPRCDSPNTKFCYYNNYSLSQPRYFCKGCRRYWTKGGSLRNVPVGGGCRKNRRGKSSLRSAADAAIASGGGRDAAFGHRFPGPVRPDLVLEGMVGNPSNPAGQAMPGGVPAATDGSTIDLAMLYAKFLNHPP

SEQ ID NO: 57572 - protein, 109 aa, Sorghum bicolor
  Clone ID: 30969259.pep
MTSKKSNRSTVTSRTALHMEWDRISCPICMEQPHNAVLLICSSYKNGCRCYICNTSHRHSNCLDRFRKMNGDSKVRASHSTYSVLSNSNIRTVQPRAHYNMISRRSRSP

SEQ ID NO: 57573 - protein, 65 aa, Sorghum bicolor
  Clone ID: 30969290.pep
AVLPCGSAGFRPVPFRFLYCFGRRCDEMLLPRRRGVVHPSAMSTITTGILISPASFLVPLSPPRT

SEQ ID NO: 57574 - protein, 85 aa, Sorghum bicolor
  unsure (1)..(85): unsure at all Xaa locations
  Clone ID: 30969316.pep
TYTRMFWSAESLYYNPAWHIIVSSWEIIVYSPILDLDRWAIPIVIMLSFGVFYXRCFGGRRKRGRGSLLPLYKNSYKNSSRSRSD

SEQ ID NO: 57575 - protein, 67 aa, Sorghum bicolor
  Clone ID: 30969324.pep
QKMVLFCDKSFYEHYMSMMCLTEIVLSTKNRQRIECFLYSLLCVALLYIAVLYEIIRFGLSNHQRLT

SEQ ID NO: 57576 - protein, 221 aa, Sorghum bicolor
  Clone ID: 30969336.pep
LLYTALRTRRARSWLYGIRRLRSFIADYGVPLMVIVWTALSYTLPGKLPSGVPRRLFSPLPWESSSQGHWTIARDLFSVPPAYILAAILPALMVAGLYFFDHSVASQLAQQKEYNLKKPSAYHYDILVLGIMVLLCGLLGIPPSNGVLPQSPMHTKSLAVLKRQLLSKKMVDTAKDSIGRSATTLEIYGKMEEIFIEMDSEQNTGSVDKELKNFKDAFCKK

SEQ ID NO: 57577 - protein, 108 aa, Sorghum bicolor
  Clone ID: 30969338.pep
RQGRAADRSIGPLEIRVVSDGTFDKLMDYALARGASINQYKAPRCVRPGPVVELLDGRVQASYFSPKCPKWSPGVGKQWSSDAAAAAKKAAAGGSNGGGGGGGAVVVA

SEQ ID NO: 57578 - protein, 87 aa, Sorghum bicolor
  Clone ID: 30969341.pep
PRHVHHRGASMPSVGDHPARIACDEGFRYLHSSDPDANVLVGAVVGGPDGSDAFTDSRDNFAQTEPSTYTNAPLVGALAFFAAGRHR

SEQ ID NO: 57579 - protein, 152 aa, Sorghum bicolor
  Clone ID: 30969361.pep
HVNPLGIKSDAPWDVIWDIMRCWVKNHPIKEQPRDSPGTAILSKSPKLEANFSRAVAALSKAQAKKIKRFLPNPERHWGPKVRAGRKITSKHISLLGPDAINGALNGGDCHEEGNGAGLDNTAPEPEGIKDVENEPSNKRQKTSDGEPASEP

SEQ ID NO: 57580 - protein, 128 aa, Sorghum bicolor
  Clone ID: 30969371.pep
PSGSRRSPISTRTSHPSSDGSSLAPETVAAVDFSARPFRVVSDKATTVLLADAVIVATGAVARRLSFPGSDAYWNHGISACAVCDGPTPIFRDRPLAVVGGGDSAMEESSFLTKYGSRVYTILPDLVW

SEQ ID NO: 57581 - protein, 174 aa, Sorghum bicolor
  Clone ID: 30969387.pep
MAEVEDKLKDYEIKKEGEAEILLHKKNAVFYNPVQVHNRDMSIAVLRTFVAKRKEEHEALVDKRNTSHEKNKQSETSSQTGEDASTGQQDEMDVVCEKELNKAEDQIDDLPKEATKPSWKVTRELRPPLVLEALAATGLRSLRYAREVEGLGKVVALDNDKASVEDCKRNIKFN

SEQ ID NO: 57582 - protein, 153 aa, Sorghum bicolor
  unsure (1)..(153): unsure at all Xaa locations
  Clone ID: 30969422.pep
PQIPRLAARCPGSGGHCRSPHWGRLRRRLRSRGRDLRRGDLVAPGQRRGWGGGGGGRWAPGIRAAALILLAVAAAAGAAAGDPDPDELERAFXIVEPDHGHTKLRLSKQGLEAIRRIETPIAVVGVIGPYRSGRSFLLNQLLSLSCDKGFGVG

SEQ ID NO: 57583 - protein, 196 aa, Sorghum bicolor
  unsure (1)..(196): unsure at all Xaa locations
  Clone ID: 30969426.pep
CPRRRRRSRPPPATTTIWSLSPLPPPPTTPPLPPPSTPFSPPPPPPPPRPAPLRRAPPPSPSPRPSPPPSLTRPPTPTPPAPAPAPPPRAPPPLPPPCRRDPRAWRPPSTPSSPSPTQRPRPSQPPPRSSPDPGPPLSPTSSPXPPPGPRPAPPFGAPPLPRLRHARRPPCRGLPGPFRAAAPGQEHRREPGHAAG

SEQ ID NO: 57584 - protein, 149 aa, Sorghum bicolor
  Clone ID: 30969444.pep
MDLLRHPFKGVVTDIKGRATWYKHDWVAGVHSGFRILAPTMYIFFASALPVIAFGAQLSTATNGILTTVETLASTAICGIIHSILGGQPLLIVGVAEPTIIMYTYLYNFAKNQQALGEKLYLAWAGWVCIWTAIMLFLLAMFNASNVIS

SEQ ID NO: 57585 - protein, 78 aa, Sorghum bicolor
  Clone ID: 30969449.pep
YVHIELASNYQANGAHEEELLQGHGVLPRRRPVLLHGRRQRCGGVQLRGRAGQGAALLRGAEVREAPAAAVAARDVAR

SEQ ID NO: 57586 - protein, 104 aa, Sorghum bicolor
  Clone ID: 30969467.pep
KLIVFSHTVDSSGTPIPVSTENSTQNSTASQQEVATKIRTRNKTDLAWGYCTQVVEGGKTKIKCMYCNMTLTGGGIHRFKEHLAKVPGNVVACKKVDPEFEYTM

SEQ ID NO: 57587 - protein, 76 aa, Sorghum bicolor
  Clone ID: 30969469.pep
LSNREKEEDFLVFKGSKLPQRPKKRAKVIQRTVNFVCPGTWLCDLTLERYEVREKKVSKKRPRGLKAMHDMDSDSE

SEQ ID NO: 57588 - protein, 72 aa, Sorghum bicolor
  Clone ID: 30969476.pep
PKPFTTFFGEDNLKAMRVEKYLLPVPNAQVLEEINQEVVRQELMNVDDAADHADAGDDDDAAMDADDGGGDD

SEQ ID NO: 57589 - protein, 144 aa, Sorghum bicolor
  unsure (1)..(144): unsure at all Xaa locations
  Clone ID: 30969477.pep
KGKSAAAQAAASGQGSSSHHHTXGGGGGGGGXDASATTLKRKRGVFQKDLQHMMYGFGDDPNPLPETVALVEDIVVEYVTDLVHKAQNVASKRGKLLTEDFLYLIRKDLRKLHRATELLSMNEELKQARKAFDVDEETLATTNI

SEQ ID NO: 57590 - protein, 148 aa, Sorghum bicolor
  Clone ID: 30969478.pep
TQVEDQKCCGPESPIQYETLALISEDMKSLEGTNSPASQPDAALAEQSDKMIHCNDAGDTQSGRKLENESGACSVPDTLSTHEHLKPETRKRVAFVAVGNPKVTGADSETKSSEVNKKQRLDMISPSNIQSRLYNKLLDCDTRDNSIL

SEQ ID NO: 57591 - protein, 99 aa, Sorghum bicolor
  Clone ID: 30969480.pep
GGKQDEGLAKAVETVLKKATDCELASIDAMAAAAHSLVIPLAIFRERLGIEEAIELIRLEEDHQVDRWGLVEGGHDVDIADLKVQMSSAVVFLELTRGL

SEQ ID NO: 57592 - protein, 41 aa, Sorghum bicolor
  Clone ID: 30969487.pep
INRYGYLSMIPFLPLKKVRILKEIQPLCSFSSRIFIFNKVD

SEQ ID NO: 57593 - protein, 79 aa, Sorghum bicolor
  Clone ID: 30969504.pep
HGAPRRQQPRRQRRRPLVRGGGDGEGGRGQGPCRRNAAAWWWWWWWLPSSRAPGLADCGHTCFTDYAKGLGLSVGSFGG

SEQ ID NO: 57594 - protein, 176 aa, Sorghum bicolor
  Clone ID: 30969522.pep
MVKEEEIMAEAGGGRGGYMDLLGLGEDDYLLCLSPSSYFASSVVSATTTSATTTAAASSPTCASYLDMAPAYHHMLSFAGQDQQYHGDGVLGFQYYGAGDHAIPAAVPQKSSPTTECSSISSMSSSPPATAISAVSCSKPQAFKKKGSRSSEQRKAASAAAAAPAAPAAAGGGATN

SEQ ID NO: 57595 - protein, 217 aa, Sorghum bicolor
  unsure (1)..(217): unsure at all Xaa locations
  Clone ID: 30969523.pep
VSNIMGIDPKPFNPXTYVEEDVFVTDESGTKKRIRLEDNIVRWRTVRNADGTTSCESNARFVKWKDGSMQLLIGNEVLDISVHEAHHDQSHLFLRHGKGILQSQGRLLRKMRFMPSSLSSKSHRLLTALVDSQNKKTVKMQKWFETKDPEKAKMERERNQSQTIRAHSILQRXREKVNCKYTQPARPRRQLSPGFLEDALDEDEEPDYGSRRMTGRR

SEQ ID NO: 57596 - protein, 56 aa, Sorghum bicolor
  Clone ID: 30969535.pep
LYLKSNFSNLDQVSRKNVLIYTIPHGRFSEINLMLQILVQIYMNLVKVRKFDLVQN

SEQ ID NO: 57597 - protein, 175 aa, Sorghum bicolor
  Clone ID: 30969536.pep
MRSLRAAQTLVSRSLLSARHLNGAASPATAAAAAGARWCATPAPVPPPRSPLPSSKVMPAGVAGAVSFSLTFATVAAAEAKAKERPQPDLLPQNVVLYQYQACPFCNKVRAFLDYHDIPYKVVEVNPLSKKEIKWSDYKKVPILTVDGEELVDSSDIINILQRRINPDEPTNDEE

SEQ ID NO: 57598 - protein, 175 aa, Sorghum bicolor
  Clone ID: 30969549.pep
IHSSDEDQSHPAPTTDDRVAGKRPMAVEPSSTEAIPARTAADPSMGQGSTSHAPKRRRLVRIVDDDNEEDKAAQSLVRRPRSRPDVAPSDASRVTRDPPAAHVEPIRPGGTEAAAVAGWTRRWFFTRRTGAPTCKFKKVSLQSLFCMRFGVDMAICINSSLLVRPRMLIRATLPA

SEQ ID NO: 57599 - protein, 147 aa, Sorghum bicolor
  unsure (1)..(147): unsure at all Xaa locations
  Clone ID: 30969551.pep
SWKVNWAQRRAVFEARREMEKEGRNHYHTRGSSRGGGGGTATERDLLLQWGNRKRLRCVKVQRRDVEAAATAAVEKAQRRAAAAAAAAAQHHPTGHTHRRVLRNSEEFAIMKSPARXXQNNRIHTVASPDRECPGRGNNNNGVPQTY

SEQ ID NO: 57600 - protein, 197 aa, Sorghum bicolor
  Clone ID: 30969553.pep
MARYSPPSLRRFFRCAASSASRAGGSGTGKKNLVFLGSPQVAASVLDKLLGASGSPESAFKAAAVVTQPPAAKNRGRKLLPSAVAQLALDRGFPEELIFTPERAREESFLSALKEVEPDVCVTAAYGNILPQKFLDIPSCGTVNIHPSLLPLYRGAAPVQRALQDGVAETGVSLAYTVRALDSGPVIACERFSVDEC

SEQ ID NO: 57601 - protein, 219 aa, Sorghum bicolor
  unsure (1)..(219): unsure at all Xaa locations
  Clone ID: 30969562.pep
DRTLDGGRRGAGEYDRIRASILDEAAIVFSTLSFSGSSIFSRMSRAFDVVIIDEAAQAVEPATLIPLVHGCRQIFLVGDPVQLPATVISQTAQKLGYGTSLFKRFQAAGFPVQMLKIQYRMHPEISMFPSKEFYEGVLQDGEGLSRKRPWHSYSCFGPFCFFDVDGIESQPSGSGSWVNQDEVEFITLLYHQLAMRYPELXSSPEVGVISPYRHQVKLL

SEQ ID NO: 57602 - protein, 210 aa, Sorghum bicolor
  Clone ID: 30969564.pep
MSQGSEAGTAAAGEGDEEKRLRAALRHLQVEAGVLERLVYKHRNQHRGAAYFQYLLKVRRDLKLLLGAGLAEVLNAVFPVLACRKPANTILVPTKQTKKKPGANHSHHERLLGVARLLSQMSEPVMKAAIQITFLLARSFFVDLCTAVFSLLARVRVLIQQMLLDVVSVYNKVTDLTDRKQAVKISISGVQAFREYYPSMNDACTVLECV

SEQ ID NO: 57603 - protein, 214 aa, Sorghum bicolor
  Clone ID: 30969566.pep
MATVAARRLLQQRWVAGGRCRLLGTAAEASPGGEGARGGGGGSGDAIYVKKPAAAAAVTTRDETSVAMPTSFMTGSVVGKRFYRDATVRRADDGNGWTVMLDYRTLKSPAKRPLKLPSRALAMAIAAEWEYQESDGIRPFTMPLMKLACTALERVPLTRRKVIDNLMKKFHQDLVFCRSPADSELTIGVHQKQKEKIDPILEWVDTEFGFKPIV

SEQ ID NO: 57604 - protein, 143 aa, Sorghum bicolor
  Clone ID: 30969594.pep
YAEFRDTGLERSEPLRKDLEWFRQQGHAIPEPSAPGITYASSLEEPSGKDPPAFVCHLYNVYLGHTAGGRIIGKKVGEKINLQKELEFYEWEGDLSQMQQNVRARLNRVASGWSRAEKDRCLGEMEKAFTCSIDLRRHMFMLP

SEQ ID NO: 57605 - protein, 106 aa, Sorghum bicolor
  Clone ID: 30969636.pep
SSSASPRRAPSTTTCRAAANPTAPASRPPTPSQRRKRPRSTSPGPTGRCILEGTALIDKAQSAVRLVSVKRLITRLARCARRVVLMCVCTNVECFPFSHNRSTVEA

SEQ ID NO: 57606 - protein, 128 aa, Sorghum bicolor
  Clone ID: 30969643.pep
GDMRQALNNLQATFSGFRFVNQENVFKVCDQPHPLHVKNMVKNVLDGKFDEACAALKQLYDLGYSPTDIITTLFRVVKNYDMPEYLKLEMLKETGFAHMRICDGVGSFLQLSGLLAKFALVREIAKAP

SEQ ID NO: 57607 - protein, 80 aa, Sorghum bicolor
  Clone ID: 30969645.pep
RRALLTSQMRSIESVGQSSVVSHSASSVCKEKSGSSGLASLGNLMVDTSSILFWCCAAPRLVFLANLDARNVAPRCATAP

SEQ ID NO: 57608 - protein, 211 aa, Sorghum bicolor
  Clone ID: 30969664.pep
PQFSLPNARPSKLPRRKRSYPSAMAASSAAAHADTYDIPWVEKYRPNRVADVVGNSDAVARLEVIARDGNMPNLILSGPPGTGKTTSILALAHELLGPSYREAVLELNASDDRGLDVVRNKIKMFAQKKVTLQPGRHKIVILDEADSMTTGAQQALRRTMEIYSNTTRFALACNTSSKIIEPIQSRCAIVRFSRLSDQEILGRLMVVVAAE

SEQ ID NO: 57609 - protein, 218 aa, Sorghum bicolor
  Clone ID: 30969666.pep
IMGLVFFSHLIGNMQTYLQSMTVRLEEWRVKRRDIEEWMRHRQLPPELQERVRRFFQYKWLATRGVDEESILQSLPLDLRREIQRHLCLALVRRVPFFSQMDEQLLDAICERLVSSLSTKDAYIVREGDPVSDMLFIIRGELESSTTDGGRTNFFSSITLRPGDFCGEELLTWALMPNPSLNFPQSTRTVRSVTEVEAFALRAEDLKYVANQFKRLHS

SEQ ID NO: 57610 - protein, 159 aa, Sorghum bicolor
  Clone ID: 30969693.pep
MAMALAWLSAPRAALSHLDGVVVPAAASRFRSETAARVGAVVFRPRTTVVSAAAQRSLVAVAAATATVPAAAGGDDEAGTPLIEEMRAAAMRLHSRDQARDGRNEAQAPMEPPIAKWQPTVDGYLRFLVDSKLVFHTLEAIVHRAAVPWYAEFRDTGLE

SEQ ID NO: 57611 - protein, 204 aa, Sorghum bicolor
  Clone ID: 30969698.pep
KMTKAMGHGLPIAVAPGKRRPHEPVQAAKFASESGVLIRDNVPILPHWKNYKNDEKYYNEFVSKLCGRLAINKTDEPTKEACTDMLRSSVRQMRYRLKKKYFNGVPANEVRTSSPVSCMSDDEWNALTAKWKNPKNLETSEKNKTNRSKVKYHQTTGSRSYVAHLHAYKKQSNNAEPSTHQNEELDVVEAFKTCHTSSKKGLEE

SEQ ID NO: 57612 - protein, 105 aa, Sorghum bicolor
  Clone ID: 30969722.pep
PVFLAAVAFLRSHSPPPHLPSPSLPSTASLARSPARPKLPSRGFQVCWPLAPRPLPGPPLLGVTSASAPDGDRWLVSSSRDRISGPRDPMRCAATPAVRARSRHG

SEQ ID NO: 57613 - protein, 190 aa, Sorghum bicolor
  unsure (1)..(190): unsure at all Xaa locations
  Clone ID: 30969724.pep
MARAQRLAALLCLAVAASLLSLGAQATTGPRARVGVYELKLGDFSVKVTNWGARLMSVVLPDSKGNLADVVLGRDTHAEYFNDTSYFGPITGRVAQRISRGRFVLDGKVYHLQLNDGNNTIHGGGTAFSKSAWTVKEYVCGGDSPYITLYYHSFDGEQGFPGSLDAYVTYRVTSPYTLGVHMNATXRDKA

SEQ ID NO: 57614 - protein, 64 aa, Sorghum bicolor
  Clone ID: 30969753.pep
KKYTAMSTRWWNDKVNNMAHTLQTTGLAPVSAFAEHCYSYICTVGGLRLLFSRDLTLRTSVNGH

SEQ ID NO: 57615 - protein, 93 aa, Sorghum bicolor
  Clone ID: 30969775.pep
HKKYLNFIRCDICWWVICTESVNVLVGNIINFNIGPLVDLDVPRSFWSQVSGKYGNMFYWKEKGEDASIEAAVTAISRCLRNPPGTNNCSEVL

SEQ ID NO: 57616 - protein, 135 aa, Sorghum bicolor
  Clone ID: 30969788.pep
KFVEIPGCLYTVNPIAVNSKYCNVFTENKRVVSIISTSEFGKVAFVAIGATMVGSITFLKKEGDYIHKGDEFGYFSFGGSTVICVFEKDAIQFDADLVANSERSLETLVSVGMTLGVSTRNKGLQVPDLQKFSLE

SEQ ID NO: 57617 - protein, 173 aa, Sorghum bicolor
  Clone ID: 30969793.pep
ANGLNVRGGSNSNDTVPVASIVFGSPRVGDDQFKKAFESPSTPGGGARLLRVRNAPDIVPTILPAAFYRDVGVELLLDTRKSPHLKRPGPGPAAWHNLECYLHGVAGTQGAGDGAGFRLEVDRDVALVNKEVDALSDEYPVPAAWWVEGNKGMTRDKSGRWVLQDHEEGNLAM

SEQ ID NO: 57618 - protein, 113 aa, Sorghum bicolor
  Clone ID: 30969803.pep
YVKNGGVHGWNLMRKLTSRGANVFAQTLLQLGASDLTGSFRLYKRDVLEDLISSCVSKGYVFQMEMIVRATRKGYHIEEVPITFVGRVFGISKLGGSEIVEYLKALVYLLLTT

SEQ ID NO: 57619 - protein, 36 aa, Sorghum bicolor
  Clone ID: 30969830.pep
MPMEQAFRHCDKDTLKMAMLKHEETFRQQVHELHRL

SEQ ID NO: 57620 - protein, 51 aa, Sorghum bicolor
  Clone ID: 30969849.pep
HIIILAMFSFDPHWHYLNCLLYNFSACMFGTCQIHHMSESIINTRKSFKKC

SEQ ID NO: 57621 - protein, 204 aa, Sorghum bicolor
  unsure (1)..(204): unsure at all Xaa locations
  Clone ID: 30969859.pep
QAEVAMQDELKAIQEEKDAVLTQLKQSETSVQNLENEVTRLKEELSVQLENNSTLNKQLEEAMLKVSNLHENLEKAQAEAACQLDGMSTKTKDLEKTINLLSSEKTKLEKDLKIMIEACTENMSFLAGFEDRVTQKISDHEAGLKVLHQSLRGAVGSCQRLQYAYDEVSTRASHLEILERSQMEQIGQLEQXNTETLEKHRLLE

SEQ ID NO: 57622 - protein, 180 aa, Sorghum bicolor
  Clone ID: 30969867.pep
NRSSSSLTSCRTTAPTSSPLSVRRPRPRALSIPRVHCCASRTPHPLDAAASWAGELAGAVPWKAAASGVLAVAVSFTCLVGFANARTGVNKPELLPKEFTTVIDVAGFLSSGQENRLRQEIEDLEKDTGYKLRVLAQNYPDTPGELFLTIYMVLPWLAFRCFITISIKDTYNLGILFTVS

SEQ ID NO: 57623 - protein, 126 aa, Sorghum bicolor
  Clone ID: 30969868.pep
MAAAGDGQTQTQPQQEPEPVAGAATGGGVVAKLEEEWRKAKEHAQTYPYVWSSYILVYGGLGAYLAWRWRKLRRTEDRVRVLQDRLRKLSAAEESQVSAPGSASTASTPPRPQQSASGPGKPASSP

SEQ ID NO: 57624 - protein, 67 aa, Sorghum bicolor
  Clone ID: 30969886.pep
GGRMVAVAAAAVEAVAETAAEAREARGQHHLAVAVAVAGAAIVGPRRRVAHPVRTKLVKTNRGTAAG

SEQ ID NO: 57625 - protein, 154 aa, Sorghum bicolor
  unsure (1)..(154): unsure at all Xaa locations
  Clone ID: 30969891.pep
SGSRAAVFKSSSFIGRGADDGLRAAVRAPRRTDLRFRVTRCGKTSPPEEEEVEAGEVRRLLMPAMPVXRGGSGSGSGGGGGDDXASRVGAGEAFIAGWGGRAETRRRGARGDKWRAGSEMGCRWGRRQRQRPPVGARPRPGARRRGQPGGRKVQ

SEQ ID NO: 57626 - protein, 79 aa, Sorghum bicolor
  Clone ID: 30969920.pep
LYPLQSAGTKYTSFDTKPKCSVAGNRGPLTLKTAAVHSDKSYILLQKKIHAHFPSSQDPRKISETKLHTYSCPTEPSEW

SEQ ID NO: 57627 - protein, 107 aa, Sorghum bicolor
  Clone ID: 30969937.pep
PDTPTSRGGEATKTDVFTSPLGDMDIDIDMEAEQSAMQRQIMEMYLKSMQQFSESLAKMQLPIELGRGDGIGSGVQKEETPDKKKVIERQQAKKDGARVFYGSRAFF

SEQ ID NO: 57628 - protein, 146 aa, Sorghum bicolor
  Clone ID: 30969938.pep
VFCWTFLYLNKTATGLKSSVNVQNWNRILECFKNNRRQNEPGFRKRLSDHKMNDDHILLQRVSDSTQYCVVHNHDRIAHVNEEAPKITLHDILDGTGSVKPYSKFDIVVWESHLPPYHKYIYSCQILEFDCNVTKNKQSQKRKFSS

SEQ ID NO: 57629 - protein, 149 aa, Sorghum bicolor
  Clone ID: 30969950.pep
LKEKLQPVVATLGTRKKGANLQGVFSKILGAAVAGGLRSDMMVKRVLVLSDMDFDGWAGSAAAWETEYQGISSRFTDAGFTAPEVVFWNVGTSKASMPVVAAQKGAALVSGYSKNLVRLFLEADGNLTPAAVMADAISGSEYDALEVFD

SEQ ID NO: 57630 - protein, 202 aa, Sorghum bicolor
  unsure (1)..(202): unsure at all Xaa locations
  Clone ID: 30969959.pep
ATMSALEELFRIARAQSLIALCGTVPGYWFTVALIDVVGRFAIQATGFLMMTVFMLGLAVPYHHWTGNHHIVGXVVMYGLTFFFASFGPNATTFIVPAEIFPARLRSTCHGISAASGKLGAIVGSFGFLYLAQSRDPGKTEHGYPAGIGVRNSLFLLAGCNLLGLVFTFLVPESKGKSLEEMSGENDEPAGAAASSNRTVPV

SEQ ID NO: 57631 - protein, 144 aa, Sorghum bicolor
  Clone ID: 30969973.pep
RGERDAFTGMDWEILTELWRKQRESGQVDPAKATQQGIYESLCRDATILFSTWEFDPTEIKNPFPGGEGVVSIWQGYEDKIVQVEIQRYVAQKLPWVRYHEHPEAGHALPDMDGVGDKIIRELLLGDDEAPRGLQLQNDLHQDG

SEQ ID NO: 57632 - protein, 121 aa, Sorghum bicolor
  Clone ID: 30969974.pep
DVEGDGMADMAFRCIQEMDIDNRMTLYQHIVLSGGSTMYPGLPSRLEKEILDRYLDVVLKGNKDGLKKLRLRIEDPPRRKHMVYLGGAVLAGIMKDAPEFWITRQEYQEEGVACLRKCGQS

SEQ ID NO: 57633 - protein, 221 aa, Sorghum bicolor
  unsure (1)..(221): unsure at all Xaa locations
  Clone ID: 30969995.pep
ILEQLLDNTQIDDFKLNIDLSVELRRYQQEGINWLAFLRRFKLHGILCDDMGLGKTLQASAIVASDIAEARARNDDKNLTSLIICPSTLVAHWEYEIEKYIDTSILKPLQYVGSSQDRVTLRSEFDKVNVIITSYDIIRKDIDFLGSIPWNYCVLDEGHIIKNSRSKITSAVKQLKAQHRLILSGTPIQNNVLELWSLFDFLMPXFLGTEKQFQATYGKPL

SEQ ID NO: 57634 - protein, 181 aa, Sorghum bicolor
  Clone ID: 30969998.pep
MVALSKLALVSAVALLVCWAYQATQPPAPAILGAPGGPPIISPRIRLKDGRHLAYREEGVRRETARFRVIFFHGFSSTKESGFPVSQELVEELGIYMLFFDRAGYGDSDANPKRSLKSDATDVEELADALQLGDKFYVVGCSMGGYPAWSCLNYIPHRLAGVALAAPAVNYWWPLLPANVS

SEQ ID NO: 57635 - protein, 210 aa, Sorghum bicolor
  Clone ID: 30970027.pep
MELDFNSDKKDILITGAHKMVKTNNPEKIAAQKYVSTRLRFSLRAYASILYLHVPDTFRIILRGRDVEPHNIVNDLMYRECVLYKPQLAGLTESSVITTIGFVKGAPDIDVQGFNVYHKNRLISPFWKVANNSYGKGRGVVGILEANFIKPTHDKQDFEKSVLYQRLEIRLKEMTYEYWDLHCHRVGYDNKKLPKAIRAVNRANHMNGGS

SEQ ID NO: 57636 - protein, 211 aa, Sorghum bicolor
  Clone ID: 30970039.pep
TTLLSSLLDRSRSRSRSRRSSAESGTAARLTEAMRPRCARAALSLDDSPPEAAAAAEPVGGGSRSAVASCASPKTPGPPARTTSLMARTATSPPPSSRTSSVTSTYSSSSLNRVLRRLPLLPSVDALLNAVGGGGPVSCCWPDDDDMAEDRVELMEEISLRSAAPARGGICGSAALDVLQMNLKDAAELQLEQNLKEMEMLECCVLIKLAL

SEQ ID NO: 57637 - protein, 182 aa, Sorghum bicolor
  Clone ID: 30970044.pep
MESAARFLRSRPDEGGGGADEQSAGIVRLSLALRPEIPEDDACDLPAGRGADAEPSIASEVVILGPAPPVDYSRIEFTDLRVEQENDAMAVQYLPFLRTGETVLAEDCEMSASPRARGEKSSTAAASSDGSISRNAAASTASTVSEDRAVSSSADAAEKPPSLHDVDEAATAPVSRRSPDTP

SEQ ID NO: 57638 - protein, 150 aa, Sorghum bicolor
  Clone ID: 30970045.pep
ESGLASVRSTPPASVSSGHLDGRPPPTALPQQHRPGALRPKSTVPRAAETDGDGAKRHSPTGYMTVRWRRRFRRAALSSPRNDRRPPDSGYYFFHNTLHLVTLTLNSDVKHDSSLQFTLQEYYGGFGTVVLYVFQLRSILFSQTVSAPHT

SEQ ID NO: 57639 - protein, 76 aa, Sorghum bicolor
  Clone ID: 30970053.pep
RENRKRWLQEIQRKPPQISMKNSQKLHKRNSTYYESILKKSSPRINPNSRKYSDLRQERVFLSKRKSAWFLMHKWN

SEQ ID NO: 57640 - protein, 184 aa, Sorghum bicolor
  Clone ID: 30970055.pep
MAPAAALVGPPIAFVAGANLPPKPIRSSSPDHSSDEISPSPMDEDSPAPGRTMKEEVVPQSGRPLAYASSGDPCVDFFFQVVPGVTSDADLAVLLDAAWSHDARTALKLVCHLRGVRGLGKSDRDGFYAAALWMHERHPLTLAANLANFAKFGCLKDLPEILYLVLHGPRDEDQDQRKGDDRRH

SEQ ID NO: 57641 - protein, 79 aa, Sorghum bicolor
  Clone ID: 30970067.pep
MVLKFLIGPIIMLLASLAVGMHGTLLHIAVVQAALPLAVTSFVYAEEYKVHADIMSTGVILGIFISLPVTIVYYILLGL

SEQ ID NO: 57642 - protein, 127 aa, Sorghum bicolor
  Clone ID: 30970084.pep
GLDMLRKHQCMIDLKDNVLRVGGGEVSVPFLQEKDIPAHIHDEEKLSKLSSLGQATGESSRAREGTPNPPQQTPPSGAPVANPPQGGDFEAKVTKLVELGFDRASVIQALKLFNGNEEQAAAFLFGG

SEQ ID NO: 57643 - protein, 123 aa, Sorghum bicolor
  Clone ID: 30970097.pep
IGAKKAGDEQTASVPQVHEHIHISAALPAPQAFHDYAGPVAAEADMLAIVPQADEIFDGILNSLPEIPVANVRYSDFFDPFGDSMDMANPLSSNNPSVNLATHFHDEKIGSCSFPYPKSGPLM

SEQ ID NO: 57644 - protein, 55 aa, Sorghum bicolor
  Clone ID: 30970101.pep
DFRASCFCHKKTIDMGYVCSVCLSIFCKNQKKCSPCGSEFSRVMPDLNSMPDQSK

SEQ ID NO: 57645 - protein, 118 aa, Sorghum bicolor
  Clone ID: 30970103.pep
YTQLQLASGNIKYFYQSRKSQRSLKVAVVGDKVPLYGGGSGLSSTATTLPPPKKRAPPVVVPPPPVPLQLTVRLRSRAFVLGRLVKPKFYSEARCSVTMDQTKLGKPVSLNKACTYTH

SEQ ID NO: 57646 - protein, 138 aa, Sorghum bicolor
  Clone ID: 30970107.pep
ESWDRFLPKFKKKNVKQKKPQTKEKKPYTPFPPPQQPSKIDLELENGEYFMSDKKKSAKKWQEKLEKQSGRAEENKRKREAAFVPPKENTAGPSESDKNASDNSEIADIAKSLKKKAKEFRKNEAQESVIAESYLASN

SEQ ID NO: 57647 - protein, 136 aa, Sorghum bicolor
  unsure (1)..(136): unsure at all Xaa locations
  Clone ID: 30970138.pep
SPKPMTPPPQPXAPPSPSPEPQPXPPSPSPMARHPKPPAPPSPPPPPCPPSDSDPGVGFDPIEEWLVDFDPAMSGELAAKGLGAAEQAAAVPHTLVETAAGKSFELEFGVMDEKVEVVSSSGLDELLAPDQLLVSG

SEQ ID NO: 57648 - protein, 185 aa, Sorghum bicolor
  Clone ID: 30970139.pep
MAVAAVAGKLGAGGDPVAVEVLLPPLSEADPLHAEKKRILENRNLSCEIQIPVTCSAADALKLLDQIIEAARVVYMDELELYFAGDDVGPFSARNELESLNVLFKTMKKLLLTSNAAAKEVLQILQDEIVVKLKSVGKSDDAWMVVQTQNHDAEDPLLKWGEHLGVKSILQIAFFQGAGRGMVAS

SEQ ID NO: 57649 - protein, 164 aa, Sorghum bicolor
  Clone ID: 30970141.pep
MLRRNIRQRREYLYTKSLEGPQRALFEKKRRIRAALEEGKPIPTELRNEEHDLRRQIDLEDQERQVPKSIVDNEYATATVREPKILLTTSRNPSAPLTQFVKELKVVFPNSQRMNRGGQVISEIVESCRSHDITDLILVHEHRGQPDGLIVSHLPHGPTAYFGL

SEQ ID NO: 57650 - protein, 214 aa, Sorghum bicolor
  Clone ID: 30970151.pep
LSPETVRIFWESKKFEGSTSSAEPWYNTPYSVENVTPSVIQQWIKKAPTEKLHLPKSNIFIPKDLSLKEVHEKVIFPTVLRKSPLSQLWYKPDMLFSTPKVHIIIDFHCPLSSHSPEAVVATELFVELLVDYLNAYAYDAQIAGLFYSIYLTSAGFQVSLGGYNDKMRVLLNAILVQIANFEVKPNRFSALKETSVKDYQNFNFRQPYSQAPYY

SEQ ID NO: 57651 - protein, 155 aa, Sorghum bicolor
  Clone ID: 30970161.pep
MIPGSAVYHVVEAMAPLYTAAVLGYASVRWLKAFSDEQCAGINHFVALYAVPVLIFHMVSTNDPYHMNERLIAADTLQKAVMLLALTAWAFWSHFRRRRDGKASSASAASPIKWVVTNFSVASLPNTIIMGVPLLDGMYGSVSGGLMKQIVVMQF

SEQ ID NO: 57652 - protein, 186 aa, Sorghum bicolor
  Clone ID: 30970197.pep
MQQQQPPHRHAKTDSEVTSSMAASSPPRAAYYVQSPSHDDGDNKTAASSFHSSPAASPPRSLGRASRDSSSSSRFSASAKSAGGAGAAGPGGVAAVPGGRGRRRSSPWMKEAAIEEEGLLGMDDDDDDDGSGGHGSGIPKRVRYALGFVGAFFGLFFFFALILWGASRNQRPVVTLRAVTFHRFVV

SEQ ID NO: 57653 - protein, 135 aa, Sorghum bicolor
  Clone ID: 30970201.pep
MASEDEANAAAAVAEDAEAAEGRNWRRKGKHDKPKPWDEDPNIDRWKIEKFDPAWNEGGMLEVSSFSTLFPQYREKYLQEAWPLVKGALKEYGISCELNLVEGSMTVSTTRKTRDPFIIVKARELIKLLSRSVPA

SEQ ID NO: 57654 - protein, 66 aa, Sorghum bicolor
  Clone ID: 30970208.pep
ETKIPNYHLDLRSSGGSHTPSINEFGLTRACSSINSSLLDFILSSTKQMSRSLLGPAKLFPTSDFT

SEQ ID NO: 57655 - protein, 121 aa, Sorghum bicolor
  Clone ID: 30970224.pep
EVIIRALKSAFSIKATRVEGLTGVWVGDQKVAAIGIHGSRMIVYHGLALNVTTDLAPFKMIDPCGIKDRGVGSIKEILQKASGAREIDDASLMDTAYDSMMKEFAELFQLSLDFSPDCSFQ

SEQ ID NO: 57656 - protein, 128 aa, Sorghum bicolor
  Clone ID: 30970261.pep
RGRCESADLGAWRRRRVQVERQGVVAAEGDLHDQSARHRAWATQGQDDADALHLAQRHGLRSHREGVHLYMGIWALLVPSGDRQAGALGDERWQGAWRPYLCLHLGMAASVPRCSKKLTFWLLTSERR

SEQ ID NO: 57657 - protein, 110 aa, Sorghum bicolor
  unsure (1)..(110): unsure at all Xaa locations
  Clone ID: 30970262.pep
AGAMDREMQTKAEGMRQVLEMADGLRLETMREVVALLRPAQAVHFLLAAAELHLAVHDFGRRKDGHXATPPPPPPRRRSDADAPGCSALRVSCNGSPVPSGAWLRAFARS

SEQ ID NO: 57658 - protein, 216 aa, Sorghum bicolor
  Clone ID: 30970284.pep
MAPRGKCRGRKHQTLASSAAASPRPRVLAPAPAMETTTTTTVADLTDFILQAILVRLTPADLLRAALACHRWRRAATLALPRVPPLLGYFFHPKGPSSPPPMPTTDKTHHPAVFLPLDAAAAASPRLSLDLTKGFASTLSIQDVHHGLVLLTPHSRPKSPLLPRILAVDPASRRRVLLSPPPRDAVPERGDLWRRERCVIGVAVLARAHPSSLTFD

SEQ ID NO: 57659 - protein, 165 aa, Sorghum bicolor
  Clone ID: 30970285.pep
MPATFPPPPPPPPPSHNLPPLLSSNESFSKFFESWIGEQSRDLEELRAAASAEPAAPEADLRRLVDQVMGHYAQYYSTKAAAAAGDVSMMFTPSWTSTTENLYLWCGGWRPTAAIQLLYTKCGMQLEHRLPVFLDGGGLNKDDLSDLSVAQLRAADQLQHRTISR

SEQ ID NO: 57660 - protein, 190 aa, Sorghum bicolor
  Clone ID: 30970296.pep
MAAAASVSGTGGGARLVDRCIDAAARGPATVEAWRRQRRSLERLPAPLADALFRRLAARRLLFPSLLEVFSRSVEEVDLSGFLSVDAEWLAYLGSFRFLRVLTLADCKNIDNDAVWSLSGMNTLKDLDLSRCKKISDAGIKHIVTIESLEKLHLSETELTNNGVMLISSLTNLSFLDLGGILMTDKSLQS

SEQ ID NO: 57661 - protein, 183 aa, Sorghum bicolor
  Clone ID: 30970313.pep
MALLPSPLCSPCHHRAAPAPLPAPTAASARHWRGSLRLAAAGSRSGPTAETKPRPTSADRRRCECFDLHRQLIPYAEAYCWQKSIVERRKGLIDTREDHSDTLIALQHPPVYTLGTDSKKEYLHFDKEDAPFEIHHTNRGGEVTYHGPGQLVMYPIMNLKYHKEDVRWYFRSLEEVIIRALKS

SEQ ID NO: 57662 - protein, 105 aa, Sorghum bicolor
  Clone ID: 30970344.pep
SSSYMMKHQQLKVFLSMLVTTGTGVRVAIYQSTWLFSYKRRLHLHGMKCSRQHEFKYLLSMRFLAFPLHFEKFRLELQSCIVHSICCYFLLPCLYASWTWILIQL

SEQ ID NO: 57663 - protein, 114 aa, Sorghum bicolor
  unsure (1)..(114): unsure at all Xaa locations
  Clone ID: 30970357.pep
AAXYSSTRRHSFAAGGGGSLSVVVVVVVVPVQRRAGGRDAGDDPCRGAQVHVRRGPTRRLRSRRRRRGGHAAAGGGRHARRRGARRRRHTAVEEENPKPNQTKSDRTNAKHCVN

SEQ ID NO: 57664 - protein, 157 aa, Sorghum bicolor
  Clone ID: 30970360.pep
VAQFSNKAPSFARFNYYPPCPRPDLVFGVKPHSDSGVLTILLIDKDVSGLQVLRDGVWHNVPTSPYRLLINIGDYVEIMSNGILKSPVHRAVTNTEKERISLAMFHGLDPEKEIEPAAALLNEKQPARYRTLKAKEYLAGFYEHFCKGTRFIESVKI

SEQ ID NO: 57665 - protein, 91 aa, Sorghum bicolor
  Clone ID: 30970362.pep
IEQNVTRTWARRRTTYYRYSVTVTNRSRKTVRELHLGVSELRGRLWGLDRARYGYVPPKWLPALRAGKSLRFVYVQHGTPANVWVTGYKLL

SEQ ID NO: 57666 - protein, 111 aa, Sorghum bicolor
  Clone ID: 30970374.pep
DKKYKRETRFTSQCPPKEIIDRIEEAAKPLGFDIQKKNYKMLMENPKAGRKGNLNVETEVFQVAPSLHVVELKKAKGDTLEFQNFYKTLSTELKDVVWACDDEIQDRSSSP

SEQ ID NO: 57667 - protein, 101 aa, Sorghum bicolor
  Clone ID: 30970393.pep
LHMWSMKMETEEAVEWLQYRVIELEKIIPVANPNDARVVVVGSAEGVGVIFVSTDVGLFSIDLKSERVKKVDEPGVHFSVLPYMSFYTPDRGRLLSLARGQ

SEQ ID NO: 57668 - protein, 152 aa, Sorghum bicolor
  Clone ID: 30970394.pep
TVLRPDVYAPFVRAFDAATAGRKRVTPPTPPFELCYDSRELGSTRLGYAVPQVDLMLESGANWTVFGGNSMVQVSDDTACFAFLEMKEEKHEGGHGYGHGGGAGTAPAVIIGGFQMENNLLVFDEEKRQLGFSGLLFGRQTTCSNFNFTLAG

SEQ ID NO: 57669 - protein, 203 aa, Sorghum bicolor
  Clone ID: 30970416.pep
MAQLLLLLAVSALTLLSPRTAAAATSTTSGGKPLVTAITRDAATKLYTAPLKDALPLVLDLSGPLLWSTCAAAHPSYECHHAACAHAHAHHPPGCPRTGHGVADEDDPFRCRCRAHPYNPFARRAASGDLTRARVTANATDGANPLAPVSFTAAAACAPPTLLAGLPAGAVGVAGLARSWLALPAQVARKQKVARKFALCLPG

SEQ ID NO: 57670 - protein, 114 aa, Sorghum bicolor
  Clone ID: 30970437.pep
MQSQIVCHGCRTVLLYPRGAPSVCCAVCHAVTNVPPPATEMARLICGGCQTLLMYTRSATTVRCSCCDTVNLVRPVSSIAHVNCGQCQTVLMYPYGAPSVKCAICNFITNVGGV

SEQ ID NO: 57671 - protein, 124 aa, Sorghum bicolor
  Clone ID: 30970442.pep
MAAAGGGGGSGGGGTTSGCGLKRRYAPRDQEEETMNQDQPSKEDWCGRIWNGMDLLKDATENKHVLPTGLEGIDTLLGGGLRQGQLTEVTGPSSSGKTQVCLHSASHAAVKHMGVVMYLDTSNS

SEQ ID NO: 57672 - protein, 69 aa, Sorghum bicolor
  Clone ID: 30970444.pep
IIVVMQAPEDFCHKDFRSTSFFFHLYDYNSDKDEEWPRGSPLGSGSRPLLIWWLLLCSAPATPSLRRCR

SEQ ID NO: 57673 - protein, 84 aa, Sorghum bicolor
  Clone ID: 30970462.pep
MADESWRIPMLVQELAAKVQQPPSRYVQPEQYHPVSLDVGAETPEPIPVIDLSRLSAADDAADESGKLRLALQSWGLFLVANHG

SEQ ID NO: 57674 - protein, 56 aa, Sorghum bicolor
  Clone ID: 30970494.pep
AHFYYKGLKMKPLHFKARKRQSGLPSQTLTPKLDGLRIVSSNGAQKITLLQMSPNW

SEQ ID NO: 57675 - protein, 182 aa, Sorghum bicolor
  Clone ID: 30970505.pep
MRKVQDEIRAAVAVAGGDLVVTEDHLEKLRYLKCVIKETLRLHTPVPLLLPHETIEDTELLGYHVPARTRVAVNAWAIARDPATWERAEEFVPERFAGDDLSTDYLPGQDLRFVPFGAGRRGCPGVGFAVPTLDLALASLLYHFDWELPTAAGSKLEMDEVSGLSVRLKATLYLVAKPWAPR

SEQ ID NO: 57676 - protein, 132 aa, Sorghum bicolor
  Clone ID: 30970524.pep
VAHDDPRNMCCSCMNTSYQPRMTISRVIPVVNLKTVASQSCSSGTEATHVAALFMYGYGLKLGGLWKFVLLLVLVNDEPIYLSTSYVLNVDCSSFSRYIGFFFWLRILIYSMRYIVSKTVRIIYNLKWRKYK

SEQ ID NO: 57677 - protein, 179 aa, Sorghum bicolor
  Clone ID: 30970532.pep
RNCQWSLDLLDAWVPMGPRGPSRVEAGKLLTASLTGRPAFEADDQSALIHLLLMQKERWMDKVHVETEFYLHGFWTGLVDRYEEMMEEHHPGLGDDRWPFITHFVGCKTCGRYEDYPLDRCVRGMERAFNFADNQVLRLYGFRHRSLTTAKVRRVTDPATNPLMAKEAALKMDAKFSSN

SEQ ID NO: 57678 - protein, 75 aa, Sorghum bicolor
  Clone ID: 30970537.pep
VWKCMQVTLVTSNTKLVATSYGPHPANVGPTFQCLPRPVTRELLYNRLLSLSLSLSIFLKSHQHTHTTALRWPWP

SEQ ID NO: 57679 - protein, 153 aa, Sorghum bicolor
  Clone ID: 30970542.pep
RPYVAQLPWHGGTRAWLSKLFPRYGHYCGPNWSSGKEAGSVLWDRRPVDHLDFCCYCHDMAYDTHDQAQLLRADLAFLRCLEGSRRTPARDGIAAAVIYRAMCIFGLKTILIPYRTNLVRLQTGPNYADFFADFVKRVASSSGRPTGGEKQRL

SEQ ID NO: 57680 - protein, 113 aa, Sorghum bicolor
  Clone ID: 30970548.pep
AAKGPHKTPPPAQHFPRTPRPSFLQSPPMLFAFRKEGQGATRVERERESFLRYLRFYRRPYDEISYRAKMRPPLGGLISIVGEKFKQKPVQQPLRRHAGLHHHNHHYQQQQRI

SEQ ID NO: 57681 - protein, 170 aa, Sorghum bicolor
  Clone ID: 30970573.pep
MAIDKVDAKEREKIEAVRKLLRKQAPLSAKQAQYCNDACVERFLRSRGENVKKAAKHLRTVLSWRETVGADHIMADEFSAELADGVAFVSGHDDDGRPVVVFRIKQDYPKFHSQKSFVRLMVFTLEVAVACMSRFVDQFVLLFDASFFRSASAFLNLLMGTLKIVADYYP

SEQ ID NO: 57682 - protein, 180 aa, Sorghum bicolor
  unsure (1)..(180): unsure at all Xaa locations
  Clone ID: 30970579.pep
LVLEFGLFXGDPHPGNIFAMRDGRIAYVDFGNVAVLSQQNKQILIDAVVHAVNEDYAEMANDFTRLGFLASGTDVAPIIPALESIWQNSAGKGLADFNFRIVTGKFNQLVYNYPIRIPERFSLVIRSLLTQEGICFTLKRDFKFLEVAYPYVAKRLLTDPNPALRERLIQVTCLDPINTT

SEQ ID NO: 57683 - protein, 176 aa, Sorghum bicolor
  unsure (1)..(176): unsure at all Xaa locations
  Clone ID: 30970591.pep
MESLLASRSIRSSFSAVASTRGASSRPSRIATLAGAGAGARPLRAGPKDSIVEALAKDDMLNATEVVQWENGMTVNGIAATQGIRICRHCRPTASLKEIEEELGAPRNILEKIIWDKEIEVAEGHAKKPLEEVIQAAQKAPPSRDFYGALEAAYKRNGVPALIAEVKKASPSXGVL

SEQ ID NO: 57684 - protein, 187 aa, Sorghum bicolor
  Clone ID: 30970614.pep
MVSQERQEPALPLPSNSSSAKRAAASMDASSPAPPLLLRAPTPSPSIDLPAAAGKAAAVFDLRREPKIPAPFLWPHEEARPTSAAELEVPVVDVGVLRNGDRAGLWRAAAQVASACATHGFFQVCGHGVDAALGRAALDGASDFFRLPLADKQRARRVPGTVSGYTSAHADRFASKLPWKETLSFGF

SEQ ID NO: 57685 - protein, 162 aa, Sorghum bicolor
  Clone ID: 30970624.pep
MAPLPAPAPASLLCLFFLCLLAAPCPGARAARFACNATAPRASTCQALISYAPPNGTATPTLAAVRTLFQLRSHRALLAANGLPLSTPPTAPAPAPLRVRLPCLCSGGAGATFQRPTYRVRAGDTLDAVARGVFAGLVTYQDIAAANNVSDPNRVAVGQQLW

SEQ ID NO: 57686 - protein, 194 aa, Sorghum bicolor
  Clone ID: 30970643.pep
MGVAGGGGRLRASSAKKQRQRTLNNIKITLLCGFITVLVLRGTAGFNLLISGGDLDGAAAAAADAKVVEDVERILAEIRSDSEADDVVFVVEDDGSSLPSSPRRNETAASFGNFSASATVVKVREYSLGPKLTDWDAQRREWMSRHPEFPALDPRRGGRPRVLLVSGSPPGPCDNPVGDHYLLKSTKNKIDYCR

SEQ ID NO: 57687 - protein, 78 aa, Sorghum bicolor
  Clone ID: 30970648.pep
LNYDVASRWHSPSLSLVLVSRAQLRDKAHVVLVLLRRCLPACLPCTTTTTTAGPVRSGPLLYKPAQQRERGGRGGGGG

SEQ ID NO: 57688 - protein, 167 aa, Sorghum bicolor
  Clone ID: 30970659.pep
GKADWELALVDTASNLSKQAASLGGGMDTLLLGGMYEQGAVRQQVAAQAASGSASSVLPGHGAAAPVLMLPAPDGTVQTVGGDPFAASLAVPPPSYVQMAEMERKQQLLVQEQQMWAQYRQGGMQGQPAGFNGLAGGGVVPSNAGMAVPYGGYGGMPMAYNQVGGYY

SEQ ID NO: 57689 - protein, 94 aa, Sorghum bicolor
  Clone ID: 30970683.pep
QNQHIKNNDIVTLYLKVNFFIKTYEGRTLVMSMWTCDTAEEVMKVIEEKLEVNTGVYYLHYRGRVLSRGDTLRKHKIGNNSTIDVRLRNSHVPQ

SEQ ID NO: 57690 - protein, 221 aa, Sorghum bicolor
  Clone ID: 30970734.pep
YVRRRKKLPDPVEKEKGVSLWSMIKDNIGKDLTKVCLPVYFNEPLSSLQKCFEDLEYSYLIDRASEWGKRGNSLMRILSVAAFAVSGYASTDGRSCKPFNPLLGETYEADYPDKGLRFFSEKVSHHPMVVACHCEGTGWRFWADSNLKSKFWGRSIQLDPVGALTLEFDDGEVFQWSKVTTSIYNLILGKLYCDHYGTMRIQGNREYSCKLKFKEQSIIDR

SEQ ID NO: 57691 - protein, 207 aa, Sorghum bicolor
  Clone ID: 30970766.pep
MPAGAGAASASKGRKKTACVTGGNGYIASALVKMLLDKGYAVKTTVRNPDDMDKDSHLIMELQSLGHLEVFRADLDEEGSFDDAVAGCDYAFLVAAPVNLTSENPETEQIEPTVRATLNVMRSCLKAGTVRRVVLTSAASTICIRPLEGDGHVLDEHSWSDLDYVTAERPPAWVYVCLYVHGAPLQYVFTTYTIYVCLHCVARDMSS

SEQ ID NO: 57692 - protein, 211 aa, Sorghum bicolor
  Clone ID: 30970779.pep
SLEGRTRKPSAASAPSSASTLLPRQPLAHELARRLRRRWTERAAMDSRYGQPPHYKIYVKMMKTVPLDVKSTDTIDQIKSQISALEGIDSSQQALFFAGNQLEKDNRLADYNIMANSCVDLYVTDGMQISVSIPSVGKTIKLNLKKSQSVADVKAVIEQKGGIPLDEQILMYGCQKLEDNKLLSQCGLSNGHTLHVLVCPTDKLRISVDVD

SEQ ID NO: 57693 - protein, 69 aa, Sorghum bicolor
  Clone ID: 30970813.pep
KENHKLRSKYDLIANIVHDGKPGEGCYRVFVQRKSEEAWYEMQDLHVTETLPQMVALSETYMQIYEQHE

SEQ ID NO: 57694 - protein, 59 aa, Sorghum bicolor
  Clone ID: 30970824.pep
MCRFHVSLVKGMYGKKAPQIDKQGPPPATEDIQSCHIDLSVINLGLVSFSDQSRRIAVV

SEQ ID NO: 57695 - protein, 151 aa, Sorghum bicolor
  Clone ID: 30970826.pep
AIVQYLQPGTGNQIPRVNMQYGQYRTHNPVGIVNTTQLAHPYPVNPVNLAGGPASAHASTRFPSLTSMQEALANLGSTALLPRAADHQYMVQQHAVQVQNNTFPTGYEGIRGMATTANTYGLPSMDQRLAAQNIQAMNHSSLPRVGTNPFA

SEQ ID NO: 57696 - protein, 134 aa, Sorghum bicolor
  Clone ID: 30970832.pep
MCAENFCTDIFSSNLTLIGQSRGQLYYFNTRERDLSVLSVWILEDYDSDEWIFKYNISTSQLFGEKGLGFALIAIHPECSLIYFVWKCEGILMSYDMERGKVCVVCNAMEHLYDPVLYYLPYVPFLSGSARLEA

SEQ ID NO: 57697 - protein, 105 aa, Sorghum bicolor
  Clone ID: 30970852.pep
ASLRQQTCPQASDGGAGDAALAPIDVRTPEAFDNAYYRNLMARQGLFHSDQELFNGGSQDALVKKYGGNAAMFAADFAKAMVRMGAISPLTGTQGEVRLDCRKVN

SEQ ID NO: 57698 - protein, 221 aa, Sorghum bicolor
  unsure (1)..(221): unsure at all Xaa locations
  Clone ID: 30970853.pep
MYFDGHHVDCSDDAKESTSPRKDLTTLVDSLGADKNEDHNVDECCNARSSSMYSMEVLDNEPVDFENNSSLWVPPEPEDEEDDHDGEHDDDEGVDATGEWGYLRSNSFGSGHCRSRDKSAEEHKKAMKDIVDGHFRALVSQPLQAEKVPLVDKSGKESWLDIVTSLSWEAASLLKPDTTSKGGQMDPGGYVKVKCLACGHPSESFVVKGVXCKKNVAHRRS

SEQ ID NO: 57699 - protein, 115 aa, Sorghum bicolor
  Clone ID: 30970862.pep
FNNLLDDSESFNQCRATGYIAWLVAWLSSTNKLSPLKISPLNLSPPSRKRMTVTVIRVPNSKLKYVLPQCKGLLAVLNVTDRIARLMATGEHIPLPLINYSIRDDGPAPLCSTYT

SEQ ID NO: 57700 - protein, 214 aa, Sorghum bicolor
  Clone ID: 30970892.pep
RVINDKVSEALVGMDPQQQAQIDQAIMDLDKARHKAELGANAMLAVSIAACKAGAAEKEVPLYKHIADLVGKTATTLPVPAITVINGGKHAGNGLPIQEIMVLPVGAKNFEEAMQMGSETYHHLKDIILEKCGSDSCNIGDHGGFAPNISSISEGLDLVIAAIERAGYNGRIKLAIDVAATDFCVGKKYDLEFKSTKKSGQNFKTADDMIEIYS

SEQ ID NO: 57701 - protein, 226 aa, Sorghum bicolor
  unsure (1)..(226): unsure at all Xaa locations
  Clone ID: 30970898.pep
TPTLPLQISSSTPSPSSSSSSPAGRCVPNPSPRCKTLDPAAAEKRPRAEGASLLGLATYEDEDEDEAARGHANGRRAVEPDEEEDDDEEDDVRRAPERRPRQAELRRDCPYLDTVNRQVLDFDFEKFCSISLSNLNVYACLVCGKYFQGRGLKSHAYTHSLEAGHHVFINLQTEXAYCLPDGYEINDPSLEDIRHVLNPRFTKEQVLNLDKNKQWSRALDGSXYLP

SEQ ID NO: 57702 - protein, 82 aa, Sorghum bicolor
  Clone ID: 30970904.pep
PPPFLSSLTNRGISWPDRIPANPSRAKAGRSSERPPPETATARLAPPRASGIARAPSGCSRPVQSRGERLPPVSLSFLSFCV

SEQ ID NO: 57703 - protein, 178 aa, Sorghum bicolor
  Clone ID: 30970905.pep
WRAPHSSLASSLASPSLDTARTPPRPPWPTVQARTRHNARCSAPSQPKPSISVPPPRRAAHLARAQPRWKPAGAADHRSLPPSPTCARGQATTGPVPAIQGDQRLRDDLLVLPHPSIAADDASAGRKRKLRRALLFSSRPGTSGLNSTKSRGFPALSWTHMNSFTRLLRDSWKLQGPR

SEQ ID NO: 57704 - protein, 111 aa, Sorghum bicolor
  Clone ID: 30970910.pep
ARAPRRCPRPCCPVQRPMAPHGPCTWPHADSSPEPGECTGTTATIASAYYIGITELVQQARAAAARNSEGDGDNTGAMSSEVGGRGRRRRKAKSTVSEDGARGWSCRGRRS

SEQ ID NO: 57705 - protein, 223 aa, Sorghum bicolor
  Clone ID: 30970911.pep
LRSAYVGTYEDNHNLKRATESLSENRNSSNIHPVGSTIDQNNSSTMAREKVDLRSHLHPDDLLKTDGKSENNQKVVAPSASSAVQASKEANKAVLPIKLPDPPRSQKATASNASTEAQKPSSLRTDDPSPATLKDAKLYMSKNLIDFDSDLEPPQGVTQTDIQKGSLPPTDVGWATFDDVTHRNTTTMPSTSSTNSVEGPMLQIPDLTSAPQIRFSNGKSLSF

SEQ ID NO: 57706 - protein, 198 aa, Sorghum bicolor
  Clone ID: 30970917.pep
MRLSGRLVMDPSKKSACAAADLTDDIIVEILSRLPVKSICRFKCVSWHWYGLITHSEHRKKIPQTLSGFFYGFVHHRGRFNREENDIIIFSDFMDITVREELLFLDPSLPFLTGYRQIIPKTCCNGLLFCLCRKVFPRDEANYVVCNPATEKWFVLPESDYDSGACAYRFRFDPAISSHFHVFQILEEDQGYGFIAVA

SEQ ID NO: 57707 - protein, 167 aa, Sorghum bicolor
  Clone ID: 30970938.pep
MVVRASSVIRCLLTVAAVLSLLMAGAAAAGGGLSTSFYSKKCPNVQSIVRAGMASAVAAEKRMGASILRMFFHDCFVNGCDASILLDDTATFTGEKNAGPNANSVRGYEVIDAIKTQVEASCNATVSCADILALAARDAVNLLGGPTWTVYLGRRDARTASQSDANG

SEQ ID NO: 57708 - protein, 161 aa, Sorghum bicolor
  Clone ID: 30970939.pep
MMGSPDGRLVELFGAVKSWMPRRGDHSPPPPASQSQSQSAAAAAAAGQPHDLSRDFWMPDQSCRVCYDCDAQFTILNRRHHCRHCGRVFCARCTANSVPRSPGDAAREDGERIRVCNYCFKRWLEEEAAARGDAAGQQPTSPSLSAASVGSDKSSFTGMNG

SEQ ID NO: 57709 - protein, 163 aa, Sorghum bicolor
  Clone ID: 30970951.pep
QKVLLPLVIIISLHAKCTIETEINIENAHLPQDLLLLVALVLAVASCHHAHSLATFSSRDLSTFKTAWKPWQEKGIAENSLSGVHGNQYRGKRRALQRSFSLWTAWYHGKRRALQTCSISLCSHVLHSDLAVRNLSSAVSNCPVSCKDNKATIIASSSPDKFI

SEQ ID NO: 57710 - protein, 63 aa, Sorghum bicolor
  Clone ID: 30970965.pep
RRGKLLQWHDQEIGRQASTIFQFLNLWVAHAPVQLQGTIVDWIQKEKESQLAALQLHQKFQTM

SEQ ID NO: 57711 - protein, 194 aa, Sorghum bicolor
  Clone ID: 30970975.pep
NMAENFGSLLETDLGADVTFSVGDETFKAHKIVLATRSPVFKAELYGPMKEEGMKPITIKDMQPDVFRALLRFIYTDSLPPLDDLEADDHSEMIRHLLVAADRYAIERLKLICQSFLCENLNVQTVATTLALADQHNCDILKDACIDFITCSNEMDGLLSSQGYKNLKRTCPAVVIDVLRRQASFVRREQFILS

SEQ ID NO: 57712 - protein, 112 aa, Sorghum bicolor
  Clone ID: 30970984.pep
NRDGGKIKFQGMRLVAIRTVRCLTNVEAFVLRASDLEEVTSQFARFLRNPRVQGAIRYESPYWRTIAATRIQVAWRYRKRRLKRAEKSRLSEETYTSHGILTPDSFQRGQRG

SEQ ID NO: 57713 - protein, 115 aa, Sorghum bicolor
  Clone ID: 30970996.pep
GKVNVIGDVILLLGKLCVSLLCALFPFLMLDEHKYRSGHNKISSPLVPVLLSWVLGYIVAKLFFAVVEMSIDTMVLSFCQDSEEHQGSAQYAPPLLMETLDEESELRRLTQGQGP

SEQ ID NO: 57714 - protein, 112 aa, Sorghum bicolor
  Clone ID: 30970999.pep
HVQYGIADKYMVLWGSALGDAINQFKMMPFLILSGQLCPPGIEGTLFALFMSINNLGSTVGSFLGSALASALNLTTGQFDNLALGLGVQMICTLLPIGFLSLIPKEVTGLTS

SEQ ID NO: 57715 - protein, 180 aa, Sorghum bicolor
  Clone ID: 30971022.pep
MEKAIDRQRVLLRHLSPAAAAESPAPPAISASACAAGDSAAYHRTPAFADDVVIVAAYRTAICKAKRGGFKDTFAEDLLVPVFKALVDKTKLDPSEVGDIVVGTVLAPGSQRAIECRMAALYAGFPDTVPLKTVNRQCSSGLQAVADVATAIKAGLYDIGIAAGLESMTVNKVSLDGQVN

SEQ ID NO: 57716 - protein, 167 aa, Sorghum bicolor
  Clone ID: 30971024.pep
NSQKLQPNFTPLKIYASLQTLVVLVASEGHEEDMAPDGDSTPVVGRPLRRRGTPAVAPRDREREHAGGNGRRKARPHGETGEAARSPGDWRRDREKGGEERERERARRPWGAGEERQGRTDKRENEEEKFWKTYFDGREGEDRRQGGGRRRRKFGGEKARLKRRMRF

SEQ ID NO: 57717 - protein, 94 aa, Sorghum bicolor
  Clone ID: 30971039.pep
GEEGEAAACPWEQDWGSGGRAQGRGSAPGVRGRGRSQGRRSDLGLSRLLFPIEILGLCLCFHVENYFADKDEKISKWLSNRLWRTKCSKDLVSN

SEQ ID NO: 57718 - protein, 106 aa, Sorghum bicolor
  Clone ID: 30971040.pep
PKPSTNSIPLSSRRRRQRWLSFLSRGHIPPDPDPVSGAAVDMHPPRDRCMLPELACPGKQFVEQLQRERVVGLSLDHAHASCLANCFTHVRPCFGYTYTVFNQLAS

SEQ ID NO: 57719 - protein, 224 aa, Sorghum bicolor
  Clone ID: 30971048.pep
RGCCGNTRCVWGSKAAATRVLLLRTPRAAATRPQLVAAPDRGGGGGACGGCGGGTVSGSAMRGGGRGGGGRQPSYAAPDGSDAAAIPAASRKMVQSLKGILADRSEGEIYATLCDCGMDPDIAVERLISQDTFHEVRRKRDKKKETKVNQDTRPRPFQKSIYRGYKAGSDRSGRDSGGFKGPVKKEPELHAPLNSSALDVKTSDTTETFSATGNVAQADAKNTT

SEQ ID NO: 57720 - protein, 160 aa, Sorghum bicolor
  Clone ID: 30971056.pep
MAEVVSSALVHETVSQLLSNLVQKYEDKEESSANRNLERLEMAHIRLEAALETSEKWQITDASLLRWRRKLKRAAQECDDTLHKCKQRILEDEQTEKEVRMSSFPVRIAHTTKSFVFSIFGPNKDESNSSTVRRFEWFADGASEFLRLLELGGRPRHHMP

SEQ ID NO: 57721 - protein, 217 aa, Sorghum bicolor
  Clone ID: 30971062.pep
TRIPRNRLCDSSPGNKTLACRRRRLLPPRAIRFPHPDPDLPTTSPRARSAISTRRLPRSIPARPQVLLPPRPMSAGAPPSSLDPLSSRVVAPSAPVAMPSPPPAPPTPAADEKRPSLSLPLKMKRLFPYAVNCVFGRTWVMALVGLQFCICVGRVVSFTTDLEVARFWVTIFRFWLYLGLAAIVLMACVDIGNYVYGVYAVKLDPPQQQPAVAAVQL

SEQ ID NO: 57722 - protein, 219 aa, Sorghum bicolor
  Clone ID: 30971070.pep
GSEHHGEDQGPAPRRPARSRRPRRRGRGRGRRGGGGRGARAVHLHHPIDETKESKSPLDTEGHGTHTASTAAGSPVPGAGFFDYAKGQAVGMDPGARIAAYKICWASGCYDSDILAAMDEAVADGVDVISLSVGANGYAPRFYTDSIAIGAFHAVRKGIVVSCSAGNSGPGEYTAVNIAPWILTVGASTIDREFPADVVLGDGRVFGGVSLYAGDPLDS

SEQ ID NO: 57723 - protein, 120 aa, Sorghum bicolor
  unsure (1)..(120): unsure at all Xaa locations
  Clone ID: 30971074.pep
RTTPSGCFESRNAHHTIELIVHELMMSICTAFFFWTTREPVDDTAQLIISASYYSRPHASRTPKIKPCIYRLCTCISSPSTRRSFSSPVLLINLLRTLLSARRXIVKRNGAYAHSLDVDF

SEQ ID NO: 57724 - protein, 62 aa, Sorghum bicolor
  Clone ID: 30971084.pep
SSGIEVSSGKNWFVCMAISSGSVKWYVYVCWTTCNVMVSKQINVDLRLMLASHGMLISIFGS

SEQ ID NO: 57725 - protein, 176 aa, Sorghum bicolor
  Clone ID: 30971095.pep
GDCNDEHCQGCYGLEGDSLNGSNANGAKKNKSVLLNGLSEAKSLVLIDESHKFIFKRDLKCCPMFRMLKTLLLNEYWCVPPDFRELACLLEYSPVLEKLTLQILFKGPEHKFEIIGSYSQMEGSAAISKNLKIVEVKFEVADEGVLKVYNFLQTLNIDFNFDEEEESLVEDVSPTS

SEQ ID NO: 57726 - protein, 134 aa, Sorghum bicolor
  Clone ID: 30971097.pep
MVRDFLVEYKAAKEKTKEEERLAREQKAEERQKQRGKEYDSGGRDRDTRRERSGERDYDRDRQYERSRGRDRSYDYRQRGSEHRSNPYYRNGRDSERGGHRYRSGDMTSERGRMRSRSRSPTRHGYGRSRSPDH

SEQ ID NO: 57727 - protein, 92 aa, Sorghum bicolor
  Clone ID: 30971123.pep
DRLVDPRQAPRLAPEPRPALPWQGHRGICLPANGGIPSAAHGTRWVVVLAEASTAVPRRRDGRSPQVPQVVGSTSSLAILLGSDQIRFLVDY

SEQ ID NO: 57728 - protein, 81 aa, Sorghum bicolor
  Clone ID: 30971139.pep
NLFFSSLRIFFPKERKSLYNTDTAARGRVLLHHHHHHQSRALRRYLQVQHQTRATKTREKVKKKKTDEQTSTSPNRELIIR

SEQ ID NO: 57729 - protein, 178 aa, Sorghum bicolor
  Clone ID: 30971140.pep
TVRIDGTNSISGGNNITTTHFKLFSKYQNNSQVPSWQLGIYSAPSNWSQYVYKFRILINIAFNQATQYIQLKDQICSMNLSPSSSMVPAKSTSSCSWKKCQLVSLNAWANQSSSSRSPVSPIRSSHANRSAARTCGALAAGPERFSSAWSAYHRKLLPSTQTRRSCAGESQLAARSAS

SEQ ID NO: 57730 - protein, 188 aa, Sorghum bicolor
  Clone ID: 30971170.pep
MESRNVVVCDNGTGYVKCGFAGENFPTSVFPCVVGRPLLRYEESLQEQELTDIVVGAACADLRHQLDVSYPVTNGIVQNWDDMGHIWDNAFYSELKVDPSECKILLTDPPLNPVKNREKMIETMFEKYNFAGVFIQIQAVLSLYAQGLLTGLVIDSGDGVTHVVPVVDGYSYPHLTKRMNVAGRHITS

SEQ ID NO: 57731 - protein, 180 aa, Sorghum bicolor
  Clone ID: 30971194.pep
MLPLLLLAAFLHGTAAAQGQGQGLPSLPIGVNYGANADNLPTPAAVASFLAKSTTIDRVKLFDANPAFLDAFAANAPSISLAVSIPNAVLPTFADRSSGLDAARGWVRDNLSPHISAGANVTLLLAGNEVLGPTVVPDLVVALLPAMRRLAQALQLESLPDVRVTTPHYLGILAPSDGIP

SEQ ID NO: 57732 - protein, 158 aa, Sorghum bicolor
  Clone ID: 30971209.pep
MTAQTKKRGAAENGDGGVSLGLAAFIANNEDVGPIVRHAFESGKPEALLHSLHNIVKMKEVEIEEICRLHYEEFILAVDELRGVLVDADELKGTLSDENLRLQEVASALLLKLDELLEIYSVNSNVGEALATLKICLQVTNLCKICNRDIAEAKLLSA

SEQ ID NO: 57733 - protein, 214 aa, Sorghum bicolor
  Clone ID: 30971219.pep
GDAVFKMDGYISNANYVAKKITMILFINDRLVDCTSLKRAIEFVYSATLPQASKPFIYMSINLPSEHVDVNIHPTKKEVSLLNQERIIETIKNTIEEKLRNSNTTRIFQTQAVNSSALTQVYTQKDKGTDVKIASGMKSQKTPVSQMVRTDPRNPSGRLHTYWHGQSSNLEKKSDLVSVRNVVRSRRNPKDAGDLSSRHELLMEIDSHYHPGLL

SEQ ID NO: 57734 - protein, 147 aa, Sorghum bicolor
  Clone ID: 30971235.pep
MVRGLRLGGRAAAAARWCTCRRVAVALCVGNLVAALLVARALYAPGSFAFAPRRGELRYSREQMRWVEESIRIRRAAEPVELIEAVKKLRKAFAREEKRRRELPLELKQKVSLEILQRLHDLGENANTTEQREAVEAWRVGKLKYMR

SEQ ID NO: 57735 - protein, 201 aa, Sorghum bicolor
  Clone ID: 30971238.pep
MPLRLRVALQLRRFSSTDAALAPPKLRNLPYRLRHVAVPAARAVISEYLHSTRCLASSHADSIAAHSPRSLLSFLAALPTVPRSLPTSELPAHLRRHLNFHPLNELPFFLESIGGPTAAAPCFNSMFLSDHPSLLGAVAALAHFGFPWSRLGLLFPSVLLDVPPDLISARLSALEARLHRLPRAAIIAACLTFPSLLEGDL

SEQ ID NO: 57736 - protein, 111 aa, Sorghum bicolor
  Clone ID: 30971239.pep
QISLLWITTPIMRESPPTQGEPSTSSAVDDSYSADRVEDSQLFLSVPALNQAASYLAQTASFLTQCLPVPGYVGLSEEGQELATLPPASASGRLSVQTSSVEPAGTNSSLG

SEQ ID NO: 57737 - protein, 79 aa, Sorghum bicolor
  Clone ID: 30971259.pep
FDLENRTKPRYTMLWWLQEHGLLRKKLAPATVLANSEKRFISTLYLVHPAVPKLWLECFSSRRHMEYYLKNIYQYADNI

SEQ ID NO: 57738 - protein, 35 aa, Sorghum bicolor
  Clone ID: 30971261.pep
EGSPNSHSRVGNPNPVPNLPAHNQGRRTFVPFPTT

SEQ ID NO: 57739 - protein, 93 aa, Sorghum bicolor
  Clone ID: 30971278.pep
ILPNPSGSGVQFYKKNKDCMASGEHVDSTDEDDIDHELLAEAETAWSQREWTIQHVLFPSMRLFLKPPKSMATDGTFVQIASLEKLYKIFERC

SEQ ID NO: 57740 - protein, 144 aa, Sorghum bicolor
  Clone ID: 30971285.pep
GALSHISDSITTVLLSDRVKRFNANAVASIDIDLKVLEGFADDTYHMTGFSDLRKETSFRDCLVEIRQLINLLLSNHPESFVNPVTREQSYGALDHKKVAIICDKFKDAPDSLFGSLSSRATVQMQSARKKSLDVLKRRLKDFS

SEQ ID NO: 57741 - protein, 144 aa, Sorghum bicolor
  Clone ID: 30971296.pep
HGSNPNYLAVLVEFEDGDGDVVQVDIMEANSGWWTPMRESWGSIWRMDSKRRLQGPFSLRITNESGERLVAYQVIPANWAPNTYYRSNIQYEAFGSAAGQAIGFGSAVGLVISSAAGLHTVITGIIGLICLVLYHLHGIEVPQF

SEQ ID NO: 57742 - protein, 142 aa, Sorghum bicolor
  Clone ID: 30971298.pep
EGLDYRHGTGHGIGSYLNVHEGPHLISFRPSARNVPLQASMTVTDEPGYYEDGSFGIRLENVLICKEANAKFNFGEKGYLAFEHITWAPYQTKLIDTELLTPVEIDWVNTYHSDCRKILEPHLNEQEKQWLMKATEPIAASS

SEQ ID NO: 57743 - protein, 109 aa, Sorghum bicolor
  Clone ID: 30971313.pep
LELPIAADGNSTRIPVVMPLSGAMAACSQLLVARYGEKSDGFVTRKDAEVPGSVVVRPERKLDHAWMVYSSLKEEPRDQADTSQVWEALLTLLVEVAQKRRHEMAMKDE

SEQ ID NO: 57744 - protein, 112 aa, Sorghum bicolor
  Clone ID: 30971316.pep
ECNTELHTDYGGTAVRWGLTHHKESAADCCQACIDQAKRARPGALKCNIWVYCPSEYGCYSPDKYEHKHQECWLKQADHPRLNFKDRYSEPYRDSHPTAPVVVPWMSGVITA

SEQ ID NO: 57745 - protein, 193 aa, Sorghum bicolor
  unsure (1)..(193): unsure at all Xaa locations
  Clone ID: 30971324.pep
SISECYSVFHRCAEGRPLASARWSTAPGTFPTRRRGRAGIQFRTNPWPPPPPSPSRPVPATGPXPPTRPPTRRRPTPRLPARRPAAAPRDXPSPGPPPIPPSIPPASPASWRAPTPPSPASPPPAXPQPPAPGLVAPQPPRRPRPRPPLPPRRRQLRVLPRRAPPARARRPSPPRPPPXRPPPRTSSTPSSPP

SEQ ID NO: 57746 - protein, 145 aa, Sorghum bicolor
  Clone ID: 30971439.pep
NKYHSVESFSVFSNVYDSSGLFGIYLTTPSDFVAKAVDIAISELVAVATPGEVTEVELQRAKNSTISSVLMNLESRVVVAEDIGRQMFSYGCRKPIDYFLQCMEEITLDDVATFARKMLASQPTMVSWGNVDKVPPYEFICKRLQ

SEQ ID NO: 57747 - protein, 67 aa, Sorghum bicolor
  Clone ID: 30971441.pep
ITFITSAALPSQRPKGKVVEMEAITRVSQLFLDVKRSTQSLMESQTQYMFNEVPGEADGDGEDAMQS

SEQ ID NO: 57748 - protein, 131 aa, Sorghum bicolor
  Clone ID: 30971483.pep
MAMAAAAPAALSPGTVPLGVLLRREVTKERMERPDVLCGEANRSRKGEDFTLLRADAGLRIPGDPSTSFSVFALFDGHNGSGAAIYARENLLKNVLRAIPTCFCREEWLAVLPRALVAAFVKTDKDFQAVA

SEQ ID NO: 57749 - protein, 186 aa, Sorghum bicolor
  unsure (1)..(186): unsure at all Xaa locations
  Clone ID: 30971497.pep
MLLHHRLLPRLLVPSPXTSTLLRPSRLPLRLSLSPRFSALSHLAAPQTVDQSDDEGAPQGKVQVQLPLDRLFVPPGATVDAGDQDAVSARVLKGSNIVLGPYARGDAQVVNADFVKSSVRPDDCPRDGLPEFALVGRSNVGKSSLLNSLVRRKRLALTSKKPGKTQCINHFKVNDSWYLVDLPGYG

SEQ ID NO: 57750 - protein, 72 aa, Sorghum bicolor
  Clone ID: 30971536.pep
KWNAGMGNGLHRLQVEIAMRVFSCMGLLKVGGRMVYSTCSMNPVENEAVVAEILRRCGDSVELLDVSNELPE

SEQ ID NO: 57751 - protein, 210 aa, Sorghum bicolor
  Clone ID: 30971548.pep
MLPRLRSSARVCGQEPAAAARRLSAAEAFAECEGSLLRPLPGLDLPPCLPDNLSRSPTRVTTLPNGLRIASEDIPGPSACIGFFVNSGSVYESGETTGVSHMLERMAFKDTKHRSHLNIVHELELAGGNVGASASREQMVYSYDTLKGYMPEALEILIDCMRNPLFLQEEVERQLVLAREEVQELQKNPERFLHEQLNLVGFSGALANPL

SEQ ID NO: 57752 - protein, 116 aa, Sorghum bicolor
  Clone ID: 30971568.pep
KILCGIDRVEHALKVFRMMKGYGHAPGVKSYSLLIEKLARHNLGDRSSALYREAVARGVPVAQGEYSIDKRYVKAKKEKKVKKRLTLPEKMRLESKRLYKLRMSFVKKPKRRMVRV

SEQ ID NO: 57753 - protein, 66 aa, Sorghum bicolor
  Clone ID: 30971606.pep
ASGSLDHEVRLWDANTSDCIGSQDFHRPIASIAFHGRGEILAVASGHKLYIWNYNKRDDTSFPAIM

SEQ ID NO: 57754 - protein, 93 aa, Sorghum bicolor
  Clone ID: 30971616.pep
NDNTKSLVLMNYFPSVPVKFTACLQHSQNLIDMVNTCYGAAGNRWANFVAVDYYKRSDGGGAFQATDLLNGKLLCGCQDIRACSQGSGVVCSA

SEQ ID NO: 57755 - protein, 174 aa, Sorghum bicolor
  unsure (1)..(174): unsure at all Xaa locations
  Clone ID: 30971638.pep
EIKDAVQTLYSNGSKNFXIHGTGALGCLPQKLAIPRKNDSDLDQYGCLKTYNRAAVAFNTALGSLCDELSAQMKDATIVYTDLFPIKYDLIANHTKYGFDKPLMTCCGYGGPPYNYDFNKGCQSKDVTACDDGSKFVSWDGVHLTEAANAVVAKAILSSQYSKPNLKFDQFCRV

SEQ ID NO: 57756 - protein, 159 aa, Sorghum bicolor
  Clone ID: 30971665.pep
MSAGGSRATFSLPAAAVPLLSALALAAAAAAAVSAAAASGFSCRPGSRPVLFNFGDSNSDTGGMAAARGWHLTRPEGRAFFPRPTGRFCDGRLTIDFLCESLNISYLSPFLKTLGSNYSNGANFAIAGAATLPRDVPFALHIQVQEFLYFRDRSLELID

SEQ ID NO: 57757 - protein, 193 aa, Sorghum bicolor
  Clone ID: 30971676.pep
MEEAENGVRNCSPTRASSNGVGKLPPSPTRENGVRNRSPTRDPGNGRRKLSPSPTRSSAPEQRKPSASPPPPRVSKWLILDRIVHRSSRRHCGVVKDDATASAPAQDCAGRPVRASLRIADPPAVSRLYLHLTGRPAISFQEPTAIAAHRNSILFRLTAPFEDPMWWHDRYSFPIDYFVYSCRSSSPPSLTLL

SEQ ID NO: 57758 - protein, 171 aa, Sorghum bicolor
  Clone ID: 30971680.pep
MWRRQLFRRLFPSPATGGTAAPPSPFLRHLSTSSTPTPAASLASSLASALTALSTTPPPATTPDAYFSLHFSDVRPTNALLAEALALSPPATSRAAAELFRFLVRRRSLHPSDGALAPVVRHLARRRDFPAVRALIQEFPTALGPATLDAYLQQLARAGRPTDAVKVFDEL

SEQ ID NO: 57759 - protein, 210 aa, Sorghum bicolor
  Clone ID: 30971683.pep
MEEGDMAQHSDGLVDNEGEHVEDANTEAGEMDTHQLDKTDSLMPPSQGLQPDNMQVDSNGESETNLANSSDMHGAVAPSVNFSGNEVPNMEISMPNAGDDSRLLSNSMPDMQNDAQQHIKQTNPFRSIGDALEDWKERAKVSADTQDHQAETGNDSNENTAEFRYVPEGEQSTSQALGAATADQINDDNQINQSFLEDESRARKLEQSDE

SEQ ID NO: 57760 - protein, 90 aa, Sorghum bicolor
  Clone ID: 30971692.pep
GAAYPPRGGGGRRARISRRNQGSARDLPRDAARFHPLSWRARARCHCSCFGRRGREGGGGRRGGRGQGRGVSPRLAVWFWWPRGGGPRQS

SEQ ID NO: 57761 - protein, 123 aa, Sorghum bicolor
  Clone ID: 30971723.pep
MEPRVPCGDGGPELRGTRRHRREGERIHVLDPRILEPLRQRSNPFRNIFHLLTQREVSPRTKHHAKRIWNKSPKYDPDLIELRFADADAKLDIFSWAESQSLHRWTAKYCPLLPPPRSTIAAA

SEQ ID NO: 57762 - protein, 201 aa, Sorghum bicolor
  Clone ID: 30971733.pep
DLPQISQEVVGVGRTSKGTWAAPVPLQRRLFGLCSRRRSCSSSSCSDLLRPAAANVGDTCSTTADCGAGQWCFDCEPKFSGSHCVRSAATNPFQLINNSLPFNKYAYLTTHNSYAIVGEPSHTGIPRVTFDNQEDTVTDQLNNGVRALMLDTYDFKNDVWLCHSSGGKCNDFTAFEPALDTFKEIEAFLSANPSEIVTIIL

SEQ ID NO: 57763 - protein, 98 aa, Sorghum bicolor
  Clone ID: 30971758.pep
GQPQGALENLDQVTPTVFDNKYYGNLLHGQAQLSSDQVMLSDPAAPTTTAPVVHRFASNQKDFFANFVASMIKMGNINTLTGKDGEIRKNCRRVNTHQ

SEQ ID NO: 57764 - protein, 75 aa, Sorghum bicolor
  Clone ID: 30971777.pep
LASGVERNHFDGWLISGCLKQFLTDSSMCSRIHRYVSSTFTSAISIASIICYLAVLKYTGSQNLVYSCCDPMSAE

SEQ ID NO: 57765 - protein, 57 aa, Sorghum bicolor
  Clone ID: 30971782.pep
WQCPVPSLAVLDAECFRSLVLHPPGTLRVHKTCFTVRGYWYETIELLLWLSQSSFWL

SEQ ID NO: 57766 - protein, 175 aa, Sorghum bicolor
  Clone ID: 30971796.pep
VLTWTCFVRGRGLAANDEDVFLFFFADARDRLDPPAGADYFGACLTGCLVRLPARELHGEGALATAASAVQGAIEKMVEDPLGCRPGWEFFRFAGEPGLRLERFMNVSGSPGFRAYEVADFGWGRPRRTENIRMNHDGQLALMRARDGDGVQASVSMLQQKHVDAFKSEFLKLLG

SEQ ID NO: 57767 - protein, 63 aa, Sorghum bicolor
  Clone ID: 30971805.pep
NLKPNINLFNFSHLEINNPNSNSDYTHIIETKISKTFVPKPKHIRCLHTTAGDHITCLLHIKL

SEQ ID NO: 57768 - protein, 158 aa, Sorghum bicolor
  Clone ID: 30971810.pep
RSDGRGRGRLGRRPAERARGRRSAAGRAARLLPFYASARRRRWQARPVRGRRRRRQGSRSCVGAGNAGGVRLSQPFRGRRRERRVPDDAAGPARGRDPPLPGVPGGRGRAVRLRPDATRPQGLMAPAPALCVRACMNRVRAGHEMEDLVLLGFTIPCS

SEQ ID NO: 57769 - protein, 80 aa, Sorghum bicolor
  Clone ID: 30971823.pep
EQRRFVQTYLCSAGEKPSDGEVEKLLGLIAKYTPASHLFWGLWGIISAHVNNNIDFEYKEYARQRLDQYWQTKPGMLGPN

SEQ ID NO: 57770 - protein, 176 aa, Sorghum bicolor
  Clone ID: 30971828.pep
MEDVANAHLYAHAHAHRSKRPPSSAAMKDGDGDVDLSMKGARYRGVRRRPWGRFAAEIRDPMSKERRWLGTFDTAEQAACAYDIAARAMRGNKARTNFPGHATAGYWPWGTPQPAAVAVAHPININPLLLHNLIMSSSHHGCRLLNQAGHGHGHGHGHGHSVPTRPPAPAPATDDT

SEQ ID NO: 57771 - protein, 127 aa, Sorghum bicolor
  Clone ID: 30971830.pep
MLNLSPPMFKPRPRRRRQIQTRNGRTGSQTKRKGSTSQQDENPLESQINGYSGPNLPEDIWCYIHSLMSMRDAAKVACVSRAFVHSWRRHPDLHFSKETLGLDENACQKDGIADFDSRVDSILKKHS

SEQ ID NO: 57772 - protein, 222 aa, Sorghum bicolor
  Clone ID: 30971833.pep
REESLVHRIDNGVSEITPRSMPEDRNGDTNSSSNEYDVYGFEDAPVSTSSKDDEQDLSPVTQSAVEHVPKRGRERAYNKHPNQIVPGKAKEPPKRKKARRSSTVTEPDARRVVDAPENSRNLIPDMNRLDQVEIQGRSNQIVIFDHGDTTTEALQHRGDAQVQVHLPGAEVNNFNSAPTANPTPISICMGDQPLPYQNNDSARSRSENSFPVDAHPGLNNLP

SEQ ID NO: 57773 - protein, 67 aa, Sorghum bicolor
  Clone ID: 30971842.pep
FCVRRLEPRNLTFLGSLSICLSSHRRLEVLLPPPNRDVPYLLLWSAVGALFTRKFGGFRLVFCRSVN

SEQ ID NO: 57774 - protein, 170 aa, Sorghum bicolor
  Clone ID: 30971844.pep
MAAVDPPPRGEAAPAPAPVLKRSTSIDRIPEDARRILHRLAGDLWGSDVDPSAPTVSQLKGAMTNEVFRITWPGGEGDPRKVLVRIYGRGVEVFFDRADEVRTFECMSRHGQGPRLLGRFANGRVEEFIYARTLSAADLRDPEISALIAKKLREFHDLDMPGPRDVSLWQ

SEQ ID NO: 57775 - protein, 163 aa, Sorghum bicolor
  Clone ID: 30971850.pep
MAICHASWVLTVVVVVVVVAGAAPHHLLVRGASDDDGGPSSPSALAGCDLFRGRWVADKSYPLYDASTCPFVPDVFDCRRNGRPDDAYLKFRWSPANCRLPRFDGADFLRRWRGKTVMFVGDSLSMNQWVSLACMLHAAAAAPVRATFTSGEPVSSVRFEDYD

SEQ ID NO: 57776 - protein, 141 aa, Sorghum bicolor
  Clone ID: 30971882.pep
MAAATEELQLLGSIPAPEGAGEVDGAVAEKGRPRGGDDEEILRFMDSVDGYLLLMDSLSSALRQGWLDLASARHSMGPSRVSSTLFDHKEQSAATKLQVVDHDGLKPSEPKPHFALSKWSLQEECPSTYDVSERAFTEPKM

SEQ ID NO: 57777 - protein, 118 aa, Sorghum bicolor
  Clone ID: 30971929.pep
PRPGHVRSASVVGRRLDSESVAVVTESEDPLGDFRRSMAQMIVENGITGGAELRELLRRFLALNAACHHHLILRAFADVWDELFSGGGGGGSHVAAQSHGSGGGRASKRPRGRADTLS

SEQ ID NO: 57778 - protein, 148 aa, Sorghum bicolor
  Clone ID: 30971934.pep
GGQLKKLFIANVPVNWDVLWILLLLGAAPALESFHVHIDNNSEQRSSGDLCDSLDANAHQHQNCRLKDLVVAGFEGLGWQTSFVRLIMKRAPLLRHVHLLDGEVRDDEQELGALQIVPRRRVWHECERAEVLDDLTAGFRFPPRIILE

SEQ ID NO: 57779 - protein, 80 aa, Sorghum bicolor
  Clone ID: 30971941.pep
PYHHTLWKGDSQLLSYAPPSVPGQQQCRQQLIYTPSISKLKGIVPFSICIHFTIYLDIWCVYISKCIAKKYVYKYSQNSL

SEQ ID NO: 57780 - protein, 150 aa, Sorghum bicolor
  Clone ID: 30971947.pep
ELYRMGARKFAIINVGLAGCLPVARVLSAAGACSDSRNKLAAGFNDALRSLLAGARLPGLVYSLADSYGIMAAIFADPPASGFADVSGACCGSGRLGVGGCLPTSSVCANRDQHYFWDGIHPSQRAALIRAQAFYDGPTQYTLSSQVPAT

SEQ ID NO: 57781 - protein, 73 aa, Sorghum bicolor
  Clone ID: 30971955.pep
WFMPSWHRVEVMLRISFCLTSSSIVQIPRFRAIVLHATKHGYWLMMDCRVNSLNAIRIYMASPTAIEVLFYAR

SEQ ID NO: 57782 - protein, 142 aa, Sorghum bicolor
  Clone ID: 30971960.pep
PHHITTLLLFISKSSLLLKMASQRCSSDDCVQSHSLVQKQNDLKMREPHFPLVAPSLMQCLLHVLLLHRSSIRYVSLDHSSHGSLFPQLGSKRSVMTSRLRHNVDVTFRAAISRRKFLGISLICENSSYSLKTLLCICLRGK

SEQ ID NO: 57783 - protein, 50 aa, Sorghum bicolor
  Clone ID: 30971984.pep
FEKVAKLKISFDQFEKSRRSVDIFERPKRTIEQLDCGRKSVDRLDRIWAS

SEQ ID NO: 57784 - protein, 123 aa, Sorghum bicolor
  Clone ID: 30971994.pep
KKWCVLKPAADLADQKVGDSVSYACGLADCTSLGYKTSCAGLDAKGNVSYAYNIYYQTMDQDDRACGFNGLATTTSVDPSAGTCRFIVEIDVGAAAAPSSAMAGVAVGWAAAVLAAFVLSVVL

SEQ ID NO: 57785 - protein, 122 aa, Sorghum bicolor
  unsure (1)..(122): unsure at all Xaa locations
  Clone ID: 30972011.pep
MGGVTSSVAXKMXFFPPTPPSYALVEDAGAGVTTLSGQPHRENVELLRLRTRKGNTLAXMYVRHPDAASTGLYSHGNAADLGHLYQLFLHLSFNLRVNILGYDYSGYGQSSGKPSEHNTYAD

SEQ ID NO: 57786 - protein, 106 aa, Sorghum bicolor
  Clone ID: 30972022.pep
MARGGRSVSQPVAAELLLVLAVALCAAARRTSAIGVNWGTQLSHQLPASTVVRLLQDNGFDKVKLFDAEDTILGALKGSGIQVMVGIPNDLLADLAAGGKAADNWV

SEQ ID NO: 57787 - protein, 132 aa, Sorghum bicolor
  Clone ID: 30972041.pep
MKATTWRGAPGTLPATAKKKRKKKAPAPRGFMCGCGSTRSVSVDISAVTTTPMKRGASTAVAPAGEPASAAKTTAGRGRDADADASAEGTPSVDSLLRQLRELERGVRALGVREREADGGVGGSGSSTAGTT

SEQ ID NO: 57788 - protein, 144 aa, Sorghum bicolor
  Clone ID: 30972047.pep
RDLPRRLPTSYNIAVDDILPPRYHRLKRLNMEAMAAYEAEKNMHKLTDIYAIKARHERWMAKIRPSTAILERYERRAMRRYVKQVNAFLLAPKNVRQRRPVHKLRLQMLGRWHENIDEWVTAAIAKWGVEDFELVIDGDCGGYN

SEQ ID NO: 57789 - protein, 219 aa, Sorghum bicolor
  Clone ID: 30972055.pep
GSYVVSQLPQERPPADLPMGIAQGEHQQLPNRLPSGWSNNLDDPNPGSGNSSLEQGAISRALNNRTHDPYTFASGVVPTGTASGYAPGEASNSMSWPSMQPNSQQVARSDQPTIPVSLPPDQLAQLAALLAQQNQPRKVGLPVDSSNNQSGFIQNSNPHGHATMMPGNSGSIPVQNSLPPVPPSMQQLHAHVPVPPIGSLPANPLNALPTSAPILGNTT

SEQ ID NO: 57790 - protein, 176 aa, Sorghum bicolor
  unsure (1)..(176): unsure at all Xaa locations
  Clone ID: 30972058.pep
MEVAAARGTGSGGGGGGGGGGGGPAPFLLKTYEMVDDPSSDAVVSWSDASDGSFVVWNPPEFAARMLPTYFKHNNFSSFIRQLNTYGFRKIDPERWEFANEYFVKGQKHLLKNIHRRKPIHSHSHQPGALPDNERALFEDEIDRLSREKXAALQADLWKFNQQQSGAVSQIEDLER

SEQ ID NO: 57791 - protein, 194 aa, Sorghum bicolor
  Clone ID: 30972077.pep
WFIISRCGDLRGEGLLSLLAQGHLTTLSVFQTPNLFVDSDPSQVHEQEILSCSSKLQELRINDVAGFTTAAIHRSLIFSSLTKLDIFRYDKVKSITEEQEALLFVDSLEDVTFFDCSNLQFLTERLRTLHNLKRLYIDMCDCEAIHMLPKDGIPSSLEELYIRTCPELQSLPKDCLPDSLPKLVIRYCPAILSL

SEQ ID NO: 57792 - protein, 66 aa, Sorghum bicolor
  Clone ID: 30972116.pep
LTDVLNGSVGILPTAWDHTQKKVSCFQQTETLLHFIMVLPRNSIKVILEQPLIHDHTRNLFTEENL

SEQ ID NO: 57793 - protein, 50 aa, Sorghum bicolor
  Clone ID: 30972122.pep
PVPEEHYGKGVPGVLKFPFSHRTSRRLECLAHFAIFPTNHFLCNYRGLSS

SEQ ID NO: 57794 - protein, 66 aa, Sorghum bicolor
  Clone ID: 30972136.pep
MRQPAMPWRSPLWLLLLATMLSTTRLLALAGGMARPGCQERCGNLSIPYPFGIGPGCFRSGFEVRC

SEQ ID NO: 57795 - protein, 200 aa, Sorghum bicolor
  Clone ID: 30972176.pep
HSIFELSRHSVMSPLLINRHGSSSFLSLNYGRQHPMVCHISWYMPEEANKQTEQKGATVHEQSAVQRTVGTIRLWPAVTTIASGGLRPETHAVGHPCRSCCAGTAAVGASIWGSRAEPQPPARNRRNPRSSSLSCGGVRHRRVWLSAQDDVLWAGEGVEEPGGGDLTGERWRRSHPRPAPPPWGRNRGEVEKVKRIRRSR

SEQ ID NO: 57796 - protein, 118 aa, Sorghum bicolor
  Clone ID: 30972193.pep
MALQGKKLINNPDDVVTEFIEGLVQTYPGLQYLDGFPHIKVVLRADVQRGSYDKVAVISGGGSGHEPAHAGFVGPGMLTAAVSGDVFASPPVDSILAAIRAVTGPMGCLLIVKNYTGD

SEQ ID NO: 57797 - protein, 167 aa, Sorghum bicolor
  Clone ID: 30972207.pep
MSKLQSDALREAIASITNDSREKQRKFVETIELQIGLKNYDPQKDKRFSGSVKLPHIPRPKMKVCMLGDAQHVEEAERIGLDSMDVEALKKMNKNKKLVKKLAKKYHAFLASEAIIKQIPRLLGPGLNKAGKFPTLVTHQESLESKVNETKATVKFQLKKVLCMGVA

SEQ ID NO: 57798 - protein, 121 aa, Sorghum bicolor
  Clone ID: 30972222.pep
TRRSTSVLEFNPCSYAFVIETQQFRFDVSDLADHHFADKYSDGVPLVLNWVVGEESCDEAKKNMSSYACLSKNSECIPSVNSPGYLCNCSSGYGGNPYLEEGRQGKQQSAFNSVGSNNMPG

SEQ ID NO: 57799 - protein, 199 aa, Sorghum bicolor
  Clone ID: 30972230.pep
GARPADSTSLSTIAPKRKRPRLVKYDEDSRPASPAKPELAEPSSKPEPPPVARSEAKTATSVAAESGTSTAPAAAAQHETSREPEKTEDRGRNRDSDLRPSESDRRDHRLESQAEPPAPAPSVKPDAEAKPVGSEARNGETTATTKIELASDGARQDKKFSIDLMAPPPGKLSDDIDGSSDPDADKKGLDSEMDMLGRG

SEQ ID NO: 57800 - protein, 51 aa, Sorghum bicolor
  Clone ID: 30972233.pep
FHFQYFIQVMGSWLPWQFSLLVHKWYLETEGCIYLYYRILNPSYLTGEQVP

SEQ ID NO: 57801 - protein, 143 aa, Sorghum bicolor
  Clone ID: 30972238.pep
GWTMANAVPIKTARETVNILQNHYPERLAIAFLFNPPKVFEAFWKVVKYFVDLRTIEKVKFVYPKDEESMKVIHKFIDPEVLPIEFGGKSSVVYNHEEYSELMTKDDTKISSFWATDAQTDHVNHVIDGTLAPEVTPVVTANC

SEQ ID NO: 57802 - protein, 67 aa, Sorghum bicolor
  Clone ID: 30972242.pep
AQGYMIFLTSFLGVSNGFLTVCFLTGAPKGYNGPEQNALGNVFVVFLKIGMFFGVVLDWLWLIGKGW

SEQ ID NO: 57803 - protein, 88 aa, Sorghum bicolor
  Clone ID: 30972284.pep
IFPTCLSITFSKYMLCISNMHETYTVQQGISQDFLSNLALVNHRGKDYFFYLQFPKTYRWWRWQGQLPREWSSTRWKCHCQVLAPLYR

SEQ ID NO: 57804 - protein, 76 aa, Sorghum bicolor
  Clone ID: 30972308.pep
SPSLSLQWRTRTRLAPCSPNQIWGRTSVNQALFTDGSPDPVVHRQPCPPCRQRRLDGFVGGVPDADENLEAFITRI

SEQ ID NO: 57805 - protein, 54 aa, Sorghum bicolor
  Clone ID: 30972320.pep
SKLRSTSLSLDGLLDYTANDIEESVFELSLFAESFGEMLQHKMGCVILSFLEKL

SEQ ID NO: 57806 - protein, 90 aa, Sorghum bicolor
  Clone ID: 30972334.pep
SRPAPPPPPLSMRRSPRRRSERGESLGPPPPPPPPLLLRRLLGGGGPPPTDTPPLLPSRILSISDLRHAAPIPGKSPPPRRIPTRSAAAP

SEQ ID NO: 57807 - protein, 117 aa, Sorghum bicolor
  Clone ID: 30972342.pep
MFRRKHASHFDSNDADQRKAKIAELKSALEPLSARSEKYCSEACLTRYLEARNWNVAKSRKMLEDSLKWRAAYRPEDIRWPEVSVEGETGKMYRASFRDREGRTIVVMRPAKQNTSS

SEQ ID NO: 57808 - protein, 210 aa, Sorghum bicolor
  Clone ID: 30972379.pep
MPMPYAPGLLSTTQLIHSKAHGLLPVGEFRSRLLPPAATPPSPKVLPSKREKAVASASTPGSDVAVTPPGSGEARRVAPSLACREAFVASEASVFMNQPPPHMSRPSIIIKLILGLLWTITHLAISFLNLWSHLIYSLECYVISSGLLRKYQNLHLGRLKCLAIVVDSKEAKSTAKVKQLLCWLSSMGVKYVCLYDIEGVLKKSFEPAVN

SEQ ID NO: 57809 - protein, 76 aa, Sorghum bicolor
  Clone ID: 30972396.pep
AAGDVAAGNKRKRSSAEASTASASALSSQQQASAGKKPNGSCFGATTTFQIGNGLQLQGSSLGHQMLLHSSNMGMN

SEQ ID NO: 57810 - protein, 36 aa, Sorghum bicolor
  Clone ID: 30972404.pep
PATCIIIIGIKKKGNHSGLSIQALDAGAERPNSRPS

SEQ ID NO: 57811 - protein, 94 aa, Sorghum bicolor
  Clone ID: 30972411.pep
MLTCTIVTIVTVALFMKLLQRPTRQAPSRNMAASTPVRAPAANPAAMADPASPANGQLSPRTPQPFMEYVRRTIDDTPYYKRDARRRFNPQNTY

SEQ ID NO: 57812 - protein, 174 aa, Sorghum bicolor
  unsure (1)..(174): unsure at all Xaa locations
  Clone ID: 30972455.pep
MAAPRPRIRAVRRGLLLLFLLVPLIYSVSRLHPWVPEKGVCLPPPTAPKRPDRLVLGPAAGQGRPDRLQCQGLRALNKIGLPSEEIYSGEHISFVTVFTTYNSVSAGDGNVPSDSVTVGNHSYSKIERSMAILNTFISFIKNXQVSMPRSNVIILTDPGSKISVNQGSATLLPI

SEQ ID NO: 57813 - protein, 215 aa, Sorghum bicolor
  Clone ID: 30972490.pep
GSDSFEHSTGSSVSPINVPFECKVDPSFVGFVEPWIDHATKKSYCLFHPYSPAQLLPVKLNPNEGFLHILVRANLKEDPKVTGSARALFVKGFYIKESGKLNLTPSCNHSVITIDGNTDIELFWNAKDLLRVSRIDTSENNGVLSRIVYRVEALKRQSFSDKVTIVLPATGQTEEVEVSYDTGEKAEPPSSWGLTTSAVMLTCTIVTIVTVALFM

SEQ ID NO: 57814 - protein, 32 aa, Sorghum bicolor
  Clone ID: 30972524.pep
SYINQCLIASLSAARGEIGPSISPLVSSVIYL

SEQ ID NO: 57815 - protein, 54 aa, Sorghum bicolor
  Clone ID: 30972525.pep
MGSETFLEILLAILLPPVGVFLRYGIGVEFWICLLLTILGYIPGIIYAVYVLVA

SEQ ID NO: 57816 - protein, 104 aa, Sorghum bicolor
  Clone ID: 30972532.pep
VLLPIKQPGYLALRRLNPNALARSKGANLIGDRRRRRRLARAQRHGAAHCVLAVRDGALDSALELLHGRCRGQRHGRTDANGARNGRSRRCRDVGEADAAGPAE

SEQ ID NO: 57817 - protein, 81 aa, Sorghum bicolor
  Clone ID: 30972533.pep
SDETRSLTYIVPAYIGMLRRDSSQIINENEEMTSTRRIDFDFDHGKAGGSTGIRFIGQGRISSQPAWQPRRRQQEPHRRPR

SEQ ID NO: 57818 - protein, 49 aa, Sorghum bicolor
  Clone ID: 30972540.pep
PSSEATGAHHEVFPMTPSNWTWEQLEGVFGSLSPLSPHQQLGFPEVTVN

SEQ ID NO: 57819 - protein, 171 aa, Sorghum bicolor
  Clone ID: 30972575.pep
ERWMQYSVGEYEAYLLGLAEAAIRRVHELGGRKMDFTGLTPMGCLPAERIIGDPGECNEQYNAVARTFNAKLQELVVKLNQELPGLQLVFADTYQLLANVVNKPADYGFDNAVQGCCGTGLFEAGYFCSFSTSTLCENANKYVFFDAIHPTEKMYKLLADTVINTTLHVFM

SEQ ID NO: 57820 - protein, 138 aa, Sorghum bicolor
  Clone ID: 30972599.pep
GIAIGVAETKADAWKALWTISLHKIFAAIAMGIALLRMLPNRPLLSCFAYAFAFAISSPIGVGIGIVIDATTQGRVADWIFAVSMGLATGVFVYVSISHLLSKGYKPRRPVAVDTPVGRWLAVVLGVAVIAVVMIWDT

SEQ ID NO: 57821 - protein, 167 aa, Sorghum bicolor
  Clone ID: 30972623.pep
MACRVKVVGQVERVDGASLSYAEFVRRFMASNRPVVLTGLTSSWRACKDWTLSGPGDRRRPNLGFFTENFPSPLVQVADCSSRDFTDQKRLEMSMQEFIDHWVRGAHRGSSDGSLLYLKDWHFVKEYPDYIAYTTPTFFVDDWLNMYLDSHPIHRDSDIANHKNEIN

SEQ ID NO: 57822 - protein, 184 aa, Sorghum bicolor
  Clone ID: 30972657.pep
MRSYFFLPCLMILLFLLLVVVGGAVVAGEKKKKTKVPAIIVFGDSSVDTGNNNFIPTIARSNFWPYGRDYDDGLPTGRFSNGRLATDFISEAFGLPPSIPAYLDKTCTIDQLSTGVSFASAATGLDNATAGVLSVITLDEQLAYFKEYTDRLKIAKGEAAAKEIIGEALYIWSIGTNDFIENYY

SEQ ID NO: 57823 - protein, 59 aa, Sorghum bicolor
  Clone ID: 30972676.pep
HPYSRNACFHRETREKMIRKSSLHVKWTNKRSKNQATENESRIYRTQIVKHSSTDIPRQ

SEQ ID NO: 57824 - protein, 113 aa, Sorghum bicolor
  Clone ID: 30972686.pep
WPGFADQYINCRYACEEWGIGLRLDETLRREQVTAHVKELMGGGGGGDTDDRAREMRRRAAEWKAKAEAAATAPGGSSYESLDRLVEDLRLAVGEADAEAELATATPTTQGRR

SEQ ID NO: 57825 - protein, 87 aa, Sorghum bicolor
  Clone ID: 30972695.pep
EGGSAPLFIAWWSAHAPLDQTYLTSGRDGSSKAVEEASGREANPNCRGSAGAPHLAAVRSPVVPGVFWSLPESSGVALPLWITFVAN

SEQ ID NO: 57826 - protein, 121 aa, Sorghum bicolor
  Clone ID: 30972700.pep
SLVDGFNAPVSMAPVGGGAGCGVAGCQADLNVCCPSALEVRDREGRVAGCRSACRAMGGDRYCCTGDYASPDKCRPTIFAHVFKAVCPKAYSYAYDDATSLNRCKASRYLITFCPPPTSRK

SEQ ID NO: 57827 - protein, 173 aa, Sorghum bicolor
  Clone ID: 30972740.pep
MNYIIGAFKPPCDIFVTFSDERTRKQVQIKKDNDKAVMVLAFQSLETIAGEVSIAPVPGKRLEHTGVKIKLLGQIELYFDRGNFYDFTSLVRELDVPGEIYERKTYAFEFATVEMPYESYNGTNVRLRYILKVTIGRNYVGSIVESRDFCVRNYSPVPTINNSIKMEVGIEDC

SEQ ID NO: 57828 - protein, 200 aa, Sorghum bicolor
  Clone ID: 30972769.pep
MERRAHAMLFPFPCSGHINPTLKLAELLHSRGVYVTFVNTEHNHERLRRRAAGGGLRGREGFRFEAVPDGLSEEDRVAPDRTVRLYLSLRRSCGPPLVDLARRRRLGDGVPPVTCVVLSGLVSFALDAAEELGVPAFVLWGTSACGFVGTLRLRELRQRGYTPLKDESDLTNGYLDTPIDWIAGMPAVRLGDISSFVRTL

SEQ ID NO: 57829 - protein, 155 aa, Sorghum bicolor
  Clone ID: 30972776.pep
MDMSSSTTAAASAPHNHQQEAMVSSPNIKEEARSPKQAEATQQPSGSGERKPRPQLAEALRCPRCNSNNTKFCYYNNYNTMQPRYFCKGCRRYWTHGGTLRNVPVGGGCRENKRASRSVSGSGSSSSSAAYAPLSPDTNTSSSKMSINTQPMMVP

SEQ ID NO: 57830 - protein, 97 aa, Sorghum bicolor
  Clone ID: 30972788.pep
LPHRRAAGAASARRRRPPPRSAPLCLSLSPPLLLLLFRVGSGRGFPSARLAPPPFPRSAKWTRTAAERSGAGDGVRAPRASRVPCACAPWLRALAVA

SEQ ID NO: 57831 - protein, 114 aa, Sorghum bicolor
  Clone ID: 30972794.pep
SPFWRPFVFSLKFELGATLRHYKDSNNDSLPPFSEVLQPLSTLSKCCTNLHQPDLNQELADDTGHEILYLQEDQFHLINEEVHPLIGQSHYLQKEQDGALHAIYLNIVASFSHQ

SEQ ID NO: 57832 - protein, 160 aa, Sorghum bicolor
  Clone ID: 30972798.pep
MACLASNNKPQLHLINIFVTVALLLVTSTHGAGSTGNNGSGNIQLILVNNCAESIWPGLLGTAGHPTPQSGGFHLAPGDEAAFDVPLGWSGRVWPRRGCSFDGRERGLCATGDCGGVLRCDGRPGSTPATVVEMTLGTPKSPLHFYDVSLVDGFNAPVSM

SEQ ID NO: 57833 - protein, 185 aa, Sorghum bicolor
  Clone ID: 30972806.pep
PAAAAAAVSELELLVPRGPGAGTAMDQFHHDRAGALEIEKTTTPAAERAAAPDMESEPAAARVAELVPPWREQITARGMVAALLIGFVYTVIVMKLSLTTGLTPTMNVSAALLAFLALRGWTRALERLGIASRPFTRQENTVVQTTVVACYTIGFGGGFGSFLLGLNKKTYELSGVNTPGNVAGS

SEQ ID NO: 57834 - protein, 192 aa, Sorghum bicolor
  Clone ID: 30972849.pep
ASTERAAENAAVVRTEQHKANSELTPGVNASRSSHDAVEAAGESKTGNETLLSAEGGETGRLGPSLNGTSEGIKGRLNNDGSVPHTSKVEREEGELSPNGDFEEDHFVPFEDGTSKGKEGSTSRSFQGRPGEVVPSSAEAAGENDADADDEGEESAQRSTEDSENASEAGEDASGSESGDGEECSREDHDEE

SEQ ID NO: 57835 - protein, 128 aa, Sorghum bicolor
  Clone ID: 30972863.pep
MAAAAAGATSLHLRHNRNPHLLLLRAAISSSRALPQQPELSPDPTAGAPDPAPLPPNPSTGSPFYSQNWRNPAAANPPSSLLPTVLAGGAFGEEHRMDAFYDTANAAGLKETFAKDMEEQRWEDIKHL

SEQ ID NO: 57836 - protein, 96 aa, Sorghum bicolor
  Clone ID: 30972866.pep
MGSTEEQQQPVPVVAAAVEEEEATPEIIFRTKLPDIAITNFLPLHRYCFERLPEVADRPCLIDGATGAVRTYAEVDRLTRRLAAALRSAPLGLGRG

SEQ ID NO: 57837 - protein, 53 aa, Sorghum bicolor
  Clone ID: 30972873.pep
QAYPFDYRCAQESTDHREMGQRGKFGRTLSQIGVSRFDPKEGWQQKLNDQRSL

SEQ ID NO: 57838 - protein, 171 aa, Sorghum bicolor
  Clone ID: 30972889.pep
AGESAGGNIVHHVANRWAAAWQPSARTLRVAGVFPVQPYFGGVERTPSELALEGVAPVVNLRRSDFSWTAFLPVGATRDHPAAHVTDDNADLAEQFPPAMVIIGDFDPLMDWQRRYADVLRRKGKEVVVAEYPGMFHGFYGFPELPEATKVLQDMKAFVDSHRATPKLADA

SEQ ID NO: 57839 - protein, 63 aa, Sorghum bicolor
  Clone ID: 30972896.pep
VSGMFASSSHNAANVAVVYSHKSFRCACFSQSCCRYWAGNYWFLRSFSGLTSFHLIIIGGLGS

SEQ ID NO: 57840 - protein, 157 aa, Sorghum bicolor
  Clone ID: 30972901.pep
VVLLEVLCARPVIDPTLPREMVNLAEWATQRLKNGELDSIVDQRIAGSIRPESLKKFVDTAEKCLAEYGVERPAMGDVLWCLEFALQLQEASLDSSGTKASPDSSGTDNTQLVLRNASRLHRNQSNASDGAEANLGDLDGMSVRRVFSKMIKSEEGR

SEQ ID NO: 57841 - protein, 109 aa, Sorghum bicolor
  Clone ID: 30972908.pep
AWKLWNEDRAADFMDASLAGSYSRDEAWRCFHVGLLCVQESPDLRPTMSSVLLMLISDQTQMPAPAQPPLFANKASKKASVSDFSLAMRTETTKTQSVNEVSISMIEPR

SEQ ID NO: 57842 - protein, 132 aa, Sorghum bicolor
  Clone ID: 30972930.pep
MEFKTCLVPLLLPTMALLLLAFGSSPAAAQLQVGYYSKTCPNVEAIVRNETAKIIAAAPSLAGPLLRLHFHDCFVRGCDASVLLESNGGNKAEKDAKPNKSLRGFGSVERVKAKLEAACPNTVSCADVLTLM

SEQ ID NO: 57843 - protein, 172 aa, Sorghum bicolor
  unsure (1)..(172): unsure at all Xaa locations
  Clone ID: 30972933.pep
CSXGVVGRWGVQSACMVADRGWGWRRTASVAGDVTVRESEPLATPASALRPLTTAAAAPQSEILIHATPSSWSSVTSLQTSCSPLAARCHFFVAETVAAVLAPRTRTSGGIRKKKRAREVEGNQIRPITGWRAGGACRWRRTRRRMSRGVRLLSLKQRGVRCTLHFFPEKKR

SEQ ID NO: 57844 - protein, 211 aa, Sorghum bicolor
  Clone ID: 30972972.pep
ARLLLTPASSRATLWPPRPPAANPLSSSFPRKRLHLARPPRAYISAPAPGPEAAYAAPTLDAAAAAADVAAAISSSDAITWAGVWALLSRHRARIAVCLAALVACTACTLSMPLFSGRFFETLIGRGNEPLWRLLSKIAALYTLEPIFTIIFVINMTIIWEQVMARLRSQIFRRILIQKMLFFDRHKVGELTGLLTSDLGSLKSIVSDNIS

SEQ ID NO: 57845 - protein, 116 aa, Sorghum bicolor
  Clone ID: 30972979.pep
MTPMGSCRGSSPTTSMAGPVLDMLLRVAVVLSALLPAARAAFTPADNYLVLCGTAANATVDGRTFLGDASLPTSVLSASRGSEANASAAGSATGSDDAALYQYARVFAAPSSYTFA

SEQ ID NO: 57846 - protein, 207 aa, Sorghum bicolor
  Clone ID: 30972991.pep
RPLSNSDLPLMDLSSIHEATNSFSKENKLGEGGFGPVYRGVMGGGAEIAVKRLSARSRQGAAEFRNEVELIAKLQHRNLVRLLGCCVERDEKMLVYEYLPNRSLDSFLFDTRKSGQLDWKMRQSIILGIARGMLYLHEDSCLKVIHRDLKASNVLLDNKMNPKISDFGMAKIFEEEGNEVNTGRVVGTYGYMAPEYAMEGVFSVKSD

SEQ ID NO: 57847 - protein, 133 aa, Sorghum bicolor
  Clone ID: 30972999.pep
MMMAQQPQTTQLLLHGVIDARILEADLSVTTDGKLQPTKKTLVKKKVFSWIRKLTFCKGQQQLENAIGLGTDGKLYATVDIDKARVGWTRMVPPVHSPKWDESFHIYCAHDASNIIFTVKADNAIGATLIGRA

SEQ ID NO: 57848 - protein, 161 aa, Sorghum bicolor
  Clone ID: 30973011.pep
MTTPATVSFGAPGPRPGAAAVQAQGGRPPAAPQLPGGGVPRPPRLQYTGVTRGPSGGGVPRPPRLQYTGVSRGPSGGGWMARVLVDPERGSCRAVGPFPDPHAAALAHDRVAIAYLGDRARPNFPPAFHPIEQRFLRLCREREGQIDVCALVADPGTYEAR

SEQ ID NO: 57849 - protein, 171 aa, Sorghum bicolor
  Clone ID: 30973033.pep
MASSSGGGGGRRLAPGGDASPASAGARRIYRTQTAGNLGDSIFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAV

SEQ ID NO: 57850 - protein, 105 aa, Sorghum bicolor
  Clone ID: 30973043.pep
TVAFHSRNQSRRRRSTGRGEIASRNGLKDRTEMNPGTNRRNGVGRNRRRRIESGKHLTESGVRDVSERLSDESTRKREGREGDVPPHSHTHRLITHTSGIVQRSS

SEQ ID NO: 57851 - protein, 146 aa, Sorghum bicolor
  Clone ID: 30973050.pep
IGNGKNSRCFGRPERRQWKQNLWGAYDKKGRILRRRRGLGALCLCCSSSCYLFFLPEQARSKKGGGEEDEEEEEEEGPDRWINQRRGADGSLNFRIATAARGRGGSKKGRGVMKRRQEKRRKQRRQETDWERGGEPKPNTSQGEIQ

SEQ ID NO: 57852 - protein, 100 aa, Sorghum bicolor
  unsure (1)..(100): unsure at all Xaa locations
  Clone ID: 30973052.pep
TLKTSHSWPVTGRWRWVVVLAMRPREWISGRRQRCGGILRWRRRGTRSYNAIXVLGPVGVLNANTMDGEVGAAHQSRGAACVSANRCRGPRAPPPSETAR

SEQ ID NO: 57853 - protein, 103 aa, Sorghum bicolor
  unsure (1)..(103): unsure at all Xaa locations
  Clone ID: 30973054.pep
VINKMDEPTVKWSKERYDEIEAKMVSFLKSLGYNVKKDEQFLPISGLVGTNMKTRMDKSICSWWDGPXLFEVLDRMEVXLRDPKGPGRMAIIDKYKDMXNGVM

SEQ ID NO: 57854 - protein, 83 aa, Sorghum bicolor
  unsure (1)..(83): unsure at all Xaa locations
  Clone ID: 30973061.pep
MADEAELAADQHVRYIVTVEKKKDSFESLVMEXIRLNGAYWGLXTLDLLHKLHAVDAAEVVYWIMSCYHPESGGFGGNVGXDP

SEQ ID NO: 57855 - protein, 90 aa, Sorghum bicolor
  Clone ID: 30973065.pep
GKKNKKKKKSLFSLLPFLVCSLFLVPLQTSWSSSYICFSCFSRAIKVTKKHGIRKKRPCTCCKSGKTLGHFHLLASGEWMPLWVQQLAYY

SEQ ID NO: 57856 - protein, 168 aa, Sorghum bicolor
  Clone ID: 30973076.pep
TGLSDDEKRSIYDKYGEAGLKGAGMGTGDYSNPFDLFESLFEGFGGMGGMGGGRAARNRPMQGDDESYNLVLNFKEAVFGVEKEIEITRLEGCNTCDGSGAKPGTKATTCKTCGGQGQVVSSTRTPLGIFQQVSTCNTCGGTGEFSTPCNTWGGDGRVRRTKRISLKV

SEQ ID NO: 57857 - protein, 137 aa, Sorghum bicolor
  Clone ID: 30973089.pep
RFSEPCRLQEIASRLAAVVSTKMGGSLAATEEHELGPRWRDSVGFLKISSGSVVLPIGKLSIGFCCHRALLFKTLADSINLPCRIVKGCKYCKAGAANSCLVRFGHDREYLIDLIGNPGFLSEPDSLLNGLSSISVS

SEQ ID NO: 57858 - protein, 209 aa, Sorghum bicolor
  Clone ID: 30973090.pep
LDILYDDEEEASPIEEVRLTVPTTDDPSLPVWTFRMWSIGLFSCALMSFLNQFFSYRTEPLVVTGITVQVASLPVGHFMARVLPRTRFRVPALLGGGEWSLNPGPFNIKEHVLISIFANAGFAFGGGSAYAVSIINIIRAFYGRHISFITAWLLVITTQVLGYGWAGLIRKYVVEPAHMWWPGTLVQVSLFQALHEKDESAKASRQISR

SEQ ID NO: 57859 - protein, 94 aa, Sorghum bicolor
  Clone ID: 30973096.pep
MVISVATPRRSTSIRDAVLGGVLGGGGRQLYQPLRCAFYDGTAGGGGGGLPGDGLSAALSEEPARVSAAGGGNKQKQAARNVLILMSDTGGGHR

SEQ ID NO: 57860 - protein, 194 aa, Sorghum bicolor
  Clone ID: 30973106.pep
YWVVQPAELQVPAKLPQLNVLQVTEEAELQRLFRAHAMALQGAVQRIVDRAGGETASLLKSLMYDYIDKASALAGGLGLIQAPPEAATPGNEAWSKWPPQPAPTHQATHATVPVRDVFGRILSTLPPKATVEDNSIAAVEKALARIELSARESPTIQGDSSGGQQLTSSVVALFSKPTEPLLQQPQHAAAVVPT

SEQ ID NO: 57861 - protein, 205 aa, Sorghum bicolor
  Clone ID: 30973108.pep
MAAATFSAAGRRLLSTAAAAKTELPVPIARLRQLARAGRLDDIDATLAPLFRSHTVAALSALSSVGLPDRASTLLGTITSPTTAHLNAVLGPLLRRRRLAGLVPSILATHASIPRDAATDSILAKSLCLTSGADSALHLLREPSSGSPPSLQLFTAIIDSFYKQRLPHRAEELWRAMVQDHGIAPDTAAYNARITYKSANGTVEE

SEQ ID NO: 57862 - protein, 178 aa, Sorghum bicolor
  Clone ID: 30973116.pep
PAVTARGKLPRFKGRSTPPPSSREIASFLLVFFGRLRRRRASTRTIMKAFHQAPVVGHAFPSCQRPCVSFSNRPYRQSSHQYQLVAAKDTFMYNKKYRRLMVTVSSLSEMPYEKFHESAYDQCKDSSLESRKIVQAAEQKVLPQDMDAQFIESILFDRTLYKYEILGRMAITGLMSAG

SEQ ID NO: 57863 - protein, 194 aa, Sorghum bicolor
  Clone ID: 30973132.pep
YWLSRHSAAHAYGRQQHEYILDNKATDKHKNQYITPEKASTPSATIESDPLPLVWGKQRDRPLSVEEWTAFLDPEGRVMDSKALRKKVFYGGVDHALRKEVWKFLLGYHEYDSTYAEREYLAAMKRAEYEAVKSQWKSISATQAKRFTKFRERKGLIDKDVVRTDRSIPYYEGDDNQNVVVLRDILLTYFFLQF

SEQ ID NO: 57864 - protein, 157 aa, Sorghum bicolor
  Clone ID: 30973134.pep
FLWRKNVSFAISRHYRRFDVFEEAEANKAGGKYDNTSIDYQIEFYKREGLTHYSSAKLPITSDVPEGCVIIREHVPITNLFTCLWFNEVDRFTSRDQLSFSTVRDKIRSRVNWTADMFLDCERRDFVVQSYHRELLEQRQATLRSWPPQRPPIVRVH

SEQ ID NO: 57865 - protein, 143 aa, Sorghum bicolor
  Clone ID: 30973144.pep
NEDRTRPPPSPPQCLPFPLETPPTTAATIPAVISIPAAPAPTPSHAERIQQARQQRDPAGRAALPDPSDRRQTQPAAILVFEAVLSLARPGRHDGSSLEAGGVRPRAVAPHQQASPPPTDPSTPSTSTPVNLPPPHPCFFVHH

SEQ ID NO: 57866 - protein, 142 aa, Sorghum bicolor
  Clone ID: 30973156.pep
TGCFPRGTIHDSLAREGFPCAREPRGSSSSPRDAAGSAAARLGSPGSADGLHPDRDGEAHRITASRLRPDISSTLPRHPIDDAPASHRPRPGTPSPLPWLPVACAISSFWSSQQSSAWPLASFQDLILSGEITHRGVYILQV

SEQ ID NO: 57867 - protein, 164 aa, Sorghum bicolor
  Clone ID: 30973158.pep
MSALELSKSMSFRSSERAKQLMLRYGHPGLDGGFDPALFSPLHESVDGDGYERSPASNYEPQRSPCARSETGTAMAAASPAAAPGKKAGPRNKLKLLGNIKKLLPGGGKRSHSSSHVHGHRHDHAGGRDGRKAAPAPRDEYLQKAMQWLSTHDVLDGDHSYEST

SEQ ID NO: 57868 - protein, 62 aa, Sorghum bicolor
  Clone ID: 30973168.pep
MAGRHRNPLPPSYPRGGGGNHPPPPLHHPLHPHLPPHHPLDDFRDPPRLPPDHHLDDFRDPS

SEQ ID NO: 57869 - protein, 158 aa, Sorghum bicolor
  Clone ID: 30973173.pep
MDIKIPFILAFVFLTLLLLRLIRCYVTSSRTNPSVLRLPPRPWQLPLIGSLHHLLLSRFRDLPHRALREMSGTYGPLMLLRFGELPTLVVSTAEAAREVMRTHDLAFCNRYLGATLEAITCGGNDIFGSPYNAQWRELRKLCMLEIFSHRRVLSFRSI

SEQ ID NO: 57870 - protein, 138 aa, Sorghum bicolor
  Clone ID: 30973175.pep
MASEANGGVVANEKGAETVGVGRYVEMEQDQESNTVKSRLSGLLWHGGSAYDAWFSCASNQVAQVLLTLPYSFSQLGMLSGILFQLFYGLMGSWTAYLISILYVEYRTRKEREKADFRNHVIQWFEVLDGLLGRHWRN

SEQ ID NO: 57871 - protein, 59 aa, Sorghum bicolor
  unsure (1)..(59): unsure at all Xaa locations
  Clone ID: 30973203.pep
YWPLFAATSHHRLRPSPIRVLPRAIDRTRLTSPPPHRGSHGXXDRRAGRRGRAAGGAAA

SEQ ID NO: 57872 - protein, 214 aa, Sorghum bicolor
  Clone ID: 30973230.pep
YWFAQYAGTSAGILDGIALKCGSKVEYRSTLCDTAELQFSIEVWIVGEKVGEGIGRTRREAQHKAAEMSLRNLANKYLSSDPNKLTDMKENGFSGNRNVFGYSGNTRDDMLPLSSTSEESRFMKMENNSRKTGGSVAALKELCTVEGYNLVFQERPSPADGLVGKESYAQVEVGGQILGKGVGLTWEEAKLQAADEALGTLRSMLGQLAHKRSG

SEQ ID NO: 57873 - protein, 162 aa, Sorghum bicolor
  unsure (1)..(162): unsure at all Xaa locations
  Clone ID: 30973239.pep
MAYAARLVAKIHPAAYPAGTPRAEPRRPSSLRVGAFSGSTTVKQQKFVAKSAISGVEGGDAFVGVKQNTRPIIVIDNYDSFTYNLCQYMGEVGANFEVYRNDEITVEEIKKISPRGILISPGPGTPQDSGISLQTVTELGPSIPLFGVCMGLQXCIGEAFGG

SEQ ID NO: 57874 - protein, 99 aa, Sorghum bicolor
  Clone ID: 30973247.pep
SMNRHRPEDLPRIQRADGGGVGGQQLSPQQAWPQVTFGCCTSQQHWHGSEAVAIVMKSARSMSHATRARAVFFMRLMPPFVLNLQMSSCEQLRCNVAPE

SEQ ID NO: 57875 - protein, 130 aa, Sorghum bicolor
  Clone ID: 30973248.pep
YWFSVSAFFVLFVFTRLLCARLHLSRAAAAAADRAAAGGAFVVNVERGIHGLEPSVVTTFPTVKLGDGDGDGGQQPPPVQEESQCTVCLEEYEAKDVVRVLPACGHAFHAACIDAWLREHPTCPVCRASL

SEQ ID NO: 57876 - protein, 223 aa, Sorghum bicolor
  Clone ID: 30973282.pep
YWGAYKYADVFKERLGVSLEKEDEMDCLVAGANFLLKAIRHEAFTHMDGQKRYVQIDQNDLFPFLLVNIGSGVSIIKVDGHGEFQRVSGTNVGGGTYWGLGKLMTKCKSFDELLELSQRGDNSTMDMLIGDIYGDLDYSKIGLSASTIASSFGKIISENKELSDYRPEDISLSLLRMISYNIGQISYLNALRYGLKRIFFGGFFIRGHAYTMDTISFAVHFWS

SEQ ID NO: 57877 - protein, 81 aa, Sorghum bicolor
  Clone ID: 30973304.pep
NCYYKREVCIGIIDRIHRELENRFDEVSRELLICMAALNPSNSFAWFDAKKSNKVRNSMSDRLLNDCLVTFIEHDIFSSVS

SEQ ID NO: 57878 - protein, 72 aa, Sorghum bicolor
  Clone ID: 30973312.pep
MSTTLGSGSVSPAAGAASAAPEVEGHWAPHGAVLTACVVGINVLVILLIFGFFWRFFSGRGGPSPSASGGAA

SEQ ID NO: 57879 - protein, 210 aa, Sorghum bicolor
  Clone ID: 30973315.pep
YWGPRRAGGGGGEPGGSSSSSSLPQRPGEPKRQRIALRDVITEVMRNTNIEKFLIALEPLIRRVVKEEIESAFANHASMMARNVTDTVPCASKNLQLQFMTRLALPIFTGSKIEGEGSLSITIALVDALTRQIVAPGKEFQIKVEIVVLEGDFESGEDDDWTAQEFNNNIVKEREGKRPLISGDVFIALIDGIGTVGELSFTDNSSWTRS

SEQ ID NO: 57880 - protein, 90 aa, Sorghum bicolor
  Clone ID: 30973365.pep
ARDQSERPGSCHHCGPRCRIIKMAEAALVALSKIGFYLAREAATFVATKFSNLTELPNTVQRVRRQLLMMNLFIQKTSALYLSDELLKGW

SEQ ID NO: 57881 - protein, 192 aa, Sorghum bicolor
  Clone ID: 30973375.pep
MGRAPANGKHSLPPPPPPPGRCHFWLPNKRRHCANTPLPSSQYCGNHLPESASGAGRRVPCPVDPSHTVLEENLEAHVGKCPLKKQVAALTAQPYYSKGINSGAGEAGCVVTSAEKRAAVYRLTEEEFRCLLGKIRSVHVATAAAIRESYLITGATDKWMNGQVDRKMPYQEKHVAQQASIVGNMEAFGLLR

SEQ ID NO: 57882 - protein, 103 aa, Sorghum bicolor
  Clone ID: 30973380.pep
EDQEGKTSFLYTPGDVDDCVGKIGQLLSSEELREAMGRAARKEMEKFDWRAATRKIRNEQYSAAIWFWRKKRAQLLRPLQWALRLLRPTTSGAAIADAMAKQS

SEQ ID NO: 57883 - protein, 152 aa, Sorghum bicolor
  Clone ID: 30973393.pep
RPVNGRGGNCSTAGCDGDLRETCPSELAVKVGGQTVACRSACDVFDTDQYCCRGKFGSQPTCPPTPYSKKFKDACPTAYSYAYDDASSLFTCSGADYIITLCASRKQQACSYHNNQLVCSGASSRRPWQITSKILLLLVLPQLIFSALQFAV

SEQ ID NO: 57884 - protein, 119 aa, Sorghum bicolor
  Clone ID: 30973402.pep
CHYTSNENIKRTDTSQRKRVQHHSVVVCVQERVLLVVEGICETAGEAFIDFLPFHHRVRLMLREGPGVEIVIEVDVLKGSPALTVSDVPLLLHLFDVLLELFLSGGDHAIPMLIAPCLW

SEQ ID NO: 57885 - protein, 104 aa, Sorghum bicolor
  Clone ID: 30973405.pep
VSGTARGGRSGCAAGRPSSRCRRCPARRPTRGSGARASVASPRAQLLLTDTKSLLLAVNNRAGAAVGVSSLTKKKLKPSVLAAATLLMRRDDDDDFCKISASTC

SEQ ID NO: 57886 - protein, 199 aa, Sorghum bicolor
  unsure (1)..(199): unsure at all Xaa locations
  Clone ID: 30973440.pep
KSSGIVGFEEHIVSGGNFHGEYPAKALDYLAIGIHELANMSERRIARLPDTNLSGFPAFLVRDGGLTSGFMIAHCTASSLVSENKVLVHPASSDTLSTSASKEDHVSMGGMSAXKSLTVVENVEHVVAIELLCACQALDFLRPLKTTRALEAVYELVRSKVKFFDKDRHMTPDIEAVHELLRTGQVWGAVKKYFPEECH

SEQ ID NO: 57887 - protein, 156 aa, Sorghum bicolor
  Clone ID: 30973444.pep
HCDPHAANMMVRPMPHDSRKLFGWKRPQLVLLDHGLYKELDYNTRISYASLWKALVFADAKAIKENSVKLGAGEDLHALFAGVLTMRPWKRVIDPSPDHLVLGKNTDYSELQNYASLYFTEISELLRRLPRVILLMLKTNDCLRAVNHALVSIWKC

SEQ ID NO: 57888 - protein, 72 aa, Sorghum bicolor
  Clone ID: 30973449.pep
PLFCTILNHRTEISWSVGVLVLAIFVLVSLKFPFGANRSKLLIYSFVVEWSPVVLIPTPLGDTSIHLVTLIR

SEQ ID NO: 57889 - protein, 184 aa, Sorghum bicolor
  Clone ID: 30973451.pep
VRVPSPLIRSRATHKCGCGSPIRSPDPPASAPIRASFHRSSSFYRRRALAARWSGDPSLQPGLLDSFLIAFAGSMDKQEPVANVEQKIGLSEKPKEQPVASKDEKAAVPPISVDSNAIDLPSEGQTQAGTSNMDGGHNGAHNFYASQAQPFYYQGSGYENTPQEWDTYPPYMSVEGLEVGPPVV

SEQ ID NO: 57890 - protein, 215 aa, Sorghum bicolor
  Clone ID: 30973461.pep
MPHTIVLDGDNLDCETLYTIGYNPSVVIELAEESKERIKHSRQIVQDIVDKDAIKYGINTGFGNFATVKIGKEDLADLQRNLIRSHAAGVGRPLTNDRARMLLALRINVLAKGFSGISLSIVESLIAALNKNCISYIPEKGTVGASGDLAPLAHMALGMMGEGKMYNPTTEKYEEAALVLREHGLTPIDLGAKEGLAMINGTQFITSLGAEATFR

SEQ ID NO: 57891 - protein, 69 aa, Sorghum bicolor
  Clone ID: 30973465.pep
MWRRAATAALSLGAGAGAVAVANSDDPAATLKVCAHLPPRLLRYSATAATIAFDYKWSLWGLEPGTPAW

SEQ ID NO: 57892 - protein, 194 aa, Sorghum bicolor
  Clone ID: 30973476.pep
MAAAILAPKPPPSLPTSASPSSFPSPSRLCLSPRHPLTRLLLRPIPCASSPSSSVLMPDPDPDLEPEPAHDRDGAQDEAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLC

SEQ ID NO: 57893 - protein, 202 aa, Sorghum bicolor
  Clone ID: 30973485.pep
MMAAPAKHVLLFPFPGQGHLSAFMSLAGLLHGALPDAAITLVSTPRNVAALRTTERSKANSSFLGFHALPFTPADHDLPPDCESSDAIQPMAIFDLLEAFEALEAAFDDYLFATVAMAGGSGRDVCVVSDPLTAWTVTVARRRGCAHAFFASCGAYGSAVLHSLFSHLPVRPDPNTGRVHLPEYPEVVIHRSQLFSAGPPAV

SEQ ID NO: 57894 - protein, 149 aa, Sorghum bicolor
  Clone ID: 30973490.pep
MNSRSRCAPRLAVLLCFVLSSTTVESAGVFTIINQCKDTIWPAATPGDSFGGGGFALRPGQSAVFKAPAGGWSGRIWGRTGCAFDASGNGSCATGSCGTTLKCGTSGATPVSLAEFTLAADRDFYDVSLVDGFDLPVTVRPVNGRGGNC

SEQ ID NO: 57895 - protein, 182 aa, Sorghum bicolor
  Clone ID: 30973498.pep
PPTSPLPPEPSLCDAPLLSFSRDRQRSGADSKALRRWGTRTRRRTTRACRTPSRRSASPSCPPSAWAGGSPPTRPRRGATPSSSSGSRSPSTASSTSRRSTARASSRPPTSPPSAAPCSRRSSRRRSTPSSPRCSATSSSSSRSCSTPSASPRRSTTRPRRPSCSGLPRSASSSTAPTPRSR

SEQ ID NO: 57896 - protein, 108 aa, Sorghum bicolor
  Clone ID: 30973502.pep
GEKQSIEREDEGEGDLCGGVAARFTRVRRRRSSRAAAGGEEKSKARNPPPAPSRHLLLLPRLLRLPRTFRFPSFNNARHRHLRRRAERASSPSLSPSLSLPTCGCLAR

SEQ ID NO: 57897 - protein, 132 aa, Sorghum bicolor
  Clone ID: 30973520.pep
MASSSSTSSSALPLFSSLLLALLLLSAPSPSASAELSFLTVSSNGSASISADPELEDVAPEPTFLEEVIDAVSEKYDWDPDAEVRVWPLDADAVRVGVVQRYEFRARAGGSAALARFSDEAVQWRRPSAPAL

SEQ ID NO: 57898 - protein, 142 aa, Sorghum bicolor
  Clone ID: 30973521.pep
GCDADASRAAPLLPREAVPVARPPPFSQVLRAPPPAPSRSRREAPRITSSRLRPSILSTPPRHPSDNVAAPRLLRTGFPSPVPSRRLPTSQVEVASVDPDPLPWMRSSKFPPVLRLTDLVAGSGEFFSFDGHILYDTLNLPF

SEQ ID NO: 57899 - protein, 74 aa, Sorghum bicolor
  Clone ID: 30973545.pep
YYDQIKKTSQIKAYTRHKMVRRIQIKYTGIFILSQMIMVTFPSHETKRGTHTSFHLLAHSSIISKQEVPQGLFC

SEQ ID NO: 57900 - protein, 184 aa, Sorghum bicolor
  Clone ID: 30973564.pep
NPEADLGPVISLESKKRIEGLIQIAKKEGCQVPLDGSGIVVKGYENGYFVGPTVVTGVKPHHTIYKEEVFGPVLCVMEAATLDDAIKIINSNPYGNGTAIFTRSGPCAGHFQHEVDAGQVGINVPIPVPLPFFSFTGSRASIRGDLNFYGKMGVYFYTKLKTVTSQWKEDDVTAKLSTAMPTYK

SEQ ID NO: 57901 - protein, 49 aa, Sorghum bicolor
  Clone ID: 30973566.pep
DTFSSEVKRLPKDRIGAPYFREPGEFPKLEESFFANPLPDCICEKHSEE

SEQ ID NO: 57902 - protein, 113 aa, Sorghum bicolor
  Clone ID: 30973571.pep
KRLCKCPEGRLAFAEHALAVSAVARAMLRVSVLASRLAVSVLWLVACSATPAERVLDDMLVSGGVGKLLALLQVENSASTKEKAAKLLRVHGPFWRQYPCFPTDLRDYLKFLN

SEQ ID NO: 57903 - protein, 66 aa, Sorghum bicolor
  Clone ID: 30973574.pep
LTWLATPLKRTVKFADVRPPETNRPFVTFKAEGNFYFVDAEHFSNKALLARLTPQKLPHESAFKNL

SEQ ID NO: 57904 - protein, 176 aa, Sorghum bicolor
  unsure (1)..(176): unsure at all Xaa locations
  Clone ID: 30973575.pep
HQQYELALVMTDKVLAFNEPCPVEPAEPIREENETEATFATRKRDHATMRMSYDLAKKQGDNSNKKCLTLAKATISEPIXGSLPECATITEYLEKVKNYFHGITKTQASILIRELITKKYTGGGVREHILRLNSLASKLASMKMELPEPFVIHVIFSSLPKEFETFVVSYNMAPEE

SEQ ID NO: 57905 - protein, 149 aa, Sorghum bicolor
  Clone ID: 30973583.pep
MLQRGVKLARNKALRNVRSFHPSITTMKEVRKVPMIINGELRISKTDTWIDVTNPATGEVIAQVPECTQDEMNEAAENSHEAFLKWKEQSVSKRVRYIFNLRQLLEQKSREIASMITEEQGKTIKDADGDVFRGLEVVEHAASMTTIQM

SEQ ID NO: 57906 - protein, 234 aa, Sorghum bicolor
  Clone ID: 30973585.pep
VAVAKILKATLVLPSLDHTSYWGDDSEFKDLFNWRHFIESLKEDIDIVETLPPEYSDIEPLAKAPISWSKVHYYRDEILPLLKKHKVIYFTHTDSRLANNGLPSYIQKLRCRVNYRSLKYSHTIEDLGNTLVSRMRQDGSPYLALHLRYEKDMLAFTGCSHNLTSEEEEELRKMRYEVSHWKEKEINATERRSLGGCPLTPRETSFLLKGLGFTRNTRIYLVAGETFGNGSMNA

SEQ ID NO: 57907 - protein, 159 aa, Sorghum bicolor
  Clone ID: 30973594.pep
MAMEEPPQLFLCPISMELMEDPVTVSTGVTYDRRSIERWFFKYGKTTCPATMQRLNSFDLTPNHTLKRVISTWLDRASSSSSSTPLCTKLARENLPSVLAGIEATPFKVTALKNLRRCMDEDVAAQQDFVAYGGIQVLGRVMTQALAESCAGVDFSAFR

SEQ ID NO: 57908 - protein, 178 aa, Sorghum bicolor
  Clone ID: 30973615.pep
MAGAKLTPNAVAAAMAGDTNLKPVVQVVDLRSIAVTGGSGPRFRAIISDGVATGHALFASQLCDLARSGVVRRGSVVQLLDYIVNDVGPHRNRKAIVILNLEVLAAECEIIGNPALPPDSGDSNSMRADQFNGALQNGSIAGTALNKVARPSDNAQVIQRSMAGNSLNMVPRPSENAQ

SEQ ID NO: 57909 - protein, 185 aa, Sorghum bicolor
  Clone ID: 30973619.pep
MSPRLAAAAAASALPLPLPPPAVAAPSRALRALVLSPGAAAAVSSSLRRRGAPACLVRRLCSHHHSSAAAATAATAVEEARRGRKQLGMTPPLYDYLLANVREHPILRELREETAAMRGSQMQVSPAQAQLLAMLVQILGAKRCIEVGVFTGYSSLAVALALPECGHLVACERDERCLEVAKKYY

SEQ ID NO: 57910 - protein, 195 aa, Sorghum bicolor
  Clone ID: 30973623.pep
MPALPAFPLTRRPSDARRRGRLVLSLVVLVAVSAAAALAYLSFPSAGRTSPPAAFSAVRAEADCCRGMEGLELWGPAVKWGSDHRLPSAAACCAACKAMCPHLEDGACRCDSWVFCGDERKCKDRFGECWLKKQKDVMAPAVIARGEDVMWTSGLIFGKGEGIVGLETNLGTLHIQLLPGCTPRSVDYFIELLGL

SEQ ID NO: 57911 - protein, 160 aa, Sorghum bicolor
  Clone ID: 30973651.pep
VMPGTASSPSSLTPIEIAMRRDRHWSGSVGRGVGRRRSQRHHCHVMPWRRDMAPGHGSQHLRGSCCMGGGGLELLGLWSRPPVLSISELSFSWSSLGSVGILVLCLAGGHRPHCQNWQTDLISSCMAQRPCRKIRFPLDGPTARSAPDRGSPAVQWLVGP

SEQ ID NO: 57912 - protein, 147 aa, Sorghum bicolor
  Clone ID: 30973652.pep
YNIYTHIVNTKTSPNKSSSSYIYKLPRTHASSCTIVLARSRMHACMIYTCTLDRSCMFSIAGVVIKFLPPVTPQIHLPTSLGAGTHGASHLLHRRTPAVAETINRLPLLRGCTGGLVPPFAGQLAAPTVRGDAVAAADIQASTGVML

SEQ ID NO: 57913 - protein, 126 aa, Sorghum bicolor
  Clone ID: 30973658.pep
RFREALFCYPTMFDMLDAIVPRDSEQRLVLEQGMLGRWALNAIACDGVDLIDRPEKYRRWEVRNRRAGLRQLPLEPDIVKELKGMVKKHHHKNFLLSEDDQWLLQGWKGRILFAHSTWVADEASSE

SEQ ID NO: 57914 - protein, 75 aa, Sorghum bicolor
  Clone ID: 30973689.pep
HFFCCNTLVATFYRPTRFTCSIIPIGQPSHSIVRSDFQGKKLSSLNCLPLFSVFPVPFFFRFLAAQPSKVVCVRV

SEQ ID NO: 57915 - protein, 67 aa, Sorghum bicolor
  Clone ID: 30973690.pep
AYHGLLSSDEVLLTGSPATADLVKLYAANQDIFFQHFAQSMVKMGNISPLTGANGEIRKNCRRVNHS

SEQ ID NO: 57916 - protein, 90 aa, Sorghum bicolor
  Clone ID: 30973695.pep
LIACKCRIIEGRRAHIENKESQKGCILYTASINKGNIPASYFQRCRPSHGAREAPEKALMMVVVVVAVVRWRNIRQEERRVLIKGFFVAL

SEQ ID NO: 57917 - protein, 86 aa, Sorghum bicolor
  Clone ID: 30973710.pep
ASTAPVSERNVGTTNQPNIPEIQSFLFPAQIRLFRCCHKVWTLLRGFHDVRDFCYQSPRTGESAIKSAQTFALLQPKIPSYDLGGT

SEQ ID NO: 57918 - protein, 183 aa, Sorghum bicolor
  Clone ID: 30973715.pep
SSNCSLHPAFNLRAARLRPANSLRSRDLSLDSLGFPLPNSCKKSMAATTIDWHGRNAALYGVADRDSKELVRALAPPMQQAAPTISFAYPCSGVEQQSAAAAAGSFLGGGGSSGLLTPAQILQLQSRLQFLRRPAAGGATLAAVTTQQMKRQGVPQAPAPLTSRPAVSKLYRGVRQRHWGEVG

SEQ ID NO: 57919 - protein, 149 aa, Sorghum bicolor
  Clone ID: 30973716.pep
MAAFSSSNGVPPGFRFHPTDEELLLYYLKKKVGFEKFDLEVIREVDLNKIEPWELQERCRIGSAPQNEWYFFSHKDRKYPTGSRTNRATTAGFWKATGRDKCIRTSYRKIGMRKTLVFYRGRAPHGQKTDWIMHEYRLEDADDAQGGTS

SEQ ID NO: 57920 - protein, 62 aa, Sorghum bicolor
  Clone ID: 30973751.pep
GYAGRSAALGCILYVWRASGVVVVVEDAAAARSALQWAVGNFIRSSDSITLLHVCPPARSRR

SEQ ID NO: 57921 - protein, 125 aa, Sorghum bicolor
  Clone ID: 30973758.pep
DNALFLLLAVIATIVAAIFLENSFGSTPGLKPLIRIPNWTPLLPVAAAERKQAGGEPEEGGRRRLVPPPRLALRSELHRTGGGGVLRCAVLCCRPFVRGEGGGGENPIRYLFFFFFFFFFFFFFF

SEQ ID NO: 57922 - protein, 114 aa, Sorghum bicolor
  Clone ID: 30973775.pep
ETVRYPGLASHPQKELADRQHRNNLHGGMLWFEVRGGTEAGRKLMDTVSKPWCLCENLGAAESIITCPAVMTHANMLKEDRIKVGITDGLVRVSCGLEESEDLIHALKTALDAL

SEQ ID NO: 57923 - protein, 118 aa, Sorghum bicolor
  unsure (1)..(118): unsure at all Xaa locations
  Clone ID: 30973787.pep
LKGIEKTSGGVQLVHVDDLCRAELFVAEEAAAAGRYICCSLNTTVVEIARFLARKYPQYGVETNLSTDDDEQLLEKPRVSLSFAKLVGEGFEFKYKTLDEIYGDVVXEYGKALGILPY

SEQ ID NO: 57924 - protein, 76 aa, Sorghum bicolor
  Clone ID: 30973791.pep
NRRVSDLRSVSYCNLCNLYGFEILEGKNFYMPLARGFFGMAPIADSSFDFCSHTKRSVENGFSSLRIIDVKLSSIF

SEQ ID NO: 57925 - protein, 67 aa, Sorghum bicolor
  Clone ID: 30973804.pep
TISGRVQVLFLRKRCSGIERSLSYLLSWLTFWYTPIFNFLVIKSCRRDAFATCLHNKASATKLITLT

SEQ ID NO: 57926 - protein, 69 aa, Sorghum bicolor
  Clone ID: 30973809.pep
LLHKYKARSEDPQSPPTSPGRGRGQELGDMYPVADHQRLHRLDPERKRAASSTAMDIDIADADFSFSTR

SEQ ID NO: 57927 - protein, 175 aa, Sorghum bicolor
  Clone ID: 30973823.pep
MLATASPHLQAAAARRLSLAVPVNQGCSSVRLPRRRPGRYASVRAASASASASASAAAPPAKEGAEDLGFQEMSSGTRRRYYMLGGKGGVGKTSCAASLAVRFANNGHPTLVVSTDPAHSLSDSFAQDLSGGTLVQVDGPDSPLFALEINPEKAREEFRTANQKNGGTGVKDFMD

SEQ ID NO: 57928 - protein, 166 aa, Sorghum bicolor
  Clone ID: 30973824.pep
MLLVSQAANGSLSARRLPSKPPGPSTTNPYPLFANPRLVRRRLALSGTGADQAPRRPTSTPAAAGEGPSGSSPAAAATEDPVLVRVADDGVPLEGVIQIEKPGDAGAESKLVSYAKLGLLAGGDVFCLLLFSAIGRFSHGLPVLDAETFKTADPFIAGWLLSAYLL

SEQ ID NO: 57929 - protein, 196 aa, Sorghum bicolor
  Clone ID: 30973826.pep
MAVHHPHLLDFSPPPNTVAMEAPPAPHFDHGGHHHHHHLLGLHVDGGVGMSVGGGVPHRALADDDTVAAWAPQAAVSLSLYNYDNTAGGSSSSLFGHDEPQFGAMPPAAALALPNHQQLPTTTSSMQQPFQLRSSKYLAPVQDLLSEFCSLEGDLLHAMNKRAPRAGNKWDDVETSSSSSGLWGHPSLSSMDLLEL

SEQ ID NO: 57930 - protein, 109 aa, Sorghum bicolor
  Clone ID: 30973845.pep
RERERESNMAGAIVSASTGVISALLPKLSMFIEQEYELQKGVKSNIAFLVAELSSMHTLLVELANNEERLDVQLKDWKNKVRELSYDIEDCIDRFMHKMSKEDAGVNLL

SEQ ID NO: 57931 - protein, 60 aa, Sorghum bicolor
  unsure (1)..(60): unsure at all Xaa locations
  Clone ID: 30973848.pep
RRSLPPGPGPPPPPSRAHPTSSAPDPAPPPPPPTPLPAPQXPSPNSRPVASKRPSPPPPP

SEQ ID NO: 57932 - protein, 208 aa, Sorghum bicolor
  Clone ID: 30973855.pep
MASEGKISKNFKSATPAGSGHWEEAREYGFNTGLVHAGVLPDPITGAVLTPIYQSTTYIQESIDKYLAKGFSYTRSANPTVKAFEEKVAAVENGAGATAFGTGMAATCTIVASFMSAGDHAVVTNCSYGGTNRAMRVMFTRFGMTFDFVDFTDLKQIEAAIKPNTKLILSESPANPTLVLADLAAISKLAKSRNIIHVCDSTFATPVI

SEQ ID NO: 57933 - protein, 105 aa, Sorghum bicolor
  Clone ID: 30973897.pep
MSPSAGEKKKMACVTGGNGYIASALIKMLLENGYAVKTTVRNPDDMSKNSHLKNLKALGHLEVLRADLDQEGSFDEAVAGCHYAFLVAAPVNLASEDPEVSKHHE

SEQ ID NO: 57934 - protein, 127 aa, Sorghum bicolor
  Clone ID: 30973901.pep
MTCATRRPGFLREAELRLLRCTLSAPPSTPPPPASPPPAHPLGPAAASALAAVETGDYEAVLAAAAPHLLPASASSGPPGSAAQFYAELGAAARAFLLGDGDGGTAGAGFECRCTVVLSAAVAALLA

SEQ ID NO: 57935 - protein, 168 aa, Sorghum bicolor
  Clone ID: 30973902.pep
MAKPVKYDDEEEISSSAEEEEDQSDAAGSGSGEEGEVEEEDAAAAPAEEEEEEASGEGQQEEEEDDESVPRDKDDGDETDVVVGKREKARLKELQKMKKQKIQEILDTQNAAIDADMNNKGKGRLKYLLQQTEIFAHFAKGSQSNEKKPRGRGRHASKMTEEEEDEEY

SEQ ID NO: 57936 - protein, 206 aa, Sorghum bicolor
  unsure (1)..(206): unsure at all Xaa locations
  Clone ID: 30973914.pep
FWHADKPLYQNSVATRLASAVSAPPSPADGAAFLAACLTTLRREWAHIDVHRLDKFYLLNRRFLHHAFLLLSASSFAPDVTSQVVSVLSDKALLPEADNVAAGTSRGLGYHVAEAFLDELLPVLPVSLETVDALLAPFFTVLEKSTDRVMVSKVKAGVFERLLESGSRLLEMVKKGEXVEKGXAEEKLGKIGLLFGLSKRFLDIGA

SEQ ID NO: 57937 - protein, 84 aa, Sorghum bicolor
  Clone ID: 30973918.pep
AHHHGGGDARFVQAYGDMAGLGGYGGGSVSLTLGLQHCNDAGAVPAEQQGGLLYGNAGDFEFINGSAEDRQRFGSSQLLHDFVA

SEQ ID NO: 57938 - protein, 52 aa, Sorghum bicolor
  Clone ID: 30973921.pep
NQNGMSFDKIISNKFFTNQSYKIQTWSMFLTAKTVQLSSYLSHTGGVINTEK

SEQ ID NO: 57939 - protein, 104 aa, Sorghum bicolor
  Clone ID: 30973950.pep
PALLRPGRMDRKIELGYCKGPALRVLAKNYLGDGDFELTTNGGHRYEELVGEAERLLEEVQLTPADVAEVFMGFDGDGDLAALQKLVDDLSSKRVVQKCAASDV

SEQ ID NO: 57940 - protein, 99 aa, Sorghum bicolor
  Clone ID: 30973959.pep
PSSGVSCYQRLEFVGDAVLDHLITKHLFFTYTDLPPGRLTDLRAAAVNNENFARVAARHKLHVHLRHGSSALETQIREFVKDVQVELLKPGFNSFGPWG

SEQ ID NO: 57941 - protein, 165 aa, Sorghum bicolor
  Clone ID: 30973964.pep
MMSRRDRMQPPPPVTAVLLLLLLLAAAPATGQIATSCTASLITTFTPCLNFVTGSTNGGGSPTQQCCGSLAEMVRTGADCACLILTGNVPFSLPINRTLAISLPKLCSSTSVPLQCRDTATQIPAPGPVAFAPALPPLPPIPPESSDSPVDPTAMSPAVDSPPFS

SEQ ID NO: 57942 - protein, 176 aa, Sorghum bicolor
  Clone ID: 30973966.pep
DASDCEGDRSRVTHQVRHGYRHTVKPLHCQRGRLELCELRHMKTVALSWSSLGSLVATAMVVRTAVRDVLPPEAHGALQALLARATAAFAQPLDTIVVHETDANGVPNELYDAAQLYLGVRCLASAPALYLHKVHGASDVVASLPDDHTAWDTFRGVRVLWASRRAESNGAYSSSG

SEQ ID NO: 57943 - protein, 131 aa, Sorghum bicolor
  Clone ID: 30973971.pep
RARPGTRPPLPACQCQCRSLPLSARLVLAWILHATDAACPAALAPHSCPARGSRLVVQWWRWWWSADPPSVRGLPFVFAHCCWPVGVDLRAACRHHPWFDYFSGTQDRGKSQQDLFRFNWTNSRVLRQDRH

SEQ ID NO: 57944 - protein, 81 aa, Sorghum bicolor
  Clone ID: 30973986.pep
RSVSWPHLVLLKTMATFFSTSTNQRDLTGGGGDMSFHHYTYSDSPAGGLMPFPATIVSEGHVAHGGDDGRDEPAAFVNVNV

SEQ ID NO: 57945 - protein, 99 aa, Sorghum bicolor
  Clone ID: 30974006.pep
MKYVLVTGGVVSGLGKGVTASSIGVILKACGLRITSIKIDPYLNTDAGTMSPFEHGEVFVLDDGGEVDLDLGNYERFLDIKLTRDNNITTGKIYQSVID

SEQ ID NO: 57946 - protein, 129 aa, Sorghum bicolor
  Clone ID: 30974012.pep
MPSPSSAHWLSLVGSIWLQTINGPNADFPVYSSQLKDLKHITQVQLNFLAFASDAGKLFGWFSGVAALYLPLWLVAFVGAAFGLVGYGVQYLFLDSAGLRYWHLFLLTSLAGNGICWINTVCYLLCIRN

SEQ ID NO: 57947 - protein, 86 aa, Sorghum bicolor
  Clone ID: 30974014.pep
MGSNSMEGLPRTAVHFLLLIFCIASKCLAASGLNSTQMVTLKVDASPKLARKIPDIFLGVFFEVMLFLAVHQVLCIIGSIQVYMIP

SEQ ID NO: 57948 - protein, 56 aa, Sorghum bicolor
  Clone ID: 30974050.pep
LVVLPDSKKKKKGGITSEPFVLKQRDVTLYKEHARVLDIISSQNLLLYLTSFASVS

SEQ ID NO: 57949 - protein, 68 aa, Sorghum bicolor
  Clone ID: 30974057.pep
VAGLRSLFATGTYRKWWFPDRVLRDYIKLMIFNRKERAQLLERLVISDEDAAVVVPCFRQVRHIQVLY

SEQ ID NO: 57950 - protein, 100 aa, Sorghum bicolor
  Clone ID: 30974067.pep
HPRTYISSNPIYAHVQSSLIIQAIPQVQSHVHVYLLSMQYYRLSWCPLQPNYICFLYYRLCWSSSILYNIIDSVGPLLPIFVESSTDNLCGPPFDIHPHP

SEQ ID NO: 57951 - protein, 54 aa, Sorghum bicolor
  Clone ID: 30974074.pep
FLLILCFPLGFVPATVIAVKKLLLVRGRHFLRGVFQICRVTILSDLMLVIHFFF

SEQ ID NO: 57952 - protein, 110 aa, Sorghum bicolor
  Clone ID: 30974083.pep
EVKKLRAANQQLLRRLQGHAALEAEVARLRSLLLDVRGKIDAEVGVFPFQRPCSVGSVACADPALCFNGNSEVGGCWEESSRPAVADVSEGLRNSMDVVASFVSSDPLAE

SEQ ID NO: 57953 - protein, 103 aa, Sorghum bicolor
  Clone ID: 30974101.pep
PNHYQDGGPRGAAPSKRNISKSSHRSKPDVTPRMPTAKIPKHKGGYVAPLPAVNLPEEQQWPRKGMYEVDSEETEEEGDNNVEDRWNYNRAVSSDDEETEDEE

SEQ ID NO: 57954 - protein, 82 aa, Sorghum bicolor
  Clone ID: 30974109.pep
TAKITYILNSTLIDQPTNTTGKLPQETLLLLLATTRSNGAKMTAQYRADRVNTPHWYNWRRSRRVVTADSFSQKVKSISVNC

SEQ ID NO: 57955 - protein, 176 aa, Sorghum bicolor
  unsure (1)..(176): unsure at all Xaa locations
  Clone ID: 30974117.pep
PTKSPVPKSTERIHHSLTVGFSADLGRLFGDDVTPGSTRLGAICVYLACGVQFGWALQLSLLTPYVQELGIPHAFASLVWLCGPLSGLLVQPLVGHLSDRLAPAASPLGRRRPFIAAGAASIAAAVLTVGFSADLTENDPRRTRIANAYFSLFMXLGNILGYATGAYSGWYSIFPF

SEQ ID NO: 57956 - protein, 120 aa, Sorghum bicolor
  Clone ID: 30974123.pep
MQVARRRYRWVKEWVPQDLVVAGGPCTLYKWVREDRLAALKAKDKEQGAESATPEPNSEVLFLCSYEGCGKTFFDAGALRKHAHVHGERQYICHYENCGKKFLDSSKLKRHFLIHTGEKN

SEQ ID NO: 57957 - protein, 125 aa, Sorghum bicolor
  Clone ID: 30974141.pep
GAPDRAALSSKLPKLCDSVVAKPWRTTTEKRRAFLMCPRIFPLPPPSPSPSGPAPPPRPDAAAAPTGPAPYHRPSPSRRTSTRRRRRRPPSSPRCSPRTSRLGFSTRRLLLRRRRRSRSLSGGRK

SEQ ID NO: 57958 - protein, 105 aa, Sorghum bicolor
  Clone ID: 30974144.pep
MGGVLGALLHRRSGGRPPAQGTRNQHRGLTREPSTYDATAAAAGGHRKAMLSKKYSYIPDTYTSLDQVAAALREQGLESSNLILGIDFTKSNEWTGKQSFGGQSL

SEQ ID NO: 57959 - protein, 128 aa, Sorghum bicolor
  unsure (1)..(128): unsure at all Xaa locations
  Clone ID: 30974149.pep
DSLRTHALFNRSPPVSSSPRLPSFSFHVRSSAVCRLRPPPKQLRPFPHFPLASTALSGVENNGLRCVALLRXLAAPASSIPAPSLKSAPLSPPTXRSFVVRFGFRXYERLGSWVGKAPPFPGEEFGAG

SEQ ID NO: 57960 - protein, 179 aa, Sorghum bicolor
  Clone ID: 30974150.pep
MVNLVHVAMQQLVHRLAKMAGLWARTVDVDDAGTVISIWVPKDKLLRAPAAEETETERRKKEEKPDADGGRLSVVLLHGFAGDGILTWVLQVGALARHYDVYVPDLLFFGGSTSPAGGRDLSPGFQAECVAAALRMLGVERCVAVGFSYGGFVAFKMAEADPGLVVSVVATGSLVDMSR

SEQ ID NO: 57961 - protein, 50 aa, Sorghum bicolor
  Clone ID: 30974157.pep
RSPQLSSGRGDRPCALQSGGLVGSWADHCGFFTQQKLGSRGSGEGGFDSN

SEQ ID NO: 57962 - protein, 105 aa, Sorghum bicolor
  Clone ID: 30974160.pep
WITKVLRTRRLARLRRRLSLPELHCSISAPRRRLSPLDLGCSISTTRSCRPGWLLLLEVRGFVQARDLLLPLHRLAQVNHRSLNQQHQVSNRCDSKRQDLHQGTF

SEQ ID NO: 57963 - protein, 168 aa, Sorghum bicolor
  Clone ID: 30974172.pep
LCSRVSGERNGRHLQVPLSVEQGSPVKNPLYQKPLSPNEANPMKSCPSKEVGNFKEKLVEENFYLITELSEQRRVPVLLLKLNDPIPKRKPAIVFLHSSYKCKEWLRPLLEAYASRGYICVAIDSRYHGERASNETTYIDALKSAWWNGDTMPFIFDTVWDLIKLGDH

SEQ ID NO: 57964 - protein, 126 aa, Sorghum bicolor
  Clone ID: 30974179.pep
DRPSPLPPSVSSTPTTHPITSSSSSSSTPPFPRFSPPPIAAKTQSTGSDVTKQKDRWRDETRKKERSREKRRKGEVETKKLVFSPLEAEVASSAAVRERERPVACPTVDSISSPPEVLMPESCFSG

SEQ ID NO: 57965 - protein, 101 aa, Sorghum bicolor
  Clone ID: 30974198.pep
RGSMPSYWVFMHYASPYKYALDALLANEYTCAANRCFGGVVGGGGAADGSECLETGRDVLVEKGLTAEERWTGVQVLFGFFLLYRVLYWVVLSRRASRAKR

SEQ ID NO: 57966 - protein, 126 aa, Sorghum bicolor
  Clone ID: 30974207.pep
PPATFINRTATRDIKLGKLDIPAGTRLDFPIIAIHHDHDVWGTDAEEFNPSRFADGKSYHLGAYFPFGIGPTICVGQNLAMVEAKVALAMTLQRFAFTVSPSYAHAPMQMLTLQPQFGAQVLVRKI

SEQ ID NO: 57967 - protein, 120 aa, Sorghum bicolor
  Clone ID: 30974217.pep
WADSTFVAIPDLQQQVPMCPVLSLKEPNMVSFFFSDIGYVDGHVATKGEYVLSLNMKSKKIQSWSICPPGRSLEFIPRVIATDFCAYKHWSCMDYQGNVTSSKREGACHSSSRAPRKQKK

SEQ ID NO: 57968 - protein, 99 aa, Sorghum bicolor
  Clone ID: 30974230.pep
ANGGEEVLVVHVDLQLIQQSIKRPHGISRMNQGFPETRCVCICRYVSCGYGADQSVWSRGHHACMESADREQLWHAWASRQPSSVKKKKTIHQCLVHVL

SEQ ID NO: 57969 - protein, 68 aa, Sorghum bicolor
  Clone ID: 30974241.pep
SLDFILSALCTKALHNIRSKALHNIISLTLETLGKGKSQCFAERKKKECRANWLESNAHLRAFHPLYL

SEQ ID NO: 57970 - protein, 172 aa, Sorghum bicolor
  Clone ID: 30974248.pep
DPGARHLLARDPRPQPQAAAVRRGPSSSSTSRSVGRQTRGTDTEVAAIRLPARARPPAFSSSFGARRGRGRCVTLTWRCGWRTTGAPIKVRPCPCPPSSSRFGDRPLLPCPLPVFCLFLASAAAAASAVLVHLHAPAGRVVVPSDHRTVRVHDCAPLRASRERGVGTGGASF

SEQ ID NO: 57971 - protein, 212 aa, Sorghum bicolor
  unsure (1)..(212): unsure at all Xaa locations
  Clone ID: 30974262.pep
NTGVGAVLLQEGHPLAYINKPLGIKTQGLSTYEKEYLAILIAVEQWRSYLQLAEFVTYTDQKALVHLNDQRLNTVWQXRVFSKLLGLTYRVVYKKGSDNSAADSLSRRQHPVXSCCAISVVTPQWCTDIVQGYSTDSXAKKLLAKLATNAAAVPHFELVDGLLKFNXRIWVGNNTSMQQQIIQSLHSXPLGGHXGRXATLKRIQVLFAWPGL

SEQ ID NO: 57972 - protein, 171 aa, Sorghum bicolor
  unsure (1)..(171): unsure at all Xaa locations
  Clone ID: 30974271.pep
MXGIVVAICQYGGEFTSGPNGNLTYKGGEAHAVDVSRDMPLESFKDEVSKVFHVDVTDMSLKYFLPNNYRTLITISCDRDLQRMVDFTISAAQVEVFLISRVEXRSVVTYSGASAIKPGSNAPGDKRKKPPSKNKVSKSNKKTPTPSAPGTSVQPSASNVKQPRPIVTDND

SEQ ID NO: 57973 - protein, 172 aa, Sorghum bicolor
  Clone ID: 30974272.pep
MKYSKEDKPERAGGAGAGSRAVPVTLVVIVLCAFSFYLGGIYSTGRSLLDAVQPAPTTLVTLGGGGTTTTTTRRSSDNDQARPALAAVAFPECPADLQDYTPCTDPKRWRRYGNYRLSFMERHCPPPPDRQQCLVPPPKGYKPPIRWPKSKDHCWYRNVPYDWINSQKSNQH

SEQ ID NO: 57974 - protein, 152 aa, Sorghum bicolor
  Clone ID: 30974275.pep
WVRRIWSVRSRDERLACIAGPPPWSRVGIPRAPGVVQPSKPCAGVEYITHIFLWHTPSRAPSLHHNGNHHYYCHGRTEQCRRRRIIASISDDVSTTQQQEEGHVRARRAEHLLRQASRRRPRAAVARRASPEAVRRVPGAAGLHPPRRVPDG

SEQ ID NO: 57975 - protein, 189 aa, Sorghum bicolor
  Clone ID: 30974276.pep
RCLRRATARARPAAAEAGLWCGQEVAAACQHVARYPLRQVRVLFVRRRKAPEQENGHVSRCRCFAVDAVEVNVIQCPISSAAARTDRAVEPHQAAPPTCRQQHQRHREEAGAEEEGRGRRERLGRRWRRGANACRRWRRRPSAWRRCTRTATRWGGTSSAGGVVEWLRQGMRSMASKLAAAEMAGDLVP

SEQ ID NO: 57976 - protein, 166 aa, Sorghum bicolor
  unsure (1)..(166): unsure at all Xaa locations
  Clone ID: 30974287.pep
APSFVPVPAEPRRNELPRGAPRTPPVTHLRRSARFLALLPWRRGGARLRHRLRCQIQAVLNVQLPRPSCAAAAERHVRRVAADAQARAVXPPRGRPPWXPRRSLTRCARTSAGRSTYCXGVSGRGTPQLWDSKAEAATATVPCELGVQHRHAQLRGDGEPRHAGRG

SEQ ID NO: 57977 - protein, 188 aa, Sorghum bicolor
  Clone ID: 30974290.pep
MAALSSALLFAALLAAAQYVLGLLHSSLWVPLRLERRLRRQGIRWPPRSLLSGNAADYRDLLAAARSAPLPSFRHDGVVARATPQYAVWPARYGRPFVYWFGPRPRLVISDPELVKAAMTDSTGAFDKAGAGGNNPLARQLIGEGLTGLSGETWARHRRVISPAFNMERVKAWIPEIAATTSSVLDKW

SEQ ID NO: 57978 - protein, 113 aa, Sorghum bicolor
  Clone ID: 30974292.pep
PSSSPSPPRRIFCVPNASTSCSQATGGSGAGAASRGRESIGFNRSIGRDPARRCLLPPPSAPRSPTSPSPSPRPSLMNRSPRVLLQITSLYILRAGASSIHLILCTSRLRRNL

SEQ ID NO: 57979 - protein, 144 aa, Sorghum bicolor
  Clone ID: 30974317.pep
ALCIVFSCLLLAGVPSSLVVAQDPSKLSLKHYSKTCPNVEHVVRTEMECAVRADTRNAALMLRLHFHDCFVQGCNGSVLLDNTATLIGKKQAKQNVNSLKGFKLVDKIKEKLEAECPETVSCANLLAIAARDAVVLVGGPYWDV

SEQ ID NO: 57980 - protein, 226 aa, Sorghum bicolor
  Clone ID: 30974322.pep
MATATATPPQCWRGLPASARAPPPLSSPLRPRPVAANFYPLRRRIATATARGRRAALACSPRCTLETAGPGFDPLGLYEEGSDSPSRSPLSNFFGILAPVFGSSSGGGARREKASYGRGAAAAIEDSSIDIGDFFKGPLPGKFLKLLGFLALSRLGVYIPLGGVNREAFAGNLDQNSLLGTLDSFSGGGIGRLGICSLGIVPFINAQIVCQLLAQLYPKLQDLQRK

SEQ ID NO: 57981 - protein, 100 aa, Sorghum bicolor
  Clone ID: 30974333.pep
MRIEELPGDPCGGRGGEGGEDELLLPRREDGDAAEGERGVVMRVAVDAKRAAVGVGARMLFYPTLVYNVVRNRFEEHFHWWDQIDEHVLLGAVPFPSDVL

SEQ ID NO: 57982 - protein, 147 aa, Sorghum bicolor
  Clone ID: 30974334.pep
ESSGSGDSEVQRTMLELLNQLDGFEATNKIKVLMATNRIDILDQALLRPGRIDRKIEFPNPSETFRFDILKIHSRRMNLMRGIDLKKIATKMNGASGAELKAICTEAGMFALRERRVHVTQEDFEMAVAKVMKKDTEKNMSLRKLWK

SEQ ID NO: 57983 - protein, 125 aa, Sorghum bicolor
  Clone ID: 30974373.pep
GIIITSIGSCHSRELTQRFLTKFQVWKLRRPLPTLITEPQNLGVLSLFCQTVLGAQIQPSSSSLLLTQMLVHCRPSPPLLSPTPPPGILLTRPWEGSGKTIIPHSTDLHLRFRNWRTSEHGESER

SEQ ID NO: 57984 - protein, 78 aa, Sorghum bicolor
  Clone ID: 30974381.pep
GGSLPWLELGANAVADAGHVDSCYAGALDELRWSEYFDSAFQAAASQQGALQAAGQCVYGGKDDVPVHFDVHGLSNGC

SEQ ID NO: 57985 - protein, 100 aa, Sorghum bicolor
  Clone ID: 30974393.pep
AQPAILASWHFDSFRSHSVEPQTLDTQIPYRQHVPAEKIDIGPHWGTHESPEQLDVDQLFLEALVAGLYVGMGLLQAPHSVPSFSALGYGSNAKLIHSRV

SEQ ID NO: 57986 - protein, 73 aa, Sorghum bicolor
  Clone ID: 30974411.pep
VQHKIKEHSSRVWNLLLSDAVIYIAGSSTKMPADVTAALEEVICKEGGVKQEDASKWLRDLERAGRLNIETWS

SEQ ID NO: 57987 - protein, 122 aa, Sorghum bicolor
  Clone ID: 30974423.pep
EKAVEIDDLCGKDDAWWGVKGYMRDNFNHSNKAISHKEHFQNSRLVESVMDLYWELPPVAGPSLTHQTRYAPARAVDPIIEDGRYGLFRKIGLARLDASVFNGYTQMAYVQISGSMLSTDDV

SEQ ID NO: 57988 - protein, 74 aa, Sorghum bicolor
  Clone ID: 30974427.pep
QAWPLKTHLCLLDKGIASSTGFFEPFSSISCSVSYVTHNLSCSYLASKLTNDSSAILCMTCSLSSLVNSILSTF

SEQ ID NO: 57989 - protein, 39 aa, Sorghum bicolor
  Clone ID: 30974434.pep
KMSVGLFQEVNMEVAKTSNSYCTSAVSRACTVEYKSCLV

SEQ ID NO: 57990 - protein, 170 aa, Sorghum bicolor
  Clone ID: 30974438.pep
RTARMGAKGKVTSIVAKKDVALATRIEEAMKKNESLEALTTNNVRRAASPQSVSTKGRPSRLVKTSNALKVVNQKGRRGVALSSKSSRTPKDTTSTQRRSPLKSQAKTTKSAAPRKAKPLKPSQSSTKASKSKAKPEGRRSKSDALNKLGTKLSVVGFRGRSSGKSAQSS

SEQ ID NO: 57991 - protein, 65 aa, Sorghum bicolor
  Clone ID: 30974440.pep
RNMIIVPEMIGSVIGVYNGKTFNQVEIKPEMIGHYLAEFSISYKPVKHGRPGIGATHSSRFIPLK

SEQ ID NO: 57992 - protein, 135 aa, Sorghum bicolor
  Clone ID: 30974470.pep
MIATTGSSAKTAAAAAVGGKSARACDGCLRRRARWYCAADDAFLCQGCDTSVHSANPLARRHERLRLQPAAASSPLHTPPRSTGAAANNKRERHDEAVPAWFRRKARTPRGGHAKSVGQALSRSRRPGVVVPHAA

SEQ ID NO: 57993 - protein, 159 aa, Sorghum bicolor
  Clone ID: 30974483.pep
MRCRGGCRSCRGCSGPSPSNCLRVGDVEGHHEDVLRYWSAQAGSGKGRRPAAAGPRTEEQPGRMTRAAVAGAAGRSSSRRGGWPEQQSPGRLGRMAGAGRERGRPVGQQGPGRGSRARSGRAAGAAPCGAGGAPGAVACGGRGGGVCSSAAQGGGRRRG

SEQ ID NO: 57994 - protein, 128 aa, Sorghum bicolor
  unsure (1)..(128): unsure at all Xaa locations
  Clone ID: 30974489.pep
MLILVFLLFSSVDLQISGATDTLTLGQSLPWNQTLVSKGGNFELGLFSPGNSKKHYIGIWFKKVSKQTVVWVANRDRPILDPSASRFTLSDRGELLLHTTPSXNTLLWSSNASSPSSPPRTTVATLQD

SEQ ID NO: 57995 - protein, 91 aa, Sorghum bicolor
  Clone ID: 30974505.pep
MAPSSAEADSPASASGRLLVLYASQTGNAMDAAERVGREAERGGCPAVDVLSMDSFDPSRLPSERFVVFVVSTTGQGDPPDSMKGFWRYLL

SEQ ID NO: 57996 - protein, 163 aa, Sorghum bicolor
  Clone ID: 30974518.pep
MGVRVVVTMTTAAAAACCLLLLQLFVGCVAVAAALPTKGGGAGGDDYLRYKDPKQPLNRRIDDLLRRMTLAEKIGQMSQIERENATADVVNKYLIGSVLSGGGSVPAKNAPPEAWVKMVNGMQSGALSTRLGIPIIYGIDAVHGHGNVYKATIFPHNIGLGCT

SEQ ID NO: 57997 - protein, 165 aa, Sorghum bicolor
  unsure (1)..(165): unsure at all Xaa locations
  Clone ID: 30974523.pep
MHDIGLSARAAGATSCSSAAAGDGGDESKTRKAHPGFVAAYTRLHSSHRAVVSLLLLLTVAVAAFLWGRARPSVDCAPPRLDARFLALPDAAAASDFGSLGVPWCRSKTGKTVEWMSKDLLNGLEEFVPIYETRPIKNNMYGMGFDHSFGLWFMARWLXPDLMIE

SEQ ID NO: 57998 - protein, 112 aa, Sorghum bicolor
  Clone ID: 30974529.pep
HRTARPLPSLPVRSLALRDSCGDLDLDLFLCALPSPLQFSLSLRSSRPYLLHASCTPHQERAPTPSSLRCRTQSKLSVRTPAAAMPPLRRALPRHHTTTLSGRRHTAIAAHL

SEQ ID NO: 57999 - protein, 84 aa, Sorghum bicolor
  Clone ID: 30974551.pep
SDLKQDMIGEVQKEFDLILRIRPWHESGLSIYLFCGFGLSRKFSSAGCATHETAYCLFLGLFFREKSLLRLQLDTSAAEAVSLR

SEQ ID NO: 58000 - protein, 126 aa, Sorghum bicolor
  Clone ID: 30974557.pep
NHRPFSNSHSSTKVQNSNANSPSSSPSSNPGPQIEGPPGANLFIYHIPQEFGDHDLANAFHSFGRVLSAKVFVDKATGVSKCFGFVSYDSPASAQAAISVMNGYQLGGKKLKVQLKRDNSKHNKPF

SEQ ID NO: 58001 - protein, 134 aa, Sorghum bicolor
  unsure (1)..(134): unsure at all Xaa locations
  Clone ID: 30974576.pep
MYTPYPDSESLKTLNGQATSDLXCTLNFPIQLYQIQEPESRATXNVHRPLDRALLLAVTAAGVAEALHRGDVLVVHRGELRVAVPRRSDSVAPKHITEGEEDESKELEVGELLGALLRGARMAVDVAVGVTRAP

SEQ ID NO: 58002 - protein, 117 aa, Sorghum bicolor
  Clone ID: 30974580.pep
CHRPLASMAWNSSAERWLCSRMSSLNLRMKSSALRSTSPIPFTTPSTPPPLPGLRSSTFLIAPTPAAMARACCCCCCLPLPPPAAVSRAGAVAGAAAAVVASCLLSRALVLGSCCCC

SEQ ID NO: 58003 - protein, 71 aa, Sorghum bicolor
  Clone ID: 30974592.pep
VQYYEKRGKLRKIDGAKSPDAVFEDVKAIFSQLNTTQENQGSSMSSRVQSNPLKRFLDLLCGCFGTQEARS

SEQ ID NO: 58004 - protein, 159 aa, Sorghum bicolor
  Clone ID: 30974605.pep
MKDLAGLGHLFVVTFLFHFASFMVIPAVTDVTMEAVCPGRDECSVAIYLTGFQNAVTGLGALVVTPIVGNLSDRYSRKALMTLPVTVAVAPLFILACNRSEVYFYVYYVAKIIAGIFCEGTMHCLCLAYVADHVGPRRRAAAFGLLSGVSAAGFVSGTL

SEQ ID NO: 58005 - protein, 185 aa, Sorghum bicolor
  Clone ID: 30974611.pep
MPRCVSTVRDRCLELERIIAARARSGSLGLDDALKLFDELLIHARPASVVAFNQILNAVSRASRASGRRSSSTSESELVVSLFNRMVRECSIKVAPTTCTYSILIGCLCRMGRLKHSFATFGLILKTGWRVNDIVINQLLKGLCDGKRVGEAMDVLLQRMPELGCTPDTVSYSILLKGFLHENRA

SEQ ID NO: 58006 - protein, 152 aa, Sorghum bicolor
  unsure (1)..(152): unsure at all Xaa locations
  Clone ID: 30974613.pep
MADAIKSQVGSFPPGKKITVVFVLGGPGSGKGTQCSNIVKQFGFTHLSAGDLLREEAKSDTEQGTMVKNLMHEGKLVPSELIIKLLLKAMLQSGNDKFLVDGFPRNEENRQAYESVIGIEPEFILFIDCPKEELERRILHRNQGRDDDXIDT

SEQ ID NO: 58007 - protein, 186 aa, Sorghum bicolor
  Clone ID: 30974628.pep
MVEMRQRRKPLVLASTQALLDSLPGDRPPPPPLEPVCLRTGVLRFPSGPGAGAEFGELASFVALPASALRRLTVVTGTPVLVKNTDNNVGRIVKAVLFDDMSLRKSHSEYTDQVVSASPSDRAMGFLPCRMFPATGLASRDEVVAYVSPLLAFNLGLHVSCPQLLIQRGGQPFKFCSRAEEIDATA

SEQ ID NO: 58008 - protein, 215 aa, Sorghum bicolor
  Clone ID: 30974638.pep
GPVSCRPSTRRQTHAMHLQAGGAVHLHLLQYFMPQHQPQESATDLEAQESAVCRRSRSSTSPAPATMWEYHQQAAHAAAALQTASSPASSFPSWSPYAGTTAALLGSSSAFATDAGSSPPGMRLPAAGEHAVHGHAWSQHGEQSNITCYKENFLDLLASKNVTQEMFEDVPAGHYAAQAMSGRFGAAGSDVAPIKYEVTAGSSPLFFRSTTTGMH

SEQ ID NO: 58009 - protein, 235 aa, Sorghum bicolor
  Clone ID: 30974650.pep
YSIDGAGKTGKLRFAEGDVEALLVFFDKMQAQNSNFFYNWDMDDEGRLKNVCWVDARSRVAYQHFCDVICFDTVYLTYQFVIPLVAFLGINHHGQFVLLGCGLLGDESPETFAWLFKKWLKCMNDKAPEAIVTTHSRPVVKAVSEVFPNTRHRYNLWHIMKELPEMSGRVEDKEAVSLRMKKVVYDTITSADFEREWVEMINQYNLHDNQWLTTLFEERAKWVPAYVKDTFWAGI

SEQ ID NO: 58010 - protein, 193 aa, Sorghum bicolor
  unsure (1)..(193): unsure at all Xaa locations
  Clone ID: 30974656.pep
LATPAGSNGGGRRRQGPTAAAAGGGRRGVRWRRGGGAQXESVKLFVGQVPKQMSEAELAALFRGVALVDEVTVIRDRATRVSRGCCFVICPSREEADKAVTAYHNKRTLPGASSPLQVKYADGELERLEHKLFVGMLPKNVTDAEMTDLFSKYGNIKDLQILRGSQQTSKAGCAFXKYETKEQAVAAIEALNG

SEQ ID NO: 58011 - protein, 125 aa, Sorghum bicolor
  Clone ID: 30974659.pep
VSAISSREGGRPARKGSGGAALAARWWCPSTCLQSACYTECKASAAFWHEAYINRLTQLSLLDVYLHNNLVQKMDAFTHVPPGFRFHPTDEELVDYYLRKKVAMKKIDLDVIKDVDLYKIEPWDL

SEQ ID NO: 58012 - protein, 179 aa, Sorghum bicolor
  Clone ID: 30974675.pep
KSHLISSIHLRITPLLCTSHTPRSPEHLHLSPIGPRRWPPSSLSLSLSLSLSLRRPPTVADARVVAHRSIANQAKPPFPERGRTRKVNNSLHLLSLRQPRPPRSSGRVARAQVNAAGVRARASPCGAADRPTQSTTSRSIRPSGRRTTIGSFKGHVLPGTLFLLVGLWRVWCSASRHAA

SEQ ID NO: 58013 - protein, 166 aa, Sorghum bicolor
  Clone ID: 30974679.pep
TDKPKQSISLLHPHTRTLSLSRSRIISFRHPMSCFGVTTMPTTTDTYYYASSSSSGRPAGPGGGGGRRAVAVVACQVRRHRGGRRVQAPEVRHRGRRRPPPSAHVVDLRALLAERLVPPPPPTELRAGLRRRPLQPPPPPAAAAASSQGPPRRRAAAAGAEHQRPR

SEQ ID NO: 58014 - protein, 106 aa, Sorghum bicolor
  Clone ID: 30974690.pep
DPVGNLRKLAAFMGCPFSAEEETPGGGGGVVDQIVELCSLENLKSMDVNKNGTTTVLGVTNDAFFRKGKVGDWKNYMTPDMAARLDKVVEEATRGSGLTFADSISV

SEQ ID NO: 58015 - protein, 133 aa, Sorghum bicolor
  Clone ID: 30974696.pep
MRKKAQERKRNMSPSSSSSSLTYQSGYPDTPSTIGVEGQELHGGSGCITSILKGTPPDMDGYPMDQIWMEIEAPEVPSEVGFVGGNENVCSSLATPLPPPTVWEYYPEACWKIDDEIKMAPQFSYSEGAGPCF

SEQ ID NO: 58016 - protein, 105 aa, Sorghum bicolor
  Clone ID: 30974702.pep
DALMSTEDGDDEDDVLSTGRTPGCRAGGSPDSTCSSGGYAGGGRKHETGGGEKKKERMKKMVRTLKGIIPGGDRMDTPAVLDEAVRYLKSLKVEVKKAGARGSSS

SEQ ID NO: 58017 - protein, 195 aa, Sorghum bicolor
  Clone ID: 30974706.pep
VAAHQPNEITFDDDENQSSFVPQIGDKVYIQGLGGGTMATVVETFGEDESCMVQYGKIKVRVKRNKIKLVQRGINNEATTSSSVKAKGRTPKQRSATTAEADRNQDGGGSISFGPVVQTSKNTVDLRGKRVSEAAYELQMAIDACRTYQVLFVVHGMGTGAVKERAIDVLRNHPRVAKFEDESPLNYGCTVAYIQ

SEQ ID NO: 58018 - protein, 61 aa, Sorghum bicolor
  Clone ID: 30974709.pep
MRNHDLMHQVALYSLWITDSFEGQCASLSGVVVSPLKTRLLDNQHLPSLKSANQAQTRGKS

SEQ ID NO: 58019 - protein, 48 aa, Sorghum bicolor
  Clone ID: 30974721.pep
HEVYGGDKIFASVRLVLAGNFCVSQASVFFKNFSFIFLQVLLGLYVSC

SEQ ID NO: 58020 - protein, 64 aa, Sorghum bicolor
  Clone ID: 30974741.pep
IASFYNRARFATIAPAIPVADAGGDNYPSFVFGDYMEVYVKQKFQAKAPRFAAMAAAAATTTTK

SEQ ID NO: 58021 - protein, 121 aa, Sorghum bicolor
  Clone ID: 30974755.pep
LACVLALPVLTLISFALGLASSAFLADSVFGVSVSIILESARRALRPWDLISSLLKSQVFGAIIAVVSCAWGVTTHGGAKGVGESTTSAVVVSLVGIFVADFALSCLFFQGAGDSLKYAMG

SEQ ID NO: 58022 - protein, 138 aa, Sorghum bicolor
  Clone ID: 30974773.pep
MAPGVGGALRLWGTTTTTGARPDMSRLWTTRLQKELEGLWADPPEWCVPGADATDLFHWQVVVVGPRGSPYDGGVFAVRFKFPRHYPLKPPKVTFATKVYHPNIDPRTGRVCLDFLTDSKHWWTPAWTVDKILLAVVS

SEQ ID NO: 58023 - protein, 142 aa, Sorghum bicolor
  Clone ID: 30974777.pep
MTSGAALLLRPTSATTHPLLHQSSPKPYFLRLHPSCRRRRRLPVPRLSLTPTTASNNSPPPPSPSAPPTAPAAPPSLFSNWSPPRAIWRGLSALLLAGQVFHRVLTGRVHRRNLLAQLRRVGPGSAGVALLTAAFVGMGFTI

SEQ ID NO: 58024 - protein, 178 aa, Sorghum bicolor
  unsure (1)..(178): unsure at all Xaa locations
  Clone ID: 30974779.pep
MDPKAAAKSKRSHTVHGRRVHQTPAAAAAHRQKRAAAANTSSGPRSRNLPSNWDRYDDEGEAEESAAVGEWTGEVAPRSKGADFGFLLEQARAQPPGARDLSAPCLPSQDLPFDFMQASTSMFEAKSEGILSWCADDNFILEDDXSTRFEVPFLSMDLNALANHLSKIKLSRRLFIEE

SEQ ID NO: 58025 - protein, 163 aa, Sorghum bicolor
  Clone ID: 30974789.pep
MSTTTCYSAPAAVVPGAGGEVAVVTAVASEAGAAAAHDQSRKKKNNHRSLYANLPAAEIIDSLPLETRFPVPHRLYGGFWKAEFLLKGMAAAAARTTSCFEFEPNPSDIFLASLPKSGTTWLKALAFATLNRRTHPPSNADGQHPFSHRNPHDCVSFLELMAS

SEQ ID NO: 58026 - protein, 105 aa, Sorghum bicolor
  Clone ID: 30974795.pep
NWSQQAHRERRARRPAPSRYKVGVSSVRQFSSYHRVDMVTVREETRKGPWTEQEDLQLVCTVRLFGERRWDFIAKVSGLRGLNRTGKSCRLRWVNYLHPGLKRGR

SEQ ID NO: 58027 - protein, 169 aa, Sorghum bicolor
  Clone ID: 30974805.pep
MAATGKLTLLLPVTLSSRSSHCTRGFMQSPRRQLPQRLTVTAAATETSSYNLPSRSSPETPEARQIRLETESALEWGGVCERLAHFASTAAGRAACEGRRVPVGRSREESERFIDQTAAAVLLPTPLDFGGVEDVSALVAAAASGRAVAVRELCAVGRSIRAVRAVFDQ

SEQ ID NO: 58028 - protein, 141 aa, Sorghum bicolor
  Clone ID: 30974808.pep
TNWEADKMLDVYIYDYFVKRNLQATAKAFQAEGKVSSDPVAIDAPGGFLFEWWSVFWDIFIARTNEKHSDVAASYIETQLIKAREQQHQQPPQQQQQQQQQQQQQQQIQMQQMLLQRAAQQQQQQQQQQQQQQQRRDGSLL

SEQ ID NO: 58029 - protein, 121 aa, Sorghum bicolor
  Clone ID: 30974809.pep
MGRARFLLPLLLLAVAGLAPAPAAAATAMTADAGVILDLAKSLTNPPPSWTGTDVCGGVSFSGITCDGAGRVTGINLVKLHLSGTLPSSFANLTALQSLQLQGNVLEGDVPSLARMGSIET

SEQ ID NO: 58030 - protein, 94 aa, Sorghum bicolor
  unsure (1)..(94): unsure at all Xaa locations
  Clone ID: 30974811.pep
PLRFAVLPTDGGGDDMSRXXXSPPSPSFFLSLPAGGTAAAASAAAGGGASSSMGSGPGGASMVGWTDRSVSRVPPRRCATASRATSSMFWGCVR

SEQ ID NO: 58031 - protein, 170 aa, Sorghum bicolor
  unsure (1)..(170): unsure at all Xaa locations
  Clone ID: 30974813.pep
MATSALDSLPAPLRSLRLKTKQQELLLRVSALALIYVLAFAVRLFSVLRYESMIHEFDPYFNYRTTLFLTENGFSEFWNWFDSESWYPLGRVVGGTLFPGLMVTAALLHRLLRALSLAVHIREVCVLTAPFFAANTTLVAYAFGREIWDSXGAGLVAAALIAIVPGYISR

SEQ ID NO: 58032 - protein, 169 aa, Sorghum bicolor
  Clone ID: 30974819.pep
ELQSSYHYLFWAAILLLPLLAVNVKLRRRNHGNKPPPGPWQLPLIGSLHHLVGALPHRAMRDLARRHGPLMLLRLGELPVVVASSPDAAREVMRTHDAAFATRPRTATLRELTRDGLGVAFAPHGEHWRQLRKLCVTELLSARRVRSLRGGREAEAANLVASVASSSSS

SEQ ID NO: 58033 - protein, 174 aa, Sorghum bicolor
  unsure (1)..(174): unsure at all Xaa locations
  Clone ID: 30974845.pep
AATPPTRTDLPSQTETNQPPVPPDGVRRRXLLPLPPPPAAAPASTRAVSARHHGGRTAPELSGPTPRVVVVTSGKGGVGKTTTTANLAASLARLNLPAVAVDADAGLRNLDLLLGLENRVHLTAADVLAGDCRLDQALVRHRALQDLHLLCLSKPRSKLPLAFGSKTLTWVADA

SEQ ID NO: 58034 - protein, 144 aa, Sorghum bicolor
  Clone ID: 30974852.pep
ALLAKLGIRPFSYGLQIVNVYEDGSVFSPEVLDLTEEDLVEKLSAGVSMVASLSLVVSYPTLAAAPHVFINGYKNVLAVAVETDYSYPHADEIKEYLKDPSKFAVAAPVAAADSGASAAPKEEEKAPESDEESDGEMGFSLFDD

SEQ ID NO: 58035 - protein, 74 aa, Sorghum bicolor
  Clone ID: 30974862.pep
PPLPQVPPLPRFPPLPSLYSPPPPPPPPPPPPPSFPWTFPPLPFFPPGSSGPSPPPLSRSRKDPGTWSPSNKQP

SEQ ID NO: 58036 - protein, 168 aa, Sorghum bicolor
  Clone ID: 30974899.pep
YSTLLPGVPEAQARMLVIASVATLENLNNGMVRPKERLDAELFYLQRALSTPVEGRDAEYPRWTLLKEKYASVVLSTDEKSEGGALSVMLRLSFRFIGKEVVTRTLPSTLTIAKLKSLINTVWKDADPRKQQLRFTPADACGAPPQDLNDDLSTLGYFGVGDGAVIDV

SEQ ID NO: 58037 - protein, 172 aa, Sorghum bicolor
  Clone ID: 30974907.pep
KIGSYAVVGNGSHVCISVDGRGTYFLDTARHTWDKVGDWTLPFVGKVEYVPELKLWFGISAYDQHLAAADLSTTDSQPQLVHGWMEFQPPEEWFQHGDPQLVNLGSGRFCIARFFTSFFEDDYAQEVSVLTGLEVVLRELNGNGKVKLEMVRHKSMRHTSIPGCRNSIDLVF

SEQ ID NO: 58038 - protein, 113 aa, Sorghum bicolor
  unsure (1)..(113): unsure at all Xaa locations
  Clone ID: 30974921.pep
MATEVNQNFFAWSQEETSMQDLSQGTSQMFGHGSISFGRFDLESLXWEKWSVFTNDRRHEEFGKFNGLVAKKKAYFEEYFKRIRELKALQQQNQQTELHLEYCGDGSDSSQTG

SEQ ID NO: 58039 - protein, 115 aa, Sorghum bicolor
  unsure (1)..(115): unsure at all Xaa locations
  Clone ID: 30974923.pep
MTSFLTALRDRYGAVDTTAYAESDFLVSTQKKKIQKKWEMVGLEQTREKQSQHAKLTVVSLPXAGIQVAEEAAGEIAEAKLARLRDLDLSHNPFASFSEVERILLSLPXLKELQL

SEQ ID NO: 58040 - protein, 132 aa, Sorghum bicolor
  Clone ID: 30974934.pep
MSGLSRRFLNLIVKSHDSAVRSLRCIDLKRLQLFNPTIPPRTPPRTMQTFGLPSPNPNFKACSADAVDKQGVACYTLAQGKVLCTDQCRRNFLYDASTHQVVTMPEFHRPRLNSLSLFIPSGEGKDKDDNDR

SEQ ID NO: 58041 - protein, 69 aa, Sorghum bicolor
  Clone ID: 30974938.pep
APLTQTAVPKILARLRGLLTSTLSSLSLIQGIRDGWRHQATVAADFTFSFFLDEFELRNIYISQVILDG

SEQ ID NO: 58042 - protein, 37 aa, Sorghum bicolor
  Clone ID: 30974995.pep
HRMMTMSLSLFHIHCCEGSLGLSVSVTHGRALFIYEF

SEQ ID NO: 58043 - protein, 119 aa, Sorghum bicolor
  Clone ID: 30975053.pep
IEPHFSSSSKDEDSSSLETIVKCKEAEAKLFQKLADDARKEVDSYRQIVRAKTQKLEEEYATKVAKLCFQETEEKRRKKVEELKLLENSHYDYHKMKLRMQTEIQGLLERMEATKKMWV

SEQ ID NO: 58044 - protein, 198 aa, Sorghum bicolor
  Clone ID: 30975072.pep
VSDPVPAMAQVLQDFPSETLEVLRETVRSMIDAPEKRDELSSLQRKLERRSDLTAEVLGRANKTQLEILVAIKTGMTTFVTGKGRVSSSELVETFLLKRCRNMNCKSVVPVDDCECKICSTKKGFCSACMCPVCHKFDCAANTCSWVGCDVCSHWCHAACALEKNLIRPGPTLKGAMGTTEMQFQCLGCNHASEMFGF

SEQ ID NO: 58045 - protein, 181 aa, Sorghum bicolor
  Clone ID: 30975104.pep
LESSDSEDELDGQVAPYRLMEKRDLAKSILLELEREHHLKVQEEVRNKLASLEVCHQNEIQRTISAFARLQKYAESRKEIDRRLDVHFQRRIAEVLDKHLSMVQRDHEQKSQIVERRIRDDAALEEAKRKEQAVKEEKLRQERARQEAEARQKEAAKLAAEARKTAFEAAKKEAAEKEAAE

SEQ ID NO: 58046 - protein, 47 aa, Sorghum bicolor
  Clone ID: 30975166.pep
ILVPVLDTNFHMFSLHTPLVIYSYSGKLWELVLGLRSLLGLGALATS

SEQ ID NO: 58047 - protein, 45 aa, Sorghum bicolor
  Clone ID: 30975170.pep
GHKPTLPQTVKIYSNLYNILNLHTTDLAYPARGIFIRVIRGLKKT

SEQ ID NO: 58048 - protein, 131 aa, Sorghum bicolor
  Clone ID: 30975177.pep
MEQDDAGDHEEDEDDGVHTQDAWEDVDPDEYSYEELIALGEVVGTESKGLAADTIASLPSVTYHAQDKQDGNMEQCVICRVEFDEGESLVALPCKHPYHSECINQWLQLNKVCPMCSAEVSTSANNVNKQA

SEQ ID NO: 58049 - protein, 202 aa, Sorghum bicolor
  Clone ID: 30975190.pep
MQSKSSHTGKKPKAKSHRGARDNLPEGSYGSKEQDTLENGSGFGDTRPKEKPWKYDSERDSDAPGISRREISSSVKHDKHLASEEQKMHIPPPVTVSTANAAPTHAAPVVIEEHWVSCDICDKWRLLPYEMNPSNLPKKWKCSMLYWLPGMNRCEISEEETTNALNALYVPAPANGIPAVGHPHVASSGLVTSNIPNMNGHM

SEQ ID NO: 58050 - protein, 205 aa, Sorghum bicolor
  Clone ID: 30975192.pep
NIMADYPTVECTSSVMEALVLFLEVNPEYRSKEIREYVSKAATFIENNQKKDGSWYGTWGICFIYGTLYGIKGLVAAGRNYENSICIRKACEFLLSTQLRTGGWGESYISCERQVYVEGPSTHAVQTAWAMLALMYAGQMERDPTPLNGAAKVLINMQMETGDYPQQEHVGNTNSSVYFNYPNYRNLYPIWALGEYRRRLLAKNE

SEQ ID NO: 58051 - protein, 174 aa, Sorghum bicolor
  unsure (1)..(174): unsure at all Xaa locations
  Clone ID: 30975194.pep
MDGSSKRIDGGGAEKPSPDNDQNQNASPNVPAASAAGDDGASVAAAAAAAAAPPADGRRPFTSLSQEEADLALARVLQEQERAYMMLTGGEYAISDAGSYDYDEEGEDDDDGSDYXEEGEALDEDEQVGDAEAEGAEGDQDLDLDPAQYEDDEAFARALQDAEERDVADRLMAL

SEQ ID NO: 58052 - protein, 232 aa, Sorghum bicolor
  unsure (1)..(232): unsure at all Xaa locations
  Clone ID: 30975199.pep
FWCFXRMAYMPIAFLYGKKFVGPITPTILALRGELYSLPYDKIDWNKARKTCAKVDTRYQLSAIFNATASCLNTFVEPFLNCWPLNKLRERALSHILEHIHYEDETTQYIGLHPVSKALNIIVRWVENPNPDVLKRHIARIHDYLWIAEDGMKTKIYDGTQNWEIALITQAFLSADIGNDYGSTIKRALTYXKKAQVIRNPPGDPNYWFRHRSXGSWTLSTVDNGWASSDCT

SEQ ID NO: 58053 - protein, 127 aa, Sorghum bicolor
  Clone ID: 30975211.pep
MLSVRRRQEDAGVRVAAAAPAQQPRGGLGMDDDAELEEGEACGDDTAFVDPDVALSYIDEKLQDVLGHFQKDFEGGVSAENLGSKFGGYGSFLPTYQRSPLPQTRSPPKAANVTSKSPFHQSSEGMS

SEQ ID NO: 58054 - protein, 179 aa, Sorghum bicolor
  Clone ID: 30975220.pep
MLLLLLIAVLTAVAAFLLFKFATVVDGDLTLVSRGPPRRDRVDGKVVWITGASRGIGEVLAMQFANLGAKLILSARTKDELERVKKNILSKNPDSRVEVLPMDLSAGEESLKEVVHVAESFFSNAGVDYMIHNAAFERPKRGALEESEEGLKATLNVNVFGTITLTRLLAPYMLDRGTG

SEQ ID NO: 58055 - protein, 65 aa, Sorghum bicolor
  Clone ID: 30975235.pep
ISVKWIFKLVQCNRALFKFHWQNLQNLQKVSIMHDRQKSLPQFLVPGRGGHSMSSKGGSSYPDLI

SEQ ID NO: 58056 - protein, 74 aa, Sorghum bicolor
  Clone ID: 30975249.pep
VATYEDDEYNSQEEKPPAAAAAAAGFGFGNSPMRMHPHRLSIDPSYSSPVDRCQSERHRGAGVKKAQEADDVCI

SEQ ID NO: 58057 - protein, 178 aa, Sorghum bicolor
  Clone ID: 30975250.pep
MEAADEENALLLHLQPTPQAVASGYASDGSVDINKQPALKHSTGNWRACYTILGVGFSECMVFSAIATNLVTLLTTVLHESKVDAARNISSWAGVCYLTPLLGAFVADSYLGRYWTMVVFLPVYIVAMLVLIASASLPTLFHSDVHPAVVYLGLYLAAIASGGVKPCISAFGADQFDV

SEQ ID NO: 58058 - protein, 122 aa, Sorghum bicolor
  Clone ID: 30975326.pep
RELAERAVLAVPFATDGNTPELRLDDGGDEDVIDAGDDVARRSKRLWQLTPVYITEWAQWLDDQKKLAGVPSDSPVYLSLRMDGRVRGSGVGYPPWQAFVAQLPPVKGMWSGLLDGMDGRVL

SEQ ID NO: 58059 - protein, 76 aa, Sorghum bicolor
  Clone ID: 30975379.pep
MARPDVLLLVAVAAAALLAAAVPGTQGFYLPGSYPHKYNPGDYLNVKVNSLTSIDTEMPFGYYSLPFCEPRDGVKD

SEQ ID NO: 58060 - protein, 102 aa, Sorghum bicolor
  Clone ID: 30975399.pep
MSDSASMAAAIEARFSSRDLIGRGNFGDVYKGFDKELNKEVAIKVIDLEEAEDDIEDIQKEISVLSQCRCPYITDYYGSYLHQTKLRIVMEYMAGGSVADLL

SEQ ID NO: 58061 - protein, 122 aa, Sorghum bicolor
  Clone ID: 30975400.pep
MHVQVTLALQPMFKRSVTFLTRDDSDMTEKVSVWGRLHEFGDMTWLPYQRKVVYRQDDRVDVATPGDAINDFLGFRAQAKLSQFTARLLGTAYIFPYWFTPSIPNYKSFWYILIYYICRYNI

SEQ ID NO: 58062 - protein, 56 aa, Sorghum bicolor
  Clone ID: 30975409.pep
MSEGTANCVDILIAIILPPLGVFLKFGCGHQFWICLLLTFLGYLPGIIYAVYAITK

SEQ ID NO: 58063 - protein, 162 aa, Sorghum bicolor
  Clone ID: 30975422.pep
MMVKCDPRHGKYMACCMMYRGDVVPKDVNAAVATIKTKRTIQFVDWCPTGFKVGINYQPPTVVPGGDLAKVQRAVCMISNTTAVAESLSRIDHKFDLMYAKRAFVHWYVGEGMEEGEFSEAREDLAALEKDYEEVGSESVDGAGEGEGDEAAPQDAPAGADG

SEQ ID NO: 58064 - protein, 67 aa, Sorghum bicolor
  Clone ID: 30975441.pep
RVTKPCLAAYAHLSTEDFKKDLEECQRLEPTDNTNLELDSTNEFRLSQIEFSQDSFTTWAVGKMTDD

SEQ ID NO: 58065 - protein, 116 aa, Sorghum bicolor
  Clone ID: 30975449.pep
YYNISLQGELGMRQFETPMFCSQEPFPLFWLPDEVACPVYFSMIDARLWRVECYHQWSVFDFNRSSSDGSALHSQQLTDMCSATLGAILFDVIHNFLKTMEDLCCCCHQVSYDAEI

SEQ ID NO: 58066 - protein, 35 aa, Sorghum bicolor
  Clone ID: 30975454.pep
GSHSPPLWSPFSALQREELIAHQICHLVNRFDYVC

SEQ ID NO: 58067 - protein, 105 aa, Sorghum bicolor
  unsure (1)..(105): unsure at all Xaa locations
  Clone ID: 30975469.pep
DSTGHDSIPQKLLFETDPNSRKYFDWTKXEFFSPNRISDRSMSSWEIEVIPXIXXLSTCHSSSWINRNPPKQLHKWKKQEAGRKRESRTADSEHPTPGNEPQRAT

SEQ ID NO: 58068 - protein, 162 aa, Sorghum bicolor
  Clone ID: 30975505.pep
MREVISIHLGQAGVQIGNACWELYCLEHGIQPDGQMPSDKTIGGGDDAFNTFFSETGAGKHVPRCVFVDLEPTVIDEVRTGTYRQLFHPEQMITGKEDAANNYARGHYTIGKEIVDLALDRIRKLADNCTGLQGFLVFHSVGGGTGSGFGSLLLERLSVDYG

SEQ ID NO: 58069 - protein, 124 aa, Sorghum bicolor
  Clone ID: 30975536.pep
MPAPPLPSLPKPQPILHVAKALVLSPRQAQPQARGRGRAQPVMCASSKRLDDALSAGFVRLLNAGHVQDADSASGTDRRYDPKPGDFAVGVVVSGTEARLDVAGGADRLAPLLAKELLPLDRHS

SEQ ID NO: 58070 - protein, 73 aa, Sorghum bicolor
  Clone ID: 30975550.pep
HMYTCIHWGGIIQHVQSLPSISIYLSISPHTLSKIRGHIFSHVGYNQALKHKNLYTHMHGHGYIFGLCTIPHI

SEQ ID NO: 58071 - protein, 127 aa, Sorghum bicolor
  Clone ID: 30975563.pep
AAREATVPDSQPTEINAKREKDHTTCKADLPCERWWKRKTTYLFHHIKGVTTVCSVVAAGAVVGFVVMGQRWQQDHWHLHQFKFSVSGESMSRVIGAFSRLRDGLPGSEQLRSLLPTRVLPQQPLSA

SEQ ID NO: 58072 - protein, 90 aa, Sorghum bicolor
  Clone ID: 30975603.pep
YMARYNASLAKEATLEYVKLAKKHGLTPVQLALGFVRDRPFTASSIIGATTMDQLKENIDAFTSTPRPLPQEVLDGIEDLFKRYKDPAIL

SEQ ID NO: 58073 - protein, 61 aa, Sorghum bicolor
  Clone ID: 30975605.pep
SIPSNSQRIPIITVDRLLEARNSRDGSDISSPPLTPLSLTDLSQQQGTKTTTSRTRMNGAL

SEQ ID NO: 58074 - protein, 227 aa, Sorghum bicolor
  Clone ID: 30975623.pep
SCPPSLASRTNSIPPRLRAPTSTTPFAVEISRARARARPLAPAAWRRGIGRRSTASTEDPSRGAVTVGLPPAWVDVSEEISANMQRARTKMAELAKAHAKALMPSFGDGRDDQRAIEVLTHEVTDLLKRSEKRLQKLSMKDSSEDSNVRKNVQRSLATDLQNLSMEFRKKQSSYLKQLRQQKEGQDGVDLEMNINGTKSTFEDDEFDDVGFTEVQMSKLKKSEAFTR

SEQ ID NO: 58075 - protein, 115 aa, Sorghum bicolor
  Clone ID: 30975627.pep
KGNFISVQQMAMPSFAVTSPPSHGGTLSALHARHPQRLHKRKVHSQVKAVAQTQLQYQKLGDSDLLISEVTLGTMTFGEQNTEKEAHDIIAYSFDQGINILDTAEIYPVPVNKET

SEQ ID NO: 58076 - protein, 127 aa, Sorghum bicolor
  Clone ID: 30975629.pep
MKSPLRRLRGFGHHHPKERRGHEPPPAKLDELVCAAHEVEDMRNCYDGLISAAAATTNSVYEFSEALEELGGCFLAKTALNGDDDDSGRVLMMLGKVQFELLKFVDTYRSNIIYTITTPSESLLKEL

SEQ ID NO: 58077 - protein, 117 aa, Sorghum bicolor
  Clone ID: 30975637.pep
AAEGASLPTAASTALQQLKAAGVRSFDGGSGSGSGADSNVPKNVLVTAASGGVGHYAVQLAKLAGLHVTATCGARNLGFIAGLGADEVLDYKTPEGATLRSPSGTRYDAVEHCATGA

SEQ ID NO: 58078 - protein, 101 aa, Sorghum bicolor
  Clone ID: 30975638.pep
RPQPAKRRRRHIHKVATTRGRRRLRADSRAATARSRARDLPSPDPRRGPRRRLLSPTTRTTRLQAGRARDGAAHGGRKKKISMTLSPSFISLYILCMHAVN

SEQ ID NO: 58079 - protein, 55 aa, Sorghum bicolor
  Clone ID: 30975641.pep
YNVVRIRMQVVSENSIGGCRLGYYLGEGGSHVAYSREDTGPYMPTLWNYEKIIFL

SEQ ID NO: 58080 - protein, 178 aa, Sorghum bicolor
  Clone ID: 30975643.pep
EFRSIGPAPIPIPAPPSIRSLVDSVSDERVNVDIVASHQSENGSISTASSTGSLESEKAAYEFLAQTPVRSTDAHLVEFSEAMRTVAKALRRVAEGKAAAQAEAAEWKRKYELETAHKQQSKIKGYNSCISNDLDKLASQLTLETPAPDQLGCCGKHGICAHEVLQDEVPGPIPRSNH

SEQ ID NO: 58081 - protein, 131 aa, Sorghum bicolor
  Clone ID: 30975658.pep
MADDNDVTGVSPVADEWDMLSLTSSIYASPLFRRGFDPINLPGYGDVINIQEGTQTGLVMSDGFVFPPSEHENLPIEPEHDNLPIEPEHDESNTNSDGKESSCAGNNDDDWCHVSPEEIGGISNENLSDNS

SEQ ID NO: 58082 - protein, 160 aa, Sorghum bicolor
  Clone ID: 30975689.pep
MLKERGGAGASAAATLYRALLLAITVDGKELNVPAEVFAAGTVMDSRTIITRLPVTAYGALRAAFRNRMRYRVAPPQEELDTCYDLTGVRYPRLPRIALVFDGNAVVEMDRSGILLNGCLAFASNDDDSSPSILGNVQQQTIQVLHDVGGGRIGFRSAAC

SEQ ID NO: 58083 - protein, 79 aa, Sorghum bicolor
  Clone ID: 30975704.pep
SARTKNISDKITWKLNGIPKVSISHVQLCTEFLLYFGASIKFGYGYLQTSMRPMVLKRYANFQTSYKLLFICVFPFEFF

SEQ ID NO: 58084 - protein, 175 aa, Sorghum bicolor
  Clone ID: 30975748.pep
MSKDSRDHLMYKGQLKGHDGWVTSIATTSANTNMIISGSRDKSILIWDLTREQNNYGYAKRSLRGHSHFVSDVVLSSDGNFALSGSWDKTLRLWELATGQTTRTFIDHTKDVLSVAFSGDNRQIVSGSRDRTLKLWNTLGECKYTITQDGHNDWVSCVRFSPNALQPLIVSAGWD

SEQ ID NO: 58085 - protein, 41 aa, Sorghum bicolor
  Clone ID: 30975749.pep
VTATERNVSANVNSTVSRPVPQRSWQQTGYGNTYGGYGGSN

SEQ ID NO: 58086 - protein, 105 aa, Sorghum bicolor
  Clone ID: 30975767.pep
PFPLLPLPLYQRRCCSPAPPATKPRNPRSRGGREALARSPCFPRPSERVVSGQQQLPWFLVVLASSSGCVCVWWNSVVVFAGIRLPAPPPLALEPELLIGFYRPA

SEQ ID NO: 58087 - protein, 67 aa, Sorghum bicolor
  Clone ID: 30975787.pep
ARYRLQLSTRLNIFQIKCILSIYARSRKDLLYPNEYHFVPISFYEVADIETHRPFRSYQPSQTLDNQ

SEQ ID NO: 58088 - protein, 163 aa, Sorghum bicolor
  Clone ID: 30975793.pep
MAASTAAVDTTAPPPPPSAEPAAAPAPDQKVSPPPHAPQPDAPAPAGAPAPAPVPAPAPRKRKLEEAGFHTSEYYKIRAVVADLRVRFVQVYQATDFRNTDAAREILKEINVVMDLSKKMRLKLGATSEPVKPLEKPSAGFVKDELVKPSEKLSAGPVTEESV

SEQ ID NO: 58089 - protein, 131 aa, Sorghum bicolor
  Clone ID: 30975811.pep
LPACLPLLPPLRSCAGPSLPPPRFVLNPWTDHAYTSSAQAVVGFFGVPFHPAKNPARALEPVKPAAVVVVVLGEAGNRQLQSPRRGKQQAAAMMSFYGHEGFGGQVSAATGAGSQVAASHGAAAAGAGPLP

SEQ ID NO: 58090 - protein, 124 aa, Sorghum bicolor
  Clone ID: 30975837.pep
RKYRIRMRGIDAPELKMPYGMEAKKELIKLIGGKSVTIYVYEQDQFGRYVGDIYCDNMFIQEQMLKCGHVHHFKKYDKRPEFENWQKEAKSTGLGLWASKKPPQKPWDWRRNKRHARHSAIPVY

SEQ ID NO: 58091 - protein, 117 aa, Sorghum bicolor
  Clone ID: 30975852.pep
PEQNCSKKPTHLMDVYSFGVILLELVTGKPAEQPASDDGSVDIVKWVRRRANVADGASQILDPSIASAAAQKGMQATLELALRCTSVMPDQRPAMDEVARSLQALCFSVHPQAPLLT

SEQ ID NO: 58092 - protein, 74 aa, Sorghum bicolor
  Clone ID: 30975857.pep
FYNIGDLEIQDNLARVWVDIGIHEPLLLDILLNALTTISSDHVGIKQVQFGGLEFLNWSEDLKTEEVGYSVCKI

SEQ ID NO: 58093 - protein, 61 aa, Sorghum bicolor
  Clone ID: 30975863.pep
LASNYAALLLVFPQIVMVITSLTICSTILISSNEMKERNLQVYLYMLITIRQFGNSISLEL

SEQ ID NO: 58094 - protein, 43 aa, Sorghum bicolor
  Clone ID: 30975869.pep
RVSGTAGYTSTTPNTLVAVLAVLLFLISCNINGTRDNKFISYK

SEQ ID NO: 58095 - protein, 62 aa, Sorghum bicolor
  Clone ID: 30975872.pep
PRLFIFVIGGATRSELRVAHKLSSKLKREIILGSSSLDDPPQFITKLKMLSTEELSLDDLQI

SEQ ID NO: 58096 - protein, 83 aa, Sorghum bicolor
  Clone ID: 30975875.pep
MHPHVLANDNLVAINFASTRGVSESSIELELQTSNHIETRTRSGFLFVMEKEFQKKNHLLQVQFMLLRQSESKAAIPHRLIRR

SEQ ID NO: 58097 - protein, 87 aa, Sorghum bicolor
  Clone ID: 30975877.pep
YMDADTQLTTESKWGYFTKNSPYSIYVGLQLLDPVFGIKKNYTATESQQHVFDGLESYTSKAMKLSTTTGAIVKGNFYMGFFFLEYA

SEQ ID NO: 58098 - protein, 64 aa, Sorghum bicolor
  Clone ID: 30975886.pep
SRATTQLLQTNPIKPCFFIQPGHRGRFQSTPYACAEPTERGYTSTNYNHDLYSPFPGLITEGGW

SEQ ID NO: 58099 - protein, 62 aa, Sorghum bicolor
  Clone ID: 30975896.pep
MSIDSDSSSQRGADYRSFRQITRDRLLVEMLRSTRKSSKSTWKVLIMDKLTVKIMSFSCKMA

SEQ ID NO: 58100 - protein, 178 aa, Sorghum bicolor
  Clone ID: 30975903.pep
MATSSLTFGVILSCALLLATATHGLQVGYYKKTCPSAEVLVRAAVKKALLANPGVGAGLIRMLFHDCFVEGCDASVLLDPTQENPQPEKLGRPNNPSLRGYEVIDAAKSAVEKACPGTVSCADIVAFAGRDASYLLSNSKVSFHMPAGRLDGRKSLASETGVFLPGPSSNLSSLVSAF

SEQ ID NO: 58101 - protein, 133 aa, Sorghum bicolor
  Clone ID: 30975909.pep
MGRAAMAASSGTTTRSVRLLLLSLLGFCVALSHQESSSSSSTDSCATAKVAVASLVPFDSTSFRCTAAWKQQDFVLRYKNTGPSEWSFILSAPDKGSYVAVGFSGKGAMVGSSAVVGWASNGKGTVKQYYLGG

SEQ ID NO: 58102 - protein, 120 aa, Sorghum bicolor
  Clone ID: 30975915.pep
MEAQWLAEYPHQGSDKRPRKRPRLAWDVAPTLFQPPKAIPMLYCRQELINGNFTTAFLPPPPIYYTGPPRNLSPPWRPDDKDGHYVFVVGENLTPRYRILSKMGEGTFGQVLECWDLENQ

SEQ ID NO: 58103 - protein, 132 aa, Sorghum bicolor
  Clone ID: 30975936.pep
MGNIIRCLTGRDHGHGDDDGYYPYYRAASTASRPRYKLQAGGWEDDDEPAAAFWPRQQSLGPIHGGVSVTPAATAASLAQDLQLNMESTSMIPEGFKRHVTSSKKAQTNWYKDMAEAYKDMKTPQKTQAETA

SEQ ID NO: 58104 - protein, 99 aa, Sorghum bicolor
  Clone ID: 30975952.pep
SSSSSPAETPQELLLDFKASLQDPSGALSSWSRSTPYCNWPHVTCTSASAAANATVSVSLSLQGLGLSGELSASSLCRVPALVALSLASNGFNLTIPLE

SEQ ID NO: 58105 - protein, 164 aa, Sorghum bicolor
  Clone ID: 30975958.pep
MLSALLGGYLTAYPPPPLPPATAAAPSPSARLPAPFPARLRHASLHVARRRAAGAGEALSASTASEGDDEYEAAAALQEEGFPSWTGGGEQEEEDYDHDPEIGDIMGDYFDDPKKAQTRMEDRIRKKRHKIVQTKTGSPNPMKVVFNKFDFSNSYIWFEFYNAL

SEQ ID NO: 58106 - protein, 139 aa, Sorghum bicolor
  Clone ID: 30975969.pep
MVMDAGLHEPCALLPGSKRDGHMPIYPQIAAAANGFTAEELESLLFLSPDGVASAAGGVGGGSYLNVAPTTVVPPARTDRRASPPPSVAQPDDSEAFSDIVLGYINRMLMAEDIDDKFEHYPEHPALLAAEKPFLEILT

SEQ ID NO: 58107 - protein, 157 aa, Sorghum bicolor
  Clone ID: 30975973.pep
GPPLAGRPKKSKPKGEGAAPMAAGLCPRLRTLLASSRPLLAARSGALPLPLRRAGPAMPLVARARRGLGSSTAADPLAEDFATATDLRFESPLEVVKYPDPILRARNKRINAFDANLRALADEMFDVMYKTDGIGLSAPQVGVNVQLMVFNPAGVKG

SEQ ID NO: 58108 - protein, 142 aa, Sorghum bicolor
  Clone ID: 30975974.pep
MSSSSSPTPAAPAASGDAGASASAPAPSASNAIDFLTLCYRLKTTKRAGWVKRGVQGPESVADHMYRMGVMALVAADLPGVDRDRCVKMAIVHDIAEAIVGDITPSDGVPKEEKSRREKEALDHMCEVLGGGSRGEYQNLQL

SEQ ID NO: 58109 - protein, 120 aa, Sorghum bicolor
  Clone ID: 30976000.pep
WQIKELKAKLGDDDAFSSVKEEPAASDVEVPAAGAAQGSSDSDSSGVVNDAEKPPSPPAVPAEAEAPQLQVQHGEVFLLKVEEDEAAFLGDDDAACGGFFADLQPPPSLPWWTEPTEHWA

SEQ ID NO: 58110 - protein, 48 aa, Sorghum bicolor
  Clone ID: 30976023.pep
YIYIHNSVTSCSNGHCGHEKSNHEYHHHNKVVNALSNHEYQQQMTLLL

SEQ ID NO: 58111 - protein, 69 aa, Sorghum bicolor
  Clone ID: 30976027.pep
NSCIVALLACVHRCDYTTSCSDHCRDSSSLSMATFEVNPGAAFMKIILGIICDIGCIKFQWFTHVIFSS

SEQ ID NO: 58112 - protein, 178 aa, Sorghum bicolor
  Clone ID: 30976048.pep
LYYKMVIHVHNDSVFRRYQQEMRKNQGLWPLYRGFFVDVNLFKANNKKAAELAKDGDTLLKNINGALDSNSSDVDGLADEDSNLMVKLKFLTYKLRTFLIRNGLSTLFKDGPSAYRAYYLRQMKNWGTSANKQRELSKMLDEWAVFIRRKYGNKPLSSSTYLSEAEPFLEQYAKRSPA

SEQ ID NO: 58113 - protein, 172 aa, Sorghum bicolor
  Clone ID: 30976050.pep
MALLAAATATAAAARRLARHQHNLLLHTRLLTTTSSTHPLPPDPDPTTPAPSPVRTPPDEQFAAWVTRLRPGFTASDLAAAITAEEDPDLALALFRWAALRPGFRHAPESYLAALTAASSGRRPAAAEALVHDVFAGACAPDLRLFNACLRFCCARRSLFPLAFDLFNKMRA

SEQ ID NO: 58114 - protein, 87 aa, Sorghum bicolor
  Clone ID: 30976069.pep
MDGASNILEKSSHECMQSWYFTREELEKFSPSRKDGITENKESEIRHLYCSFIRDVGIRLKLPQMTLATAVMLCHRFYLHQSLAKNG

SEQ ID NO: 58115 - protein, 108 aa, Sorghum bicolor
  Clone ID: 30976101.pep
WSWVVVVLVVTARRRRSITGGAIPASPHSPFPGCPSSPDPHPHTSVCVCDPSFLACFSLVLDQRPSHPPPSLGRESLRISHPAGSSDSHEETERFHLRRRRRRQSRPP

SEQ ID NO: 58116 - protein, 221 aa, Sorghum bicolor
  Clone ID: 30976109.pep
KDQEEDYTPKSARSSMMPFHAVPDLLSWEDGDGSNSLGAKPSFQLNTEVKCAEWVSSSRPPMEGESHSGDLPEYLDTEVASSSNTVVLGASNTSEKGGNVDLMSYSNNEMPLDNLIHGSMELPSEFVTETLPVISRDLHPIPEERVVENFNMQEKHETAIFTDSAAALTGHVIEQHFDVGSDGTLSSKVVSSYPQVNDVIQSASSEHEEILNPFALMATEP

SEQ ID NO: 58117 - protein, 101 aa, Sorghum bicolor
  Clone ID: 30976122.pep
MGRDAEETSPPVSSSELEQEEDDDDCYLSDQEDDALEESVLQVLEDEHHEDCHWSASCVITKESLLAAQREDLRKVMELLGLREHHARTLLIHYRWDGGRI

SEQ ID NO: 58118 - protein, 101 aa, Sorghum bicolor
  Clone ID: 30976125.pep
GDAARHAAHSRVLAHRRAPPPQPQTHGVRLPWVTARRAGADPWRGGAISSVSSPYLSFLLLAAAAAPRCSPHAYPGATCARAQGAAPNQWSIGRAEVADLR

SEQ ID NO: 58119 - protein, 110 aa, Sorghum bicolor
  Clone ID: 30976126.pep
METIKCCIACILPCGALDVVRIVHSNGRVEEISGGPVLAGEIMKAYPKHVLRKPPSTCPADGGAIVVQKPVILPPNAELQRGKIYFLMPVMATAPAPAPEKPAAAKQQPP

SEQ ID NO: 58120 - protein, 81 aa, Sorghum bicolor
  Clone ID: 30976129.pep
YMEYGKKISTTPGSLHIYAIKGTAHLTAGFGGCHPDPLCWWARNLVQIPSPLHSTCQMDWDRINGPSQTQIQRAKSIREQF

SEQ ID NO: 58121 - protein, 64 aa, Sorghum bicolor
  Clone ID: 30976131.pep
VFIRTSKTHMDTAETSPERKRQKLQTQPGRPSQYSVPSPKLSWWVPVLHSIYTNGFKSTQSVPN

SEQ ID NO: 58122 - protein, 138 aa, Sorghum bicolor
  Clone ID: 30976145.pep
IKKYTHEILTLWYRAPEILLGATHYSTPVDIWSVGCIFAELVTNQPLFPGDSELQQLLHIFKLLGTPNEEVWPGVDKLPNWHVYPQWKPTKLSTLVPGLDADGYDLLEKMLEFEPGKRIPAKKALEHPYFNDVRKEMH

SEQ ID NO: 58123 - protein, 59 aa, Sorghum bicolor
  Clone ID: 30976146.pep
GAIVKHDNGTHQSHLTCSFFFSLNLSLNNMTMSRLTQGLRSSKHEMFQLFMFGNRKASL

SEQ ID NO: 58124 - protein, 123 aa, Sorghum bicolor
  Clone ID: 30976174.pep
DAHTLSVMPYDPTSMKSIEHAIISSPLGINPTPDGNRIIAAIPPLTKENIQALCKVVTKSAEDFKQSIRRARQKALDTIKKSASSMPKDDVKRIEKEVEELTKKFIKSADDMCKAKEKEISGS

SEQ ID NO: 58125 - protein, 93 aa, Sorghum bicolor
  Clone ID: 30976175.pep
DEWVVLDKKVNTYPTVRGFTAIGTGGDDFVQSMVVAVESVIGEHVPEGQISQKVSAKGKYVSVKIGPIRVVSKEQVQAVYNAMRKDERMKFFL

SEQ ID NO: 58126 - protein, 77 aa, Sorghum bicolor
  Clone ID: 30976179.pep
ASYKHPYWFYDQKLYLIQQRLSSYKEGKTNKNETSMNTNPHHEQRGHHMRPTRTLAYSISQRRRLSLSPKVPSDDES

SEQ ID NO: 58127 - protein, 88 aa, Sorghum bicolor
  Clone ID: 30976183.pep
VTMKLLNKKAWKKMAPARASKFQHKLMLCATFSSPYRPFHRVGSSSNNSPALLIMGIHRVLLQSFINLWGASCSGRGSWFLKTVCTNL

SEQ ID NO: 58128 - protein, 103 aa, Sorghum bicolor
  Clone ID: 30976187.pep
GIVLMQMAIPTLRTQSGLKNFNAELRSAGYDLNRWRQSARRRPDLQILDLDSGRGWDLATKLISERGPNGGGRLSAAAALRHPYFLLGGDQAAAVLSKFSLSK

SEQ ID NO: 58129 - protein, 113 aa, Sorghum bicolor
  Clone ID: 30976201.pep
LGDSAITSASGSGIVLFFLGGGCGAAAVGAPWPDAAGTAPATPGSAAASCCCGDISGLIWSCWSPSLTPKNAAADEFDAITTAAASRFILQAPPAPARQRHCFSFLPVALARC

SEQ ID NO: 58130 - protein, 223 aa, Sorghum bicolor
  Clone ID: 30976209.pep
YWNEMQVDLTNKLGEAESLSKALSEDLASVKEMVQKGQEELEATSNELASIVEARDNLKKELLDVYKNLESTTHELVEERKIVTTLNRELEVLAKQLQVDSEARKALEADLDEATKSLDEMNHSALLLSKELEGTHSRNDTLEAEKEMLSKALSEQTKITTEAKENTEDAQNMITRLQTEKESFELRSRHLEEELALAKGEILRLRRQISTNSSQKPRAPPRA

SEQ ID NO: 58131 - protein, 190 aa, Sorghum bicolor
  Clone ID: 30976213.pep
AVRYSHVAARNPNSAHRCASDSPDVSASRPDSAPPAARATGLDDASRCSSALRSPSGMAAAPPPSLLAASTPRSSFTAPAAALVASPTAGPVVVEGSSGSAVTRSFGVTPAPALLVTVSDVSACCSDLLSSSTKDAQPSSALVAPHLKISLWACGLAPDGWRRAGYFLTRVAAGGRREAAMARKALSSHF

SEQ ID NO: 58132 - protein, 180 aa, Sorghum bicolor
  Clone ID: 30976226.pep
MTPPSIFHHHHRLLPLPSASPTQILNPFAASSRRLNHHLPKPKVLSLPPRPVFSSAFAVAAVGDDEDVVVGDCLVFDDDAFEEQDLDILSSPPPPTSASRQDWRAEAGEGESLVPERWRDAEEEINLTKKEKRRIAHGLRFGSRLERRAPPAVAAPDEFRAYRKGMLSAEREHVAHVYRG

SEQ ID NO: 58133 - protein, 48 aa, Sorghum bicolor
  Clone ID: 30976280.pep
GQGLGVPLRLVYRSRRLRWSGFLSATPASGNDGGGGGEGNQKRGFFSR

SEQ ID NO: 58134 - protein, 107 aa, Sorghum bicolor
  Clone ID: 30976281.pep
SRGSTERYLLQPLPLLCVRGCRRGESPDRTMACCRALPLQLLPASAHSRPRINFHRRIRCCAAAGDQVEAPQDAVLKAISRFHCQRTSVFLNAQMHMDLGYELLYYR

SEQ ID NO: 58135 - protein, 40 aa, Sorghum bicolor
  Clone ID: 30976295.pep
YTFIVHWNKRNLIDIHVMSGEMDSTSSYHLIMVHYYLQFQ

SEQ ID NO: 58136 - protein, 151 aa, Sorghum bicolor
  Clone ID: 30976331.pep
RHAPMVAIENAAERDRMMFPSSTSITKPDSNGNPENCCDNEPAKRLKTDTKDNEQSSSESFRGDLSETSRPYLCTGFDIYLVWEPCTMCAMALVHHRFKRVFYAFPNPVTGALGGVYRLHGERSLNHHYNVFRVSVPEAYSNGLKYCSKEC

SEQ ID NO: 58137 - protein, 145 aa, Sorghum bicolor
  Clone ID: 30976352.pep
TITLLLQDLVGGLQATRDGGRTWITVQPLEGAFVVNLGDHGHLLSNGRFKNADHQAVVNSECSRLSVATFQNPAPDATVYPLAVRDGEAPILDQPITFAEMYRRKMARDIELAKLKKQAKAEKQLQQSGKEFAVANTKPLDDILA

SEQ ID NO: 58138 - protein, 114 aa, Sorghum bicolor
  Clone ID: 30976353.pep
STPPSDMNPGLAAVLKKQCPANPNFTNDPTVVQDVVTPDKLDNQYYWNVLRHKVLFKSDAALMASTQTARMVLENAGIRGRFERKFARAMLKMSFIEVKNAANGEIRKSCHVAN

SEQ ID NO: 58139 - protein, 103 aa, Sorghum bicolor
  Clone ID: 30976376.pep
ASVVPDLYSKECKRSQRLHEQINTLKAVLESTKKPLEVANEQLVESDSVIVVKLLLHFSFSNRLFFIVDDVCSLPIIGLGEQLNTLSLAIDAVTSMVNTRGET

SEQ ID NO: 58140 - protein, 82 aa, Sorghum bicolor
  Clone ID: 30976378.pep
TSKRQILIGFRMKSKSLFGRTSHERLLWRSQSHFDEAINYAFAKTAPTPLLLTPLLLKTACPQKRLAGLSKSCQTGPNICRL

SEQ ID NO: 58141 - protein, 183 aa, Sorghum bicolor
  Clone ID: 30976379.pep
MLAPVSIGAVPFLPTAAAGESTLRASFVRDEDERPNVPHDRFSDEVPVVSLEGIDGGGARRAEIRARVAAACEDWGIFQVVDHGVDAALVAEMARLARDFFALPAEDKLRFDMSGGKKGGFIVSSHLQGEAVQDWREIVTYFSYPVKSRDYSRWPDKPAAWRAVVERYSEQLMGLACKLLGVL

SEQ ID NO: 58142 - protein, 181 aa, Sorghum bicolor
  Clone ID: 30976381.pep
MGDEASPTTPPAPLYLDGCPGCAMERKKASSKGIPYKELFFVAVTTIASALPISSLFPFLYFMIEDLHVAKTEQDIGLYAGFLGASYFIGRFFASLFWGVVADRIGRKPIIIFSVASVVIFNTLFGFSVKYWMAITTRLLLGALNGMLAPIKAYSIEICRPEHQALGLSIVSTAWGLGLIV

SEQ ID NO: 58143 - protein, 118 aa, Sorghum bicolor
  Clone ID: 30976386.pep
MPLQSGTSSCSDDSDDSNAIDPIGIYTMEEYIAEQSVLHNLIERIGVKIQAKIEAQQAGTSRRRSGFNRKFIERDHGEGHQRLVADFFSEDAVYNEKLFRTRYRMRRPLFLRIVRALG

SEQ ID NO: 58144 - protein, 207 aa, Sorghum bicolor
  Clone ID: 30976389.pep
KRRAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLKTQIGKDIYFDLVDHDKVPSFRIQKQMTFAQFKEEVAKEFGIPTQFQRFWLWAKRQNHTYRPNRPLSPQDEAHTVGQLKELVNKAHNAELKLFLEVELGLDLKPLPL

SEQ ID NO: 58145 - protein, 155 aa, Sorghum bicolor
  unsure (1)..(155): unsure at all Xaa locations
  Clone ID: 30976397.pep
MAEIEPLQVVVYEGNADLQMSGGEDEFVALPGNGSTDAAQEGNADPVKGMIFDSEDDAIAFSQRYAQEKGFTITRRTSKTMDEKLQYFTLACNRQGKAQCSRNKLNQNPSTKTQCPAKLNFRLHDTDKFCLTSLILEHNHDLIXSETGINVCRNK

SEQ ID NO: 58146 - protein, 170 aa, Sorghum bicolor
  Clone ID: 30976433.pep
MRSSIATYRESLSRLAGEVDDAAADEVPAPPLAPAARGGDLSATPPSSGRRRRYSRPGPGPEAAEPDEISKLRVDIQKLQASEAEIKALSFNYAAMLKEKEEQLGKLREENGSLKRSMESCKAVSANSNGTLERSPRAQRNAVQENPLNLTKQNGYGGGSFHGAQANGLH

SEQ ID NO: 58147 - protein, 176 aa, Sorghum bicolor
  Clone ID: 30976438.pep
MAWELIEVPGNLNPSLQDSTVDVLATKIDPKLANTLIRQLSQVCPLENLRHVKRVRRRTECGGKSELSIILCVSTGSEPCSIQFSEDLQKIVDTYQLSPFTAKVAKYCATSKEEWEEQCKLWPTSYHPAHDLDIVRGFQEEELPSIFNCMKTAIQLSKAGNAAIIIDPSSMQIIAK

SEQ ID NO: 58148 - protein, 92 aa, Sorghum bicolor
  Clone ID: 30976446.pep
APPSGYPPPPASNLVPPTGTYPPPPPESGSAYPVYPRSAPSPPPGTVDRALPYYPAPPAPGGSYYPPPGTRHPEIDGAGRNPYYPPPGSRYP

SEQ ID NO: 58149 - protein, 46 aa, Sorghum bicolor
  Clone ID: 30976473.pep
TSDTVNKFWAVPEVFFKQFSDSMVKMGNITNPAGGEVRKTCRFVNT

SEQ ID NO: 58150 - protein, 62 aa, Sorghum bicolor
  Clone ID: 30976503.pep
WTDSLWGNYFLLCCPFHDYLFNICTKSKQILKDMCPKKLGIVTLFFLWGVCVNRVSILYTNK

SEQ ID NO: 58151 - protein, 209 aa, Sorghum bicolor
  Clone ID: 30976527.pep
MLRGSAALLRRLAPRVLGGGCGSTHRRLPPPIATFLQARFLSSPTTSSSPPSSSSAAGHDEEAEDRELPEISNGDAGARLSISVDRSGLYNPPEHSHEPSSDSELVKHIKSIIKFRSGPISIAEYMEEVLTNPQSGFYINRDVFGESGDFITSPEVSQMFGEMIGIWAMCLWEQMGKPAMVNLIELGPGRGTLLADLLRGSAKFVNFTK

SEQ ID NO: 58152 - protein, 151 aa, Sorghum bicolor
  Clone ID: 30976529.pep
MDSTLFIIGVIGNIISVLVFTSPIKTFWRIVRSGSTEEFEPAPYVFTLLNGLLWLYYGVTKPDGFLVATVNGFGALMEAIYVVLFIVYAANHATRVKTVKLAAALDIGGFGVVYAVTRFAINELDLRIMVIGTICACLNVLMYGSPLAAMV

SEQ ID NO: 58153 - protein, 98 aa, Sorghum bicolor
  Clone ID: 30976531.pep
RSSRGPAACDSPPAPPPASPSSPSPSPPPVSSPAAPPPPSRTPASPSPRPPRLLPSSPRQTKPTLTPPPPPAPPPLPLQQKQEAEAEAVGAAAVRSRS

SEQ ID NO: 58154 - protein, 188 aa, Sorghum bicolor
  Clone ID: 30976537.pep
MSLGSGAGTGGRRITIRSISCRGVRAFVPFQKPPLYAAVSLGGRREKTQPDADGGESPDWDDAVFSYDLDRDTGAQAQQQLRVEFEVKAQVPILGNKLVGTASVPVADLAAAGDDAGLRHVSYQVSAPDGKPNGTLSFAYAISGGPGPGNGVRPQPQLYPAPGGARPDQNPSFCCAPPPSAAYPPPQP

SEQ ID NO: 58155 - protein, 122 aa, Sorghum bicolor
  Clone ID: 30976554.pep
MKIAVEGCMHGELDIVYDTLRKLEEAEGVKIDLLLCCGDFQAVRNENDLQCVNVPQKFRAMNSFWKYYSGEAVAPYPTIFIGGNHEASNYLWELYYGGWAAPNIYFLGFAGVVKFGNIRIGG

SEQ ID NO: 58156 - protein, 122 aa, Sorghum bicolor
  Clone ID: 30976561.pep
SLFTSVPISLPAACHPCLVGAPPAILLSSPPAVLSLLHTLRAGVLHVEGQLQRAEVGCRPSAFSVHHHEQHAVPYADGQTHRGLGLGRHLGWRCCSLASSTRDAPSSVSSVPRAKADLGRWR

SEQ ID NO: 58157 - protein, 212 aa, Sorghum bicolor
  Clone ID: 30976586.pep
MHFCVFGFLKRQIIKQIGARRIRKPLFQIAGEDRSTSAADDNIYEDDSVKRSILSSPLVEFSTVYSATNNFSEKLGEGGFGPVFKGILPDGQEIAIKRLSKSSGQGSEEFKNEVTVLSKLQHRNLVRLFGCCIHGEEKMMLYEYMPNKSLDSFIFNEGKRLVLGWKLRYKIIQGIGRGLLYLHQDSRLKIIHRDLKASNILLDDDFNPKISD

SEQ ID NO: 58158 - protein, 133 aa, Sorghum bicolor
  Clone ID: 30976596.pep
NFASCFICKQQGHLSKNCPENKHGIYPKGGCCKECGEVTHLARHCPNKGKQDLISSRDDDYNMEEHNQEGPAVHHGGDDLEDDFVDDEEPKPAKSKKAKQSGSKPATGTGNDEKSASAKTKAKQGLKVVKFFG

SEQ ID NO: 58159 - protein, 191 aa, Sorghum bicolor
  Clone ID: 30976605.pep
PRPGALGKQGVALRISADNAAFVGCNFLGAQDTLYDHLGRHYYRDCYIEGSVDFIFGNALSLYEGCHVHAIARNYGALTAQNRQSLLEDTGFSFVNCRVTGSGALYLGRAWGTFSRVVFAYTYMDNIIIPRGWYNWGDPTREMTVFYGQYKCTGPGANYAGRVQWSRELTDEEAKPFISLDFIDGFEWLKL

SEQ ID NO: 58160 - protein, 116 aa, Sorghum bicolor
  Clone ID: 30976619.pep
SCLWTNADNCYACARIKRKIDHPNGEEHFGGHPHKTDETEDDRDYDHTEFQLFSPTTIDVDYRFFDPDRDIDLVKWYADKIDRAEAIYSKLGLKNGNTNDEDIAEEDIEVYCRRYA

SEQ ID NO: 58161 - protein, 81 aa, Sorghum bicolor
  Clone ID: 30976631.pep
MIEGKEIILHFLVVNHNTHCLPSKEQALPFGLPCSTAIKHLSMTFIGYWRYFCRKEGIFDKDHLLACCLSDPCIALQRWLM

SEQ ID NO: 58162 - protein, 39 aa, Sorghum bicolor
  Clone ID: 30976637.pep
ARSIPISLYPYHIIITALGKNIFHPHTWTYITVLLNPQN

SEQ ID NO: 58163 - protein, 143 aa, Sorghum bicolor
  unsure (1)..(143): unsure at all Xaa locations
  Clone ID: 30976650.pep
MQESSSRYTAADAATLRKCVKCRGSFCLSCKVPWHDSMSCYEYKMRYPHARPEDAKLQNLARXEVWRQCVKCKHMIELAEGCYHMICVCGYEFCYTCGKEWKNKKASCSCPLWDERNIIREEDDDDYEEDDDDYEEDDDGLYY

SEQ ID NO: 58164 - protein, 89 aa, Sorghum bicolor
  unsure (1)..(89): unsure at all Xaa locations
  Clone ID: 30976662.pep
SPLLCFLLSTASSHAHRRSQYEGHYPGKHGSAAAPAGPRGGAAAGGEEEGRGVGAGAXXTGSLXTGGGGDGEGAGDRGRRSXAGGPDAG

SEQ ID NO: 58165 - protein, 198 aa, Sorghum bicolor
  Clone ID: 30976670.pep
RERERERVRSQAWVDWFVRVRWWPAATTWPHSTSRSPSHPPPPSPPPISTSHSNSRSPRPSKPRSARTMPPPHHLRRRPPPSSPSPSPPPTPPTPSRSRPPTSRAPSRTAATPKPGSPPPPASPRTTPSSPATSPPSPRINGPTTATTSSAPSTPRPARCSASSPRVCRAGTSWARGTGIPASPCSRWLSPGRRVGWC

SEQ ID NO: 58166 - protein, 204 aa, Sorghum bicolor
  Clone ID: 30976680.pep
RAQSSAAQRWRAPRPTPPGPASASSEPALSRSPEGAPGPCSPEGQPRRQPENPSVQQRCLVGQDPVLLLPCNERRPVGSTGPSSRRRRSASRLGTPSSRKVKDLPKLHWTHNNLTVMDVTPLWNHSSDALLYAHHPSHMVDLNKSQNPDGFSHCHELGRQAPHFLGNGVSWGNLDAKGSIPRKQVFQTDEVLLSQVDLNKTQNP

SEQ ID NO: 58167 - protein, 193 aa, Sorghum bicolor
  Clone ID: 30976719.pep
MASSSSPQPPPPAASPGAASPSEERRAGGGGRPPVPPYVKAAAGSLGGVMEACCLQPIDVVKTRLQLDRTGAYRGIAHCGATVARAEGVRALWKGLTPFATHLTLKYALRLGSNAVLQSAFKDPDTGKVSAHGRLASGFGAGVIEALLIVTPFEVVKIRLQQQKGLSPDLLRYKGPIHCARTIVREEGIFGLW

SEQ ID NO: 58168 - protein, 59 aa, Sorghum bicolor
  Clone ID: 30976723.pep
MPLLTYYVLCLRFRNIIMLPIAATIILYLGFLEMTTVFYAPPPQEKVVALCRKNVIQFS

SEQ ID NO: 58169 - protein, 124 aa, Sorghum bicolor
  Clone ID: 30976724.pep
SREIRAKGKRWCRVGGSVDASHGRRHQCPSSRIRSRLPSFVRREDKSEKNWSGSRSRCLSVAVAVTSLQRGDEANVEVGTTTVRKGRWLAQRRRWQEEGRGDDGGAATEEKSEARRLEPGNVGR

SEQ ID NO: 58170 - protein, 187 aa, Sorghum bicolor
  Clone ID: 30976726.pep
SFVIVESDERTVSSAPLSCSPEHRHSIAIRLREFLNFPFLFLPSILLCHFRPHLQPKLSMKTTNRNRIKINFHSSSSRNARPIRIANPLLFQRTQANSPRKKGPTDKAYPRPTFPPRESPARQALSSAQAQAAAKNRTTHPAPRPPIRCGGFSPTGTNRGSRRLPQPRGYRRSYGGRAVGLGSRSKS

SEQ ID NO: 58171 - protein, 84 aa, Sorghum bicolor
  Clone ID: 30976747.pep
AAAGAPITGGPAAAGAMPMGPAGMKHHHPAPPMGMYGHAPMGHPVAGHMMAPAAVGTPVMFPPGHHSPYVVPVGYPAPPAKMHQ

SEQ ID NO: 58172 - protein, 129 aa, Sorghum bicolor
  Clone ID: 30976750.pep
MSPMICTKDVNSNYDVAYCIVSVATVSQRYAEMLREMREHDMEDKLEHKKSLREKKLQKKLKLKRKRQEETEAGSEEDSGSESDRGQDTANKGKKRYFSDGEDNDAAKDGDVLAQQEALALKLLSKMHS

SEQ ID NO: 58173 - protein, 73 aa, Sorghum bicolor
  Clone ID: 30976755.pep
AALPRWRFKEPGPAADVPRDRDHDDQECCICLAQYREKEEVRQLACTHMFHLKCVDRWLRIISSCPLCKQELK

SEQ ID NO: 58174 - protein, 71 aa, Sorghum bicolor
  Clone ID: 30976761.pep
PRVASCWKLTDFLWSNWNLGDTAIKGFILFFNFFHKLTLTMYLNFDVFRVPHNHQICEFWKCIFLYLEFQN

SEQ ID NO: 58175 - protein, 155 aa, Sorghum bicolor
  Clone ID: 30976778.pep
MTSWISPLLLLPRMQPYLKNKNPRIRAKASVCFSKSVPHLDVVGIKEYGMDKLIQIAATQLSDQLPESREAARNLALELQVFYEKSQASTSDEHEGEPSASPDAESWEAFCQSKLFALSAQAILRVTPTTKEGVTSTTTKEGVTSAPKEGLAVGC

SEQ ID NO: 58176 - protein, 167 aa, Sorghum bicolor
  Clone ID: 30976784.pep
TKLLLKKLLHQFLKQTVHTKICRLFCTNCIAQHQARSEFEAYNYIVLPYGSHSTSERSVCSAAKVRQPELRANHIVDSLTALQICTFSSSWEWMPACDHFALLSSSPDDDDLCHGSDEDDAHAPFHIVMYGCGDSSCRDTRSRFLADSERPSAISCSRVGDGAGATG

SEQ ID NO: 58177 - protein, 192 aa, Sorghum bicolor
  unsure (1)..(192): unsure at all Xaa locations
  Clone ID: 30976796.pep
VGCKRNREHRSFQPLKTAVCVKNHYRRSHCDKSYTCRRCNVKRFSVLADLRTHEKHCGRDRWVCSCGTSFSRKDKLFGHVAAFDGHAPALPPEDDDAVTNAVGLGTGSGRLTTMDTEAVSRMASMEFFPDAVLDGLVCSDIKGFALMDGGQGQYLEDDDGRGSLSPLPMGLDSCDFDGXDLFGAPAIDFELR

SEQ ID NO: 58178 - protein, 65 aa, Sorghum bicolor
  Clone ID: 30976802.pep
DKFHTNTALLNPRSTCLHPLSTLTTLMYSCLCVVAALPVRDHNLDLLKIKGKIITEGTSHMFLWV

SEQ ID NO: 58179 - protein, 142 aa, Sorghum bicolor
  unsure (1)..(142): unsure at all Xaa locations
  Clone ID: 30976810.pep
MDLHQLLKYRLTGANVFYEFPTENNLANTPWPASPLKSEFSGSPYTPLSSQLECDNLSALSNTPDNQSSTETISAQPISPLEVDSSYRQAAILRENTQVRPDPLYATSRHNMQHALREIETVLMAPDAEDAATXTKHEFEEH

SEQ ID NO: 58180 - protein, 221 aa, Sorghum bicolor
  Clone ID: 30976823.pep
MSRDEPSRGSGGPGTSRRSAEGAMAESSGSGSVSVDVERISFSGKEHLVRTRCGSVTVAVYGDEDKPALVTYPDVGLNYMSCFQGLFFCPEAASLLLHNFCIYHINPQGHELGVAPISSDVPVPTVDDLADQVADVLDFFSLGSVMCLGVTAGAYVLTLFATKYRERVIGLMLVSPLCKAPSWSEWLYNKVLLNLLYYYGTQGLVKECLLQRYFSKKLRGD

SEQ ID NO: 58181 - protein, 181 aa, Sorghum bicolor
  Clone ID: 30976828.pep
MAAHATLPFSCSSTLQTLTRTLSPRGTHQLRRGFLRLPSLAALPRLARPCRRHVSASAAAAPNGASAEGEYDYDLFTIGAGSGGVRASRFASTLHGARVAICEMPFATIASDELGGLGGTCVLRGCVPKKLLVYGSKYSHEFEESRGFGWTYETDPKHDWNTLIANKNTELQRLVGIYRNI

SEQ ID NO: 58182 - protein, 175 aa, Sorghum bicolor
  Clone ID: 30976838.pep
MGKQLLVLDEADQILDHGFRSQVDAIISQIPKVRQTLLFSATQTKSVKDLARVSLRDPEYISVHEEAKTATPDTLEQYAMIVPLEQKLNMLWSFIKRHLNSKTIVFLSSVKQVKFVYEIFKKLRPGIPLKCMHGRMKYEVQQAIVADFNETTSVLFSTDISSRGLDIENVDWVVQ

SEQ ID NO: 58183 - protein, 205 aa, Sorghum bicolor
  Clone ID: 30976844.pep
MRPPSSSSSSSSSSSSSSSSAMAAPGGGRMSAFTMRAVARMSRARWFIFLRRVYQYQNGPRSDLGSNPFNSPGWLALELGVIVAQMVLTTAVVATSSAERPAWPLRLWVAAYNVGNVLSLPLLYWRHRHSSAGGRGGDALSGDLEMRGANDALRDSRSYLMNKARAFLELFFAMWFVMGNVWVFDARLGSLQRAPRLYALCISLL

SEQ ID NO: 58184 - protein, 210 aa, Sorghum bicolor
  Clone ID: 30976852.pep
LLVSTTSSSSISGLLVGQLQDGGCHPAVGLQEVVVSEAKALVAVKDDIRGLQYRLMWLQAFLRHANRRRRDTSDELLRELLKQTRDVAFDAEDAIDDYYLKVDLSRSASWSQSIARFFSGFTEQVSMRHNLSTKIAEINLRLEDIFNNKERYKIEAAPNDFPWKPSTNISEAKKMDDVQLSPIKQEQLEKKLEDAVFCNSKRRLVICVTG

SEQ ID NO: 58185 - protein, 211 aa, Sorghum bicolor
  Clone ID: 30976853.pep
NASTNLQAPMQPVQTPQYALFQDSKKIGQVQHVNQFMFPGYGYPAYPFPTIPLVSNIQAEGYLTKPTGTSYRTLEDSPKQSSSIEMSQDIPSRPLIMTPQEKIEKLRRRQQMQALIAIQQQQQQFGQEGSGSDTMVSQAYSPRNKNPDSLGSSIVIDENANKVFSPEVIPTNHDLVHKSSAISVDPFIEEKIYYQLQDALGKLDTKTRLCI

SEQ ID NO: 58186 - protein, 191 aa, Sorghum bicolor
  Clone ID: 30976855.pep
MAPTACLRLPFLPARARSANATATPFSPPRRLSLKCSATNGDNSNPNYISISPGVESVDVNGLRRPPAPVSTPTVPGARDPNWLPRPLTSADAMEADGKGLKVAYQGCAGAYSEAAAKKAYPNCETVPCEHFDTAFQAVQNWVADRAVLPLENSLGGSIHRNYDLLLRHSLHIVGEVRLAVRHCLLANPGV

SEQ ID NO: 58187 - protein, 218 aa, Sorghum bicolor
  Clone ID: 30976876.pep
FMKNGSLDAFLFGGDRDAPPPGGKMPWPTRFAVAVGTARGITYLHEECRDCIVHCDIKPENILLDEHFNAKVSDFGLAKLVNPKDHRHRTLTSVRGTRGYLAPEWLANLPITAKSDVYSYGMVLLETVSGRRNFDVSEETGRKKFSVWAYEEYERGNLAGIVDRRLPAEDLDMAQVERAVQVSFWCIQEQPAQRPSMGKVVQMLEGVMELERPPPPKS

SEQ ID NO: 58188 - protein, 87 aa, Sorghum bicolor
  Clone ID: 30976888.pep
LKSGAFQPPYIVFRSCAYCQSPLFFSVLRAWCSFVSEILLLCFLCPGYALTEMYVVPGGMFFFFCCKKKEGSFLRNVIKSLKSVKHA

SEQ ID NO: 58189 - protein, 74 aa, Sorghum bicolor
  Clone ID: 30976889.pep
KDKAKAPNGRESTVGEVMSSPAITLPLYKTVLEAAALMLKEKVPRIPVVNDHHHVIGIVTRSDVFQTLEPTNKA

SEQ ID NO: 58190 - protein, 160 aa, Sorghum bicolor
  Clone ID: 30976917.pep
STLSDVLSNFDSNLGIPYSSVLNDAVRVSYAVHLMLVFPMIFHALRLNLDGLLFSSARPLSSDNRRFGIMTALLLLVIFGSAIFIPSIRDVFQFTGATAAVCIGFIFPAAITLRDPQGIAKKWDKILAVFMIVLAVVSNVVAVYSDAYKIFHKKSAPSNA

SEQ ID NO: 58191 - protein, 45 aa, Sorghum bicolor
  Clone ID: 30976930.pep
FGETNIHSLVPTDKIHVKTAAVQVSKSHHASSCDGPTIPCTFVHC

SEQ ID NO: 58192 - protein, 201 aa, Sorghum bicolor
  unsure (1)..(201): unsure at all Xaa locations
  Clone ID: 30976966.pep
RTAATDSSKPEAAAKEAAPLGRSXRVKVVPKPKVDMKRNLEDLWWSAFPIGTEWESMDRIKEFNWNFENLEKTLEEGGELYGKTVYLFGGTEPQLLDVNGELKIVLVPVVVAVDCPFPPSDKIGINFVQTGKEEIVPMKEMKMAWVPYVPLEDRFVRIESLKTKIFTLCCTQRRSVLKCMKTERANKFYYCTPYYMPLNPP

SEQ ID NO: 58193 - protein, 165 aa, Sorghum bicolor
  Clone ID: 30976973.pep
MVADTESADSLPGSSNAASETPAHGSIHQKSQENPSKKTHKAEREKLKRDQLNDLFVELGSMLDLDRQNTGKATVLGDAARVLRDLITQVESLRKEQSALVSERQYVSSEKNELEEENNSLKSQISELQNELCTRLRNSSLNQNSLGMSLPVANTVGPDLATHPM

SEQ ID NO: 58194 - protein, 178 aa, Sorghum bicolor
  Clone ID: 30976974.pep
RKPRWLAGLTAAPTFPLAASLPPPPKQPAHSSYINPHRPPCRTPLPPTLSLPARLAVTMALPPSSSASSLSAASAQPTPLHLHLTSRAPGRLPLLHFSRAALPLPLRARIPRTNNPPGTPLHRGLPPPPSASASPSIAGGGFGSDDAEENHGGDGGSGSGAGGDEGGGDDGGHNDHGG

SEQ ID NO: 58195 - protein, 82 aa, Sorghum bicolor
  Clone ID: 30976981.pep
MDIEFSNCDMLESMLQYGSSGPRNLSLEYLRNITNNFSDERLLGEGGFGTVYKGVLPNGESMAVKKLNSSMPGVKDKQFENE

SEQ ID NO: 58196 - protein, 150 aa, Sorghum bicolor
  Clone ID: 30976992.pep
MKSKASTLLKLKQMVSTLMAAVKSKSTAVRVKTSALKTRLLIFGILRNKKLLMTAINHKIHAIMGHQDQEAAAAADGGDNKDGGACQQRGAGAGDGDEDGGGGGRKAIVLYQPPTSYSFSSELGAHETEAEAEAEVEEDSDDYLTHSLFA

SEQ ID NO: 58197 - protein, 219 aa, Sorghum bicolor
  Clone ID: 30976997.pep
APARPPPPQSHEPSRARGEPSSRRARACPFHRRPHRPPGRLSCPAEPRRPRRRRRRGATAARCSPLSSPLTPVPGVQIRLTAPLLLPKDTLKKILELNADAEYLKKFGLNGRTDVESYKSCIPLCVHSDLEPYIHRIADGDSSPLLTGKPVTSLSLSSGTTQGKPKFLPFTDELLETTLQIFQTSYAFRNRKYPIGRGKALQFIYGSKQVVTKGGILAT

SEQ ID NO: 58198 - protein, 151 aa, Sorghum bicolor
  Clone ID: 30977005.pep
RPHDSPRSRTPLAPPHTRTPHRRRTTCTPFALLPPSHHRRCTPLAPLPPRRRRGATPATTKGKATRISSSPDARPPRPPTRGEVAVVPSHLRHGRNHRSPSRPSGGLRLPVSARARAVKAPPDLGRGTGSRAGHEVRQAAGGVAWSGSEED

SEQ ID NO: 58199 - protein, 213 aa, Sorghum bicolor
  unsure (1)..(213): unsure at all Xaa locations
  Clone ID: 30977023.pep
VDPTLSSPPALNPSSPPCEEASALPPPPPPPGGTLHSRTPAPPPSPPPLEAGAVMAVSGTGAGAACRPQGSRALPGGPFPTTMARIPSPPQHPSAAAXEPAVPSSPSIPSFAMFSGVGRGRGSPLPPPPPPEDAPKQPTLTKRFDNAPQRPDPEPXRVSMLPPPRRRCPARSRSPAPAAGSPGCSSLRRISLRKRTGSSGAARRRNRLPQCRR

SEQ ID NO: 58200 - protein, 160 aa, Sorghum bicolor
  Clone ID: 30977025.pep
MGEETHQSVQELAASLGALPPEFVRSEHDQPGVTTYRGADAPVIGMSEPGFGARMAVAATEWGLFQVVNHGVPSAAVAELQRVGRAFFALPREEKERYAMDPASGKIEGYGTKLQRDVEGKKTWNDFFFHVVAPPEKVDHAVWPETVAVAGYREANEEYC

SEQ ID NO: 58201 - protein, 218 aa, Sorghum bicolor
  Clone ID: 30977063.pep
DTKVFIFEVANGKRIPLGAGQHVQICVSTKSEDNKPPERIVRKYTPIEIHDGRFEVLIKQYEQGIVSRYIFNMKIGEKIFMRGPFGAFNYSPNKYKSIGMVAAGTGITPMYQIIREVVKNVEDGTKIKLLFANRSEEDILLKSELDTMVGDNLEIKYLLSQPKTEVYTKGRINQDLIKEFAYPNTDAMMLLCGPDAFCDLAKEILQSMNHSKSLLHTF

SEQ ID NO: 58202 - protein, 136 aa, Sorghum bicolor
  Clone ID: 30977079.pep
PRAGRRGLRDRQLRRGEHLEHGRQPVVHAGAGRVNNPSATSHHARARRHGNPRHHVAGEWIGHPRRSDTSGTPPSRGAEVAETRIRRRREIIWRNRRRRRTLLFVRFKMLFLGSYSSAPVLLRFLVFFSCLNSLAA

SEQ ID NO: 58203 - protein, 73 aa, Sorghum bicolor
  Clone ID: 30977082.pep
QSPPQLLQARRRRQHPDHRCSCWLRRRREPACGLCLMHISTSRSKSLLPLYMWSVDRQISNASGNVCPCLLGS

SEQ ID NO: 58204 - protein, 134 aa, Sorghum bicolor
  Clone ID: 30977084.pep
HHAPAPQPRPLSLPLHHFTVQPSAAAGVTAASRPVVLDSVPVIESPTTAAKRVRLFGVNLDNNPLSESDGGVGEASHQGNALSLQMPGWQQRTTPTLRLLELPRHGAAESSAASSPSSSSSSKREARSALDLDL

SEQ ID NO: 58205 - protein, 79 aa, Sorghum bicolor
  Clone ID: 30977090.pep
RKLHADLDYCPDPERYGRPIKPLERSAPEMPMERLLEATAPAQTPAPALPFDPETDMSVGGWLAEAVDWVLDKIEWVFG

SEQ ID NO: 58206 - protein, 30 aa, Sorghum bicolor
  Clone ID: 30977092.pep
DFATVALLFVCGKYCPIIDYLGSKDSSRDL

SEQ ID NO: 58207 - protein, 100 aa, Sorghum bicolor
  Clone ID: 30977093.pep
KLKKLAERDEEVVLASGIPCTIIRTGSLQSTPGGERGSDFTEGIATKGRISKEDAATICVEALDSIPRKTLIFEVANGDEKVRDWNAWFAEQIKREEEIQ

SEQ ID NO: 58208 - protein, 86 aa, Sorghum bicolor
  Clone ID: 30977108.pep
RTTHIFDDCIVESCGDLLLEKADKAASFVAGGAAGTCGFLSSCHACNKQLGHGNDILIYGGDKAFCSSECRYQEMMLFDEAVDNLR

SEQ ID NO: 58209 - protein, 146 aa, Sorghum bicolor
  Clone ID: 30977110.pep
IKTCLTRSTRPSMFPVYFTWISITRLGIGIQSQRRLIFQFTSPVSIRRVGTLQRRLIQPTSRWNHLPNSKFNTKTFEFHCFSTSSSICLLLLIEFATVIQLTWLEQAVMNAAMNKFKDGHKIHHQSHKAKRRRALAVELHHSVVFS

SEQ ID NO: 58210 - protein, 172 aa, Sorghum bicolor
  Clone ID: 30977118.pep
MTMMAPHPQPLPLAQPPPAAAAAFGDTTLTKVFVGGLAWETHKDTLREHFERYGDILEAVIISDKLTGRSKGYGFVTFKEADAAKKACEDATPVINGRRANCNLASLGAKPRPQPPHILRPGPSPPATPAPHAHALPSPHQPTPAIAVGSRGVSPVPWYYHASTTPPPPPPP

SEQ ID NO: 58211 - protein, 121 aa, Sorghum bicolor
  Clone ID: 30977132.pep
IDTSSCRAPIADPDVLSSFRETASRLAHMRLVALTSHHSPAARKAANAGRRLSGCTSTARATCCHARRSGCTPAASPDLFAPLVAPRFSRASARIPWCGCGGRRKQPREEGYAGRERPEAN

SEQ ID NO: 58212 - protein, 209 aa, Sorghum bicolor
  Clone ID: 30977141.pep
MATNGMAPSFFPANFLLQMQQPLHHQQQQEHHHHHHQHHHDEHHLLAPPPPALVSPFLHDFGGAMAAPPPMLAGGLGMGGDDSHLHAAEPQQQQDGGGVASDDEEVSAAAGGGCGGERKRRLSVEQVRTLERSFEVANKLEPERKAQLARALGLQPRQVAIWFQNRRARWKTKQLEKDYDALRRQLDAARAENDTLLSHNKKLQAEIMA

SEQ ID NO: 58213 - protein, 121 aa, Sorghum bicolor
  Clone ID: 30977151.pep
RRVEFSSPVQAVDRLASNGQEQPPARNRNARTPPARAAGRGQPSRWPSPSPTAATRTPLYATEGTMPAKRSTDPAKRRASSGTKRTCGGPWEPAGSSLQPPGDAVLAATRRPAGRRRWGWG

SEQ ID NO: 58214 - protein, 149 aa, Sorghum bicolor
  Clone ID: 30977157.pep
KNHVGDLDASSAQSMTSLTPNYLTRFANKNNIQGGGGYPNRSNLIVQTNPYDKPQPSFPFPNSRVMGHSFKVPGKVPVLNPETNQQVFSSPAIQLESTEEDVAMSDKKFKKYKLSQVRNVSHDTKVFIFEVANGKRIPLGAGQHVQICV

SEQ ID NO: 58215 - protein, 128 aa, Sorghum bicolor
  Clone ID: 30977163.pep
MGWGWSSCCKRSDGAEPGRRKKKKDTTWRIFSLKELQSATNNFNYDNKLGEGGFGSVYWGQLWDGSQIAVKRLKSWSNKAEREFAVEVEILARVRHKSLFSLRGYCAEGQERLIVYDYMPNLSIHSQL

SEQ ID NO: 58216 - protein, 122 aa, Sorghum bicolor
  Clone ID: 30977167.pep
SLASCFAFGLEPPCAALRFCLVSNGAESSWRACCRSCTGPSSTSPTAGRRPSATRSATSRRRSRRRPTTSASPPPEPTCRPSSPPRRAATTIAGDPDRSNHRPADDGSEAIRYEACEEEEFS

SEQ ID NO: 58217 - protein, 154 aa, Sorghum bicolor
  unsure (1)..(154): unsure at all Xaa locations
  Clone ID: 30977181.pep
MDMAHERDASSEEEVMAGELRRGPWTVEEDLLLVNYVAAHGEGRXKRTGKSCRLRWLNYLRPDLRRGNITPQEQLLILELHSRWGNRWSKIAQHLPGRTDXEIKNYWRTRVQKHAKQLKCDVNSQQFKDVMRYLWMPRLVERIQAAAANASAGG

SEQ ID NO: 58218 - protein, 95 aa, Sorghum bicolor
  Clone ID: 30977188.pep
RRGPCRSRRRHERDLAHGIGRVLLLLVRLLLSRESPARGELVHIATTTYPKQLELYLYSTALACFLWYFLLLPSLVPPPASSIHSSPPAGCYLAG

SEQ ID NO: 58219 - protein, 203 aa, Sorghum bicolor
  Clone ID: 30977196.pep
MPLPHLLPRLSHTPPPLRAGDRGNAALLSPGGRRRRRRPALLAVVRAKRKDEASFADRILDYIEGGPKLRRWYGAPDLLPKDGDGGAEDEEDESQVDIEEPRDAVLVTNGDSEIGQMVILALILKRARTKALVKDKRTTEEAFGTYVECMVGDMEDKSFTKKALRGVRAIICPADDGFFSEPTDLKGVQHIVLLSQLAVYRNS

SEQ ID NO: 58220 - protein, 62 aa, Sorghum bicolor
  Clone ID: 30977206.pep
LQKKKLICREQIRPQICVCSLTIHIELLQLSSIGNIFILQLTLTLSESPTYTDQEKKSHYQE

SEQ ID NO: 58221 - protein, 115 aa, Sorghum bicolor
  Clone ID: 30977234.pep
PLTLTRSVIARCNSTGDLYPFFPTTSSSSTHILTATPTSTLWHGRLGHLGSEALSKLISTQVIPCNKPQHEHICHACQLGHHVRLPFQLSSSRAVKLFDLIHCDLWTSPIVSVSG

SEQ ID NO: 58222 - protein, 80 aa, Sorghum bicolor
  Clone ID: 30977246.pep
TAFCLWAEVAAMRDVSATETAIIYGLEPVWGAAFAWAMLGERWGTTGFVGAILIIAGSLMVQIFGAIPDVSRGDNYQMNS

SEQ ID NO: 58223 - protein, 122 aa, Sorghum bicolor
  Clone ID: 30977247.pep
GEPLTYDYRFVHFGEKVKCHCEAVNCQGYLGSQIKNPIQSIIASATSQGQLREVSSTQQEASRLKPIKHLLPWTNCIEVSFNLRSKRKISRLCWAHKKKRTSLEASSTSMPTSMSEVPAADI

SEQ ID NO: 58224 - protein, 177 aa, Sorghum bicolor
  Clone ID: 30977270.pep
MFLPKHPSSSRPWRPSLQPGAHLIRPRPRIPATTSSGRRHLLRPSAAASSGSPSRDSPLPVPPAKRSSKNKAPDEIGRSKAVRPGMRESAGPETETEDPSPQRTALWSARRRARAAWRKVASWVPSKARSLVLLNLVTLIFASNISVVKQAEALLDPDLFNMLRFTIAAIPFVPLLL

SEQ ID NO: 58225 - protein, 169 aa, Sorghum bicolor
  Clone ID: 30977280.pep
MAVGGTQPVLRKYLGALKDTTTVSLAKVNSDYKELDIAIVKATNHVERPSKEKYIREIFHSISAARPRADVAYCIHALARRLSKTRNWAVALKTLIVIHRALREVDPTFREELINYGRSRSHMLNMAYFKDDSSAEAWDYSAWVRIYALYLEERLECFRVLKYDVETDP

SEQ ID NO: 58226 - protein, 156 aa, Sorghum bicolor
  Clone ID: 30977302.pep
TGRFELPRPRARVGCLQHATVTVTHHTQAMEEASARERKRPREVWKRLLKAAAWDPQYTYLPIADTLKVPGVQVCLFAVVAEIGAAVHSLGTDFTVTLRIVDESRKDGISATFFAENTALLPCVKSSGDVIRLHNVVVKHHHGEFFLTFDKKFSSF

SEQ ID NO: 58227 - protein, 56 aa, Sorghum bicolor
  Clone ID: 30977317.pep
HLDSSGNTNDQGINIWPSGSSICAQISTGSLCIEISTGSLCTEISTEHTTKYPWHM

SEQ ID NO: 58228 - protein, 136 aa, Sorghum bicolor
  Clone ID: 30977340.pep
VAPLASFPRRRCNPARRVRSLGIASSVARTRRRRFDGHFNRDSPGAIVEYVYTSRPVIRKVLYVYVILPDGRRVLYIYARTRWPVKTPTLPPPRRSSARMQRPSTSSSPPRRRPTPPFTPRRSPSTTSRAPSPSCS

SEQ ID NO: 58229 - protein, 176 aa, Sorghum bicolor
  Clone ID: 30977356.pep
PYLQAIAKETLRLHPAFPLVVRRSTEPCKVSGYDVPAGSTVFVNVWAIGRDAACWAPDPLAFRPERFLEGGEGRGDSAGLDVRGQHFHLLPFGSGRRICPGASLAMLVVQAALAAMLQCFEWAPVGGATVDMEEGPGLTLPRKRPLVCTVKARLHPVPVPTAAAADNGVDGTLHCA

SEQ ID NO: 58230 - protein, 34 aa, Sorghum bicolor
  Clone ID: 30977366.pep
CQPFCFFFRYIRGFPRKGFWCFSIKFKALFRVVD

SEQ ID NO: 58231 - protein, 87 aa, Sorghum bicolor
  Clone ID: 30977374.pep
PKFGESRDDSSFGRFDSFRSRDTGFFPQESRFSRFDSISSSKGENVSRFDTGNSSQNFGRFDSFDDADPFGSSGPFKASGSRSPPKL

SEQ ID NO: 58232 - protein, 89 aa, Sorghum bicolor
  Clone ID: 30977387.pep
SLREHKDSDEYVIPCGDWFGRVSCPHYLAELVLYFGMLIASGGSDISVWFLYLFVITNLSFAAVQTHKWYLQKFEDYPRSRYAIIPFVC

SEQ ID NO: 58233 - protein, 78 aa, Sorghum bicolor
  Clone ID: 30977399.pep
CALVEVQDCGSLVTEEQPYAMLMPMEYFLMGYGLYRPYQLSSSPRSPLSPCCIPPELLSPESMGVKLKPIKTRVAINF

SEQ ID NO: 58234 - protein, 55 aa, Sorghum bicolor
  Clone ID: 30977402.pep
INLGGDTWMRVGIWLLMGVLVYVFYGRTHSSLTDVVYVPVAQADEIYRSSSGYVS

SEQ ID NO: 58235 - protein, 84 aa, Sorghum bicolor
  Clone ID: 30977435.pep
QEKLQTPSQLLLWEKKININTKACMLLVPTPPFVTPSWRNMQKYETINSKLEIHINSKASLYFVKDLRSPSGRSLTSQLVAAGG

SEQ ID NO: 58236 - protein, 198 aa, Sorghum bicolor
  Clone ID: 30977450.pep
MEVATSRELINPTAFSILVLVAGLTTVFYVLRRRCSGNGGLRLPPSPLALPVLGHFHLLAPLPHQALHRLASRHGPLLYLRLGSMPAIAACSPDAAREVLKTHEAAFLDRAMPTAVHRLMYGGQDFIFSTYGPYWRFMKRACVHELLDGRTLERLRHVRREEVSRLVRSLSRSAGDDGAAVDVDAVLMGVTGDIVSRM

SEQ ID NO: 58237 - protein, 162 aa, Sorghum bicolor
  unsure (1)..(162): unsure at all Xaa locations
  Clone ID: 30977459.pep
ARPPPSTPAAAPTASPLRRRRSRTSPAAAPSPPEKSRRSSSAPRANRPPSRPAPFHPLRRPLPLPAPRRPAQILDAEPPLILHGAPLPYPPHRPLPDPAAXAEPLPAAQIHHMCASPPRFLSSCSSTPPPRPHQDPPIRITHSPPSSPTAAAPAPATPLLPR

SEQ ID NO: 58238 - protein, 118 aa, Sorghum bicolor
  Clone ID: 30977465.pep
YWILLSRFMLPGAGFRLNMEKVSGDQSEFTKNVFFQSAGTCTCTQDQNHTDALWPYSGVPEVATSQNYTATLHKRQCATLNCTIKASTIQLPAWPYRQASTKLHFKHSDLQLTSKHSD

SEQ ID NO: 58239 - protein, 62 aa, Sorghum bicolor
  Clone ID: 30977471.pep
DRVETLFPNITNKTVQTTYNHASRACIFNNILSGAAVVHSLSSCSFSTSVSTKVLNKSIHML

SEQ ID NO: 58240 - protein, 68 aa, Sorghum bicolor
  Clone ID: 30977492.pep
SRSDFRSSIIVSCQGAKRAIENALAMCEAKLLPSNMATTPSVVAADDVHGRSRGGDGHIKIYWILTEV

SEQ ID NO: 58241 - protein, 117 aa, Sorghum bicolor
  Clone ID: 30977500.pep
MALEAGSSGGGGRGWGGGFRSLMRRKQVDSDRVRAKGQPQLAKELNVPELVAIGVGSTVGAGVYVLVGTVAREHAGPALTISFLIAGIAAALSAFCYAELASRCPSAGSAYHYSYIC

SEQ ID NO: 58242 - protein, 124 aa, Sorghum bicolor
  Clone ID: 30977516.pep
VRSCNLLAQAYLYTTSPHLFEGDAEDAFIRVRNKVKVPLYGCDCYAYALLASGFVDIVVESGLKPYDFLSLVPVIEGAGGSITDWRGDNLHWPVTAESRPTSFNVVAAGDARVHKQALDTLQWC

SEQ ID NO: 58243 - protein, 139 aa, Sorghum bicolor
  unsure (1)..(139): unsure at all Xaa locations
  Clone ID: 30977544.pep
FASPRVGDGNFKRAFASFPDLRALHVKNAGDVVPTYPPLGYVDVAVQLPIATGRSPYLKQPGTILTLHNLECYLHGVAGEQGSAGGFKLEVDRDVALANKGEDALKXQYPVPVSWWVAKNNFMVKGTDGHWALQDFEQI

SEQ ID NO: 58244 - protein, 59 aa, Sorghum bicolor
  unsure (1)..(59): unsure at all Xaa locations
  Clone ID: 30977580.pep
VNRAVVGRRVGAYFKLXRRKSTFTEELRAGAATFLTMDYIISVNAAVLTDSGGPCTARD

SEQ ID NO: 58245 - protein, 194 aa, Sorghum bicolor
  Clone ID: 30977602.pep
MLSSSSTTAHSATSPLPGPASTNPNPRSRLLRLHAASRVPSAALNARGRPPMCSVSASSAAGAGGWGAAAVGELATERLVEVAQRAADAAGEVLRKYFRQRVEIINKEDNSPVTIADREAEEAMVSVILKSFPTHAIFGEENGWRCAESSADYVWVLDPIDGTKSFITGKPLFGTLIALLHNGKPVIGVIDQPI

SEQ ID NO: 58246 - protein, 75 aa, Sorghum bicolor
  Clone ID: 30977617.pep
PCQMVPSTLKMLLWYDYLFLTHLISMLQMSSKGDIREHCITQFHHYYPNPNIEDKYTRSIDHMFRTDHKFQRNTL

SEQ ID NO: 58247 - protein, 201 aa, Sorghum bicolor
  Clone ID: 30977651.pep
MIVAAAPAPPVPAPPAKPPLPILSSSLRRGFSSWWFSNGNAHGRDSTTSSRATRRRWWSDPDGSEEDYGSSSLEDEEYDYDYDYDDEAAFPGFGGAGELFDEPWFSKVFKMYGFLLPVMLVSMFAATGTKAFLMAMVFPLGQSAISFLLDAVWGRSRKGNRDDRRWRRPVQEEDYPEDTTDFATGGRGNRYSGGTSSYYEG

SEQ ID NO: 58248 - protein, 141 aa, Sorghum bicolor
  Clone ID: 30977672.pep
NGMDQPGDLTREEYLHDTVRIDFYKNYLTELKKGIDDGANVVGYFAWSLLDNFEWLSGYTSKFGIVYVDFTTLKRYPKDSAYWFRDMLSGTGSKAAAAPQTGSGTRPAASASATSNGAALLVSLFVSLCVLLPSVFMVSSV

SEQ ID NO: 58249 - protein, 53 aa, Sorghum bicolor
  Clone ID: 30977677.pep
TICTLNTVAKVHAPPPPSLTSLPTEIASNAKTAQTDPGHFTARAQSNSSTPFC

SEQ ID NO: 58250 - protein, 156 aa, Sorghum bicolor
  Clone ID: 30977684.pep
VVHQDGYIEIKDRSKDVIISGGENICSKEVEEVLFRHPAVADAAVVAMPHPHWGETPCAFVVRRNSAAELSEDDVLAFCRKRMARFMVPKKVQVVGALPRNALGKVEKVKLREAARKLAPTVPAQKPKGKTTTSSTTVGGRREDQPVAHVMAVSRL

SEQ ID NO: 58251 - protein, 88 aa, Sorghum bicolor
  Clone ID: 30977686.pep
KIYELKNQMLRLSLHKLQKHLFILVFQGCIIILWNVLCNLSCKSYFYLIPHPFIIPLPISRMFSFPKREKKRLFKRKRECRRITKLAM

SEQ ID NO: 58252 - protein, 41 aa, Sorghum bicolor
  Clone ID: 30977691.pep
KNTESELERDAQFLGVIPLLLISLSYFLIEMFRFVIAIGRE

SEQ ID NO: 58253 - protein, 108 aa, Sorghum bicolor
  Clone ID: 30977698.pep
ELKLSVPQQYGPLKLQVFDHDMLSKDDKMGDAEIDLQPMISAATAFGDPDLLADMQIGKWLKSPDNALARDSAVNVLSGKVKQEVSLMLQNVESGEVELELEWIPLNQ

SEQ ID NO: 58254 - protein, 171 aa, Sorghum bicolor
  Clone ID: 30977709.pep
PEMAKLLELDDGYFIDQFGGKADAYARFSYYPPCTRPDLVFGLKPHSDGTFFTLLMVDNSVGGLQVLRDGVWYDVPTRPHTLLINLGDQIEIMSNGIFKSPVHRVVTNAEKERLSVALFYSIDPEREIQPADKLIDENHPALYKKVKIKEYIAGLYEHVARGEMVIETAKI

SEQ ID NO: 58255 - protein, 86 aa, Sorghum bicolor
  Clone ID: 30977718.pep
PKYMLCGYLRNRRAREASILQSIENGAQTLFDIVSKTYSDVDRKFWIPASFNVRLHVDHLNSLHKLPKDFSLEMFSRSCDDFISKV

SEQ ID NO: 58256 - protein, 210 aa, Sorghum bicolor
  Clone ID: 30977744.pep
MGSPSYKLAAAITVPSTGEFLVVRQPRPPSPPDEEEDYRRFVDSDLYDLPSAPLAPLAGTLRSEVAIGGADSVAVRLDLSRLDVSAALDQIFDQFGLPDGMRGEWRLLKYVEEAEFGPDAGINTVYIIGSLESKLDAPQESCKWMSKECALRLLSEAKPGNDRIGQYAYIGILNSELSSNTTTSPALPSQEYPPGITLVPMKSRTLAPFR

SEQ ID NO: 58257 - protein, 169 aa, Sorghum bicolor
  Clone ID: 30977752.pep
MDLLRSHLHKVRIPEPTNRIHKDECCVSFDTPRSEGGLYVDMSSFLGFGREYVEWNFEKTGNPVYLHIVQRRKPEPDEADRPLKKPTLLAIGVEGGFGDQEPEYDDTFEIVILPDFVSLPFPSVDLPEKVRLAVDKVLLAESADRKEQLAAWVADKKNISAYAMDLQQL

SEQ ID NO: 58258 - protein, 182 aa, Sorghum bicolor
  Clone ID: 30977774.pep
MFVLRKTLLHGLPAPPAAAAAAPSRISSLLRLLPSASFSGGSGGGDEWGASSFPGGGSGGGGDEWGSTWSTGLTKDHFDGSSPSVGRPAPSPSVGHPDPSQSAPISHERAAVRSMDEWDEMIRDLERSDVEAKAFVDSWDDRWRETCALLKQVREPGARGSYLKDSEKQEMYRLHKEDPATY

SEQ ID NO: 58259 - protein, 180 aa, Sorghum bicolor
  Clone ID: 30977777.pep
MGAAAAGPAAAPPATTHCRSIQLLLLALAVVPLGSRGLRVRAVGADTGGLSRDAFPKGFIFGTATSAFQVEGAATSGGRGPSIWDPFVHTPGKIAEDGNADVTTDEYHRYKEDVDLMKSLNFDAYRFSISWSRIFPDGEGKVNEEGVQYYNNLIDYMIKQGLTPYANLNHYDLPLALQKK

SEQ ID NO: 58260 - protein, 178 aa, Sorghum bicolor
  Clone ID: 30977790.pep
MDQLPKRPANYVPLSPVGFLPCANAVYGDRASVIYGRVRFTWRQTYHRCRRLASALLSLGVRRGDVVSVLAPNVPAMYEMHFAVPMAGAVLNTINTRLDAGAVATILRHSGAKLFFVDYDYVRLASDALRLLAADGTPAVPLVAVIDDIDSPTGARLGELEYEALVAHADPDADLPPL

SEQ ID NO: 58261 - protein, 25 aa, Sorghum bicolor
  Clone ID: 30977792.pep
FFVCKLVCSIIFKFILLTYKFNFVM

SEQ ID NO: 58262 - protein, 177 aa, Sorghum bicolor
  Clone ID: 30977800.pep
MKPSQSKKKGKKKKKSSPPAAVPAPPPPAEGAADSEACSLLPETLTISAAAAATAAVSETESSSSGEASTCASSACFTASSSGTASSSSFSPFSSSASTASSSAAGEERRDLTWLLDAFASATIDQIDSAYREAGGDPFVAAGILGSTQDTQPPQPPQPAAQPPPPPDLSPRSGSGG

SEQ ID NO: 58263 - protein, 44 aa, Sorghum bicolor
  Clone ID: 30977819.pep
MRHDMESCDQGGEDQDKAWLDGPVARVKGKSEALKRGTACDGEA

SEQ ID NO: 58264 - protein, 139 aa, Sorghum bicolor
  Clone ID: 30977827.pep
ADERGLKRAAVTNAPRANADLMISILGLSDFFQLVVTAEECERFKPFPDPYLRALELLGVSPEHAVVFEDSTTGVQAGVAAGMPVVAIAEESREGKLLAVGATLVIRDYEDPKLWAALDKLDIAKPEAAAEANGTHTQL

SEQ ID NO: 58265 - protein, 124 aa, Sorghum bicolor
  Clone ID: 30977828.pep
TEVDVSSANEHVRADDLEVMLREAYAHPAVEGVMLWGFWELFMSRDDAHLVDAEGQVNEAGRRLLQLKREWLTHSHGHADENGEYKFRGHHGEYHVDVTTATGKVSQTFTVDKDDAPLVLNIKV

SEQ ID NO: 58266 - protein, 75 aa, Sorghum bicolor
  Clone ID: 30977837.pep
RLIIWSEANKSFSALHAFLAAKDDMGISYITHVQIHFASSPCLPNADQGPTSLSTRPKAAAVRPPRANGPDHLFL

SEQ ID NO: 58267 - protein, 108 aa, Sorghum bicolor
  Clone ID: 30977861.pep
KKVRLAKLGVTIVIPLEPVSGKWMEMIVIVHAGGLCLSHVGFAQTIWLRMNLRMMSWKLNSQAAARRDMGTWMEEKLYYSRSHHILDTSQSALYNVDVDARCWTLFLA

SEQ ID NO: 58268 - protein, 207 aa, Sorghum bicolor
  Clone ID: 30977880.pep
KAKNIDANPKDYLSFFCLGNREVKVPDEYEPKRHPTPGTDYDRAQKARRSMIYVHSKLMIVDDEYIIIGSANINQRSMDGARDSEIAMGAYQPSHLNTNGDVARGQIHGLRMSLWYEHLGELQEDFKDPGSLKCVRKVNKRAEEFWKMYTSDNLEDNLHGHLLSYPIDVTSEGTVTEREGVKFFPDTEAPVLGTVPLRVQLGSAFTD

SEQ ID NO: 58269 - protein, 186 aa, Sorghum bicolor
  Clone ID: 30977903.pep
MAAMPLLHGTLDATIFEAKFNNSNQVTKFLQGLIPQMEGRPTGLPVQMYATIDLNNARVGRTRIDDSNPDNPRWNESFHIYCAHYTTHVVFSIKLRLPIDAVLVGRAYLPVQDLLAPTPNDQEDNIVDRWLDILDDEKKPLPHGPKIHVRARFTDVAGDPSFGSGIDGKKYAGVPRTFFKQRQGCR

SEQ ID NO: 58270 - protein, 62 aa, Sorghum bicolor
  Clone ID: 30977918.pep
LAERNKDAARMAGWLHYLSDEKRFPKTRQVEFDLVLGSNGKQFRTRSIEVVRFVKLLDEAKS

SEQ ID NO: 58271 - protein, 65 aa, Sorghum bicolor
  Clone ID: 30977923.pep
TGPAMGTSIAVGSSMLPQTRSPTLRRRRRRPAASCGGSGSGGGDPQPDPAGGLADRRTEAAWWVR

SEQ ID NO: 58272 - protein, 169 aa, Sorghum bicolor
  Clone ID: 30977926.pep
MIQSNKFFATMAIPVDPSDSVRGCSSGIGRVAPLEAVLFDIDGTMAISDPFHHRATSEMLLKVGYNNGVPITPEFGMAHMAGRSSDQIGRFLFPDWDQARLDAFFAEKEALFARYAGEGLREIAGLTALCRWADERGLKRAAVTNAPRANADLMISILGLSDFFQLVVT

SEQ ID NO: 58273 - protein, 171 aa, Sorghum bicolor
  unsure (1)..(171): unsure at all Xaa locations
  Clone ID: 30977928.pep
MAAIGGDDAAGLVVVVGDGAGDDNIILNPEFDDGLDNWAGNGCKIELHDSLDDGKVLPANGKYFVAATGRTDTWNGVQQDVTARLQCKLLYEATATVRLHSSAAAVAPCEVRATLGVQTADGRQQYLGIGKSQVSDKEWVQLQGKILLNSTVAKASIYIEGPPAGVXVLLD

SEQ ID NO: 58274 - protein, 151 aa, Sorghum bicolor
  Clone ID: 30977939.pep
WSSSRRLRRSRPPPSLPLSRVPTQPRRRHRASSAVASARHGGGHPPPCPFLLAPQGLAEWRRPLQGAAPMQHVAAALDVGPAATIPASCPHYCPPTLLVRISSCHRRNPRCLGSRTQRRLASSSSAAAPTAQFGCRILPYLTPPPRVLHRR

SEQ ID NO: 58275 - protein, 160 aa, Sorghum bicolor
  Clone ID: 30977940.pep
LQLRRHHGGRCLPPHPGPLPHAHLVRFRGRRTEQERQPRAPSIPCPQEWLRSYPPPPPLSLSLSLSLSWQVHARRVAGLAGPGVSALQSRVVRAIALLLLVVVAVASFMSGKQGWIRGSKWSSEWLEETSHSLRDETSRRDGAEVMKGCRSRQPAAPQGV

SEQ ID NO: 58276 - protein, 178 aa, Sorghum bicolor
  Clone ID: 30977960.pep
DTDAQSLEASLEEKSLEIEGKLHAADAKLAEANRKKSQADRDLEEAEARQRRLEKEKLYFETERKAREKQLKEQEESLQEWEKKLKESQNRLNDLQRSINEREERANKNDQLFKIKQDELEEARKTVEAAKVTLKVKENDINKRLNELHSQEKDADSKRSALEEREKKLVEREAKVTT

SEQ ID NO: 58277 - protein, 106 aa, Sorghum bicolor
  Clone ID: 30977965.pep
MRRTKRGDGLAGRSHKSTTPPNGKRKNNNLLASAIEKIQKTKRGDNDFTRRLHKSIRGRNGNGMVTESMALGDLHGDSNRYDWTRLSDELKSNLSRSVASLALCNG

SEQ ID NO: 58278 - protein, 109 aa, Sorghum bicolor
  Clone ID: 30977983.pep
QIGIPPQTASATSSFMVLFCASMSMVQFILLGVEGIGQASIYAGICFVASVVGVVVIQRAIRKSGRVSLIVFLVTAIMALSTVIVTCFGALDVWMQYTSGEYMGFKLLC

SEQ ID NO: 58279 - protein, 93 aa, Sorghum bicolor
  Clone ID: 30978009.pep
LNQSTNFLPVLPFLNNQQLGLLATTWAGALFGPTPILATHKRVHNRLPVLQAGKSCVTVQIFSLHLQCVERNVKQATYIVAVGLSVLELIANV

SEQ ID NO: 58280 - protein, 189 aa, Sorghum bicolor
  Clone ID: 30978022.pep
LGFVIIQPRGFPNPYLHGCRRRHHRASFVSAATVHPSRPLAAASPVHLQRGMAGAARAAAHLPLPSAPSPAACWFITSLWLLYWGLAAIEIEMLACGKGCPVVAKTCKPARSSLSPGCHFALVLSFGVQHCSVLPGHPLPTSRQPRVLVSKSFAAMRESLQFILLLAVGALLKGLAFVCVCVCVCEQGS

SEQ ID NO: 58281 - protein, 156 aa, Sorghum bicolor
  Clone ID: 30978042.pep
ALPAALEQEASSPARRRGNRTNTIASPPARASSNSKQNKQTSNAAPGPAPPPCRRTQPSPRRGGALPALPLALRRPRPSPVPVALRPTRTTRTQRAHQRPPPRRTRPPQARPRPPPQRTQATEDRPRRRRAGLRAVSAHLFAGNLGGSRRRLNPFH

SEQ ID NO: 58282 - protein, 198 aa, Sorghum bicolor
  unsure (1)..(198): unsure at all Xaa locations
  Clone ID: 30978046.pep
MPREISRSPPPFRRRGSPPPRYASRRNRRDRSRSPYASRRKTRSPSPLWDRSNSPSPRRHRSPPSPRRHKRQRSRSTTSSLENNSGSPSHVSEKINPTVKQRMEEEKKRRQKEAEFKLLEEELARRVEEAIRKNVEERLNSEEVKLDIERRIEEGIRKLFDEVDSQLQKEKEAALHEARKKAEQERREREELDRMLEX

SEQ ID NO: 58283 - protein, 107 aa, Sorghum bicolor
  Clone ID: 30978049.pep
QSTKPTMTRTTQLFPLVAPPSRFLPVSGGASNTTTSSLQSLLAEVSQWRETQLGDPSSSPGGARLMLACGRTSRVMGALLPGGSVSSAGAWAAGAVPAHLEPGGGWA

SEQ ID NO: 58284 - protein, 77 aa, Sorghum bicolor
  Clone ID: 30978061.pep
LASLYQSTHFSEFNNVLTNQCRCGRISPPLNSTPPERRWSGASAECARRRVQPRRAGVRRSGDGRRRRCARLHAAQA

SEQ ID NO: 58285 - protein, 170 aa, Sorghum bicolor
  unsure (1)..(170): unsure at all Xaa locations
  Clone ID: 30978068.pep
MAAAADVSTAARTSSSPAAEEGGQRGEHESESEGEEVGVAAVLDFDMLCASVALSAERRKGAAAPEGAXGXCGGXCGGVQRMWEGDVVLDCLEDRRIALEASCCPCYRIGKNMRRANLGSCFLQGMXYCILLAAGLISLIAFSVTRHHIYLYMGLGSVLLIAIYTGYFRR

SEQ ID NO: 58286 - protein, 56 aa, Sorghum bicolor
  Clone ID: 30978075.pep
GRSGRAERQKNLRRSQRRRSETSLRFAGWEGMWIVEYSSMMPFGEETRFTIDYLLS

SEQ ID NO: 58287 - protein, 149 aa, Sorghum bicolor
  unsure (1)..(149): unsure at all Xaa locations
  Clone ID: 30978076.pep
NRXSLLASLPTGGPLVPNTSGLPLATAGSAGAXDVALHIGRLLLLGGGGLGREEDTXQXXEDPVQEAAGFGRVPEQRLQLRRVLPPLHHVLHHPRVRRRRCHGHTATEPARGKKKMKKKKITTRPPQVHSSQLSDDSLEAAASSRASNQ

SEQ ID NO: 58288 - protein, 78 aa, Sorghum bicolor
  Clone ID: 30978115.pep
SRPFRDIFDYGMDMKRVTGTACRAYEGASRIGRGNLAASNKVKKCGLFVTGSVRPNKAVAAATTTMLPGTRVIIKNFF

SEQ ID NO: 58289 - protein, 100 aa, Sorghum bicolor
  Clone ID: 30978131.pep
QKMLTTMVPKRRPRIGRSMALMAGKLNNIFGAEPLFGTLHFQYLQHEQNKHNTRHITRTSRNLSTIAIQPTNIDKDTHYSIFDEPTIATSASMQHLFFMR

SEQ ID NO: 58290 - protein, 98 aa, Sorghum bicolor
  Clone ID: 30978138.pep
TPTYSFQSSAGAADRNTRKKNLYIHLACTEPRRTNSLDEETNKSWLAVHDAYVTRSSNCDLVILCSRFSQVCCHRLDGSWSPLLAYVVGTALIARLEH

SEQ ID NO: 58291 - protein, 104 aa, Sorghum bicolor
  Clone ID: 30978160.pep
MSRYVEMLDMGVRVAARFHSHCPQTARMYYKPPQTQTTTTSSSSSSSADDANKATSFGLDAPSVLRRPSALAAAGEFRAGDRSGHHQLHDFGFDTAQVVVYEVV

SEQ ID NO: 58292 - protein, 194 aa, Sorghum bicolor
  Clone ID: 30978170.pep
MEERYEALKELGAGNFGVARLVRDKRTKELVAVKYIERGKKIDENVQREIINHQSLRHPNIVRFKEVCLTPTHLAIVMEYAAGGELFEKITTAGRFSEDESRYFFQQLISGVSYCHSMEICHRDLKLENTLLDGSPTPRVKICDFGYSKSALLHSKPKSTVGTPAYIAPEVLSRKEYDGKVADVWSCGVTLYVM

SEQ ID NO: 58293 - protein, 91 aa, Sorghum bicolor
  Clone ID: 30978175.pep
LTSRKVLEEEASPIPLYSLADLGSPASDLPLDARTSRSPAVKEEAGRRDGAGRREEAFLPAHQLANRGFTVVSCRTDNISVPSYQEVPYIA

SEQ ID NO: 58294 - protein, 146 aa, Sorghum bicolor
  Clone ID: 30978198.pep
PGHGWSNPSLPFLIPLGLFAWFVERWVVPFSNWVPLAAAVWATIQYGRFKRRTTVEDLNKRWKHLILNTAPTTPIEPCEWLNKLLLEVWPNYMEPKLSKRFQSTVERRLKNRKPKLIDKIELQEFSLGSCPPTLGDQGMRWITSGD

SEQ ID NO: 58295 - protein, 139 aa, Sorghum bicolor
  Clone ID: 30978202.pep
MRRSRCHEGGGAAAAAAFSALLLGCVLMALVGGGAAQGPRLPSDYKTLSGAAPLVIAKGGFSGVFPDSSQDAYSFAKVASAPGTGTAMWCDVQLTKDGVGVCLRDINMNNCTTVGQADPARKRTYVIDGMHKTGWFVSD

SEQ ID NO: 58296 - protein, 167 aa, Sorghum bicolor
  Clone ID: 30978212.pep
MHANEKCVNVVVGDVDVDLYPFLLRYKDGHVERLLCSPFVAASENPTSNRGVATRDVVIDAGTGVSARLFLPCRATSGGRSRRTTTKLPLVVYIHGGSFCTESAFCRTYHRYATSLAASSGAVVVSVDYRLAPEHPIPTAYDDAFAALRWAASLADPWVAEHVDPHR

SEQ ID NO: 58297 - protein, 44 aa, Sorghum bicolor
  Clone ID: 30978217.pep
QCSPAACQPRLGTLKHTVVSHSPGQSAGGAARTARTRRRTGGAT

SEQ ID NO: 58298 - protein, 145 aa, Sorghum bicolor
  Clone ID: 30978244.pep
AAAAATAGAFPDVTITTAFSLSSVATASGKLRVHECSICGAEFASGQALGGHMRRHRPLNAPDRAVTVTTAIVAADTTGNSNSKKESSAGINLELDLNLPAPSDEEAVVSRLPPPPAVMLGLGQFNDGKKAGLMLTASALVDCHY

SEQ ID NO: 58299 - protein, 66 aa, Sorghum bicolor
  Clone ID: 30978250.pep
TSFYKSTEVDHGTPVLTGGYKLVLQHHQLVIIHFTYTSLQPHELKRNQERGRPSTHHSVPYNHALK

SEQ ID NO: 58300 - protein, 140 aa, Sorghum bicolor
  Clone ID: 30978261.pep
HTNHNKHHHHGGGGARIFSAGAFAVRPELCSQKGIFFPPVPLVPEPPNIGGVPIPPNPVTPAPPSLVPPLLPTPSPPSVLPPLVPQPPPSSIVPPLLPPLVNPPPPPPPPQLFPPVPLLPPVVPGVPPASASKNRRTGNP

SEQ ID NO: 58301 - protein, 161 aa, Sorghum bicolor
  Clone ID: 30978304.pep
MAAAAAAVTATFRTLLQHAAVGGVPVPLPSVRFQSLQRHRVGLRLLAPPRGRPVLLPPVAAAAAGEEFSSDGEDSTGDEYFDEEEASESEEEAEAPRAYSPPRSRPTRGDDPGRLFVGNLPYTYTSEELVQVFAEAGRVDDAQIIYDKVTNRSRGFAFVTM

SEQ ID NO: 58302 - protein, 157 aa, Sorghum bicolor
  Clone ID: 30978364.pep
MGYDQSKSNDGDVTAPMMLHGRVAIVTGGAGGIGSAVSKHLASLGARVAVAYIGDPAPALELVSTINKNSSSSSSSSAGGGGDQPRAVAVEADVSDAAQVKALFDAAEAAFGGGGVIHILVTAAAVLDFSYPALAETSEASYDATFGTNARGTFLCC

SEQ ID NO: 58303 - protein, 70 aa, Sorghum bicolor
  Clone ID: 30978378.pep
FKSVTPGNIWSSFFFTFAFAFPFLQPNSSFHFRFCLVGSRSRIFVRLSFVPEVIFLSTQHLSCIFASAGW

SEQ ID NO: 58304 - protein, 161 aa, Sorghum bicolor
  Clone ID: 30978380.pep
SKDFIDRSKRNSKNRSNLKILHHSGSKPYRQIIWDNGGKENNPPTLDKLFSLTHMKDGTFVDSETSTKHAEIEVERLLNPTLSNVELMDKCFESNRRDHVVGYGGGIRARDIRSPTVTKAELIEKLTQSEQEKKELQEDNQTLHEENRTELKSRIKEQYEC

SEQ ID NO: 58305 - protein, 106 aa, Sorghum bicolor
  Clone ID: 30978388.pep
GKDVLEALGKDGVIVNISRGANVDQAELVRALQEGRIAGAGLDVFENEPGAPGELFSMDNVVMTPHVAVFTAESMSDLRDHTIANLEAFFSGEPLLTPVLPHSPVM

SEQ ID NO: 58306 - protein, 49 aa, Sorghum bicolor
  Clone ID: 30978416.pep
KPPFVDLANRLFDSFETLQEAVTAKDDDRISGRYAETKVILQELMAKMA

SEQ ID NO: 58307 - protein, 54 aa, Sorghum bicolor
  Clone ID: 30978420.pep
VHRMAAPESHIAIIGGTGKYENAKGFAAIQTLHPGDEHTTDGVETLLQFNVHLI

SEQ ID NO: 58308 - protein, 140 aa, Sorghum bicolor
  Clone ID: 30978421.pep
LENARQILKIVDEFGSFDRYCWGFLNHKPIVSKFRYPRQVPVKSPKADIISKDMMRRGFRGVGPTVIYSFMQAAGLTNDHLVSCFRFEECNAIPTLCTSDIDRVNMKADPKKDEMTTKIYCEEITTNPEMPRTIDALIVS

SEQ ID NO: 58309 - protein, 43 aa, Sorghum bicolor
  Clone ID: 30978425.pep
RNGIDRNIKLVYTEFIYSLRVGHIGLELVNSHIASGAPRDIYS

SEQ ID NO: 58310 - protein, 72 aa, Sorghum bicolor
  Clone ID: 30978432.pep
MARARGGAAWVLLAAAWVLWAAAAAEARSPSGRRVHRHLKRLNKPAGKSIESPDGDIIDCVHISHQPAFDHP

SEQ ID NO: 58311 - protein, 62 aa, Sorghum bicolor
  Clone ID: 30978437.pep
GDLSQRTAGSYHHGCKLLPCLLRRQPPSAPAEPTHAARDVPSLLVLLPAAAVPVQEVSLPRP

SEQ ID NO: 58312 - protein, 140 aa, Sorghum bicolor
  Clone ID: 30978441.pep
MAKNAAQAVRAALCLALALALAVANCAFAGRVLDEQAAAPLPTDPLPAPTDPPADPVVAPAAAGAAGAASAGAAATGNAGAAGAGAGDHPLTFFMHDILGGSQPSGRIVTGVVASAAANGQLPFARPNTNIFPIQGAMPL

SEQ ID NO: 58313 - protein, 190 aa, Sorghum bicolor
  Clone ID: 30978453.pep
MARGDGPAPAPAPTPARGARVVLCPLSFQGHLSPMLHLAGARHPAGITFVAVPDVIPEAVAPATNNGGIAKLLALNAAMESSGHVRHALASLLAEEGAPRLACLIFDSTLSAAQDAGAGLGIPTLVLQTGSATSFRLFRSNTYDMLHDKGYLPATESNLHMPVKELPPLQVRDLFDPSKLPNKEIVHKIL

SEQ ID NO: 58314 - protein, 71 aa, Sorghum bicolor
  Clone ID: 30978468.pep
KGSGKTVQKRQGRGRNKCKKVAKLKAGEKIKVVFYNNRALSKTFPRQLGRIVRDSNITPIRVKKWTDISPA

SEQ ID NO: 58315 - protein, 180 aa, Sorghum bicolor
  Clone ID: 30978504.pep
GPNDTCCVVLTEFILKLAGQNNLPPQPFLLALASSSNIGSSATPIGNPQNLVIAVQSGITFGQFLVGVFPAMIVGVVTNTCILLCYFWRYLSVPEKDQEGGAAERGPEVVADEEVTSHRFTPARMSHASSVNGGVDVDCISEPIRRTDSLNRADTMSMRSRSYNSEGDIQVAIRSMRASS

SEQ ID NO: 58316 - protein, 86 aa, Sorghum bicolor
  Clone ID: 30978513.pep
CCSSSSPPLRLSPPRGCLAPSLRRPRASKSPQLPLISLFPGVVQAPGTGRPPGPCLGVYRVPALLRAMLGLSAAGVGVLGPELAPL

SEQ ID NO: 58317 - protein, 44 aa, Sorghum bicolor
  Clone ID: 30978522.pep
KQARKFQTWSIAGYLVARMMLEDPSTLMMISMEEDRPVKPTMRR

SEQ ID NO: 58318 - protein, 96 aa, Sorghum bicolor
  Clone ID: 30978528.pep
SWSLCTNCAAVLCPEGLYDGMLLFFMFPVHCSFPLHLQDWAFHLLLFASTLHNGIQALINPVSVPQKIMSFAVNKLVILLPADSLPTFCCFSLNHI

SEQ ID NO: 58319 - protein, 53 aa, Sorghum bicolor
  Clone ID: 30978532.pep
AVTGWYVFITVHAYTTLEHIYSMQAVLNLHFRPLRHSYPPQLTCVEMNTSVAK

SEQ ID NO: 58320 - protein, 145 aa, Sorghum bicolor
  Clone ID: 30978539.pep
VSEVQAQKKGRGKKPAAAVKPKAPAPRKRAPAQGKATQKKIDEMLQGIEDNNTSPEKKVRKMRPSPFNKKSGSILQRGSTAASSETTAEASPPSGSSAEPVGAAQPRRTARATKKPVYVTDSDPEDEVVELTDDSDFDVDGDSDE

SEQ ID NO: 58321 - protein, 177 aa, Sorghum bicolor
  Clone ID: 30978546.pep
ARVGPVVIASSDLLKTAADDRAFLKRAGEGWGGVDEILLPAEPAALRKLLELASYRPPPRLMTPDFLLCDFIKKLFTENRERLVHLLKGITVGTDKFQVTPIPQDALIVWGDHDQLFPVEKAFAVQRALNGSARLEVIKKTGHAPQPEDPARFNRVMLDFLLASHKPDDPSVNPSSQ

SEQ ID NO: 58322 - protein, 177 aa, Sorghum bicolor
  Clone ID: 30978552.pep
KGGGMYWFTDLTTPDNLFILPVLTSLTFLATVELNMQDGMEGNPMAKTMKKVSRFFGVMFVPFTIGFPKAIFFYWVTSNLFSLVYGAVLRNPAVRLCLNLPPLESHPTPAQVQPLNLSRGPEASPGVDSPISDKECEQSSSVLSTGADSPIADKECEQSSSVLSDRILFVASKGYPN

SEQ ID NO: 58323 - protein, 210 aa, Sorghum bicolor
  unsure (1)..(210): unsure at all Xaa locations
  Clone ID: 30978569.pep
PKEYETFVVNYNTQPEGWDLEKVIAMCVQEEERLKNANGGSVNFVKGKNKKPFYNKKAPDASTSQNKGGSTSQPKAHPKQDNQHRQEDPDRCRWCNETGHWKHDCPKFMKHCLVKXFSGGRTLQRGERQIKVATGVEAEVQAIGNLSLDLASGFTLELHDVLYVPSLARNLISVSCLSDYGFDCHFSKNDCKLQLNNKCVGLAFRQGKLY

SEQ ID NO: 58324 - protein, 162 aa, Sorghum bicolor
  Clone ID: 30978582.pep
MAASPSPRAAALRGPSLIALLFLVAAVVSVPPVAAEIRETAIRADPRSIIPLDEFGFSHSGVLELNVSGIAFDPPASAELDLSQLGFFLSTLDAWVHVLRQLQDLDVTCALQSELVKLASSFDLLRPPSNPAGVEVARSSSFSTAFRVNEPGQYTLVFANCL

SEQ ID NO: 58325 - protein, 190 aa, Sorghum bicolor
  Clone ID: 30978584.pep
MSSKKKRAAIDLSLEVERSDEDHGSGGRGKGDRRRGKDDGEVDKKEEQFKEQGEEPKEETGEEEKVVVEVVVDQGGDGTKEIKYRTQQGEEMEDDKQSPADAHGDGESDGAEARAQDKHVVEAAGNGDGGDDSYTTMVQDEVSAMQEEMEKMKEENRMLRRVVDRTVRDYYELQKKVEACYQQQQADEPK

SEQ ID NO: 58326 - protein, 104 aa, Sorghum bicolor
  Clone ID: 30978590.pep
MATTDQALNAMHFISAIPKLTGQNYVLWREELDAALALAEIDLALQEPKPTEPEEPERAQNETDEAFANRKRDFAPIRAKYDLEKYKWEKSNRKCKIVIKKTIT

SEQ ID NO: 58327 - protein, 160 aa, Sorghum bicolor
  Clone ID: 30978592.pep
MKKASRYLKQLFSAIVAAVKARSTAVGTKASSLRTRLIVLGIMRNKKLLLSAIQSKIHAIMGGGSSGHHQHQGSSSSGGYGGNNGNAVASGHGGGGEGERGLFLASSSGARKAAVLQSLPSFAVEQEARAVVLLSSLPSFALERDAGGANEDKDTVEEAA

SEQ ID NO: 58328 - protein, 201 aa, Sorghum bicolor
  unsure (1)..(201): unsure at all Xaa locations
  Clone ID: 30978598.pep
LQDGSLETTAGIRVPQHQARALTRPAXRGYICKCNQGFEGNPYISDGCKDINECKHPDKYNCSGECTNTIGSYNCRPKEALPRGARIAAGILLGFVVALIAFLSTEVFRNKEKKKRQGFFQQHGGQMLLRIIEKDANNIAFKLYERKDLVKATRRFHKDNVVGEGTHGTVYKAILGTATTVAVKRCKQIDKSRTDEFVQEL

SEQ ID NO: 58329 - protein, 232 aa, Sorghum bicolor
  Clone ID: 30978612.pep
LVYYGKKYHSALRITKDLSRGYGYFNDYENDSSNLSHLDMDAEQYHVDRNAYWDGPSFYQRKLTSRFGGMGPMLFNVNLKVQASYQGEHVPLVSLMSRLNGKAIVGHPIQIEIVEDGSTDHLVFCGDSGMQESTATPPAWPTGRRTAMQRVPRSNPSGALLDGDNEGGLVYSDYEMKPTLRKYSSSSNHQVKVNKKSSSNARRSSAKSHKKSSKKTNLRALSSISAAKKHHG

SEQ ID NO: 58330 - protein, 159 aa, Sorghum bicolor
  Clone ID: 30978617.pep
ILRRTNHSVDREGISTVSASKSGVHGFAELKDFLSIADQDFQKDTKGSSDSRCLHEMLQESQSDSPVSFYSHLDSSEESDSEAAPYDKGRSAKIMPIDADFLAAKLHERSNHNKNLTWCTSPENAMIYAPESPMYKVDDHEMKSNRLQSNRSHGSLNNL

SEQ ID NO: 58331 - protein, 143 aa, Sorghum bicolor
  Clone ID: 30978622.pep
MASGMDAAGEPGNSLHGMTGRELAFAFSTAAAEHDGDDAAASKFDLPVDSEHKAKSIRLFSFANPHMRTFHLSWISFFTCFVSTFAAAPLVPIIRDNLNLTKADIGNAGVASVSGSIFSRLTMGAVCDLLGPRYGCAFLIMLS

SEQ ID NO: 58332 - protein, 162 aa, Sorghum bicolor
  Clone ID: 30978624.pep
MASTSSLPAVALVVALMLVLGNSGTCHAARLLADATAPAAAPAAAVPGIPALPKPTTVPAIPTVPVVTMPPMPAVPAVTVPSMPAVPAVTLPPMPAVPSVPAVPAMPNAAALPPVPAAVVPKLTTLPPMPSVPSIPKVTLPPTPSSIPGVPTMPFLAPPPKA

SEQ ID NO: 58333 - protein, 100 aa, Sorghum bicolor
  Clone ID: 30978626.pep
RDGPLFPFPAEDAGGGETPRVWRRRGFRGRRNRFRFRGNVHGQPVVGVVERHPPGEERSGRSPRRPRRLGVLVGGGGRDKRKKGIFFFFFLIFFFFFFFF

SEQ ID NO: 58334 - protein, 176 aa, Sorghum bicolor
  Clone ID: 30978641.pep
MCTCKLWLPAEGTGPAVAQCHQPEPMGASLSLVPVLDYFARRECLGAGLHQNAVTLPYPDGGAGATCTVQYWAPEGEPQLPPLLLVHGFGPRADWQWRCQVGPLSRHFHVIVPDLLGFGGSSYPFETAPPPTEATQAAVLAALLDALPGMEGRRVAVAGTSYGGFVSYWLARAAGA

SEQ ID NO: 58335 - protein, 158 aa, Sorghum bicolor
  Clone ID: 30978650.pep
MDLPPGAARRTTYSLLPQFPDDAAPAPANVLQRQSSGSSYGAGSSISTSSDYPFHLQPPASAAGVAPPGSAAAPPGAAGSPCKSWAQQAEETYQLQLALALRLCADAACAADPGFLDPGDSGSGRGSGNGRAFPLAQPAPSAGSLSHRFWGNGSLSYN

SEQ ID NO: 58336 - protein, 89 aa, Sorghum bicolor
  Clone ID: 30978651.pep
LDSLSPPPRTAISPPPWLSPRGGASPPACPTTSPAASTPPSRTSSLLTTSTPTPLPPLPPPPWPPSPSPSLSTSLPTATSLPRPPTRTS

SEQ ID NO: 58337 - protein, 220 aa, Sorghum bicolor
  Clone ID: 30978653.pep
PTAVTFNIMLKSYIQHGMLEDAKDLLYDILNCRIRSKADSSQVATADKFTFNTFLEACAAAKRWNDFEYAFRQMLLNGYHFDERRHLRMVLDAYRHGKDQLLDDLWHYLCHHSRVPPTPVIMERFCLKLMQGDTLAAISCVSSFKEGKICNISSTSWLNLLNRNTARLKEEHVTKLAHELNNLVSSRSSSNSITLYQKILSSCTAFLSGATIVEKAPSDQ

SEQ ID NO: 58338 - protein, 114 aa, Sorghum bicolor
  Clone ID: 30978657.pep
MDLVGSLLMNTTRLLDPSGLHFLGWLVTAGSIGLAALIYALLRLQREAALYWTKAAREKRAAWRRSRCPSSCHSWSEDRFHGGQPSTCCVCLSSLSGSAQGADDVVHRCSVCGV

SEQ ID NO: 58339 - protein, 161 aa, Sorghum bicolor
  Clone ID: 30978663.pep
GNDASPKIKKFVQVMAVAGNKLRQDGKQLEGNEARQVDTLDRALEQDQVHGDGGIKEVYAGTTASAPPPLPRNGVLISGCQTDQTSGDATTAEGVSYGLLSNAVQTILARKHDGAVTNRELVLRARELLSKQGVTTQQPGLYCSDEHASLPFICSSRDASG

SEQ ID NO: 58340 - protein, 116 aa, Sorghum bicolor
  Clone ID: 30978683.pep
PLYVQCSRVLWRSVQTWEFFTRSRENRPEIRCGREWLRSSRFFTAPKFQFQPLTFSFLVRGRERRDGHFPLCRPRWARIRVRCLVCTGGLFVMCYQAGSVQVVFCTQVSGYPHRVP

SEQ ID NO: 58341 - protein, 166 aa, Sorghum bicolor
  Clone ID: 30978694.pep
DGGCKAKTSSGGGSKGSSEGKKKRSEEQQGSEGNAKKSKNEASSPTSSLKASQVPKVKLGDKITALQQIVSPFGKTDTASVLYEAINYIKWLHEQVQLLSDPYMKTSSSKDYNAWGGSDRKEKSETEIDLRSRGLCLVPVSCTPQVYRDNNGPDYWTPPYRSCLYR

SEQ ID NO: 58342 - protein, 179 aa, Sorghum bicolor
  unsure (1)..(179): unsure at all Xaa locations
  Clone ID: 30978707.pep
DTSKVLSGKMQLEEGEFSMADVXESVNMANVXASRQGVAVVWDPCEFSVVRCAAVLGDSKHFKQILDNLLSNTLKFTDEGYVVLQGWATQPIARSNVSAPSRFAHPWHSGGSSLGCLFRAREDSGDXGHVQNDPNLVEFHFEVVDTGIEIPKEKMMSVFESYVQVNNGQGGTGLGLGIV

SEQ ID NO: 58343 - protein, 80 aa, Sorghum bicolor
  unsure (1)..(80): unsure at all Xaa locations
  Clone ID: 30978734.pep
MGLRVAATAPAAAGVRVLGGGAASVKPRPWVALGGRRRLSVRMSVATTEVTFSAAAAVGASEDXALEARNSRTVVAVILG

SEQ ID NO: 58344 - protein, 111 aa, Sorghum bicolor
  Clone ID: 30978744.pep
TGSTGHFTLQQNPQLFCSFTGETWHCRRLTRASVSAARRLRRWAWGWRRGWHCVVPPRSPGIGLVSLKSSISAVCSFIYGELQSVEALIWFFHFASLVRPFTDAIAKSYSP

SEQ ID NO: 58345 - protein, 160 aa, Sorghum bicolor
  Clone ID: 30978745.pep
MSLQPGEAAVSASTSRATRQVPPRQPAGPRVQGNGCCTSLARQAISLLNHSPPPLVQPIPLTVLAPMATNPGVLCRASPRPPPASTAAAHLHSLSSSSASEHIPHSTQRGRLAAAPPPPPRCVASPTIASVKDQTEAEVAMGYTMTEICDKFIEFFMYKK

SEQ ID NO: 58346 - protein, 190 aa, Sorghum bicolor
  unsure (1)..(190): unsure at all Xaa locations
  Clone ID: 30978758.pep
TLHLARGHRHSISTNSARAARSAPKKGQSTTRCRTHQPDRVPFRPPPAHHLNNHARKHKRVACFNYPGRNDELKGCFNDVTRMRRCLVERFGFDEADIRVLADADPSTPAPTGANIRQELERLVGDARPGDTLFFHYSGHGMQLPAETGQDDDTGHVQTADQDFKELVXKVPDGCIFTIVSDSCHSGGLI

SEQ ID NO: 58347 - protein, 127 aa, Sorghum bicolor
  Clone ID: 30978769.pep
STFLHVQRFALQLQPPPNNVLVFRHLALHRRLNLAGMQKAGRPADSTVSPPRDAWIRGAKACAVAGRAAGSREGAPPADSTVSHRGQGRRGAAVGRRELGGSPPAGNCPATGRRSESGKPGTWAVRE

SEQ ID NO: 58348 - protein, 188 aa, Sorghum bicolor
  Clone ID: 30978782.pep
MGSAPRLPSDVVFEVDDMTFHLHKFPLMSKSRKIHRILSEQEEQRPRRRRRQMRSSSDGGGDGAAEIEIEEAEEEEEAEPEQEQVRTGEGDGQPYSIAFPDFPGGPGTFEAAAKFCYGVRVELTAWNVAPLRRAAEYLEMTEDHAEDNLAARAEAYLEQTVLRHPGDTTKALKSCEELLPLAEELGIV

SEQ ID NO: 58349 - protein, 131 aa, Sorghum bicolor
  Clone ID: 30978790.pep
AESHTNPEPVPSTLAPPPSPSSSSSSPPPPRPCGPATTRSLMNTTDGDASWNKRTTRASSTSSPSGSARAEREGGAEAAAESRRTAAAAARRLVDATGGEEGGGGGFRWGGDGRRRRSSGRSDIAGLGVRE

SEQ ID NO: 58350 - protein, 64 aa, Sorghum bicolor
  unsure (1)..(64): unsure at all Xaa locations
  Clone ID: 30978796.pep
PVSSLLRLRRVCKEWWNMISAPRFIKEHAYCAPKHLLLYLPKLSISASLHPKTAXPCHATVIDE

SEQ ID NO: 58351 - protein, 147 aa, Sorghum bicolor
  Clone ID: 30978797.pep
GAGGEVGRSMQAVHDAHDDSENFLELLNSRTLAPELFAEPPACDYLKKMEYGSSHGGGGGGGGGWPDHQFTTAALEKHLSSGYGGGALAHHHAAAGGGGPERLTANLSDLVSNWSIAPPNPCLGDAHHRAAACDNNNAAAVAALGHG

SEQ ID NO: 58352 - protein, 175 aa, Sorghum bicolor
  unsure (1)..(175): unsure at all Xaa locations
  Clone ID: 30978798.pep
ALHCTTRRHTGLSAAAARPPSRCCPXRECRXPPXAPFLLPSIPAASSRSGGGGGAFFSAAVGRSRLRCGGGPRHGHATVAAGSKDNGGGTAEGEKGEDDAPAFNPFGFVTDNPSSRSAIQLPAVPAEDGNVGQMLYRIEDKGREYGSYVRAGEFRWFVRETGSPDARRGTIVFLH

SEQ ID NO: 58353 - protein, 88 aa, Sorghum bicolor
  Clone ID: 30978804.pep
MATTTGRAPLLFCLVLCLCCCAPRLCAEVVAAGSGGGYAVRAVTVDKGGARLRAELAAVAAGGGGGGVHAAYGDDVRNLDVYAKLETD

SEQ ID NO: 58354 - protein, 114 aa, Sorghum bicolor
  unsure (1)..(114): unsure at all Xaa locations
  Clone ID: 30978814.pep
ATTQVEGARCREGSCRELLGFRTASTSRAQGLRRLVASGRQRQESRPTSARPTVTAAWRGHRSWSPPAAARRRCLGEVVRRPTAARVTSPADXGMVMAAWRXGRRXPVXRHRVV

SEQ ID NO: 58355 - protein, 50 aa, Sorghum bicolor
  Clone ID: 30978819.pep
KLNCLLLSSNKVGAELQTSRSQGLAHPTCLNEGLLLSCQIKGGQCERPDS

SEQ ID NO: 58356 - protein, 122 aa, Sorghum bicolor
  Clone ID: 30978829.pep
AAKAYANSLSLCKETFFSAQMDDELVLRYQALMKESSKLPLFDLRKLNASLPVPSVPEITTEILVMGARNDFIIDSEGLYETSRFYGVQPVCVEGVAHDMMLDCSWDKGAEIILTWLEKLTP

SEQ ID NO: 58357 - protein, 64 aa, Sorghum bicolor
  Clone ID: 30978830.pep
EAHMHSLIAREWEELNRECLCTRTFSSNFTQVCLNIARMVSVMYSYNKEQRLLVLEDYARMLIL

SEQ ID NO: 58358 - protein, 120 aa, Sorghum bicolor
  Clone ID: 30978831.pep
GEPPYAETLGDNLNLTIPAPGPDVIRNVCGSIRCVVVLVSGRPLVVEPFMDIIDALVAAWLPGTEGQGVSDVLFGDYGFTGKLSRTWFRSVDQLPMNVGDAHYDPLFPFGFGLQTQPSTY

SEQ ID NO: 58359 - protein, 179 aa, Sorghum bicolor
  Clone ID: 30978840.pep
SFIMDVVVKECSDVFQGISSLVDVAGGLGGATQTIAKAFPHVECSVLDLPHVVANAPTDTNVKYIAGDMFESIPSANAVFLKWILHDWGDAECVKILKNCKKAIASQGGKVVILDMVVGAGSSDEKHVETQILFDLFMMFINGAERDELEWKKIIFEAGFSSYKIIPVLGVRSIIEVYP

SEQ ID NO: 58360 - protein, 110 aa, Sorghum bicolor
  Clone ID: 30978841.pep
FATAFNSYCSLVDNARLYSTNTLGVPKLIGWKDGESSLLVDPAEIGCLDRLRSLNEEANCVHELYADGQPTGGSSSAWQDLVMSPLRASAQGELKAAIERNEARFNPALP

SEQ ID NO: 58361 - protein, 226 aa, Sorghum bicolor
  Clone ID: 30978890.pep
MALLRLHLPRPPLPARRIPALPSALSSSTTSCLWRGRLPASRLLCSSHPASSPDASSAAPPSIVAGLLDYLNESWTQFHATAEAKRQLLDAGFKLLSESDDWDLQPGGRYFFTRNMSCLVAFAIGEKYRVGNGFNIIAAHTDSPCLKLKPRSATIKSGHQMVNVQTYGSGLWHTWFDRDLTLAGRVILKATDGSFKHKLVKLTRPLIRVPTLAIHLNRTVNTDGFK

SEQ ID NO: 58362 - protein, 184 aa, Sorghum bicolor
  unsure (1)..(184): unsure at all Xaa locations
  Clone ID: 30978899.pep
LLVPVPSPPRLQQRPPPWRPPPRPRRSPATTSAALAPAPASRPSPSDPSAAAPPLSPSPSPTPSPPSPPRWPHPPPHPHPHLHPHPPPPAAASPPSPPPPPPXGPSPGPGPGPSPGPSPSPSPXRRPPRRRSPRCRARPSSRSSPPSRSASSSGSSRPPPACHATRGSSSPSSSPPSSASSPSR

SEQ ID NO: 58363 - protein, 121 aa, Sorghum bicolor
  Clone ID: 30978903.pep
MALLSATSPAKAHFSALLFCHDEPQQHQHQHQHALPGGGNRARQKRARGRCAAAPSMRPPDASVAPAAAAGEARRKKRPRVLVAGGGIGGLVFALAARRKGYDVTVFERDMSAVRGEGQYR

SEQ ID NO: 58364 - protein, 180 aa, Sorghum bicolor
  Clone ID: 30978924.pep
MATATLAAPPLFLFSRPAPAQARTARRRTARPFLRPACAYALQEGQSRRFHRLPCGLDLEVIAQCPPAAGERPPLVFVHGSFHAAWCWAEHWLPFFSRAGFPCYALSLRAQGESSVPQEAVAGTLETHTGDIADFIQKELPLPPVLIGHSFGGLIVQQYTSCLQELLRPKIAGAVLVCSV

SEQ ID NO: 58365 - protein, 155 aa, Sorghum bicolor
  Clone ID: 30978926.pep
MNKDAVEPSRRAAAFGIMTGIFSAAHTLGSVFSRFLPEKWIFEVSVVLLICSIIYMKIYLVETVQRASTSSQHLSMSSLLVKLPKERWESIKENISIVKNSETLRRISYAAFFYKLGMIGISDVLMYYLKSVFGFDKDQFSEILMVVGVGSIFSQ

SEQ ID NO: 58366 - protein, 114 aa, Sorghum bicolor
  Clone ID: 30978927.pep
EEAAAAAAARNPAWEEVKVVVPKPAEGAVAAAASTNGNRCYGGMVMATASDGVPFFFLAKATALLSIVDILGEHRGGLGLKKTHEKAYMVAGMEFLLQNQNRARVAVGFVRGQG

SEQ ID NO: 58367 - protein, 181 aa, Sorghum bicolor
  Clone ID: 30978947.pep
VGPFFARARRNRTPSRRCRRRQNPPRFRLGAAAHHFCAATPQKSFAHAVAADADADASSSSSLSTSFEPAMAGSKPLPLRLAAPLALALLLALALVANFLWASSSRRVSPLSASSSRTVMRKRAKAVGHLNATYADLPAPHWDWEEMPAAPVPRLDGASVQIGNLLYVFAGYGDIDHVHSH

SEQ ID NO: 58368 - protein, 146 aa, Sorghum bicolor
  Clone ID: 30978959.pep
MLGHGLATDASRTLQCPATSRVSSAPLGLVSSMSFNRRCKEKNKIFTNVDRYTKYSTSFCYAPRNARITPLATASFGDMADSSTPIFPRIHVKDPYQRLGISREASEEEIRAARNYLISKYAGHKPSVDAIESAHDRIIMQSFFDR

SEQ ID NO: 58369 - protein, 153 aa, Sorghum bicolor
  Clone ID: 30978973.pep
ESLNINGKISELPTWVRQLHRLTKITLCRTSLRGEDVHRLGELANLRCIRLLHQSYAEQKLTFSTREFRKLELLVIEDLGISDVNFAENAAPNLKKMDWSFTRKDITLSGIKKLSNLKEVHLNGHCDDNTLSKIKQDLNENSNLPKLSVRSMS

SEQ ID NO: 58370 - protein, 74 aa, Sorghum bicolor
  Clone ID: 30978976.pep
HNLLLFFVVICLPGHFLGCRYMDVIWADYWFGLNWFGLVVLVVLWMSFRLRLDLCVVAWYYLCWRGIHILGFHL

SEQ ID NO: 58371 - protein, 186 aa, Sorghum bicolor
  Clone ID: 30978993.pep
KEGDQGGSHERRGLTAGRVGTSEQTVDEENFQLDSEDDDEHPLVRIRSRRLRGRTTEPAETVQRLDNPPSSPQPHVQIGHQHSGGFPSEEWGGISSEEHDEALMLEAAMFGGIPEGAPYPFSFPARGRSTRYPQVARPPSPSLTAQRLLREQQDDEYLAALQADREKELKAAQEAELRRVEEAAAR

SEQ ID NO: 58372 - protein, 105 aa, Sorghum bicolor
  Clone ID: 30979003.pep
RLRHREGQWRRPEPLRAPAGGLVRVRVRAAALEDVLPVPLRGRTAQEPDDAPAAVRLPAAAAAAARRLDVNVVGVHHVNGSVSSPEHYLLLLQSSYLTFTKQLCA

SEQ ID NO: 58373 - protein, 146 aa, Sorghum bicolor
  Clone ID: 30979006.pep
MAPLTLDRDRASYLLNMAALELCMVKSFSKAAVEDSAVCSYLLLLANLAHRQEDVHELRVSGLLQGGGGLTDEEALRFFTNLRNMRRGRSYDRVMAQIEVYKESKWKEAKVYAFYYKNKKTIAAFVTGIGALVGIIGTLLSIKKSL

SEQ ID NO: 58374 - protein, 71 aa, Sorghum bicolor
  Clone ID: 30979007.pep
RKFLCLHFGTLKSYFETILEPELKKYMADILSVQALTMSTEGERASCQRDFILHWTQKGITWHGGRGRGRG

SEQ ID NO: 58375 - protein, 184 aa, Sorghum bicolor
  Clone ID: 30979023.pep
MMDGENVDEILAGMEEDPQLADEPEREDVKAQDPVAAPDADDAAGKKSKKKKKKGGFMMDVDGEDIDQILAGIEGRPPPAEEPEPEDTNDDGTVAAAAPVEDAEGKKSKKKKKKSGSTAKEEEELEKVLAELDLVPPAAEGKPAQVPQSAALAKEDVGAAEDGNVEDKAEEGGEVESAAPRRRR

SEQ ID NO: 58376 - protein, 188 aa, Sorghum bicolor
  Clone ID: 30979042.pep
MMMGRRRAGMAVAVAVAVLLALSSSCGVASARGPTRTRKPPAKKTLPAGQKPPAKSKFFPLTPGRFGHKRNYEASCADEGGPSCYVGCPSDCPKSCLVFCEYCLAFCACDLRPGTSCGDPRFTGGDGNTFYFHGNKDQDFCIVSDADLHINAHFIGNHNPALNRDFTWVQALGVTFRGGGDDNHHRFY

SEQ ID NO: 58377 - protein, 143 aa, Sorghum bicolor
  Clone ID: 30979072.pep
MDMIGGSAQSAVDSLLGRLSSVLVEEAQLLRNVHGDMQFIKREMESMNGFLQDATDDGHGGGGVSNQVRAWRRQVHELAFDSQSCVDRYVHTFGASHPAAGAGLLASFGRVPELVRTLPTRHRIATEIRELKDRALEVGERRQ

SEQ ID NO: 58378 - protein, 174 aa, Sorghum bicolor
  Clone ID: 30979090.pep
MGNTCVGPSTPSDRHSFFNTVSLAVLWRPPAAAAAAARAEPSPTTEPSSSTPSRAPDPVTISDSEHPPHSTSTSTASVPAAAPPNPNGKPKPKVKRVQSAGLLAGSVLRRDSERLKDLYTLGKKLGQGQFGTTYQCVEKATGKHFACKSIAKRKLVNEEDVEDVRREIQIMHHL

SEQ ID NO: 58379 - protein, 130 aa, Sorghum bicolor
  Clone ID: 30979091.pep
MAASNIGMMDGAYFVGRNEILAWINTTLQLGLSKVEEAASGAVACQLMDAAHPGAVPMHKVNFDAKTEYEMIQNYKVLQDVFNKLKITKHIEVNKLIKARPLDNLEFMQWLKRYCDSVNGGFMTNYNASE

SEQ ID NO: 58380 - protein, 161 aa, Sorghum bicolor
  unsure (1)..(161): unsure at all Xaa locations
  Clone ID: 30979093.pep
MARPPQEAIDTFVSITGADEAAAIRVLEHQNQXNPVPATSSYDDMMELDEPLDPMFNRPLFPRTLGNPFALLDPGFADLTAGDIFGRGPRVTQPRDVRQIPIEVKDSNTQSGSSGQGPIIEDVTGRESYYGPEVHGTVIVDEDDEDLPSTPSAHDPMIPSS

SEQ ID NO: 58381 - protein, 215 aa, Sorghum bicolor
  Clone ID: 30979096.pep
MEMEGRGLSDLFRNTSEEIFLKAVMENSMGVAAAPSMEMLGFKNMSQGLREDSEELFNSWLMNGEIPVFGAVNNRPRQPSRLSSEAAGQPNQQHDIAQQSFITDNLVQQNLAIPSVEYPNNHNQQSLKNAAEKGMQASDLLLAKAWFHSTQPMTRSRSSELRRRYAAMQTNLAPITIGSIEATNQLQQDFTNTTNSTPVSNTPVHTPKFVSPSSS

SEQ ID NO: 58382 - protein, 117 aa, Sorghum bicolor
  Clone ID: 30979102.pep
MGSPLASWPWASLGSYKYLLYGPVVAQAWRETGSLLPLALGSSWCLHLLLLLALRSLTFQLWFSYGNMLFFTRRRRVVKDGVDFRQIDAEWDWDNMVILQTLIAAVVVGSPAFPGVS

SEQ ID NO: 58383 - protein, 77 aa, Sorghum bicolor
  Clone ID: 30979103.pep
CRQAHQDFPLRVLPPSPLNPPPPSQGSPLAGPADSAMASGNCYPRAPPIHSSPPLVPAALAALCCGALFGRVTWLSV

SEQ ID NO: 58384 - protein, 111 aa, Sorghum bicolor
  Clone ID: 30979109.pep
ASPAPRCCCCCCCCRGARTVGVEPAEEPINPPRRRVSRRVGGRHRSPAPRALARRISQVAKLATYLVRGWHWSPARLARQGGAGAEGGGGATRAPHARTPAPAPRGRDPPW

SEQ ID NO: 58385 - protein, 216 aa, Sorghum bicolor
  Clone ID: 30979112.pep
QAYCCIKFSELNIRCDHMVMEPAAAWGPSCEFQLANWTVEEPAAEVWAPAVGLPLEYASSDIFGTCPQAYVPESIGEKQLVEFEYNYSSASRHNLSPEAIVVDGQNRHEVVDPQKLETRIVVSNDSYATNVFNQVEHAFKVDINLMAEKMHRYPAGLGDTIGESYTVPRIVAIGPYHHHRDHLKQAEKVKHMAAICCVKESGHLLEEMYAAVASIA

SEQ ID NO: 58386 - protein, 106 aa, Sorghum bicolor
  Clone ID: 30979123.pep
KELIKFKGFQVPPAELEALLIAHPSIADAAVVPQKDDAAGEVPVAFVVRAADSDIAEDAIKEFVSKQVVFYKRLHKVYFTPSIPKSASGKILRRELRAKLAAAAST

SEQ ID NO: 58387 - protein, 151 aa, Sorghum bicolor
  Clone ID: 30979124.pep
IAGKGPWENRYMDLGRNAKVLGAVPPGKLKAFYNALDVFVDPTLRPQGLDLTLMEAMQCGKPVVATRFPSIKGSIVVDDEFGNMFAPNVESLLESLEAVVAEGARRAARRGRACREYAKSMFAATKMALAYERLFLCVKNDTFCGYPAEFD

SEQ ID NO: 58388 - protein, 118 aa, Sorghum bicolor
  Clone ID: 30979135.pep
KILVGLANPEDLQLSTAERKLVQTYNQKPVLSRPQHKFYKGPNYFEIDLDVHRFSFISRKGLETFRERLKHGVLDLGLTIQAQKAEELPEHVLCCMRLNKIDFADNGQIPTLITAADE

SEQ ID NO: 58389 - protein, 41 aa, Sorghum bicolor
  Clone ID: 30979153.pep
VARNHSFHTIILVCVLSSTLISMQNCRSYPLAPQICQMPSR

SEQ ID NO: 58390 - protein, 108 aa, Sorghum bicolor
  Clone ID: 30979158.pep
MLTSSDFSRAAGAFVTHCGWNSTLEGITAGLPLLCWPMYAEQKMNKVFIVQEMKLGVEMRGYDGEVVAAGEVETKLKWVMESEGGRALRERAAAAKDAAAKAMIREDS

SEQ ID NO: 58391 - protein, 74 aa, Sorghum bicolor
  Clone ID: 30979174.pep
GSLAAIPFGTMVVVFILWAFISFPLALLGTVVGRNWSGAPNNPCRVKTIPRPIPEKKWYLTPSVIALMGGSTGT

SEQ ID NO: 58392 - protein, 100 aa, Sorghum bicolor
  Clone ID: 30979212.pep
MAASLRSPPPPPAAFRRSRVVVRASSSSSSSSSSAVSSSSSAPKARFVARRSESVPVQQLARPLAEYMSLPASQYSVLDAERIERVDDSTFRCYVYRFRF

SEQ ID NO: 58393 - protein, 194 aa, Sorghum bicolor
  unsure (1)..(194): unsure at all Xaa locations
  Clone ID: 30979223.pep
LAKVPCAGTQFQRKLITVAAXXEAQPQVAAPAAPEETVFRSKLPDIDIASHLPLHEYCFARAAEVADAPCLIAAATGRTYTYAETRLLCRKAAASLHGLGVGHGDRVMILLQNSVEFVLTFLGASFLGAVTTAANPFCTPLEIHKQFRASGAKLIVTQSAYVDKLRHEAFPRIGGEDKDNALTVLTIDDVXDTP

SEQ ID NO: 58394 - protein, 153 aa, Sorghum bicolor
  Clone ID: 30979232.pep
MRRQIPPVSCLVLLAAALAAASAASPTPAAVAVNVTGVLSAFPDLSDFTRLLASSPVLAELAGRSSLTLLAVPNGNLPQSPSAFAAASGADLADVLRYHVLLEYLAPADLRRLPASGKLVTTLFQTTGRAPADLGAINVTAAGASLAVVRSPA

SEQ ID NO: 58395 - protein, 155 aa, Sorghum bicolor
  Clone ID: 30979236.pep
SNVAATNSGTCNDEEFCSSTLKELQAAMSPRPSFPASIPSNKVQPMPIVGVSPHHQQQKKKTAVVRLSFRRRSYEGDEMTEMSGSANYLYRPRAGFTVACSTGEKLSEGCWSVLEPSTFRVRGESFFKDKRKYPAPDCSPYTPIGADMVAYTRKI

SEQ ID NO: 58396 - protein, 158 aa, Sorghum bicolor
  unsure (1)..(158): unsure at all Xaa locations
  Clone ID: 30979260.pep
MKKKTVVLYPGLGAGHLMPMIELAKVFVQHGVAVTVALVKPPLDLEASTSPRGRRAASSNPSISFDACAAPPXPPLTLVGSGDGRRRKYYVLEMVDCLXGMNAPLRXFLRVLPAVDALVIDMFCPDALDVAADXQAPVYYSYASCAGDLAVFLHLGFT

SEQ ID NO: 58397 - protein, 151 aa, Sorghum bicolor
  Clone ID: 30979264.pep
LDDDGARRAEVGVHEEGDLVRHGGGLHGALLRLGLLAAPQRRLRAQLPLPRVGIHLRGAEEPERGGLPRRREAQVAGDDDGAIDGDVVVRRRMSRAPLVPTEGHLHWPIDGWMVICWIQHQGTQGAGLLLTAGRLDSNKEMVYILHALGEG

SEQ ID NO: 58398 - protein, 34 aa, Sorghum bicolor
  Clone ID: 30979279.pep
KPTYIRFLTGLKAYSRIFSRLAFGARRNKYVTED

SEQ ID NO: 58399 - protein, 33 aa, Sorghum bicolor
  Clone ID: 30979281.pep
FGLGFERMILFAPGMENIRDVIPFPRSPGRADL

SEQ ID NO: 58400 - protein, 156 aa, Sorghum bicolor
  Clone ID: 30979284.pep
ADLRITRLQHTNFCTILLLISPGCVIPTFCESVVDVQYLFIRYSSLLTTSLSGSLSPVRWLVVVGVTLINSFEAASKTTSSSFREKDSSIPQTGLYEIQDCFLLFANVTIYVKIATELTSWWCCKLQQSVKIQHMNFLIVNCEQTAKEFPMCILLS

SEQ ID NO: 58401 - protein, 148 aa, Sorghum bicolor
  Clone ID: 30979293.pep
KELQRRIQELESSRELTTHPSETTRSIKKTRGNGSVTKKPYAGSKRKSPDDLEKKHEHPWILPKDGTSNITVTVGNTDVLLEVQCRWEELLMTRVFDAIKSLHLDVLSVQDSAPDGFIGLKIRAQFVGSGAIMPWMISEALRKAIGKR

SEQ ID NO: 58402 - protein, 80 aa, Sorghum bicolor
  Clone ID: 30979311.pep
LNDLQQRSFDRSLDSWIRNRQLIPQINYIYIVYNFSFSLFAKKLPSQDLWLSNPYPAKTIQIHTPHPDSDVIHQLPSSSA

SEQ ID NO: 58403 - protein, 80 aa, Sorghum bicolor
  Clone ID: 30979316.pep
AAGANRSLTWVDWSHGGPHPARFTRMEVTVDFLRWLRGGAGSTCTYNGRTTTVCFLFARKFLPNSLTRFLRFAPKVMGFG

SEQ ID NO: 58404 - protein, 99 aa, Sorghum bicolor
  Clone ID: 30979320.pep
VQKIRNLCDQTMFKSHPCLTKNRSHHTSYPLLKLEPSASISSQLQNAPAILQSLMPQHKLDLQTFIAPCRLGKHYLCCMAVGSDNSACASMLLPSTEFL

SEQ ID NO: 58405 - protein, 73 aa, Sorghum bicolor
  Clone ID: 30979330.pep
HHHHHHDDDDGGNGGSNNSMLKEAGIVDFYSPAALIGYNQAAAPTNRAAAAASAHLMPNFEVHTTAGTAGFGP

SEQ ID NO: 58406 - protein, 136 aa, Sorghum bicolor
  Clone ID: 30979332.pep
QRLRYQTKCHFYPSAKRKVKYVCNLRVTAGTPRQFEIKYTTATSLSLSLYSTCGSISNLSLAETEHLAAGGNRASCRQCRRCQEAIAPATSSHPATRPGHTLVSGSLAHQLIGLVAELELCDHHQVSSPILITLSS

SEQ ID NO: 58407 - protein, 68 aa, Sorghum bicolor
  Clone ID: 30979335.pep
RQGFNKRLASVVVALTWKWCLISFLVLVSGGVLHLLAVAVAVASSCVLLTIDFNGGSNTPESTKIQGS

SEQ ID NO: 58408 - protein, 104 aa, Sorghum bicolor
  Clone ID: 30979338.pep
NPNGYWKAPYGLIYRNMAILGVEGFSVLPKHCLALSAGFFVFVFVFSVARDVLPRKYARKEAMFMVPAVASGLICGDGIWTFPSSVLALAKIKPPICMKFTPGS

SEQ ID NO: 58409 - protein, 188 aa, Sorghum bicolor
  unsure (1)..(188): unsure at all Xaa locations
  Clone ID: 30979343.pep
MASRRGSSSCALCEGSNLPSCCAVCVNARLLEYHTRLRMMRSLRDSLQARIATRLEAKNKTDEQRIWRASKAQDIKELRDRLTELKRKTAIDKTKVEQASSDLKAKTASLNLAFVMLKKRRADAVAMHTNAMKIAQMNLMATTSDCMKMQSKSVKQLCRLFPMRRVIKEGEKKTXYSGPYDSICGVRL

SEQ ID NO: 58410 - protein, 192 aa, Sorghum bicolor
  unsure (1)..(192): unsure at all Xaa locations
  Clone ID: 30979351.pep
MTWCNSFNDVRAVENNLATAAAVAAAKKQQQASSHVNLIRTCPSCGHRAQYEQVQAAATIQDLPGLPAGVKFDPTDQELLEHLEGKARPDARKLHPLIDEFIPTIEGENGICYTHPERLPGVGKDGLIRHFFHRPSKAYTTGTRKRRKVHTDEQGGETRWHKTGKTRPVFTNGKLKGYKKILVLYTNYXKQR

SEQ ID NO: 58411 - protein, 147 aa, Sorghum bicolor
  Clone ID: 30979353.pep
QLGSWIWGGARRQRRHKEGSGDGAHLDLVYVPPPPQILIRNLVWFDKNFIFSLIWLVNMHCVGGGCPRRRPGRRMVRRGGARHLQLLPRHQQRHDVQRVPVACHRRCSPLVCRHRPISVVAATLAAAVPANVICSRHYGLDEHSHQH

SEQ ID NO: 58412 - protein, 196 aa, Sorghum bicolor
  unsure (1)..(196): unsure at all Xaa locations
  Clone ID: 30979355.pep
MPPEYGMPTRTAADAVVNRRPRRLFGRSSERKNPLNLQFERQVARLEARQQQQRCIIVTVIPFNFCYDFKSPSLTESASDDPSSQPTSPEESPETSSLSPSSPSILFLHLNAQDGSHRRWLDNSSRLLEDKPTTSNSMSDSDFLVNSFTKPSDNARHSSRRKSKKKSKKHRXRCRKPTDGSEAKFRESNGAVPAVD

SEQ ID NO: 58413 - protein, 182 aa, Sorghum bicolor
  Clone ID: 30979360.pep
MDRARSGAAAADDEEIEKHQPVPEDMESDPAAAREKEQVPPWREQVTLRGMVAALLIGFMYTVIVLKMVLSTGPLPTLNVSAALMAFLALRGWTRVLERLGVAHRPFTRQENCVVETCAVACYTIAFGGGFGSTLLGLDKKTYELAGASPANVPGSYKDPGFGWMAGFVAAISFAGLLSLIP

SEQ ID NO: 58414 - protein, 224 aa, Sorghum bicolor
  Clone ID: 30979378.pep
WLVLLCSLTPNQLPLPRSAASLLPASTAPPPESTPTTSTAGGGGGHAHRKPRPVPHRQLPSTIAPPQLELEDEPSEDDGEEDDPEAAKRKAPSKKRKLPPLFSPGAHYHWKLCGAKSGYHYIPCVDFDGDGSQRHHERSCPRSPVTCLVSLPKEYKQPAAWPERKDKVWYGNVGHPRLSNYVKGHNWLNHSGEYLMFPPDEWEFKGSARHYVESIDEMAPDIDW

SEQ ID NO: 58415 - protein, 196 aa, Sorghum bicolor
  Clone ID: 30979385.pep
MAPPPPLLPLLLILLVTVPLFPTAAPTATTLPLYRHLPHVAEAEAEDAHHHPLSRLAAASLARASHLKRRGRASHHSQKGSSSGGHKSIPATAALYPHSYGGYAFTASLGTPPQPLPVLLDTGSQLTWVPCTSNYDCRNCSSPFDAAVPVFHPKNSSSSRLVGCRNPSCLWVHSAEHLAKCRAPCSRGANCTPASN

SEQ ID NO: 58416 - protein, 182 aa, Sorghum bicolor
  Clone ID: 30979387.pep
MAPSASPVQEGLQQAAERQLMRNQLAAAARSINWTYAFFWSISSTQPGRRVLTWTDGFYNGEVKTRKISSSVELTADQLVMQRSEQLRELYEALLSGECDRRPAPVRPVSSLSPEDLGDTEWYYVVCMTYTFRPGQGLPGRSFASNEYVWLCNAHLAASKAFPRALLAKSASIQSIVCIPLM

SEQ ID NO: 58417 - protein, 105 aa, Sorghum bicolor
  Clone ID: 30979401.pep
MEALHEELPFDLDFHPSSPLVVTSLITGELCLFRYAPESQPERLFSVKAHKESCRAVRFMILSGSADCSVLASDVESGKAIARLEDAHGNAINRLVCLTETTIAT

SEQ ID NO: 58418 - protein, 169 aa, Sorghum bicolor
  Clone ID: 30979411.pep
MPSPAAVLVSNGAISPHAPPSAAAFLDSTPGAYTTARGTLHWWPRHLRRLAESATLLARSHPDLLGLPVPRSRALDLDFHSIQSLVNPSVQVAIHEMRARLPTTKDDDDLALTALVRGAGAGADSVSASGDGLDVFVHVGTYSPPIFGESGARLAVAGRGRDAAAAKYA

SEQ ID NO: 58419 - protein, 176 aa, Sorghum bicolor
  Clone ID: 30979437.pep
KDTSLLFLAGKGDGNIRYYEVVDEAPYIHYISEFKSNVPQRGLCMLPKRAVNVSECEVVRLLKLSNKLNEPISFQVPRKSDIFQNDLFPDTFSGEPALTAEQWLGGQNAEQKTASLEGGFVKKQNSSFNPDKQVVEEAPLSEKELKEEVEKLRKRVAYLEAEVIKKDAKIKELETK

SEQ ID NO: 58420 - protein, 47 aa, Sorghum bicolor
  Clone ID: 30979439.pep
QTLPLLECQKSIAIQEIILLQNTCMGVLRPVDMVVIFRHIHHLFEVK

SEQ ID NO: 58421 - protein, 180 aa, Sorghum bicolor
  Clone ID: 30979440.pep
DYFIHEEFMTSTWDIIAERLGFMLVFGDLVFIPFTFTIQGWWLLRNKVELSLLAGLANLCIFLIGYLVFRGANKQKHVFKKDPKAPIWGRPPKVVGGKLLASGYWGIARHCNYLGDLLLALSFSLPCGVSSVIPYFYPTYLLILLIWRERRDEARCSQKYREIWAEYCKLVPWRILPYVY

SEQ ID NO: 58422 - protein, 89 aa, Sorghum bicolor
  Clone ID: 30979446.pep
FGHQMEVVTNGRVRAGEHRAVTNARAPRTSVAAFVMPAMGCVVSPAPEMVAEGEAPLLRPYTYQEFVGVYTAANGDRDAVLARLQNNNG

SEQ ID NO: 58423 - protein, 108 aa, Sorghum bicolor
  Clone ID: 30979462.pep
SSGGEALTFNSLKTLPVATKEQQLHTGVQDSKLLDANLVEEAAKFLKGLLGLTIFGFDVVVQEGTGDHVIVDLNYLPSFKEVPDSEAVPAFWDAVRQAYESRRGNAQC

SEQ ID NO: 58424 - protein, 159 aa, Sorghum bicolor
  Clone ID: 30979488.pep
KITEDDLVKLRYLQLVIKETLRLHAPVPLLLPRECRESCRVMGYDVSKGTKVFVNVWAIARDMKLWHDAEEFRPERFESSSIDFRGNDFEFTPFGAGRRICPGITLGLANLELALATLLYHFDWDLPDGVRLEEFDTTEIFGITLRKKSMLWLQASPSN

SEQ ID NO: 58425 - protein, 194 aa, Sorghum bicolor
  Clone ID: 30979513.pep
MDIRILYIVAFVFLALLLLRLILSYSRTKPSSALRLPPGPWQLPLIGSLHHLLLSRFSDLPHRALREMSGTYGPVMMLRFGAVPSLVVSSAEAAREVLRTHDLSFCNRYLGVTLETVSCGGKDIICSPYNAHWRELRKLCMLEIFSQRRVLSFRNIREEEVANLLRSVSDQCGGGPVVVNLTDGICRMINDVAA

SEQ ID NO: 58426 - protein, 196 aa, Sorghum bicolor
  Clone ID: 30979528.pep
MSVRVVRQSKFRHVFGQVAKKEDCYDELRITKTAWDSNYIAANPSYFAVIWDSGGGGSLAVIPWSQKGKIDANIPLIAGHKGPILDIDFNPFNDNLIVSVSEDCTGKVWGIPEGGLKSTMSEPLQTLNGHRRKIGTVLHNPVANNILATSSTDLSVKVWDIEKGKDVLSIDAQHSDIIQSVDWNGNGSLLASSSKD

SEQ ID NO: 58427 - protein, 96 aa, Sorghum bicolor
  Clone ID: 30979530.pep
GSPNSKSLPRETTKTVRNAPSTNRPAARGHSIGFSVSHPLPALRHRHRHRSPVAASRGSSRNQTTPGRPSFSESGFRDLVVRGHGGPVLSARAGSR

SEQ ID NO: 58428 - protein, 181 aa, Sorghum bicolor
  Clone ID: 30979531.pep
MEAAAAVLPALVPSGSAVVVLVAYLGYLAAAGAILPGKLVDGAILSDSSRLHYRCNGLLSLLLLLGLSALGVYMGWMSPTVVADRGLELLSVTFIFSVIVSFALYFAGIKSRHKSSSLRPHVSGSFIQDWWLGVQLNPHFMGIDLKFFFVRAGMMAWLFINLSLFAKSYLAGSANLSVILY

SEQ ID NO: 58429 - protein, 88 aa, Sorghum bicolor
  Clone ID: 30979537.pep
MAIRITMSYSGYVAQNLAASFGLRCTTAAAAGAGAAPGAGCRFLQDALSRPFCLFASSRRADPHHDAEDHNHPKQPMPRPKALPPAAA

SEQ ID NO: 58430 - protein, 177 aa, Sorghum bicolor
  Clone ID: 30979539.pep
MAEPLSNGAVYHSVPESYVLPEHKRPGSSPSSCSAAAIPVVDLGGDDTDRMAEQIVAAGREFGFFQVINHGVPEDVMRAMMSAAEEFFKLPTEEKMAHYSTDSAKLPRFHTSVGKQQEQLLYWRDCLKIGCYPFEEFRRQWPDKPAGLGAALEPYTAAVRGVALRVLRLAASGLGLA

SEQ ID NO: 58431 - protein, 227 aa, Sorghum bicolor
  Clone ID: 30979550.pep
CTAPLSPCCSAPLLFERRTPRHGEPQPLHSHSAPAPARRRHAPAHLSSAPWCRRAPRHRQRRRHCPRHRQSGRHPPSCALSLTFSPAASSCPLARVRDARRVVVVVAQGLGNNTGDYARLAAALRDDHGLPAAVVARVTRPDWLRNAAGLADASYWRGTLRPRPVLDWYLKRVDDAVSEARELCAPGGKISLIGHSAGGWLARVYMAEFEASDISLLLTLGTPHLPP

SEQ ID NO: 58432 - protein, 208 aa, Sorghum bicolor
  Clone ID: 30979556.pep
MLEWSRTSFCLYVTSRVDKGLISELQNQNWRVLSVGNECSIDVPGVLNVQRLQELLLTLATLIKREICGSSVLVIGYIMKKSREEDFTKRGAFPIYPSKDSLIFVPLSFEVPLSLQLQEVDMVLHKITDEIVKIDPNCSIDFPKGISFSAGMSEIIRFVEEHPDFCVMDSFKNIYPLLDRLQIQKILVRLQELSTEGKPKLRAPYSLK

SEQ ID NO: 58433 - protein, 143 aa, Sorghum bicolor
  Clone ID: 30979598.pep
VDGSLLYQASLGHISIRNTDKNTEFPPAESWVTEGDYISWSKSSNGSELVSLKISWKLKTPDERQPPFSKYNIYVEKLTADSDVKAPRSYLGVASVDAFYVSGLEISNEVTSLKFFIQAFAHDGSWQELEECPNFFLSPVHSE

SEQ ID NO: 58434 - protein, 104 aa, Sorghum bicolor
  Clone ID: 30979609.pep
MVRSKISVSADNKEFTCHDKVPVILIVSWVNGIPMDLDLNLVETGSLVMTVFTTAFTLQDGKWHYLKGFNLTLCYIVIAVCFFTIKAIPTPKKHMPEMLGLESN

SEQ ID NO: 58435 - protein, 157 aa, Sorghum bicolor
  Clone ID: 30979610.pep
FLLSDRTFVSSAAKFLLVLSLGLFIHGLLPSEVFGFTVEKVTPEHFEVSHLALRNSLMSLASAWNGSIHKLRVLAEGENWSLLLKVFAFLYSIKLMLSFQFRILMGLVLASMFIVFIVYEQCEEEIDSLVAIASVKINWLIDRVVGNLPASLKAYIA

SEQ ID NO: 58436 - protein, 109 aa, Sorghum bicolor
  Clone ID: 30979623.pep
HWSQHRSYIHFRSKFLNKERRMVHHLTYIGSAKIQDGEFSQGFSFTDESSEPIALSPNSSPSFHWWLLQSSFSPLGSKRAASLHPEQELGRKQQASPPPPPPPAPAPAP

SEQ ID NO: 58437 - protein, 36 aa, Sorghum bicolor
  Clone ID: 30979640.pep
LKIMPQLSLEHQSVKYYLTVFELISYQFNQETYWTI

SEQ ID NO: 58438 - protein, 88 aa, Sorghum bicolor
  Clone ID: 30979643.pep
SFCLASCFSPLPPCSSLFRDHLTVSSSQSQITRPIPRAACLLCCLILILVHLTRSLGSISINHPVVYLATLLCSDWIRLGSSWNRGSG

SEQ ID NO: 58439 - protein, 87 aa, Sorghum bicolor
  Clone ID: 30979644.pep
MATPSSPSPTHSPTSSSSSYWCYQCDRFVRATAAPASPACPSCGGGFLEEMGAPPPPRPAYLRRHRAHNHHHHHHHHHHIAAAAADL

SEQ ID NO: 58440 - protein, 176 aa, Sorghum bicolor
  Clone ID: 30979673.pep
QVNVPIHALMALMRRVLLVDGSLHNKLFPSTTSLHQELICFELPSLHSSFLDLLNATIKGMRSQLLPHGASIIRLITEYFKIAKLPTLRTKAYSILQLLLTSMGAGTSLHLLEAIVSNAIADLNDDGGSDMTVINTNPSQLTNESSSKIYSKKRKLEPQMQNSTISGSEKVAVSPR

SEQ ID NO: 58441 - protein, 190 aa, Sorghum bicolor
  unsure (1)..(190): unsure at all Xaa locations
  Clone ID: 30979680.pep
MAAMEEQPLSSSSTSMAIVLSLLKNNPADAVLLALVAVVTVVALRHYLISSWRQQEQARRLPPGPRRLPVIGHLHLLRPPVHRTFQELASRMGPLMHIQLGSTHCVVASSPEVASELIRGHEGSISERPLTAVARQFAYDSAGFAFAPYNTHWRLMKRLCMSELLXPRTVEQLRPIRRAGTVSLLGDLLL

SEQ ID NO: 58442 - protein, 162 aa, Sorghum bicolor
  Clone ID: 30979681.pep
NKESNPELLPDAVTYTTLLKGLGNNRDLYSVLNIVVEMKSSLISLDRTAYTAMVDALLACGSIDGALCVFGDIIKHAGKNKDLRPKPHLYLSIMRAFATTGDVDMVMRLNKRMWPDSVGAISRAAKEEAHELLMEAAVNNNQIDLARGLLRQIVNEKECFSW

SEQ ID NO: 58443 - protein, 98 aa, Sorghum bicolor
  Clone ID: 30979687.pep
LVAHRLAFARPLGVGVADHNGRAAHAAAAAAAARVGVGGVGPSLLAFLLGCSCSVMRVRHLDAVFRHCLLPLCFDGVPCFTNRGELGPDEGEQQEGSE

SEQ ID NO: 58444 - protein, 71 aa, Sorghum bicolor
  Clone ID: 30979695.pep
HDAVPGSLVIWYDAITVNGDLDWQDKLNKYNKPFFDVCDGLFSNYTWKENYPQDSPTLAGDRKYDVYMGID

SEQ ID NO: 58445 - protein, 176 aa, Sorghum bicolor
  Clone ID: 30979706.pep
MASPNSGEVGAAGDLLETGLLLAASKQEEAAPPAAVETTTTTTSSGRRLAEHEMTATRSRVRQVVRRAAAQLQEVFLGTKLFPLFSAVPLAVAAEHFSFGRAWVFVFSFIGLAPLSERVSFLSEHVADTAGPTAGGLLNATCGNVPELVIALFALHKEKMGILKWSLLGSILSNLL

SEQ ID NO: 58446 - protein, 188 aa, Sorghum bicolor
  Clone ID: 30979707.pep
MATAEPGPPPPKPACAVTFGRCTLLGRYLAAALAASGRWSAVAILDPSSPTSPSPAPGPSASHLVYHHDVDLSDHERLVSALAGAAAVFHVDATTAAASGSDGSFLSLHRFAVEGTRRLLAACRSAGVERLVYTGSADVVASVARDVINADEDSAPYPDKFGNAVSELRAQVEMMVLGADGGDGMRTC

SEQ ID NO: 58447 - protein, 203 aa, Sorghum bicolor
  Clone ID: 30979711.pep
SAVLVQPLSIHDLNTSGNLVTVDIPLPLKNDDQSIESVVAQTNLPKEQILDLTSVLKDLSSKFELSTLGYLRLLRLHRIDEPDKFDPENVSYQWVPLSLEFGIPLFSPKLCEKICERVVASYMLQKDYLNEHSDVMQNVRRQLRELCSEYQATGPIAKLFNKRGSSRDSPRALINSISGRWNLSNDPSTPTSGEAPSEHERLK

SEQ ID NO: 58448 - protein, 70 aa, Sorghum bicolor
  Clone ID: 30979715.pep
HIGFCIFAAIAPPIIFRGKSLTGILAAIDTFFDHAIVGIFYFVGFALFCLETLVSIWVFQKVYMYFRGHK

SEQ ID NO: 58449 - protein, 97 aa, Sorghum bicolor
  Clone ID: 30979718.pep
QSKNAWQALLNELPDDTSEHVLVAVGHPAIHIALICRCLDLPMEYVSSFHLDDGSISVMDFPDGPKGRGIIRCINYTAHLGRWSIPITRPMENDEEF

SEQ ID NO: 58450 - protein, 158 aa, Sorghum bicolor
  Clone ID: 30979720.pep
MQSKELHNNLELAQKNIVDHTSAQRKRKARVISEYAVMARSIIRKKFQQLQESAIAERLKEEKAVNDAKSDTVKDHVLANTSAIGKTQNIDTNLGMATNDDEGGVPEVGDSVYVPKLKNEATVVKIDLSKDEVQVQAGMMKLKLKLKDVKVQKRKVSR

SEQ ID NO: 58451 - protein, 192 aa, Sorghum bicolor
  Clone ID: 30979744.pep
EEGILKELELAGFQYLGGPTDGDKKIELKPGFYMEHDEDVGAVVVGFDRYFNYYKVQYGTLCIRENPGCLFIATNRDAVTHLTDAQEWAGGGSMVGAILGSTKQEPLVVGKPSTFMMDYLAKKFGITTSQICMVGDRLDTDILFGQNGGCKTLLVLSGVTSLQTLQSPDNSIQPDFYTNQLSDFLTLKAATV

SEQ ID NO: 58452 - protein, 96 aa, Sorghum bicolor
  Clone ID: 30979756.pep
RHANMVQFGGEVVNTRPSGSHTATQMGSGHFPREGFDRAAYFRNLQVVDWDNNLIPAANLKLLADHPGCYDIQGGSNSYWGSYFYYGGPGRNVKCP

SEQ ID NO: 58453 - protein, 46 aa, Sorghum bicolor
  Clone ID: 30979761.pep
GLMPFSNVMCELNAGLMVMGTRVHHVNLTMSFRAKKKRKLYLIAKL

SEQ ID NO: 58454 - protein, 74 aa, Sorghum bicolor
  Clone ID: 30979784.pep
APDAGRDARGAPIHPSIHPSIHLPYKLAIAYRRGDERRRRIAHSCAAPVFLCARDACQQRAVHEGPPWQLRRRR

SEQ ID NO: 58455 - protein, 80 aa, Sorghum bicolor
  Clone ID: 30979796.pep
MASTDAILSSPVASDGFKSKFLASPVVQVPADASSSSSSQRQQVKMELTSGEIACKQQQLKPRFALELDGLNCFETLVPR

SEQ ID NO: 58456 - protein, 72 aa, Sorghum bicolor
  Clone ID: 30979799.pep
MHHDPNPFDDGADENPFSNGGGGARGGGVKSQYGFRPAEPAGFGGGGGRGDATVDIPLDTMNDSKGKAKELS

SEQ ID NO: 58457 - protein, 97 aa, Sorghum bicolor
  Clone ID: 30979806.pep
MLRLSIAALTSPLLPTSVPAVRPHPRRLLRLRVRSLAAASSLSPSARSLRLLEWGKVCDAVASFAGTAHGRDATKKQLWEVEDVSYELSQRLLQETE

SEQ ID NO: 58458 - protein, 93 aa, Sorghum bicolor
  Clone ID: 30979823.pep
FPWPVIPPPLRHGRHLRPPHRHSSVSPSSPALSSPASAEHLRSIRGPEPNPRRRPPCLQVRSLPYLTYRNATVSLAFAGKILASLDFSCCIVP

SEQ ID NO: 58459 - protein, 70 aa, Sorghum bicolor
  Clone ID: 30979832.pep
PLAGQQQHTHSPFSSLYLMTSASFPLPATCDAQACFTKSTPMAGALQLLLTQIKFPRALVAICLFSLFVL

SEQ ID NO: 58460 - protein, 166 aa, Sorghum bicolor
  Clone ID: 30979833.pep
MLQVRASPTFLPSTSSSSSQAPTHSPFSGKSQRRGGLAAAPSANRVARRSGVVMAAAAAAAKLEDADALIDSVETFIFDCDGVIWKGDKLIDGVPETLDLLRSKGKRLVFVTNNSTKSRKQYGKKFETLGMSIDEEEIFASSFAAAAYLQSIDFPKDKKVYVIGEE

SEQ ID NO: 58461 - protein, 37 aa, Sorghum bicolor
  Clone ID: 30979834.pep
VLDHHVWFSPYRKPQRAKRNKNTISLSHVSRYSRLLT

SEQ ID NO: 58462 - protein, 96 aa, Sorghum bicolor
  Clone ID: 30979835.pep
LAAPSSFSSQRRVGEAADASPPQSRFPNPRFAFSVSANLVASSSPPHSRPRGRAPRSTRAKLLYSTTGCRGRCRGVGIRPDFLPFAVDVIMLSILW

SEQ ID NO: 58463 - protein, 193 aa, Sorghum bicolor
  unsure (1)..(193): unsure at all Xaa locations
  Clone ID: 30979837.pep
ILLTNASPPPPPRPDSVPPRPIHLTDRPPMDADDPSXPPPPQTTTPSSTPLTRSPPXSPSLSPSPSPPPSPSAPPXPHPLLLHAPPPPAPRKESKAXPTPSSPLLPRPPQPPPPSPPSRTSLSSPIPPRPPAPPLALSPHPRWRRRNKRSTIRPRMRMRMLRWRRELLRRRRRQRRRRPRAYSSTLPCSSLRQ

SEQ ID NO: 58464 - protein, 144 aa, Sorghum bicolor
  Clone ID: 30979839.pep
MASAIKAASTSRWSSSPAVQSSPLPKRVAMPGRRRSVATVRSVAAVAPAAPAPARLTGAGLTVSQTMSKLRAQGKTAFIPYITAGDPDLATTAEALRLLDACGADVIELGVPFSDPYADGPVIQASAARALASGTTPDAVLAML

SEQ ID NO: 58465 - protein, 118 aa, Sorghum bicolor
  Clone ID: 30979847.pep
MASCSSFYFVPLLLLLMLLLVSPTATAAQPSSEPGGNATAARLRPGKELLRHKRIRALLTKLNKPALKTIQSPDGDIIDCVPSHLQPAFDHPKLRGSKILDPPERPKNCNFTLGGSRV

SEQ ID NO: 58466 - protein, 100 aa, Sorghum bicolor
  Clone ID: 30979851.pep
MSAPMVDADYMAEIERARRDLRALISSKNCAPIILRLAWHDAGTYDAKTNTGGPNGSIRLPQEYSHSSNAGLKIAIDLLEPIKQKHTKITYADLYQLTGV

SEQ ID NO: 58467 - protein, 66 aa, Sorghum bicolor
  unsure (1)..(66): unsure at all Xaa locations
  Clone ID: 30979853.pep
IFQWIVHAATPIWWPYPFLDLTSNLAPLWYLAVAVLQLPXYVVFRLVIKLKHHLLAKWFPVSYVRG

SEQ ID NO: 58468 - protein, 51 aa, Sorghum bicolor
  Clone ID: 30979865.pep
TKLEITKTVSGVLYFGYMLIASYAFFVLTGTIGFYACFWFTRLIYSSVKID

SEQ ID NO: 58469 - protein, 96 aa, Sorghum bicolor
  Clone ID: 30979880.pep
DEKEMVSRTVYCTNIDKKIGEDEVKQFFEGTCGEVSRLRLLGDYVHSTCIAFVEFVQADSAILALNCSGIVLGTLPVRVSPSKTPVRPRSPRVTSY

SEQ ID NO: 58470 - protein, 124 aa, Sorghum bicolor
  Clone ID: 30979903.pep
AGQAQCQNYQARIYNDANINAAFAASLRAGCPAGGGGGANAPLDASTPNAFDNAYYGDLVAQQGLLHSDQELFNGGSTDGLVRSYAASSARFSSDFAAAMVKMGGIGVITGSSGEVRRNCRRVN

SEQ ID NO: 58471 - protein, 138 aa, Sorghum bicolor
  Clone ID: 30979905.pep
ADAENPMPSPPGTGTGSAWGRRLGVLGVHQPARAAQPGEAPPRRPPAGRDRRWRASPVAAPPAHFQRLAPPLPLLEARRRRPVPVNSSTTPCPCDPVKLLSHCSPTCSVHFSHRTYTTIVTSWVLSFLFFLFFILVLP

SEQ ID NO: 58472 - protein, 93 aa, Sorghum bicolor
  Clone ID: 30979927.pep
MRCARHPYEGGVGVCAPCLRDRLLALAAAQNAASSLPPPLPPPEPPEPEPVFPRSVSSPYVCRRKSDASSAPRGRPPGSLLFFRTPQVGPAYG

SEQ ID NO: 58473 - protein, 168 aa, Sorghum bicolor
  Clone ID: 30979955.pep
PALKNPPKPRAFPADPSQIPRKTRSKPPKKPQQANKAPTPSSEPCSRAQSQNPRTKQTQNRSTGLATPIPPGSPPIPSARPPICSCRRRRLESGRQAGPTEGPASNTPPSARVWPRRRRCLRLHTSAPRFPSYLSLSLSLLAYFLSPITSLTLFFSSPPFGFLDRPVG

SEQ ID NO: 58474 - protein, 130 aa, Sorghum bicolor
  Clone ID: 30979957.pep
VFAAATQPDWQHSQEQSRPRRRARGERRGGGNREGRTEGEDYHKEAAINARPKRAGNETRRWAPKKSVKRFQIRSSTDQRPATDCIAGSGRASPVRAPTLHGAKTHWILPPGRLRRRSGGRRKRRVATVD

SEQ ID NO: 58475 - protein, 201 aa, Sorghum bicolor
  Clone ID: 30979958.pep
PTGFIHNHFTFLVKYHKDANTDLARIVAFEVKPYSIKHEPDGDWRGNATPLKTCDPHSRRLVVDSDSPQEVDANKDIIFTYDVNFEESPIKWASRWDTYLLMADDQIHWFSIVNSLMIVLFLSGMVAMIMLRTLYRDINKYNQLEDQEDAQEETGWKLVHGDVFRPPANADLLCVYVGTGVQFFGMLLVTLLVAILGLLSP

SEQ ID NO: 58476 - protein, 219 aa, Sorghum bicolor
  Clone ID: 30979982.pep
LLEEAPPETCPPPPSRLPPRSQEQLCRSLGRKTSRAAAAAAGTTSPNSFKAAPRHGKGNFITSAGLSSWLELSLQEISIHQKSKMRSRKPLGIQLFECARGSPISFRSCQALVLVLTFLSYASYHATRKTTSIVKSVLDPKTNLGMLHWPSHLYLQNLKGAENNNATLSGGWAPFNAEDGTVLLGEIDLAFLGVYAIGMFFAGHLGDRVDLRILLTIGM

SEQ ID NO: 58477 - protein, 99 aa, Sorghum bicolor
  Clone ID: 30980002.pep
ILQMTSIIQSIHVISSSKMAPTIRNITSNGTNQLCLKTVRIYSNLYNIFNLHTTDLAYPRLRKVHPGFEENLQKYRRLASAKFHYAIKDHTNGPLLKYK

SEQ ID NO: 58478 - protein, 32 aa, Sorghum bicolor
  Clone ID: 30980004.pep
FVFYRYPEIHINPRVLVLGNRCPFMSSTKQPL

SEQ ID NO: 58479 - protein, 153 aa, Sorghum bicolor
  Clone ID: 30980016.pep
RLMLVYIAICSLMGSLTVISVKAVAIALKLSFSGSNQFIYVQTWFFIVVVTICCLVQLNYLNKALDSFNTAVVSPVYYVMFTILTIVANMIMYKDWASQTATQIATQLCGFVTIVAGTFLLHKTRDMGNPPPPDQICLEEARECGPRSTNSSS

SEQ ID NO: 58480 - protein, 46 aa, Sorghum bicolor
  Clone ID: 30980032.pep
AKVPQGIENCPCLKKLWLLGLHEDFKAQWNNKRMKQKMQHVPEIRI

SEQ ID NO: 58481 - protein, 108 aa, Sorghum bicolor
  Clone ID: 30980045.pep
EEFHAMTWFSSWAVDGDHSYPDSPVGAEEMSFEVRELEKPDQDAIGIERIIRSIPAGERAFLGSMCKDIIDTGRLLWLGQKGLVADLVSYVPSKISPENHLLIAKCTF

SEQ ID NO: 58482 - protein, 81 aa, Sorghum bicolor
  Clone ID: 30980061.pep
VIFWAIVWEGAILYPRTNNLPCDLLGYCLGRCHLISYLWLPFVSLRTECKESFLAWWIFHCTFSAVESSALLRKHMVRWCR

SEQ ID NO: 58483 - protein, 147 aa, Sorghum bicolor
  unsure (1)..(147): unsure at all Xaa locations
  Clone ID: 30980081.pep
MTTAPPRPGPAAAAXGSPRRPPRVRGFRATPSPSAAGLPHHNPHRVVAPPGPFHLPRRRPRRATDAPPPPPRSPPLPRARLAPAPASPATPPPRRPAARRGPAPRPRLRPGLPPLRTSPPPPRRPCLRQGSPRPCQLRETRFYREES

SEQ ID NO: 58484 - protein, 52 aa, Sorghum bicolor
  Clone ID: 30980083.pep
VFQRTHINSMIWNCDWFRPVLTRNSVCKHRNIFGIEGIGRSGPRGGQYERRG

SEQ ID NO: 58485 - protein, 91 aa, Sorghum bicolor
  Clone ID: 30980092.pep
FNQSQISRPTRPPSFSKARTYQQMESLVHGATSSVDLLLHWIYTMEIEIKSTSRGRGTYRSGCYRSLRYEPTPWVCNVARGPCRALRRDPR

SEQ ID NO: 58486 - protein, 212 aa, Sorghum bicolor
  Clone ID: 30980094.pep
MASRSRDDDSAHPPPKRPRRDAEAEADAAEPSPRVVLNPADCDLDFDVDGGGLRGSALHEGGFAYCWSGARATVGARGGGRYCFGCRIVAEQPVEMDLTTPEERHLCRIGVSRGDDPVGVLGESQHSFGFGGTGKFSHQRRFVNYGVKFGVGDTVVCAVDLDSKPMASIGFARNGEWLGIVRHFDASEKGLGLVDAPLRPMQWGSALFPHVL

SEQ ID NO: 58487 - protein, 95 aa, Sorghum bicolor
  Clone ID: 30980100.pep
INQTKKSLQLVKVRRHQMAATYASFDFPLLLEKPQRRFTRSLLKTKVESSLVGSNDALDSASDSPPSVKNMEMKMSKKVACLTKHPGNITELLNT

SEQ ID NO: 58488 - protein, 150 aa, Sorghum bicolor
  Clone ID: 30980112.pep
MTWPKLSPSHCLKTPPCLEEIFLSSTIKDLIPKISSSFSFVVKIHNRKRKLLGITTNTLNMILSLHVLANTEQIVNFRPSQLIALPPRRTERAAPGGAWPPRAADSGRPSWEATPPANERASEVNVTGTREGGRGGGGEATAFRFLSLSS

SEQ ID NO: 58489 - protein, 156 aa, Sorghum bicolor
  unsure (1)..(156): unsure at all Xaa locations
  Clone ID: 30980121.pep
SSMGNTCGFGQILGLCSGLCADVDVADLMQAAGSNIGHLRSSGVLANRVVGSQYQFNTEDIDESSAEELRDAKSYAKDNAMLIQVQVSGTATKTFWRLSDEATRISRKLALILGNHHSACKCLSDPLQVSNVWXGSTGNVKLRGAKFTDKGFSIER

SEQ ID NO: 58490 - protein, 183 aa, Sorghum bicolor
  Clone ID: 3421473.pep
DQYQNWQHNAPPPPPDHVIKISSHPTPPPPPLNVHSSGSASNHSGGESRPPLSPGTVLSFSRSTFTYEQLMTATNGFSDANLLGQGGFGFVHKGVLPNGTEVAVKQLRDGSGQGEREFQAEVEIISRVHHKHLVSLVGYCISGANRLLVYEFVPNNTLEFHLHGMFSSCVCTVITSSRSKCFV

SEQ ID NO: 58491 - protein, 95 aa, Sorghum bicolor
  Clone ID: 6672290.pep
TVQFWIWCMYNIAGLRDTKLEDHTAFEHREASSDAAVDRQKIACPSPTSPFALQINQAGWHSKQEDTASQTQYTVHTRTRFRYDEGNQFGAAPVH

SEQ ID NO: 58492 - protein, 68 aa, Sorghum bicolor
  Clone ID: 6672303.pep
LTLDDNIFFHVFQELSPVLFTLMKSTEPFLDEYYMLDLEETMRKVGFVNVCSILTDPRHRTVTATVPY

SEQ ID NO: 58493 - protein, 83 aa, Sorghum bicolor
  Clone ID: 6672306.pep
APKGQDCGSYMKDFFANGGPGYLVNNATSVCEYCAYKVGDQFFEPLGLEFRHRWRDLGILAAFIGSTLAILFLAARFLNFNRR

SEQ ID NO: 58494 - protein, 126 aa, Sorghum bicolor
  Clone ID: 6672308.pep
WRECLYFPDELVLSRESEGLIRSFLCDAEHRIGNEGGQHGGATQIKNHPFFRGVVWDQLRNIRAPFEPRLSSNIDVSYFPIDEIPQEDTSAAHRAQVRAMPEEQEAEMSLPFIGYTYKAFNAFQVN

SEQ ID NO: 58495 - protein, 128 aa, Sorghum bicolor
  Clone ID: 6672310.pep
MPPPPPPAYGLWRSSVRVDPNLLHWQRVDAVSERGSAMSHQTQSRAGSVTEQIPPVPSRAHSAVAEGPRPPSYVSEDGISYVVEAAPRSTVNRDSHTGYSEIHPAWRPGYAMSEIRGGELPAIGNYQR

SEQ ID NO: 58496 - protein, 147 aa, Sorghum bicolor
  Clone ID: 6672331.pep
QVAWFRCTPTEISPCSLRTCKENIRKLGFGDRMFWWIIAVAASHRIVAWNASMDCSSQFPVGGSGGLIRFIVSQRSIGQVANHRIIYRQCCLDSLSLLCILLPGLFIFTKQYVFVSCMCTPICLMKCLANATTGCTITFISKNSRPH

SEQ ID NO: 58497 - protein, 126 aa, Sorghum bicolor
  Clone ID: 6672334.pep
DRGPDVVFDCAGVPESLNTACQAVRPRGTVVNVAIWEKEVPFNPNLLVFKESKYTAVLGYRREDFQAVVDLLAEGKLKPSKMITRKIQLDDLVEGGIKALIPDKENQVKILVEVGAAMGRVDSAIH

SEQ ID NO: 58498 - protein, 79 aa, Sorghum bicolor
  Clone ID: 6672337.pep
NGSASLKEKEKLAKAFYKRERDITKLSTDIRITLFCKFRVLGTIWFKAMGYGVFHHHQHHHFCFPCFFLFPLDTCLWVD

SEQ ID NO: 58499 - protein, 91 aa, Sorghum bicolor
  Clone ID: 6672365.pep
ASTACDSVQAVPVAPPSHFICPILKRVMQNPCIASDGYSYERVAIEMWLHENDVSPLTKTRLPDKNLVPNHALLCLINCWKGEAGATGLIC

SEQ ID NO: 58500 - protein, 126 aa, Sorghum bicolor
  Clone ID: 6672383.pep
YSDDDFENEDMNEEVEEYDMFDRRDNSENRRRENVDDDEVQEPIMKTKVMEYNHKICFSLKPVKECPRGTTMEKAEDIKIPFTCKDRSSTEVRRLLREAKSKDITQQLEFNKPSFVETVRSARICV

SEQ ID NO: 58501 - protein, 78 aa, Sorghum bicolor
  Clone ID: 6672387.pep
PGSNAALSLAFPFVLTRQNHILSVVVMFMETKGCLSLNPPTFFFFFFLHKGFCTPNRFLFVWLFFDRGKKNGGWGRDG

SEQ ID NO: 58502 - protein, 98 aa, Sorghum bicolor
  Clone ID: 6672397.pep
PKQNEFVDYLMCDQEMNEGWMDVRKMQGCSTRQLRMLAHQPCVLCWEVSSIPDFQTLGFMMGVSCQLPRQRSVFEGCSNLCQLVRPNEAPDSIHQVDQ

SEQ ID NO: 58503 - protein, 78 aa, Sorghum bicolor
  Clone ID: 6672398.pep
EWTLGAQDYAACGSGAGDRPRPGIHLACCSRASRSSVVDIFPKFSRGLEGDHLLSVQSVPHVLTRSCSILLIKFVMLL

SEQ ID NO: 58504 - protein, 98 aa, Sorghum bicolor
  Clone ID: 6672402.pep
AFPDITSISFKGIHGRGVRVPVRAHGSDVIPIRDISFQDMSVGIGYKKKHIFQCSYVEGRVVRPVFPKPCENLDIYDEQGQLVKRAVALNSTELDYDI

SEQ ID NO: 58505 - protein, 115 aa, Sorghum bicolor
  Clone ID: 6672409.pep
AILQVMVHADFEYTRPIVIIMPNTKFLQDKSRELGFSDDDSTLSSERMSAYVLDDLQDIARRSGLSKIETVTGVVITDIEWTPQSGLVTPTMKLNRRFILNYFRDEVEKCMQSIG

SEQ ID NO: 58506 - protein, 75 aa, Sorghum bicolor
  Clone ID: 6672419.pep
SPERGHYYTTKMTDDCRLITCIAVLTLYWSLASDHNMRADRRDIVAVSTRSLHGPRPTGAAPAAFSECTSSSVKS

SEQ ID NO: 58507 - protein, 84 aa, Sorghum bicolor
  Clone ID: 6672450.pep
CPNPSAFLSCRSSADITGLFSRYKLLYKYVSMRMATCPDPISSLLQGILIHPCRTLGPVLNMQGRKEHACMLRRQSDLRARCPS

SEQ ID NO: 58508 - protein, 110 aa, Sorghum bicolor
  Clone ID: 6672474.pep
DKHSGTIVLSANSKVRIEVWKFVRDHWDSDIFPTLSGNKVVLERFLRFGLNKFAEESVADEIKKFFEGKDTRGYNKGLEVIDDTIRSHAKYRTRDEQVVREWLKASGYLG

SEQ ID NO: 58509 - protein, 82 aa, Sorghum bicolor
  Clone ID: 6672476.pep
QLSTSDDQHTVSESYLINPGRWILYHVGDFVISSSDEVTELKFSMMQIDCTHTKGGLCVDSVYIYPKDLEFEEDCVFCQQIL

SEQ ID NO: 58510 - protein, 78 aa, Sorghum bicolor
  Clone ID: 6672484.pep
QEQRGVANGISMTLMSLFKGVAPAAAGILFSWAQKHMNGGLFLPGDQIMFLTINMVSILGLILTFKPFFSMSNALRRS

SEQ ID NO: 58511 - protein, 28 aa, Sorghum bicolor
  Clone ID: 6672491.pep
GRPMDSLVIITKSTEGQRHPDPIMHYKP

SEQ ID NO: 58512 - protein, 110 aa, Sorghum bicolor
  Clone ID: 6672496.pep
SYIYLIAHSLGLKPPNLTPWQPPELQLPTNNMQGLRFACELHRKHPPPLLGTLGIPWLLRLVWLLFCTAAVGSAVNCLLTKTFGLCCGLLPHGLFICPRYPLSSFLFPPS

SEQ ID NO: 58513 - protein, 116 aa, Sorghum bicolor
  Clone ID: 6672498.pep
PSRHSASRQLDLLGTRVNGGWELDLAVLLKGSAGDLLEDCLELGLRGQPPVHVEVDVDDDVAHVEGALLVVGLVGGPLPRAAVDVHVDEAGTGLVGPDRVVGGPSYVRGEGLVDAD

SEQ ID NO: 58514 - protein, 79 aa, Sorghum bicolor
  Clone ID: 6672499.pep
KVIFELLAGCDRQYAAVVRILCIALQLPRCAMPTARIQIQAGICWAPSNASLRKVGCERCLLFAYVHQKLCCCLQQHPP

SEQ ID NO: 58515 - protein, 67 aa, Sorghum bicolor
  Clone ID: 6672514.pep
MGCSIVIIVVVADEIVAVAHPVLLIECVSIVHSLDLDHAPLAVHLLDCAKDNLICSLTALLVKCLWA

SEQ ID NO: 58516 - protein, 85 aa, Sorghum bicolor
  Clone ID: 6672521.pep
DEDVFKWKFKRTENIADDIDRYLSRFLILQYMSTWNRPKATHIYTDGTEMRRNLFVDLLAHERNRYRTYLLVDINIIFVVSRKDL

SEQ ID NO: 58517 - protein, 43 aa, Sorghum bicolor
  Clone ID: 6672535.pep
TDAEIDYVLKAVQERVTFLRELSPLWELVQEGVDLNTIEWSQH

SEQ ID NO: 58518 - protein, 93 aa, Sorghum bicolor
  Clone ID: 6672549.pep
NNVNDAFSPVATWLRQNNRQAILTETGGGNTQSCIQYLCQQFQYINQNSDVYLGYVGWGAGSFDSTYILTETPTGSGSSWTDTSLVSSCLARK

SEQ ID NO: 58519 - protein, 137 aa, Sorghum bicolor
  Clone ID: 6672556.pep
QMMIDVEMDVLNVFDYQPVNQPFQASDLQIIKYLARYDNIPSIKRLLIQSYQQLYQINQSINQPNLVIRLHVQCHSPAAYVIFESPVDGHWDDNGFLCTPQTSGRYLTFYPTDRTIDHNYFRTTLNYYSVWDTYNRD

SEQ ID NO: 58520 - protein, 59 aa, Sorghum bicolor
  Clone ID: 6672557.pep
SEKSRRRTESKYKGSSYSKRICPRFVMNDQKTVPSDTIIIGGSLVFGLETSAISRPPFH

SEQ ID NO: 58521 - protein, 79 aa, Sorghum bicolor
  Clone ID: 6672579.pep
GLPAGAQLSAPVFDTVIRMITIKGSYVGNRADTAEALDFFRRGLITVPFKTIGLSQLQEVYTLMHDGKIAGRIVVDPTK

SEQ ID NO: 58522 - protein, 91 aa, Sorghum bicolor
  Clone ID: 6672601.pep
LLGEAALLAHQSVWTEDGAGQRSTTLLLSRAAYVFRAPVSFFADCSSPSSVATNPLYNQLSIALVFDLCIENEAGESRGRVLQVWQCHLLY

SEQ ID NO: 58523 - protein, 103 aa, Sorghum bicolor
  Clone ID: 6672611.pep
MCIRCARKIFNVVDDDPAPRAEVFAFARSLIQRRYPDLITEIIDANSTGLDYQEIIIPAEKRVSNARMKQELGINLLHPTYRSGLQSIIDAWQIQSQLPNISQ

SEQ ID NO: 58524 - protein, 103 aa, Sorghum bicolor
  Clone ID: 6672613.pep
VKNVQKILVILTHLIMKPPQKMMKNGHKKSKKEFKLIKNVVIKQKNKKPKLMNLPQLNLMKKLMIKPKVMAKLKTPKQFKAPNLSNLISTFHKFNCLELLFQL

SEQ ID NO: 58525 - protein, 90 aa, Sorghum bicolor
  Clone ID: 6672618.pep
KWNGEFSLNDYAPTLLGYLDTSSLLPSLRNRLCFESTGLGLVLRTGARAGSNLFFDERDEKPIRIGGYWDCNVMKTEGKGEAFCSFVYHI

SEQ ID NO: 58526 - protein, 81 aa, Sorghum bicolor
  Clone ID: 6672640.pep
TRGRGETKKHAARHETSRPPPHKFHRQKHSQCGTAPSSSDASQGEPLRRRRRLKVSNGDHSLPSASPPNSHLYLPIFYTLR

SEQ ID NO: 58527 - protein, 80 aa, Sorghum bicolor
  Clone ID: 6672649.pep
RHQLPEPLKRPSTKKKIHIHSSKPYHKAQRFERVSTHKVSVIIMVLLIVGLLCFKFLLVRAVQMWFDDRGGTFFHLEHSF

SEQ ID NO: 58528 - protein, 64 aa, Sorghum bicolor
  Clone ID: 6672650.pep
REDPDGEAELIQLHIATALLTSGCSACSCLTVCHQAGRFLLHFHFSFQKFSTSIYALHLAWSAV

SEQ ID NO: 58529 - protein, 85 aa, Sorghum bicolor
  Clone ID: 6672668.pep
AVQANQISWQFYAGGVIKKLCGDKLDHGVLTVGYTTVNTDEAWIVKNSWGASWGNEGYLYISTDGTANKGAGVCGILASASYPTK

SEQ ID NO: 58530 - protein, 93 aa, Sorghum bicolor
  Clone ID: 6672670.pep
CPITIPIFPFVQQRQGLPPSSAEKRLSILFYAGLFSTWASSGDADHDGCVGWTLSIRYCNDLICTMASLTPWVTIWLACSILEHSEERSVIGT

SEQ ID NO: 58531 - protein, 107 aa, Sorghum bicolor
  Clone ID: 6672677.pep
EMGECGTLHLYTIYAEAYPTTYSFPQGGPSSPRRPSHPIPHTAPTTTYLPFHLLHSPVCHWISMRPLRSSQRKRRQRIGRRPRNVEEDLRGADGGDAAARNERGKRR

SEQ ID NO: 58532 - protein, 110 aa, Sorghum bicolor
  Clone ID: 6672702.pep
NKTPLEAFPLAVASSASVPDKDVVPVEHRYPDGYQGWTAAIHHNPNQKWYYLSGMTGSERLLLECFDSESLKPGSNIGGRVPHTAFQDPRTRTDAEGRESIEIRALVFGP

SEQ ID NO: 58533 - protein, 54 aa, Sorghum bicolor
  Clone ID: 6672708.pep
CGSTVLNAAIFIAYHSACPNAIDYIFWDGFHPTEKAYNIVVDKLIQQASKYLMM

SEQ ID NO: 58534 - protein, 61 aa, Sorghum bicolor
  Clone ID: 6672738.pep
TGRAVQNQPSTGFAPIVEPPESSVAMLVSMGFDDNNARQALVRARNDINVATNILLEAQSH

SEQ ID NO: 58535 - protein, 70 aa, Sorghum bicolor
  Clone ID: 6672739.pep
LACCRFPIPNASTSSLFTKQDDGEPHSSYSGRCILSFSMPCANILLQPVYCLLACLQNGTYCVCFIGVVC

SEQ ID NO: 58536 - protein, 96 aa, Sorghum bicolor
  Clone ID: 6672767.pep
SFYSIMTPARPATARTPIALMELTPAALPLSAVELEPSPLEEEEPVSLAQVTLSQMVAVSLRSAMRELTSGTSLQASRREEMPSFWSMYQELSLEA

SEQ ID NO: 58537 - protein, 113 aa, Sorghum bicolor
  Clone ID: 6672778.pep
NGCQALKDYQDFAKCAEQGAHAYGHNGIGSVMRDVYASPGDPVFWLHHGMVDRHFRIWQNADSARTGYIDGTAAGNTPLTMDTSIVLNNLRPNMKVRDVMNTVSYPMCYKYSY

SEQ ID NO: 58538 - protein, 90 aa, Sorghum bicolor
  Clone ID: 6672780.pep
ERLIHGWEDVYNDVQEWRYKDIPAVFGAEEGSVLTYRVQTKDELEKLFQDEEFSSGETNKMRFVELVMPWDDAPAALKAVAAAAAKRNAE

SEQ ID NO: 58539 - protein, 115 aa, Sorghum bicolor
  Clone ID: 6672788.pep
DVCMYACIYVYVYTKNTYYTGTYTYLQATIAMRRLCAHNVVPVSRCVMGSSIEEHILVINHQTVDERNTPSSLPIHWSRSMQRHAQRRPIDSNHRKNPQWQHRHQKTKLANSQSP

SEQ ID NO: 58540 - protein, 52 aa, Sorghum bicolor
  Clone ID: 6672789.pep
PSSGVPATAGTGTGSKTTPTAPYLMSGGASIRGTVSLVLAFAAVAVYAISAV

SEQ ID NO: 58541 - protein, 119 aa, Sorghum bicolor
  Clone ID: 6672790.pep
SVAARIKGAIERMDDELVRSAIDYFEMAEMDKRPALRGTLPPTDMHITSWFGRPQYDADFGWGKPQFMSRAESVRGGYVHLMNDEGTTDDGGGSGDVRMLVCMEAVNIKELGRLLYAKL

SEQ ID NO: 58542 - protein, 63 aa, Sorghum bicolor
  Clone ID: 6672798.pep
PKQEKGEKAELLIFNTTTTTTHSHMQSVIHACNFRHGSGIVMKMNDINKKTKKNSQIIRQTVF

SEQ ID NO: 58543 - protein, 62 aa, Sorghum bicolor
  Clone ID: 6672810.pep
DMLISNHRKVLACVVCGRLKSAFQIASRSGSVADVQYVAHQALHANALPVLDTCKQWLAQYM

SEQ ID NO: 58544 - protein, 72 aa, Sorghum bicolor
  Clone ID: 6672812.pep
CFHCSDFLQEPWWRSWSQILTGSSFSLRPCLVSKYQVLWSGKQDSCFFEHLQVSCCLGPCNLLVMNWISLEV

SEQ ID NO: 58545 - protein, 142 aa, Sorghum bicolor
  Clone ID: 6672822.pep
DLFAIVWNSEVEIRDLLKNAFLPAWILDVIDSFWGYLASKYHLYFAGHALSGDPNYLMHGRNLQWEPTEDDGKEFTNSLRIGLTYVDPSHPLYNIGRDQQSSTENCAFWDEVAAEISEIGAKDAGTFVGFRDQSDGVTSFEL

SEQ ID NO: 58546 - protein, 110 aa, Sorghum bicolor
  Clone ID: 6672823.pep
KSDKAHSSHTGSDINSATNKVPVHTSHNEKLQKYGNKQKPQRAIRARSADNKPADHHTTHNTQDKHTFITTHWHLKLYNTTPALVHSAFRIRLTDTTPTTTYWCRKLLRM

SEQ ID NO: 58547 - protein, 89 aa, Sorghum bicolor
  Clone ID: 6672827.pep
SRRVVTLPRRPPPRRSRSPSSASPSLRSLSLRMTLRRPRSLLAARLTTSVASSSTSRLRLRTSSLKRWSPCSRRSRSALPATKWRHLRN

SEQ ID NO: 58548 - protein, 127 aa, Sorghum bicolor
  Clone ID: 6672838.pep
TVTLADIDTSLLDPAQAAILSQLQLSSTITEEQPSSASTFTYTTPSALQSHFNKLTQTLEPNIDLFADGVHKIEQYRSTAERVADRVLGTAAKRLEERDRETKERAGSDGLGVGDVLRGLASVLGDS

SEQ ID NO: 58549 - protein, 138 aa, Sorghum bicolor
  Clone ID: 6672855.pep
FDRAPGRVFCDRSFATETGLTCLGNWNHDASLSMAQMGGGSLSRSLASGHHANKDYEMTITAMILVLFYLFYFLLPLFRTSSFEIPPCLLNYARRLLGQKRRVPLGRAELQVTNSLAYQFICATGVLALGSCKKTKRE

SEQ ID NO: 58550 - protein, 57 aa, Sorghum bicolor
  Clone ID: 6672864.pep
LDSWVRYEGQVKQRQQKELAQSVIAKVQKELENPKVLQQILQQSVADVEKIVASKAQ

SEQ ID NO: 58551 - protein, 88 aa, Sorghum bicolor
  Clone ID: 6672880.pep
ENKRLNEEVANHAKQLAEIKAFLQSQNGGGGLCSVLMRVLLSQPWVRITHLNCKQATDLCLRQAMPGKLLHQTTSFPSTSSLLSLFAA

SEQ ID NO: 58552 - protein, 49 aa, Sorghum bicolor
  Clone ID: 6672886.pep
YDLKNRIWHIQGSCALKGDGLYEGLHWLASTLKELQASGRLPSGGTSLF

SEQ ID NO: 58553 - protein, 131 aa, Sorghum bicolor
  Clone ID: 6672893.pep
HKKRGRCCFGETRLKTRSQEAKQAPTRNQSLESTMGRGTDRPRSMARRRQPCPALVAVADAWAGETPHAQHHDTSGGLARQEYQAVPSTSAAACSSASAAAHGLPAPPSPVLTPPLTNMIRTPNGYFRHGR

SEQ ID NO: 58554 - protein, 83 aa, Sorghum bicolor
  Clone ID: 6672954.pep
DLSLVCEIMQLEAFGDDMRNKFLGGHERILAWIANVKKAPSPLFEQAHVFLFEVKAQMQSKAPVAAKLGASEASSKPKFASKL

SEQ ID NO: 58555 - protein, 74 aa, Sorghum bicolor
  Clone ID: 6673057.pep
ILQVVTFPGRYLVFFYYHHWHASGTFVLCMCLSRMGKVGQMSFFLLEGLLRRRMRSGSRSTLSCQVCWSLQTDR

SEQ ID NO: 58556 - protein, 63 aa, Sorghum bicolor
  Clone ID: 6673062.pep
LQGADKEWQHRHPIRLGVRGLVCWLSSTGTDSIPVNQYLPVAYYILSPLIQLAGGYTWCSTYT

SEQ ID NO: 58557 - protein, 116 aa, Sorghum bicolor
  Clone ID: 6673063.pep
PSQHGHVLRQGQLDTSSNLQLSTSLGGSLILPVLLRQLYKSLIPNHIPHRLAQAGSALCTRNMKHQIQHKADQTHRGVYPCFWRTRVSYLFGLAFVLFSTLLFHKTFDYFFSVYQL

SEQ ID NO: 58558 - protein, 53 aa, Sorghum bicolor
  Clone ID: 6673065.pep
IHYAYKNMNTLWVSTLIYTLYLHVDESGSMLLYTIVILSLTSIRLYYLHVAFT

SEQ ID NO: 58559 - protein, 50 aa, Sorghum bicolor
  Clone ID: 6673073.pep
QLTKSQKMLAMKRVDGNVRGRFGQSHPLPKPGKANHSKSHINLKFHSSIA

SEQ ID NO: 58560 - protein, 116 aa, Sorghum bicolor
  Clone ID: 6673087.pep
EMSPEEARKRKSNNMLQDAAAVGIAALGIKSAYSEWKEMNEQRHSVKELEARRRKRRKARERREKEARLNALGNMNGPGANPYAYPVAANQPYPTSYADANPYGASVPPPPMGARY

SEQ ID NO: 58561 - protein, 44 aa, Sorghum bicolor
  Clone ID: 6673097.pep
YTTICYYALWWVGWANHYLCANQYLQLAIMQTLYRHISPSPIQN

SEQ ID NO: 58562 - protein, 136 aa, Sorghum bicolor
  Clone ID: 6673116.pep
GEDAKFSLPETGLAIIPGAGGTQRLPRIVGRSRAKELIFTGRRFDAVEAATMGVVNYCVPAGEAYQKALELAREINQKGPVAVKMAKKAINQGAEVDMPSALAVEEECYEQVLHTQDRLEGLAAFAEKRKPVYKGK

SEQ ID NO: 58563 - protein, 110 aa, Sorghum bicolor
  Clone ID: 6673143.pep
LIARRRARWADDGSIQAPTAAAERAGVHELHGVLAVAVDALSRLAAVAVEHVVGPLELVQRRAVVVHDAGGGGAAVAARAQLQPRQVVVAAAAVRRRRHQLEPVVAAATV

SEQ ID NO: 58564 - protein, 93 aa, Sorghum bicolor
  Clone ID: 6673152.pep
ESFVLSNLGIFAGADETGPWRISQLLFTQSADTSGGPVQFSMCSVRGGPMAVSLSWEAALVQEKMIDTVFNTFESLINDICANKLYPLILFFW

SEQ ID NO: 58565 - protein, 81 aa, Sorghum bicolor
  Clone ID: 6673168.pep
TRIRGLGMVTTSPQHLAFGHGRHACPGRFFVAHELKLIMIHILLNYDIKLVGKVPEKQWIGGTIIPHLKAEIQIRRKKVSA

SEQ ID NO: 58566 - protein, 181 aa, Sorghum bicolor
  Clone ID: 6673177.pep
RDERAGHDEAANSPARWHRGGRKARARSSWPYSQWRQSRPRTRWFLEEAALLVGYMMTMMRSDAKREGEWGVREEKSQCLSFSVLIVFLFHCLNSCYLLTQLGIFSFVFFVVVHRYHGYVWRASGRNMIWNKKHREWRFGGQESVFLLLEASCIKVSRVCSILPPYGLNYSKQISRCFCLV

SEQ ID NO: 58567 - protein, 41 aa, Sorghum bicolor
  Clone ID: 6673181.pep
AFLSSIHVSNVSFSNLGVWDVGFYNWWEFYFSPMLARTNTP

SEQ ID NO: 58568 - protein, 160 aa, Sorghum bicolor
  Clone ID: 6673203.pep
GVEYVSMEELLRASDIISIHCPLMDSTRHMINAATIAAMKDGVIIINTSRGGLIDTAALIDALQPGKVAFAGLDVYEHERPYFFQDRSSEITITDAMLARLSSMKNVILTGHQAYLTHNALQAIAEVTLGNVTEFFWQRKQQPLKNQVIDEWQKAQQGKL

SEQ ID NO: 58569 - protein, 124 aa, Sorghum bicolor
  Clone ID: 6673208.pep
DADSITVVGPLWTGPLHDAAFLTEMLSLANEWGWACTIENGVTLEKLLGMMIEESDPRLPPGYIRIDEISRRAKVNSPPLGTLINSLRKEGFSACRSHIGANIIKTNCPIASCINVARDIRNIR

SEQ ID NO: 58570 - protein, 120 aa, Sorghum bicolor
  Clone ID: 6673210.pep
HVVVAHTALCELRRYWVRGARAGTSDSETFAELPGYPDNLRADGRGGYWVALSNGVAAAGGGGEEAAPTVAVRLSREGNVTEALDGFSFVSVSEVAERGGALWVGSVDTPYAGALKRRTS

SEQ ID NO: 58571 - protein, 51 aa, Sorghum bicolor
  Clone ID: 6673225.pep
TKNSNLIEIFGRDNVVSDLTQMGEFHPNSVISGGIPKPFRGGVTKFYNATP

SEQ ID NO: 58572 - protein, 78 aa, Sorghum bicolor
  Clone ID: 6673227.pep
TYGYRDEIIHGRQNVVVRPEVGDLWFFNSRNMHQVEKVEPEPCPELGLPYRPRLCLSSFIGLLPEHKTGGRPRLILWS

SEQ ID NO: 58573 - protein, 43 aa, Sorghum bicolor
  Clone ID: 6673229.pep
IHSKKNMVSEPKSNGVAPAMAGTKVLVPGPAQEIPKSKCCSSM

SEQ ID NO: 58574 - protein, 101 aa, Sorghum bicolor
  Clone ID: 6673243.pep
GCCIIISTNSQNSKWPCGTFPGWQGEEGYRETVEVSNNSCLSSCMIRGEKENRRLLTMVLLSAPSLQRRVLYLRRRYSFLDFVDLCTLTISFRESCGGILL

SEQ ID NO: 58575 - protein, 156 aa, Sorghum bicolor
  Clone ID: 6673245.pep
PSRPNAARYCEHVFDRIGCQYNAPAAYAPNVFESCLGDSQDFPGVYTGANGVVSTYSQPPESLGAITALPYTARIPASSSCTPYSSSALYTANPSVSISSSSSSTSTSRTGTTSRSTSTRTVTSTNTSSTPGAGFMSAKASPVLAFVAALAGFAMF

SEQ ID NO: 58576 - protein, 72 aa, Sorghum bicolor
  Clone ID: 6673252.pep
FVEWKLETYRLEVFVVYLKCKYCYIVSSTTQAERESSGEGQDAATEESSVTRPRKGARARRPNVLVSGPEWA

SEQ ID NO: 58577 - protein, 41 aa, Sorghum bicolor
  Clone ID: 6673329.pep
GGKDFQREIFFFPKRYCRSIQSIPTSHVIQLWDILTSSHIT

SEQ ID NO: 58578 - protein, 93 aa, Sorghum bicolor
  Clone ID: 6673330.pep
RKRKRLRRKEGESSDDYAGVDRIVLSLAHSSTELLQLPFSVPIPPGKVLDKKTAESRLFLCVGLDLPFCLAFFLAFLRDISVSASLHCERVMT

SEQ ID NO: 58579 - protein, 119 aa, Sorghum bicolor
  Clone ID: 6673346.pep
PLLVPPYRRGKILSLSSFFSIRHVPCRFQATDHVLTWVNGFGILFFSYSLCHVCFSHSVYPQPGVRLSQSQRNDYGFSSCTITCCRFTSFVWVSFVLLRGTGMGIDRFLYVKSGLGGEG

SEQ ID NO: 58580 - protein, 97 aa, Sorghum bicolor
  Clone ID: 6673360.pep
TKKVFSFLIPFTLTLPLQNQAILSRKSKIPKTIKITALISSANSIPSPSKAYPSIKGQFLFHCSRPQPISNRKRISIAIPSRDPQIKKSCFSGLSGC

SEQ ID NO: 58581 - protein, 64 aa, Sorghum bicolor
  Clone ID: 6673371.pep
VIIVFKISTVLMLYLLVPLNGFIGENAVQRHEDYLNAKSKSCHSFIPLFSHLIITVPELPSFKR

SEQ ID NO: 58582 - protein, 70 aa, Sorghum bicolor
  Clone ID: 6673377.pep
IEEQFMGPPIPIYEPLEDGTKDNIFISKSYDATSHFETTTDDVKDIYHRATGEELKVEGLREGIQVAEEQ

SEQ ID NO: 58583 - protein, 100 aa, Sorghum bicolor
  Clone ID: 6673386.pep
GIGSQTHLDPGAAGQIQGALTALANSGVKEVAVTELDIRTAPSNDYATVTKACLNVPKCIGITVWGVSDKNSWRKEHDSLLFDSNYNPKPAYTAVVNALR

SEQ ID NO: 58584 - protein, 53 aa, Sorghum bicolor
  Clone ID: 6673410.pep
IGQNFALVEAKLALSMILQRFAFELSPAYVHAPYTVLTLHPQHGVPLRLRRRL

SEQ ID NO: 58585 - protein, 68 aa, Sorghum bicolor
  Clone ID: 6673422.pep
MVKGSIPGTKKRVVTLRKSMWTHTSRKALEKISLKWIDTSSEFGHGAFQTPAEKKQFQGTLKKDLTSA

SEQ ID NO: 58586 - protein, 136 aa, Sorghum bicolor
  Clone ID: 6673438.pep
NSPSNSFRSYSVSSSEGENRCGAVVACLSRKVMPSGAANGVGTSKVLLAFSGAMLFQETSSETGTSMRLFLETRVGCSPFGLDWTETIIWQDKPSLDEFTSIHLCIHVMYQQFSTRSINKQIIKRALILEESVPGL

SEQ ID NO: 58587 - protein, 118 aa, Sorghum bicolor
  Clone ID: 6673454.pep
RIHSPQRARAAAGGETASGGGGRHPRSSQHCRTPQPAARGRRAALPRARASLRDGPDGAVHIPLRLALISHTAKRPERRRQQRGHARASTASHSRAARRAENQTDNQQRSRSLTCTVQ

SEQ ID NO: 58588 - protein, 155 aa, Sorghum bicolor
  Clone ID: 6673456.pep
DKYLIYKEITSCWHLARLAFAEVLVGAVSVERSVDRSPHQFALSSAKQLAVWHNQMATNPLAKQLQLQQFASGHSNNRIEQNKLINERTRHTQKHTCTASSTWWSRRLIEGNKKATKFSNGSSKCRQRSGRSAWSLGYQSDVPTRAVTRTRAPGK

SEQ ID NO: 58589 - protein, 62 aa, Sorghum bicolor
  Clone ID: 6673461.pep
MFLCSHGLHLITPRDLQVKKFHCNSPSAAGVYDVMIPFHFFFKVNINITKRSLADGGYGWHG

SEQ ID NO: 58590 - protein, 37 aa, Sorghum bicolor
  Clone ID: 6673467.pep
GPATALGLHPKFSNKKPTFNPNFYPNTLDKLTRNHIW

SEQ ID NO: 58591 - protein, 80 aa, Sorghum bicolor
  Clone ID: 6673472.pep
NYTQTDISPSSYRARTAPTAARRPKAGPATAAALPVGTLLALLSLPEPEPEVPVGGGSSASLGGGSVAGVGSNGLGDAGE

SEQ ID NO: 58592 - protein, 97 aa, Sorghum bicolor
  Clone ID: 6673486.pep
IELIPNKQVNGSSTSSYHRHHRPFQSLSSSDVCQFPSPSISLAAKSFPRTAIVSRLSMDWALIESACYFLLAAVSPQMSTPNLAHIRTHRPHPVRRY

SEQ ID NO: 58593 - protein, 89 aa, Sorghum bicolor
  Clone ID: 6673491.pep
GLDRRQRRRHRPRCLHRHHRHFQAAEQAARLGHPLHFHERCISRPEPHRGLRIRQRAEAQDHREEVRSHCFVPESATGWVLIEECVNDG

SEQ ID NO: 58594 - protein, 58 aa, Sorghum bicolor
  Clone ID: 6673493.pep
IWIRRAGPNYQEGLKNIKSVGQELGLDMHVYGPEMHVSGIVPLALVPGKTTDIKEFSG

SEQ ID NO: 58595 - protein, 50 aa, Sorghum bicolor
  Clone ID: 6673494.pep
AGTSPWNANLWFFLHLLLMKHVQRTISIYIYTHGSGILFYTLGVEYYSTP

SEQ ID NO: 58596 - protein, 79 aa, Sorghum bicolor
  Clone ID: 6673497.pep
GSFLVLGPFCTYHPFIRACFQKHALFSVSVSAVFRRCFHGCCRWWEQCIGRNVFAVGLGLELTPLVLELEEGQKLRLCL

SEQ ID NO: 58597 - protein, 72 aa, Sorghum bicolor
  Clone ID: 6673523.pep
TTNGKIGFRKEKKERERKGNSDGQDPVLRTHLSSGLVNFSPLNEVLKGVYRLRVSDDGPALDLKYRRNVFKD

SEQ ID NO: 58598 - protein, 61 aa, Sorghum bicolor
  Clone ID: 6673531.pep
GRITAGHLCSLRRAGSGLVPCFGAFGFGSFWAIMSGMKPVKRDGSVDEEDRINQCQRAVPF

SEQ ID NO: 58599 - protein, 137 aa, Sorghum bicolor
  Clone ID: 6673541.pep
KQVFPRNFQKGALIGGGTLDPRIPLSKQEDLIVWMRTAALPTFRKLYGRIQVDLRAGELITVTMQNNYNTYSFGGKKAVVLSTAGVLGGKNSFLGRGYVIVGLACLLLALLLTMLCLVFPLKEEHLALQYPLPRPAR

SEQ ID NO: 58600 - protein, 52 aa, Sorghum bicolor
  Clone ID: 6673557.pep
TVKCWSLLWDRRWRKSSRRDPGAPSSESESAIRAASAAILKAAKHSTPPANI

SEQ ID NO: 58601 - protein, 157 aa, Sorghum bicolor
  Clone ID: 6673569.pep
NPALKLRRYIQTRSLDALPSTLLGVWYSAAHMADCRPDVWRGSPQSPEPLHLLQQNLDEALLLCAVPRELISLASELDELSVRLEAQNLVVWVTTVIHQVEEVDKDGLQNLLTLGDGGGSLLNTNLLAKLLPAVEFAYGSTIVELDLSSKRSLLDVL

SEQ ID NO: 58602 - protein, 108 aa, Sorghum bicolor
  Clone ID: 6673570.pep
LLVGHGTEWCDGACFVKHDIRVVFMFQYGQPFLITAERLIGYKIARFDIVGIFQRGFSIVRKFLAVDNGLSTLGLNHSTPGSILFIHRGVSPLQADNTGPIWPPIGKG

SEQ ID NO: 58603 - protein, 81 aa, Sorghum bicolor
  Clone ID: 6673576.pep
PNPSRDLLKLDLLFPSSFVLAPAFAPFCLTIVVPSYRVLSTSSPFPSTQSPYLLLDQKKKKKREKKNTPLILQAPSDVVAA

SEQ ID NO: 58604 - protein, 66 aa, Sorghum bicolor
  Clone ID: 6673578.pep
LTKVSELEVRFARLWTQCQRCQGSLHCEVICASRDCPIFYMRMKARKDVEDSGKELVRFDNDAALW

SEQ ID NO: 58605 - protein, 69 aa, Sorghum bicolor
  Clone ID: 6673581.pep
ISYRVSGDRNQHLLITDYDRAKGLAKPTFYEGSAHLNENSSQLGNDWINSNRKYELNFKQDGYLSLETG

SEQ ID NO: 58606 - protein, 43 aa, Sorghum bicolor
  Clone ID: 6673582.pep
IHYNGQSKPWLEIGFKHLQPFWTKYVNYSNEFIRNCHIMEPQL

SEQ ID NO: 58607 - protein, 68 aa, Sorghum bicolor
  Clone ID: 6673583.pep
EHLKIACLCLHDMPSKRPTMLKVMAMFKELQASSAVDSKTSECTGAMDDACFGDVEMTTLKEDKEEKD

SEQ ID NO: 58608 - protein, 99 aa, Sorghum bicolor
  Clone ID: 6673587.pep
MGSASSVAPSGPTTMANMKPVTSSSAKPAPAAGGDAFGALWGKASGGVKKPETPKTGPAMGQLAKEKSSAGIWGAPAAPSSSGSAPPKTGGSAMDDLLG

SEQ ID NO: 58609 - protein, 54 aa, Sorghum bicolor
  Clone ID: 6673597.pep
LKMGSFSKMSHPLACFCKKCSDKPVTVKDGNTQPRNIRCNRSNSLSRIATESKK

SEQ ID NO: 58610 - protein, 175 aa, Sorghum bicolor
  Clone ID: 6673614.pep
MMTILGGQPPDELLREAKNTIRFFKHVGIYPGNEAPSGLSSAYRILSEEEVEVRDSKRPKMGKWYFPHLKLDKLICTYPWNNSELSETEKTDRLGLVDFLKGLLEFDPNKRWSPLQALYHPFITGESFTGPYEPVPETARIPVARAAAIDHNPGGGHWLHSGLSPQVGSVNRYLP

SEQ ID NO: 58611 - protein, 75 aa, Sorghum bicolor
  Clone ID: 6673634.pep
NRRFKCAFYENCPYDAGEPKDLYRHYWVHHKAYAKENNIPSPQGKCLACGESFGRKDAEECGLFDFTVDFIAWAS

SEQ ID NO: 58612 - protein, 71 aa, Sorghum bicolor
  Clone ID: 6673636.pep
TKTPGPGLLTRNFIVYIGCYSIQSPLTATRRKGGRRGRRLQLQVSWRPVRCSGSSLSASNILLLRKFFVLY

SEQ ID NO: 58613 - protein, 55 aa, Sorghum bicolor
  Clone ID: 6673639.pep
PKFSNNFTIRVNFQSPNFYANLKKAEASGQKAPSRGLLKASQGAKLNITPSLISR

SEQ ID NO: 58614 - protein, 61 aa, Sorghum bicolor
  Clone ID: 6673651.pep
NEGFFLFAENLRQGQLVSQTAEGALRNLRCSPPIFDGMEVLSAAESPRPTNAVPDMDMRMD

SEQ ID NO: 58615 - protein, 63 aa, Sorghum bicolor
  Clone ID: 6673655.pep
MHPDPRCHTFSLSSVDPCSPSSRLLSSSTSFFRSPFSFSRLFMCTMAFSTTLALLFCAFACFP

SEQ ID NO: 58616 - protein, 109 aa, Sorghum bicolor
  Clone ID: 6673657.pep
VYTRGSSFWGGVLRLNKFCFLGYHSFLLYFFLLFLFLFFSFFFPPLFSCITLLMELLDEFKMTAWRIEIDWDCIDGKKKGLAQPKKEEEAFFGVSRLRDIKLGVKSFFV

SEQ ID NO: 58617 - protein, 177 aa, Sorghum bicolor
  Clone ID: 6673661.pep
VPGPLSRLVLSLNRFEEVLQTQDCNIILRHCGDTRRWDDLSKVFEWMQEREMTNAASYSSYFKYLGLSRDPARALQVYGAIKDQTMKVHVSVCNSVLGCLVKNGRLDSSFKLYDEMIREGLSPDPFTYSTLLSGCMKLKQGYTKAMELINDMKSRGLQMDIVIYGTLLAICASHNYC

SEQ ID NO: 58618 - protein, 84 aa, Sorghum bicolor
  Clone ID: 6673673.pep
ETHWRRGLKARREVMEGVGAWFVQIGDLNTVHHLWQFANLEERRGRREQSWQVEGWSDTVHKTVPLIQSMKSRILVPMPWSPVR

SEQ ID NO: 58619 - protein, 165 aa, Sorghum bicolor
  Clone ID: 6673680.pep
MARIYEWKNIYSNKDFRKEALPWFWENYDPNAMSLWFADYKFQDELSVTFKVCNLIGGFNQRVDGKILQGSFGNWLILGSEPKLAVHGAFLFRGLDIPEGFKENPDFTAYTWTRVNLDDPEQRTWLQDLWGWECEDRKFVLPKVLGGDGTPFDCTADTVNGNTLK

SEQ ID NO: 58620 - protein, 129 aa, Sorghum bicolor
  Clone ID: 6673690.pep
GRLMLEKYGTDFYTLDQFPLEIRPAYTMPSPKNPKLSNSYDMFMRGQEILSGAQRIHNAKFLAEQMRKRDPPIDPESPGIKEYVDSFKYGCPPHGGAGFGLERIVMFWLGLPNIRLVSMFPRDPQRVTP

SEQ ID NO: 58621 - protein, 77 aa, Sorghum bicolor
  Clone ID: 6673695.pep
GSSRPAAYEGQKDRRRTWPGRVSHPNIPSGHPSRFWCVDRSVGWVGSVVSLLLLALLPSFVIRSMPALVASMRASPS

SEQ ID NO: 58622 - protein, 150 aa, Sorghum bicolor
  Clone ID: 6673702.pep
VEKYTLPDGRVIRIGAERFEAPECMFNPALVDQESVGMGELVFDCINKADIDTRAEFYNHIVLSGGSTMYPGLPSRLEKEIKRLYFERVAKGNKVSMQKFKCRIEDPPRRKHMVFLGGAVLAEIMKDKTAFWMNKAEYEEQGARVLRKCF

SEQ ID NO: 58623 - protein, 94 aa, Sorghum bicolor
  Clone ID: 6673703.pep
RKCWAIGLVADIYGGSSIGMTTMRPFRALFQRVLGFPLRPPPFSSSMGLLGNKGGNPAVIVRPIKPSKHAVTYRGGFICLSHPNCLCRTLGSAR

SEQ ID NO: 58624 - protein, 99 aa, Sorghum bicolor
  Clone ID: 6673709.pep
MSNFVCDVPPLIYRHVQIVADHARRYMSHVLRCQILRLRGKRKKRENVNARYAVQNRYIKQSRPISSVVRAKQRNRYAKGNNRKEQKPSMDEVVNQVPT

SEQ ID NO: 58625 - protein, 37 aa, Sorghum bicolor
  Clone ID: 6673715.pep
NENPGLPFLFINFQTRLRELANWVSNLVENPLKQKLN

SEQ ID NO: 58626 - protein, 90 aa, Sorghum bicolor
  Clone ID: 6673720.pep
SNHRPCEIQSSDNKKATLDPMLKAYLLRHHHSKSKMHESIRRNADASTKSWIRIWRSLFERKFSNNLPPSKFSIAFHKKLHLGNNILGLC

SEQ ID NO: 58627 - protein, 53 aa, Sorghum bicolor
  Clone ID: 6673725.pep
LVNSAEIIRPNLSIREGIEIIVSGGMTMPQVITSLEPTPRKSQNIRLDRVRTV

SEQ ID NO: 58628 - protein, 45 aa, Sorghum bicolor
  Clone ID: 6673726.pep
DWDPGKFACSSNRNIVVGKQGTLGLQGLVNETFELFSIAVQNKGG

SEQ ID NO: 58629 - protein, 53 aa, Sorghum bicolor
  Clone ID: 6673739.pep
NALNFGSPVSRVTGGGAAHLHVYRLFIILCGIAVDFVVAAVSIKVDSVRCRDG

SEQ ID NO: 58630 - protein, 51 aa, Sorghum bicolor
  Clone ID: 6673749.pep
PLSIYILSLPLPYLPEGTDLSTSFLIGVATLVLGLLLYNLPQKSTNQVKKD

SEQ ID NO: 58631 - protein, 156 aa, Sorghum bicolor
  Clone ID: 6673752.pep
GATSSSASRTGERGRGTTGPGRGRGRLQDLATQVQGHGRARATKTHLATQVGRGHRVRATKNTQVWRGRRTRARLDDARGPARARATPPGRRTRARVTPPGRRNARGLDDARGRGRLLDDAGWMFCFLTRDRNFCYVELVSATVMKFYIRNPLFFS

SEQ ID NO: 58632 - protein, 47 aa, Sorghum bicolor
  Clone ID: 6673755.pep
SSFYLMNYGSWNSFSSNYLNYGNCSKGQEQAPSNVCYNLFRQECSQQ

SEQ ID NO: 58633 - protein, 91 aa, Sorghum bicolor
  Clone ID: 6673766.pep
VTANDISLKFTEAERAILSLYRDRKSSPHDQDEDGKGHAMLALETILGAFNMFLVNDVNDITQWTHKSLSLSAMGLIKTLASTAGDGNERM

SEQ ID NO: 58634 - protein, 71 aa, Sorghum bicolor
  Clone ID: 6673789.pep
TSWRFHPSYPNLKHKGMPNHSRSQHYTRGTEKLFQLVSCLLLQISKSSPYMPPFETVSSKSSISSKSASSS

SEQ ID NO: 58635 - protein, 37 aa, Sorghum bicolor
  Clone ID: 6673800.pep
KAETAASAPLKLQVEKAMVVAVDRRSQRVRKPKVFAE

SEQ ID NO: 58636 - protein, 97 aa, Sorghum bicolor
  Clone ID: 6673806.pep
THRVTAAWLLFHTGNPCTLVLGCLIGTAEITQLIYVPKCKTTTDVHPWSTTKRSSRFTPAWPELLRLSPKLLRRAGASSRLLPDDAPADPAGSWRPS

SEQ ID NO: 58637 - protein, 109 aa, Sorghum bicolor
  Clone ID: 6673821.pep
YQTKYFRPPFGNEGARMRSRLTKAVGNDAYIVNWSVDVEDWLWAETDTPEQQKVAFQRDVNKGGNLVVLHYLYPSTVSYLREFIQIAKKTGKQLMRVDQCMEDPNAPPL

SEQ ID NO: 58638 - protein, 67 aa, Sorghum bicolor
  Clone ID: 6673835.pep
HHSMIPPPSPGGFISLPETPNPLRQLSASSLTASLAGPSAIHSSGLDSPSPSVNSITHYYPSSSHPS

SEQ ID NO: 58639 - protein, 59 aa, Sorghum bicolor
  Clone ID: 6673840.pep
LYVLICQRTPEKPCLNDVSDVGSWRRAALIASVFLVVLTLIPLWDELAEELGVGLVTSF

SEQ ID NO: 58640 - protein, 84 aa, Sorghum bicolor
  Clone ID: 6673846.pep
ASTFKGVIRALRDFAPKLIEHNVSIWVRRAGPNYQEGLKNMKAATQELGLNAKIFGPEMHVSGIVPLALVPGKWEESKAQEFQA

SEQ ID NO: 58641 - protein, 45 aa, Sorghum bicolor
  Clone ID: 6673855.pep
NQIQIFDFLKAWQSMLGSVSQGASYPSIGPDNNQKTPKVYKQNAV

SEQ ID NO: 58642 - protein, 69 aa, Sorghum bicolor
  Clone ID: 6673856.pep
IEQTVTATAHETCHRLFCDVVIMKTYKADDVHRAATVFKDDKCSPLMAFTKVHPSAPKCISFMLNHVSQ

SEQ ID NO: 58643 - protein, 67 aa, Sorghum bicolor
  Clone ID: 6673865.pep
DPPDLADLPRSSNSICSNLTTNSLTKGLLYDQSPALIFPWAQLSCLIMSYRVAVVSAFRQFTSDTQP

SEQ ID NO: 58644 - protein, 83 aa, Sorghum bicolor
  Clone ID: 6673867.pep
EAVKFVPEVAGAAGAVLAVLISLIFVVVGGGAAAPSKEQVKAQSKKAKDAAVEAKDKAAAAVATGAEKAQAEVNKRTTRSNAS

SEQ ID NO: 58645 - protein, 133 aa, Sorghum bicolor
  Clone ID: 6673879.pep
QWNRFKPSSTHCSAFRMASSDLPHIAQSKTTHTSVAGGACHYQLQRFPLEAGEHEPVLFSLQETQSRSGPSRGQEGRCFWKWTLSFPVRDLLHLRNIRKRSDTGFCVQPRGGAAASTQLGRQPQRHLLSLLFL

SEQ ID NO: 58646 - protein, 124 aa, Sorghum bicolor
  Clone ID: 6673899.pep
NDTGVGLIPWAPLCRGHLARPASAYGETIRSEGEKKAGTSTTGPQVEADRKTIERVEELAKKHGWSMSSVALAWINKRVASPIIGFSSVKRIDEALEARGKTLTEEEEKYLEELYTPRNIVGHS

SEQ ID NO: 58647 - protein, 28 aa, Sorghum bicolor
  Clone ID: 6673913.pep
QIANMIDSSMTVTTLLKMLLDSPQVDSG

SEQ ID NO: 58648 - protein, 135 aa, Sorghum bicolor
  Clone ID: 6673924.pep
EVLRLYPPILLLGRETYQETELGGVRYPPGVVFSLPIVCIHHNPGVWGEDADEFRPERFAEGVSKASKDAPAFFPFGWGSRICVGQNFALLEAKMGLAMILQHFLFELSPSYTHAPCAVSTLQPQYGAQIKLKKL

SEQ ID NO: 58649 - protein, 104 aa, Sorghum bicolor
  Clone ID: 6673940.pep
ARPHLPQFSHPLTGHSSGFVGPFGTITISRTRVKTSPGRKRLTGSTQAAFKKNAKTNPSSKGRGYFHPYNRHKNVDFQRQHIFPVSQRGPLRKALEGGKNGRKA

SEQ ID NO: 58650 - protein, 145 aa, Sorghum bicolor
  Clone ID: 6673942.pep
MSRVLEPLIVGKVIGEVLDHFNPTVKMVVTYNSNKQVFNGHEFFPSAVTAKPRVEVQGGDLRSFFTLVMTDPDVPGPSDPYLREHLHWIVTDIPGTTDASFGREVVSYETPKPNIGIHRFIFVLFRQKRRQAVNPPSSKDRFSTR

SEQ ID NO: 58651 - protein, 37 aa, Sorghum bicolor
  Clone ID: 6673954.pep
SMCSKVLIFILCGVCFELLYCTYYFINTSIDKETLSH

SEQ ID NO: 58652 - protein, 156 aa, Sorghum bicolor
  Clone ID: 6673971.pep
HPQQLLPGHGRHGHERRAAHLPASAHEPHQGHPRALGRRRRLDCAQRGRRRGPGVARSIPRGQRHCTTRRVRHLRRGQEGPEDAVERDHRRDVQVHHRAVLDEEGLSEGKPSHVFISFVPAETYSVLIPNDVRWRGRWVLLRACAWVIISWRGLLS

SEQ ID NO: 58653 - protein, 106 aa, Sorghum bicolor
  Clone ID: 6673975.pep
QILPATFFVTKKAACFKLCLQSVSTCSVLPGSNQVGILEGNTVGFSLLHDAAYEVWFFKDSDSGGDETYWVKVLEEAASSKAVGGISWTAGGDNRGDVLKPFFHGI

SEQ ID NO: 58654 - protein, 73 aa, Sorghum bicolor
  Clone ID: 6673981.pep
FLAATEAEYAACMERALVIKNEEPTTYADMQRNARRSAQRFSDETFVQAFVACLVPLVLAARQEREVSPLASS

SEQ ID NO: 58655 - protein, 68 aa, Sorghum bicolor
  Clone ID: 6673996.pep
MECNNKLRSADQIPTCSVGGAERPDHIRPIDPWFACYTMLLGRPAQALLENERVCRSSVCLQTSPQPQ

SEQ ID NO: 58656 - protein, 68 aa, Sorghum bicolor
  Clone ID: 6674006.pep
AKKKRSQPKKVGFPILGNAKLKKPNPWRWTYFSFGKTFRDLANSIKWQISIVKLLEMLLAMKQVGFHG

SEQ ID NO: 58657 - protein, 67 aa, Sorghum bicolor
  Clone ID: 6674023.pep
GGTASRTQQDQAKESQMNLNKYYRIFSRLGGELLPQAVHHSWPPNSKTKTERKKKGTPKENERKKKT

SEQ ID NO: 58658 - protein, 36 aa, Sorghum bicolor
  Clone ID: 6674054.pep
EQLSCICLFSSIYHNKEEMPRVINIYGQLGERVWFG

SEQ ID NO: 58659 - protein, 55 aa, Sorghum bicolor
  Clone ID: 6674061.pep
SQVFGWKENSVMWANEGFWIIELLTRLNTRSKVSPISRKLHLRIDTRRRRSPDFA

SEQ ID NO: 58660 - protein, 99 aa, Sorghum bicolor
  Clone ID: 6674076.pep
FMLVDFSGKETVQAATLVYLATYMHGHRVNGPWIKIIHSINDIIRSTCSHVRFLLPIECRSRAHCLVPTACSTRTAANTGRSYQCSSQLAARLIIRRPV

SEQ ID NO: 58661 - protein, 63 aa, Sorghum bicolor
  Clone ID: 6674080.pep
RNTRLDRPAKDEYLPSASQAQIISTSERKISERILQPKLSLEYYPIVQASNAFAGNNSIICYD

SEQ ID NO: 58662 - protein, 55 aa, Sorghum bicolor
  Clone ID: 6674082.pep
IGVCIFHVSVDEEMKVEKSEYFYERGNFLASFLSAPAADAAPGSGSSGCPVMHGN

SEQ ID NO: 58663 - protein, 41 aa, Sorghum bicolor
  Clone ID: 6674085.pep
GVDDAGLKEIIGAAVKRKKAKHAGMFDIAKTANRPMIHIGG

SEQ ID NO: 58664 - protein, 72 aa, Sorghum bicolor
  Clone ID: 6674094.pep
TNKNAWEFAVTKKFTGGDTVKGTYAASTKLFGLEWSRDSIAGGSFKVGTTFDLSDQSKAPKLIAESTWNYEI

SEQ ID NO: 58665 - protein, 74 aa, Sorghum bicolor
  Clone ID: 6674104.pep
LYSCCFIKAGAYVSFLCLICTFFAILLLPLPEGGWKKPWVELAHAHLASLHHPLVSEEMGCRSETSYLSTSIAS

SEQ ID NO: 58666 - protein, 64 aa, Sorghum bicolor
  Clone ID: 6674122.pep
PFPVHLFQGDEDGVVPVQLQRHICRKLGWVNYHELPGTGHFLSAVTGLGDRIVSTLLSSPPASA

SEQ ID NO: 58667 - protein, 129 aa, Sorghum bicolor
  Clone ID: 6674134.pep
GYTPVLDCHTAHIACRFNKLLQTINKRNGEVLEQDPKFIKSGQAAICELVPSKPMCVEAFSKYAPLGRFAVRDMRKTVAVGVIKVVKRKTEKGDWIISGGKEDGKAVKPDVAMDKKALKAAKAAAGEKK

SEQ ID NO: 58668 - protein, 73 aa, Sorghum bicolor
  Clone ID: 6674140.pep
TSLKTMEVASRNQVDHAKPPKPLKESAASPHSRHGTRSFPRHERSWPVGNPDLQNRVCWRQCCLHRTGQQSRS

SEQ ID NO: 58669 - protein, 60 aa, Sorghum bicolor
  Clone ID: 6674160.pep
PHLSKCTGLLQPLLPMCASATKELSLDPESKFQQHRSTITVPRQCLHHRLFFISAVKVQN

SEQ ID NO: 58670 - protein, 89 aa, Sorghum bicolor
  Clone ID: 6674176.pep
NKLFTKVLKKGDVFVFPQGLIHFQFNPKHDKPAVAIAALSSQNPGAITIANAVFGSKPPISDDVLAKAFQVQKGTIDWLQAQFWENNHN

SEQ ID NO: 58671 - protein, 91 aa, Sorghum bicolor
  Clone ID: 6674182.pep
KFFIKVFLSNCTFPYSYLVTTSSQSADHRRELLITKLESKSNHFSHLKQTTSQTVTGGLYRAQVQIHRNFSDLRLLAIPPSYFQVAENNPF

SEQ ID NO: 58672 - protein, 77 aa, Sorghum bicolor
  Clone ID: 6674188.pep
MFCNSRWMMDDECAQVAIPLHRLRAASPSANKLKPAEKFIQLVSVDSHEFWFLGFVNYDSAVAHLQEALSGFRNLQA

SEQ ID NO: 58673 - protein, 61 aa, Sorghum bicolor
  Clone ID: 6674190.pep
FVRFIRLNCKLIMEHMMLVEKTGQRNDPQWWHTLSSREVFRPLVIIMSSTTFIYRLSLNFL

SEQ ID NO: 58674 - protein, 98 aa, Sorghum bicolor
  Clone ID: 6674204.pep
FGMLVLEMVSGRRNSDPSVDSQNEVYLPEWIFERVITEQDLVLSREMTGAEKEKVRQLAMVALWCIQWNPKNRPSMTKVVNMLTGRLENLQMPPKPFV

SEQ ID NO: 58675 - protein, 100 aa, Sorghum bicolor
  Clone ID: 6674216.pep
ALRDIGQRDIAEMVPYDDYYYEGASLVANQSFREIERNSDTSTKRGSISFRTMIREDQLQQDGTDEIGFSSRSGVHIGSPSGSSPSAAMPMLPLKEIPRY

SEQ ID NO: 58676 - protein, 113 aa, Sorghum bicolor
  Clone ID: 6674223.pep
IVRKFKAYDAQIKGTGNEYRVSVSPARSKSNSPDGKEEAYASRYQTEPKKKVFTSVQKSEAASSRKDSNASQKQKGSIQGSLSSINSGYGSVRRGEDSKKVGSVAGSVKSKGF

SEQ ID NO: 58677 - protein, 114 aa, Sorghum bicolor
  Clone ID: 6674224.pep
PPLEDYRTVMVQRAIFQSVASMGLPAFTIHSVVRYSGRAMKNMKNQVIRTWAPIGLGLAVVPFLPAMFDEPVENAVEWAFHKGFETFGGKDAVGNAPTTGREDMLAKRPKEKEL

SEQ ID NO: 58678 - protein, 71 aa, Sorghum bicolor
  Clone ID: 6674228.pep
TDNPKRKLPERRKERIPLAQSIVDQFAAGGFYASITSRPGQCGRCDGYIFEGEELNFSLRKMQKKKGKAHQ

SEQ ID NO: 58679 - protein, 80 aa, Sorghum bicolor
  Clone ID: 6674232.pep
LCKKLQLDINEITVDATTTTGEASFYADSCPAPALPSESKTATGGAKSSKGRPAKKPKTEVGSKNIKDMFRRVTRNGSGS

SEQ ID NO: 58680 - protein, 83 aa, Sorghum bicolor
  Clone ID: 6674238.pep
HYLTVMIPSRNEMHQNDHHSRIALCFPSIPVSHIICNLHDQLSFSLMRTTLSTMSFSRRQTPKGMVFYFMMNIKQVVTSFSLR

SEQ ID NO: 58681 - protein, 71 aa, Sorghum bicolor
  Clone ID: 6674255.pep
RLQGYVNQPIPLLFAAEQLAITRRQSLCSVCDRRPSPSKHNSVMHAYVQICSISPPLICEFTSYLQIIHST

SEQ ID NO: 58682 - protein, 80 aa, Sorghum bicolor
  Clone ID: 6674257.pep
IGLYLGPKAKPRVYWELFSFKLQRIKVNRREKIQKSLANTVSMGSHYPNSTLVCHNFVTRVGIPMFRKKRIKFIFSCIIF

SEQ ID NO: 58683 - protein, 128 aa, Sorghum bicolor
  Clone ID: 6674258.pep
KGVTHQFIVGDLSHPRIKDILLKWHEIDTRIRLEEGYIPDKKEVLLDIEEEEKEGALSRHSEKLAIAFALISMSDNMPIRIFKNLRVCHDCHHVTKLISKVYGREIIVRDRTRFHLFKDGSCSCKDYW

SEQ ID NO: 58684 - protein, 93 aa, Sorghum bicolor
  Clone ID: 6674278.pep
RLAKLGYCWQFITLAGLHTTALISDQFAKAYSTVGMRAYGELVQEPEMEQKVDVVKHQKWSGATYVDELQKMVTGGISSTAAMGAGVTEDQFK

SEQ ID NO: 58685 - protein, 76 aa, Sorghum bicolor
  Clone ID: 6674279.pep
EYCLFLFISYVVEKRERVCISLGLYNSMCTEWMYWYMCVGTLHHHLNNLSSETLSWKESLGATDNEALGTWSVEQG

SEQ ID NO: 58686 - protein, 57 aa, Sorghum bicolor
  Clone ID: 6674286.pep
EKIKIAVVRRANYSKPQYLNDDDVLSSFIQGEDDYLGLDHVDRTRTLRNGVGDLFLK

SEQ ID NO: 58687 - protein, 66 aa, Sorghum bicolor
  Clone ID: 6674309.pep
PFIHAPQSSRTETKPLVYSGCVLFPFQKIKSGVVVSSCNCFRFCFYLFVLQVWNWTCAGRSSTVSV

SEQ ID NO: 58688 - protein, 141 aa, Sorghum bicolor
  Clone ID: 6674313.pep
TSARIRELRKEQGLGEDWDIWRDGCPGGESPEDVTTRLDALIADLRARFHNGRFGKNAGWRGSDGTGANDVLIVAHGHILRAFAARWVGKDLRDNPSLILEAGGVGTLSYEHHSVEEPAILLGGAFVVDVVEKEQEEAHKH

SEQ ID NO: 58689 - protein, 169 aa, Sorghum bicolor
  unsure (1)..(169): unsure at all Xaa locations
  Clone ID: 6674319.pep
ENEVTTISRASHFNIISLLGYCLEGSHRALVYEYMQNGSLNLYXFGSIDSVETKQLHWQKLYEIVVGVARGIDYLYTGCRTQILHFDIKPENILLDQNMCLKISDFGLAKLCXKKETEVTISGARGTIGYMAPEVFSRQYGRPSSKSDIYSFGMVILEMVGARKKENLP

SEQ ID NO: 58690 - protein, 56 aa, Sorghum bicolor
  Clone ID: 6674324.pep
FVTSPILSKSSATMLVMEINIQFPRTSEKVELYILSHASQCILANAPNYTIKGLQH

SEQ ID NO: 58691 - protein, 131 aa, Sorghum bicolor
  Clone ID: 6674332.pep
EPNPIKNADVYWLRYVMHDWSDEFCVRILAAIKPSMGSRSRILICDQVMNTTLGSEELAAAPAPLPANWGYYTRYSHQRDLAMMALLNGIERTPREFRVIIERAGLKLHKIWDCRSQVSLVEVVLPNSELV

SEQ ID NO: 58692 - protein, 125 aa, Sorghum bicolor
  Clone ID: 6674334.pep
VPHSENRFPGYDMESKELDAETLRKYIFAGHVAEYMETLADDDEERYKSQFGGYVEDDLEADGLEELYADAHKQIREDPWKKEESDEPKKTKEEWKKESLKYRTPKLTKEEKEKRVQEKIKQLKA

SEQ ID NO: 58693 - protein, 119 aa, Sorghum bicolor
  Clone ID: 6674338.pep
TPPPPPSLHTHIQKADPSQLMRHHCRFRHDSTNGVPHYCLFDTLFFLFVGMGRRLGLGTVLPLAFWVFVCCLLPSSLSTACDTPQLTRMDTLQMFSMALDAATCRLFLLVVIDQNTIIF

SEQ ID NO: 58694 - protein, 129 aa, Sorghum bicolor
  Clone ID: 6674339.pep
ETELENVPMVTTESGLQYKDIKVGEGPSPPIGFQVAANYVAMVPNGQIFDSSLEKGQPYIFRVGSGQVIKGLDEGILSMKVGGLRRLYIPGPLAFPKGLTSAPGRPRVPPSSPVVFDVNLLYIPGLDDE

SEQ ID NO: 58695 - protein, 73 aa, Sorghum bicolor
  Clone ID: 6674340.pep
KKQSRLFVRFQVTTGLMSSPSQHIHPLSSVIEDVCKRRNKPERTTSNTRHQMIPCTVSIEDTPSNNQYRIPTQ

SEQ ID NO: 58696 - protein, 45 aa, Sorghum bicolor
  Clone ID: 6674344.pep
WRLMKTILTRCHVYDKERYYVPFDELVPEESQPIKFLRKFMPDYA

SEQ ID NO: 58697 - protein, 70 aa, Sorghum bicolor
  Clone ID: 6674346.pep
GNPYVITIKQHHCIGYNISNTMREAYKYFYRHHRYILEPHLKYAKCISPINLLLSSVAHHPGTHPHLPLN

SEQ ID NO: 58698 - protein, 107 aa, Sorghum bicolor
  Clone ID: 6674357.pep
GPPHGQVGHALRAGHRVHLRLLALRGRPQQQQRQAHRVALAQLPQRQLHRAGGRRGQVVGRVRPHHRGGELQRRGRQALLGEEEGRRRQRLLSCPLSPCTQKTKLFN

SEQ ID NO: 58699 - protein, 87 aa, Sorghum bicolor
  Clone ID: 6674360.pep
NLCYLCRCVCHGPHFRVFVGAGDQGKNIRGNRILIPLTRHDLGMRSHHVLLSHATGPFSSWIPRQSCSHSLLGCIIFSVHMNVHCTI

SEQ ID NO: 58700 - protein, 149 aa, Sorghum bicolor
  Clone ID: 6674368.pep
KGVKIHLPTDFKIANKFADDAESKVVTDKDGIPEGWMGLDIGPESGKAFADVIKGAKTVVWNGPMGVFEFPNFSAGTDAVMNALVEATKAGATTIIGGGDSAAYAAQSHHENDVSHVSTGGGATLELLEGKPMPGVTALSDKDKVQANL

SEQ ID NO: 58701 - protein, 82 aa, Sorghum bicolor
  Clone ID: 6674369.pep
TKPAATKPAQPINKPKTTQKVRGTKTRGSCPAKTDATAKASVVPAYYQCGGSKSAYPNGNLACATGSKCVKQNEYYSQCVPN

SEQ ID NO: 58702 - protein, 111 aa, Sorghum bicolor
  Clone ID: 6674371.pep
HPKRLGPKRATKIRRFFGLSKEDDVRKFVIRREVQPKKEGAKPYTKAPKIQRLVTPQRLQHKRHRLALKRRRAEASKDAANEYAQILSKRISEAKTAHDEARKRRASSMKH

SEQ ID NO: 58703 - protein, 74 aa, Sorghum bicolor
  Clone ID: 6674374.pep
FRKFCGAYHALLRPVAINQHYLLSMTMTTYMLNLATTSHCQRDKSKTNYPSLRLRFFLSMQRRGWRRSILIWVY

SEQ ID NO: 58704 - protein, 89 aa, Sorghum bicolor
  Clone ID: 6674377.pep
GLGPVLSGNTTYPVINCPPVKPENVNLDVWSSLNVPSGLGCSTVLYPEAAALQAAQIIGLGDFMVWSKLRVKLLSNLNSIRLADQKLNA

SEQ ID NO: 58705 - protein, 106 aa, Sorghum bicolor
  Clone ID: 6674379.pep
DVTEAMAGASLAERPTQSVPGSPARSSSNAGNLHRTRSDSKVPVAEAVETRLTNKEKYLSFFSLREEGGDYIQDVTEMTRVPVILKTDLTKSPPCLTIRSLNPYAL

SEQ ID NO: 58706 - protein, 134 aa, Sorghum bicolor
  Clone ID: 6674380.pep
LFIKPITHQQLNNSTILSERCSRRWPDRLFRSVLLRTISLQLSEPSIHPRLLIISQTPILMRSPIILTQAPQRQMLKDRHDSRDDNDRNRISPIIRPRSVEYQHKRIERIAEQIRRKRTGHFATSSRVSRSVCS

SEQ ID NO: 58707 - protein, 69 aa, Sorghum bicolor
  Clone ID: 6674389.pep
VSRVYFIQGVSYLIPAQVHQALCDNPMFENERQKRRICFRRPFHAIDRRAVNNLRTPNSHAMPYPDNPI

SEQ ID NO: 58708 - protein, 82 aa, Sorghum bicolor
  Clone ID: 6674397.pep
RKYTSRLLYPSCFGVRRTIASSRANCDLRGLPLLPDAQERQAPRGIALHITDCRDTPIRSNSTSNPTCQRAMDLFLLNVFLR

SEQ ID NO: 58709 - protein, 71 aa, Sorghum bicolor
  Clone ID: 6674402.pep
LQKFQQAGAGGNGHIPLMHETYASTVQTLTPALINWAKQNNLKLVTVADCLGNAGGAYQSGTFNGNGQNHC

SEQ ID NO: 58710 - protein, 116 aa, Sorghum bicolor
  Clone ID: 6674404.pep
IARVVLQEGTGKVFINFRDAKEYLQGNPMWMEYCKVPLMTLGFENNYDVFVKVHGGGLSGQAQAICLGVARALVKISNANRVPLKSEGLLTRDTRIVERKKAGLKKARKRPQFSKR

SEQ ID NO: 58711 - protein, 110 aa, Sorghum bicolor
  Clone ID: 6674423.pep
ATRVQQILQEYKSLQDIIAILGMDELSEADKLTVERARKIQRFLSQPFAVAQVFTGIEGKLVDLKETIRSFKAILSGEGDDLPEGAFYMVGDFASARAKGEKILADLEKS

SEQ ID NO: 58712 - protein, 157 aa, Sorghum bicolor
  Clone ID: 6674424.pep
YGCDVWYAVRVRQLPLVSPHKTAMSRHRRCISRSTICETPVSQPLRLMKSRRRAISSIPLKPTAVALSNTRSQALAAFHTSSLLTWRRLHLQLWVRLAAQSQATVFWWAGLVTPGRSLVLAHRASKQTCRISVPFFCGSSLPQCGRCVDLDFIRLFS

SEQ ID NO: 58713 - protein, 131 aa, Sorghum bicolor
  Clone ID: 6674432.pep
NLRDETNNAPPPLSLASDFFQLGGDIMGLAQIASILDHEEGWKVRVEDLLDQPVFVDQVKLLAVERKKQIERDEMNPWGEKGKANGKNGVGEKMTLERKETGLGALARKMGLGTKRKDTGKGPKDGQGARK

SEQ ID NO: 58714 - protein, 73 aa, Sorghum bicolor
  Clone ID: 6674445.pep
KQYRVLDMADGFVTAMTETGDVKQGLSVIDQSNLWSRLQQAFESGRGSVRVLVLNDGGRELAVEMKVIHGSRL

SEQ ID NO: 58715 - protein, 73 aa, Sorghum bicolor
  Clone ID: 6674447.pep
LAICLQRCGLHLAQQRPGDLDAQPGVPDGEVVVLGREHHLLGVVHQRVHGALPERRAGAQVGDLQRPQHVGGV

SEQ ID NO: 58716 - protein, 46 aa, Sorghum bicolor
  Clone ID: 6674455.pep
IVPMEYPYGSRGPAVLDDFTASYGYKFSDAAGYQWPMHDGQAPNKL

SEQ ID NO: 58717 - protein, 51 aa, Sorghum bicolor
  Clone ID: 6674456.pep
GVAGILVQDPQIAESSELSYLSTAQAGAVILSEEQSVRAMGILEPLLTKES

SEQ ID NO: 58718 - protein, 151 aa, Sorghum bicolor
  Clone ID: 6674466.pep
LNSGVFSQLHDDESKVYVQLHGPLEKIVQCYAVCTSLTTLPESLDMEIFSDVSLMQLYCLAAQLDDDHVRGLVLDQWRLLSEQNKEIELVLGELNLLFDSTSCSDPARDIWAKSVCAAGLVGDLLAMDGCGSALADCLRSLAAEASVGYWF

SEQ ID NO: 58719 - protein, 85 aa, Sorghum bicolor
  Clone ID: 6674467.pep
CLRGQVPAGGVVTVEPGVYFCKFIIDPYLENPEQSKYIDSSVLAKYWDVGGVRIEDNILVTETGYENLTTAIKEPGQLEALMASS

SEQ ID NO: 58720 - protein, 51 aa, Sorghum bicolor
  Clone ID: 6674475.pep
MVYRPGLRLQRTCVDGGTIVLVLFLKHLVATQLVGGLMPTSGVCWGCYNIC

SEQ ID NO: 58721 - protein, 78 aa, Sorghum bicolor
  Clone ID: 6674480.pep
FPDEGMEGDLSTPKCLANFLTVVGLTVICLYLTLFSSVWFKVYVLASCAYLSFVTYYSILPPQLIGSPEGDVKAKKAV

SEQ ID NO: 58722 - protein, 90 aa, Sorghum bicolor
  Clone ID: 6674481.pep
LRFDFPRFGRPPRIVLINNQFFSFLFRDAWAHPVEDKERKAATEVCVKRRPRGVQGKGVWKIDDKQGDMVPVQKGGGSKKREREIAGLHD

SEQ ID NO: 58723 - protein, 119 aa, Sorghum bicolor
  Clone ID: 6674493.pep
RRKNGTLLAFGIHFTPQISLNEFQKPALSTHANLYLLGKRNKRKKERKEKWKIKHTSIIFSLTRPCCSFVVRKLESDHTIVVSCSHVTWPIRRTPWEGTCPRRPPRGCSSSCSARPSPL

SEQ ID NO: 58724 - protein, 110 aa, Sorghum bicolor
  Clone ID: 6674494.pep
ERVDSPSLFPCFSPGALLLLHQSSSLLLCCFSPFPWYFGHSHLISSQKKEIVIAQQTPFLFTVLRQLNTPDSPLLLARESTLTKLRFFPLFQGTKCIVVYTRGGCNGEEG

SEQ ID NO: 58725 - protein, 111 aa, Sorghum bicolor
  Clone ID: 6674496.pep
SPDKATKGTNLSISLLSGVIAGVVAAIVSHPADTLLSKINKKGAGGSGSTTSRLIAIAREMGFVKLCLTGLPARCIMIGTLTAGQFGIFDSVMAAIGAKKFHFHNPDEAHH

SEQ ID NO: 58726 - protein, 131 aa, Sorghum bicolor
  unsure (1)..(131): unsure at all Xaa locations
  Clone ID: 6674502.pep
RRASAPACPTAPCCCSRSTPPSRSSSWSSTTSTSTPPTGXPASCSTTTPTPIPTSPTPGATLRRSSATSARCPARASSTPYPPSAPRTRRCTGRSSAGSSATGSSSESRPAACQSRATAAPTRTFISIAAT

SEQ ID NO: 58727 - protein, 75 aa, Sorghum bicolor
  Clone ID: 6674511.pep
KHVVHIDSSFEVTQQIVARKLESLSISLGVHIFFGIDLLGIDLLLASFDRARDSPSGLEISALDGMDQYSPCLAL

SEQ ID NO: 58728 - protein, 78 aa, Sorghum bicolor
  Clone ID: 6674517.pep
SFIHLKLKDANLYRTGYPNTSNGNRIEAKLLHHLWLWQMATSLASSEGCKLPLPIFSSKEILLLSTKLDTAVSSNVIL

SEQ ID NO: 58729 - protein, 76 aa, Sorghum bicolor
  Clone ID: 6674524.pep
TKWASLRQTFALSSHIYWRYTRCSIKALHQATSWQKVQQKLVLMPELDCTYVMYRICVFLLQNAIMQMWKYAYIFI

SEQ ID NO: 58730 - protein, 106 aa, Sorghum bicolor
  Clone ID: 6674545.pep
MAKAGAHIIVAHMGLTTAGSIGAMTAATLDDSVLRVQAIADAALGVNPDIIVLCHGGPISGPQEAEFILKNTKRVHGFYGASSMERLPVEQAITNTVREYKRISLK

SEQ ID NO: 58731 - protein, 123 aa, Sorghum bicolor
  Clone ID: 6674561.pep
KRRGIITCNAQETMSYASFAFESCNADALPCSGFVAPERNINFLPSSNPMRWMHQQEKQRSPSLAIVLPISPITSSCYSEPSTRPHLPRLPQPRQQVILRLALSAKESIEDAADEVDKDDSEE

SEQ ID NO: 58732 - protein, 100 aa, Sorghum bicolor
  Clone ID: 6674575.pep
VKKKESVQREAERQAERPRKDVANHQFGRKQAQRERQSRMIEQQLAQSLKRSRDDEATQREEVERASKSRKTEGEISSAKERYLARKRAAEEAKKAAGGT

SEQ ID NO: 58733 - protein, 154 aa, Sorghum bicolor
  Clone ID: 6674577.pep
WSGGGFSNYYSRPKYQDEAVKTYLASKAAPPTSYFNVSGRAYPDVAAFGVNYQVFVNGVVQNVAGTSASTPCFAGIVSLMNDARFRAGKKPLGFLNVWIYQHAGRTPNAFYDIIKGNNAYGDCQYGFSATQGWDPISGFGVPNYKILQHLALLK

SEQ ID NO: 58734 - protein, 149 aa, Sorghum bicolor
  Clone ID: 6674580.pep
GPVSEELVWRSLIVPLHVLARFSGKHIIFLTPLYFGIAHVHHLYEFRITHPRVPFILAVARSLFQFTYTSLFGFFAAFVFVRTGNVYTCILAHAFCNWMGLPRFYGRVGVEAGVPIGPPDVDKKDDVDQKTAPAYHGKGIAWTVAYYLI

SEQ ID NO: 58735 - protein, 131 aa, Sorghum bicolor
  Clone ID: 6674583.pep
EAKKKLDEIISDLKPDNFSTVRPASRFGQAPAWKNTFTNIQPTLTSPMFIAEHQRFDRTPQASVLPSNEDKERKKRIQSAKIETIKQHHDILSKRVEKDTLKQDNLEQSRLKTKLLAVNTHEFNARLRNNF

SEQ ID NO: 58736 - protein, 90 aa, Sorghum bicolor
  Clone ID: 6674594.pep
RAPENRSSWWYARGVLRAASRGLGEWEEFAARFVDGEATKSSHAVEWLADVYAESEKAKSVKMLTLLKEKYDPIRKNYWDYRIRQLGEVA

SEQ ID NO: 58737 - protein, 71 aa, Sorghum bicolor
  Clone ID: 6674600.pep
LFNGLLDSTGTRNGSRTTRIVKAQYCRKMLDDSDVMLSSQLAVSSHSVHLFLKGSRTKSSCFDLFVHTERT

SEQ ID NO: 58738 - protein, 86 aa, Sorghum bicolor
  Clone ID: 6674609.pep
GNAKQHKPRSNFLFQPFKTLAFTGSRPKPPTSILIPYDSILLFHSTEAEDAHSPSFSTVGGVLFVHLLLFCFSLFSLVFSFSFLIC

SEQ ID NO: 58739 - protein, 64 aa, Sorghum bicolor
  Clone ID: 6674612.pep
YHQLCDDLSNVNYTAWVVNTKLIAHSVATYARSFKGFPERTIDADVATTSYNKEIKYRGSKLFI

SEQ ID NO: 58740 - protein, 104 aa, Sorghum bicolor
  Clone ID: 6674633.pep
FDRAFHPVPTNRVRTWKEYDTFFSQYFIIPGKKDQDVKAELKKGKVEYGHIVKSEFPGGVREVREWLSRIRGTLVEMPLDFLVDAGDIAKEGLTLNNLTNELYT

SEQ ID NO: 58741 - protein, 90 aa, Sorghum bicolor
  Clone ID: 6674634.pep
MKSGCTSSSTTTSVVASVEADSSCSVQCNPYVSDPFLSPKRLDFDLCTSAVAVAQWGLDPCLICCLLLYKVGCVDSLVLFPTTSDWALRG

SEQ ID NO: 58742 - protein, 107 aa, Sorghum bicolor
  Clone ID: 6674639.pep
MAQRAFAQEKMPNDPMFKLVSQVYKIAPGVLTEHGKTKNPYPNVDAHSGVLLQYYGLTEANYYTVLFGVSRAIGVLPQLIIDRALGAPIERPKSFSTDKWAELVKKL

SEQ ID NO: 58743 - protein, 63 aa, Sorghum bicolor
  Clone ID: 6674654.pep
PSLQNVRVRLDGEETLSEELALKVKETLRNEARAHPNHPNIDIRIDEKWIQLCMSTLRSSPLT

SEQ ID NO: 58744 - protein, 83 aa, Sorghum bicolor
  Clone ID: 6674679.pep
LLISYCTTDQSISHIIDDGVALLRSFHGQPDRTRTAPTGRRRSCCIRPAPPRIGSPIDKASGQNTHTAACASAGSSGGCCSGS

SEQ ID NO: 58745 - protein, 119 aa, Sorghum bicolor
  Clone ID: 6674688.pep
TLREAINTVSKYAGGALPENARILVRRHLTSLPQRFRVATMTDRNAGQQDNETALTEGAHKVLVLAKEGLDMVVQVSGVVDGTIVSAEQWLDRMGKRRAQEDEKPMLPQTEVNGDVKMG

SEQ ID NO: 58746 - protein, 117 aa, Sorghum bicolor
  Clone ID: 6674689.pep
ETPAFHSLILIGSSFLITTTCDMLCFLLLLEFSPNSRVGRGRMGRKTWNKRTRPPPILPSLPLIPSLLHAYELLNTGRKSLSCSASGKQRKKHSRYVFAKCANLHASCRFYTLLEYQ

SEQ ID NO: 58747 - protein, 103 aa, Sorghum bicolor
  Clone ID: 6674703.pep
QTPLQSHPPTLIAATQTMSAIITNSWPRILETEHMENVARILSLCWLNVSEEIEHEASRTSADINTLSQELAHAARILQALWDHDASKRPAKLSEALKQEPRL

SEQ ID NO: 58748 - protein, 95 aa, Sorghum bicolor
  Clone ID: 6674713.pep
MGSLTCLLYLCIYMTIARLGMFHKPHRACRRLCVFNYGRPRTMGIIDKAYFWMTSSLARMISTQCWVQNNAQGKRSMKDDPCIINTLEGYDSKEE

SEQ ID NO: 58749 - protein, 105 aa, Sorghum bicolor
  Clone ID: 6674727.pep
KFAVLNTGIHECRSCGYRYDQAAGDPSYPVPPGLPFAQLPDDWRCPTCGAAQSFFESKSVEIAGFAQNQQFGLGGNSLTSGQKGLLIYGSLLVGFLFFISGYFLQ

SEQ ID NO: 58750 - protein, 62 aa, Sorghum bicolor
  Clone ID: 6674730.pep
NARGTCCQTGTAKTRVYLCNPTTAGTCRNASSYVFFDGVHPSEAANVFMAESMVDAGIELVT

SEQ ID NO: 58751 - protein, 72 aa, Sorghum bicolor
  Clone ID: 6674741.pep
ARGYNRNMGLPFATKPNAFLDEFSYRRVKTSDHLQMQPLICFTSSYISMKKPPTGEASSPNKHQQAYRQQNH

SEQ ID NO: 58752 - protein, 201 aa, Sorghum bicolor
  Clone ID: 6674743.pep
PGPPLDMMNGIIADSRKARATPADGEESKDLLGLLLSMVEDEGSDDEVRITETDVKALILNLFIAGTDTTSTIAEWSLAELIRHPDILKQAQEELDTVVGRGRLVTESDLRHLTFFNAVIKETFRLHPSTPLSLPRMAAEECEIAGYSIPKGCELLVNVWGIARDPALWPDPLEFRPARFLPGGSHSDVDVKGGNFGLIPF

SEQ ID NO: 58753 - protein, 58 aa, Sorghum bicolor
  Clone ID: 6674746.pep
KFLQTKQGLSMAAFGHQPNKPYNQTDLLVLLVRTSLKKRNPLVRTSSNLLQRILPRLF

SEQ ID NO: 58754 - protein, 79 aa, Sorghum bicolor
  Clone ID: 6674747.pep
IRKKENGIIKIQGRKEGRNGVLQFDTEIFEITASYHLIEMKQTSGDSVEYQKLLEEDIRPGLKDIVWSWHGDDLQQKQE

SEQ ID NO: 58755 - protein, 46 aa, Sorghum bicolor
  Clone ID: 6674749.pep
WSSAIYSSNNPVGFHRMEFFFFGGGMNGNQLKSSIKSQTSPFETIL

SEQ ID NO: 58756 - protein, 122 aa, Sorghum bicolor
  Clone ID: 6674754.pep
DVYIAGQVLKKSLSTYNKVEGQEVVSAKKAELIYGALDAHPDVYRVVPDKSVRSRMNICFRVTKNGDTDGTEKAFLKEATAQGLTGLKGHRSVGGIRASSYNSIPLEGAEKLAKFIETFATS

SEQ ID NO: 58757 - protein, 122 aa, Sorghum bicolor
  Clone ID: 6674760.pep
KGEKKILREHGIKAFSMHDIDRHGIGRVMDMALGWIGSDTPIHLSFDVDALDPMWAPSTGTPVRGGLTLREGDFIAECVAETGSLVALDLVEVNPSLDEQGASDTVRAGCSIVRCALGDTLL

SEQ ID NO: 58758 - protein, 125 aa, Sorghum bicolor
  Clone ID: 6674763.pep
ITSDGDSLSGSPRDSTSTFDHPRSPPAPPTSSGAASGPMKVLDDLAVEYQIKWLPLCSDYIASPPSDPKKREEDHRRLSESIMMHIMLKLDGVEAEGMPEVRARRKELVKQVQKTLKDLDIAKES

SEQ ID NO: 58759 - protein, 113 aa, Sorghum bicolor
  Clone ID: 6674774.pep
TTPLLLLRSFLYFECRNMLATPTLLFTSTTPTTAFCFQFGHLGSIAVNYLPRIIKRNSSKAKTSYTKLSFTKWNQENHLYLSLFIILDPLRRLQFQLEIVYFNTSYICFCMHA

SEQ ID NO: 58760 - protein, 147 aa, Sorghum bicolor
  Clone ID: 6674781.pep
LGKCILISTYMYPTSLQHTYSHSRATQVMQGIIRKKKQIKPSQIAPPATSSLHLQTLHYASPLNFSRPRYRPALSPLPFSLHHLALHVALGPDTSTSSFCVLPQPGSEEVGNVVVSCSATLASLVAVRSRSGGGLYVSLWPFGNRRF

SEQ ID NO: 58761 - protein, 126 aa, Sorghum bicolor
  Clone ID: 6674800.pep
TVYTLPDGERAAMGDRHEPLSTPPDRTYRLDTPRVSTGNSPPHVTRLVSVGCLTLRVLLPLVVGNFVVDLLGDLWVHGRDLVHGGGERRAGLLKQSDQLVELTNALLRVLHLVLQLGKELVDGLLL

SEQ ID NO: 58762 - protein, 106 aa, Sorghum bicolor
  Clone ID: 6674830.pep
ERLSRASVDLADGGKTLARVELVLTSADHEPRVTLNLVRVVEVVHELLEEAGGLLLGSGAGVETELGDPDLTVRLGGLLNVRGEAVDGLVVIDVVEVDVAGIDGGV

SEQ ID NO: 58763 - protein, 87 aa, Sorghum bicolor
  Clone ID: 6674832.pep
LRCICTGRMSREVKRRKEKCWRVEKTSLCPLLQHDTSDDKHGDSIVASIIANPQASRGTIRTARCGGAIRESTVEDKRLGAIDIGNG

SEQ ID NO: 58764 - protein, 48 aa, Sorghum bicolor
  Clone ID: 6674834.pep
MVYCIYVFISRKTPPPGLPCSFWSKLNIPSFSALSYQSWSFHQLWYST

SEQ ID NO: 58765 - protein, 106 aa, Sorghum bicolor
  Clone ID: 6674842.pep
NKCNAEFGRGSDARRKAIIRGALSDEDLFTKVMRSLKDSFKANSEATQTKIQDATIEYLRVIEQRFDLVRSENVARESEQDPDFRLRVEQVARAGRETMQRVHQVI

SEQ ID NO: 58766 - protein, 111 aa, Sorghum bicolor
  Clone ID: 6674846.pep
FSAMEVETLVRYQLPVVVIVFNNNGVYGGDRRSPDEITGPYKDDPAPTSFVPAAGYHKMMEAFGGKGYLVETPDELKSALSESFRARKPAVINVIIDPYAGAESGRMQHKN

SEQ ID NO: 58767 - protein, 56 aa, Sorghum bicolor
  Clone ID: 6674891.pep
KDFLFFFFLKKTQGFLLLLLKKKFSMDSDLKGVQPLSNKWELDPMGAFRPTGAPII

SEQ ID NO: 58768 - protein, 118 aa, Sorghum bicolor
  Clone ID: 6674896.pep
IKSPGHRFFICGVPGHCAAGQKLNIRVLKTTRSSDAPSPSPAPAAARSGSSAASPSPSTEPSGASASPPASSTDSPPDATATTAPAPNANGAGVSASNCRAVVGAMALAAVASMAMLH

SEQ ID NO: 58769 - protein, 49 aa, Sorghum bicolor
  Clone ID: 6674900.pep
FQGVFFFEKWAFWIMDNGYCDLSQIMDSKHQEGWPQKGKCGKEFFHIIT

SEQ ID NO: 58770 - protein, 138 aa, Sorghum bicolor
  Clone ID: 6674906.pep
GGSSTSSTQEAFPCDRWRGRGTTNPSALKLETNPNPKLIPITRRTTYSYYRLLLSFQRKQADKGATRRESQPGAGVSVRPQDKTRTPTTAARGRGRAGVPCRERARPTCPVTSQAQASARQPSPPPPLLVVLRHCSAG

SEQ ID NO: 58771 - protein, 81 aa, Sorghum bicolor
  Clone ID: 6674914.pep
ESKRLGGILCFEMEAAGLMDTFPCLVIRGISDYADSHKNKDWQAYAAGTAASYAKEVLSVIPPAQMKMTQPVGQTMRSGNG

SEQ ID NO: 58772 - protein, 47 aa, Sorghum bicolor
  Clone ID: 6674915.pep
GRNKKLFFPKTSLFLQPNQPRKIATPLFIFFTSKKLNSGPILGNLLQ

SEQ ID NO: 58773 - protein, 85 aa, Sorghum bicolor
  Clone ID: 6674934.pep
KTPSSQKKKKKTESESSPPLPVARNHSRSIKQKLQFLSVLEGAQAWSREVNSRLQAGDLLVIGGVDVGKDVVGSRRNGRGEIDAL

SEQ ID NO: 58774 - protein, 95 aa, Sorghum bicolor
  Clone ID: 6674937.pep
RKMNTLFYLDITHKTSLIPTLLCNLLNKSRFFVVNFKQLYSFSEDSNTQCNISMLHREDLWRLLHLSSHPQIVLSFSHQRLYIQSRDERRHGPKS

SEQ ID NO: 58775 - protein, 64 aa, Sorghum bicolor
  Clone ID: 6674941.pep
VTIQACHEGVIAVATNTDSYSSRFLVPILYSSCLTEHKVIMIMMEHSSFLIPNLNQLHTFIQNL

SEQ ID NO: 58776 - protein, 73 aa, Sorghum bicolor
  Clone ID: 6674942.pep
DQQLTGHQTWYDCQFLINENILGKCFRSCSSFINPRISPLTMKYECPRLSLLIITPIPKANTIGPESYDVIPC

SEQ ID NO: 58777 - protein, 88 aa, Sorghum bicolor
  Clone ID: 6674944.pep
SVAAYPHYSHYPFPTQGQTGIGHVKPSSPVQAASQQAALQIDAHDEGAGRGDHVFDLVLLHAVRLPGAVPLDADDLARALALEIDEEE

SEQ ID NO: 58778 - protein, 112 aa, Sorghum bicolor
  Clone ID: 6674946.pep
GLIDNEKLDSFYIPIYGPSEKEVREIIEAEGSFSIDKMAVHESLDGIDAPKTAARALRAVMEAIIAQHFGPSADAMDEFLKITEKFIEMAPLDAFSPNKSSAFVAASLTRRT

SEQ ID NO: 58779 - protein, 167 aa, Sorghum bicolor
  Clone ID: 6674947.pep
ARRLEQDLDRRRQLRADHQHQGHWRYQLHQLRHLLAARPLAGHLQRGRQQQGHHQRLRAQRSPARPPVGCGARKRPRHGQRVLQVARRLRQRPGQPRSLPLELSSVVIALSVRLDSINKGTESTTTRRHGKGKQARLPRSYPLFQLLFVHRTLPSSLIFSKYTIIRL

SEQ ID NO: 58780 - protein, 99 aa, Sorghum bicolor
  Clone ID: 6674955.pep
LLAVLIFILIFLLLLWLFHSYIALTNQTTYEVARRKRIFYLRGVPERVHPFSRGICRNLYDFCCSSQKGYILEAVPPSEELEARAARYTCRDVICCRCC

SEQ ID NO: 58781 - protein, 167 aa, Sorghum bicolor
  Clone ID: 6674972.pep
SHLLMNMVPLFLVGSALHEDIGRANLLTLYVGCGAVGFVGSVATYAMRGMLGVTTLGASAATLGVCAAYFWEHRLDGYRFFGLPQDGVPGIIFLALICVPQLAAFGKTVKLKIDIASHLCGILNGILGMELINRTRSEREKRTIDVAGTPVRAARLPRPDESIEGSN

SEQ ID NO: 58782 - protein, 124 aa, Sorghum bicolor
  Clone ID: 6674975.pep
GRPGCVRYVASLAPGTTTGEIGIWATEKLLEIDHDARRLAYAVVGSSLGFGRYVATMSIVAADDEDDAGCRLVWAFECDPVQGWSRDGMLAYLDAGVKGIAARIEEAHAAAASASAGGDGGVAA

SEQ ID NO: 58783 - protein, 84 aa, Sorghum bicolor
  Clone ID: 6674978.pep
ALAIPDENAMLGSSLILCHVQDRKCTNKNCNRLLFFLSWESLRPVTVPGPVCIVATRRSTFDRVENKRIGVAPLKRPNLVWPPI

SEQ ID NO: 58784 - protein, 153 aa, Sorghum bicolor
  Clone ID: 6674988.pep
VVSYAQGYVLMRAQAKELSWHLNYGGIALMWRGGCIIRSKFLGNIKEAFDKNANLENLLFDPYFVNKMQATHSGWRRVAALAVTRGIPIPAISTALAYFDGLRTARLPANLTQAQRDYFGAHTYERVDKKRGEFFHTNWTGHGGNTASTAYIV

SEQ ID NO: 58785 - protein, 91 aa, Sorghum bicolor
  Clone ID: 6674997.pep
GSPEEYEAIAHAVRRGTAVPDVAVLARQGLAFIVREGRSGAARSRSGGLCGCGNTPSYAWHATVGVAAAVSIAAFAYWYGWKAPYLAKRDS

SEQ ID NO: 58786 - protein, 60 aa, Sorghum bicolor
  Clone ID: 6675023.pep
AYLETEISVRSNIQFRAPQNALDSSSSVIDLSNFLFLCWKHAETVSSPNEHYCLGNLEPT

SEQ ID NO: 58787 - protein, 81 aa, Sorghum bicolor
  Clone ID: 6675037.pep
CKPAYLDNAINSPTPKFGAESAQSHDSMDKKGQNDAEELEESMTPPAYSEPPRNIQLSLRSASAKMKPSTLPRRSARLLPK

SEQ ID NO: 58788 - protein, 95 aa, Sorghum bicolor
  Clone ID: 6675050.pep
RTFKIKDFGDSIPGHGGMTDRMDCQFIMGSIAFFYYSSFIAVHHTTVGGVIEAAITGLTHEEQIEVVKKLSKHLVNQGIISPKVLELLSEQMVRR

SEQ ID NO: 58789 - protein, 42 aa, Sorghum bicolor
  Clone ID: 6675120.pep
TSGHQKVALAIFWHSLFARPCLVEYLIFLGELLVTKFSLYLI

SEQ ID NO: 58790 - protein, 34 aa, Sorghum bicolor
  Clone ID: 6675147.pep
AHYGQCGGIGWTGPTTCAGGFTCKVSNPYYSQCL

SEQ ID NO: 58791 - protein, 43 aa, Sorghum bicolor
  Clone ID: 6675164.pep
QPIHGQRNYIYTRGSSLLKGNRDPITYITTHAADAKRRIACFA

SEQ ID NO: 58792 - protein, 59 aa, Sorghum bicolor
  Clone ID: 6675178.pep
YRFHYLFVLIQISWMQKHTKASSKSNGYFGLLLLIRRALQLPVHVMRCIPFVHIFEPKL

SEQ ID NO: 58793 - protein, 52 aa, Sorghum bicolor
  Clone ID: 6675179.pep
ANRSSTLIHPQFTLSRSRFAHRRKLGGKVDVATADVFLSLDYKQNRNIDILC

SEQ ID NO: 58794 - protein, 100 aa, Sorghum bicolor
  Clone ID: 6675183.pep
GVKTALLCVLDFTAPLFVSRRAEPGFGPGLCFTLYPGLRGQILIYKLQFFPVGLRVHRGASLGHGHRYQQHNLPVRYPSQRRSSKYGPSRSGSSKGHGKS

SEQ ID NO: 58795 - protein, 80 aa, Sorghum bicolor
  Clone ID: 6675186.pep
RHPAAALAAVAPSGVGLSPAYRYLINYSRVWISQDFTQTFWIAMEIVGSFSIPIQGDRAYHHQHPKQAKCECPASYWCRA

SEQ ID NO: 58796 - protein, 90 aa, Sorghum bicolor
  Clone ID: 6675196.pep
LTSIALAGASGQDFDQGRREKDQRGLLNFHPSRRRVCADIVTTAAPGKRRSKHVDDKEACHHGSAHAYFSADSTVFDRAQCEFGDISVSN

SEQ ID NO: 58797 - protein, 92 aa, Sorghum bicolor
  Clone ID: 6675200.pep
GGKTAYPVDTNMVWLDIDASGVELNQFIELGEQYGVRVKGGRLVVHYQIGEDAIARLKQLFTEVLKGEPGDLKEAKADHDPEALKLKGKPVE

SEQ ID NO: 58798 - protein, 64 aa, Sorghum bicolor
  Clone ID: 6675202.pep
RAMSQTFAPMGSARHHLILAPITANKERWPLEDTRPMFADRSGRIRPSSRGLCTELGKMNAPPP

SEQ ID NO: 58799 - protein, 114 aa, Sorghum bicolor
  Clone ID: 6675208.pep
STSRLLASHHHSGSSLRHSELADETSSQAPSEGSTVVSQLEAEEKELRERLVVLEEQRFMVEAMVKTAQGSRRFEEVSALSRNVDELDAEIKVLRNKVGGVEERWEGVYRNGVA

SEQ ID NO: 58800 - protein, 68 aa, Sorghum bicolor
  Clone ID: 6675222.pep
RVELSSRTVSQAKLLLKMKSGGGGGFRVMMEGEGGSSAMSLGWRDSVQLITATGWRRRRRSTNKPAFS

SEQ ID NO: 58801 - protein, 68 aa, Sorghum bicolor
  Clone ID: 6675225.pep
INMGNVLERLQTAHLYQLPRLKGGCLRFLVDFRKVYEMHDDLNAFLQTADRDLVAEVFHGVLAAWSGR

SEQ ID NO: 58802 - protein, 158 aa, Sorghum bicolor
  Clone ID: 6675229.pep
ESQFSNKWFHSSYVSWISKKIGSPSRKVVLHDGGADDVVVVVPDGRGLRLRRRPWSYRWTPRSGGCARTCSLHCHAPWRRRRGRRRGAGLERKTTSASSSHSRTSTSVSPAPTICASSVICICTHLLLLLDRRSPFPIRFIIMTTLSAVKYNVFFFIL

SEQ ID NO: 58803 - protein, 57 aa, Sorghum bicolor
  Clone ID: 6675232.pep
TVSIYSLLRKAFIHGSGRCLLSQKPRPGGCSQDNSITTLHSSMHREAHRRWTSPRNF

SEQ ID NO: 58804 - protein, 47 aa, Sorghum bicolor
  Clone ID: 6675236.pep
AAIQFALVVVTFYSCFFPLWKLLLRSIYDKLIYEPSGIRSVMDDVLM

SEQ ID NO: 58805 - protein, 69 aa, Sorghum bicolor
  Clone ID: 6675237.pep
AVPELPKPEVPPHPVAPELPKPELPPHPTVPELPHPDVPEVPNHELPPLPKAELPPKPEGHYPEPEAKP

SEQ ID NO: 58806 - protein, 138 aa, Sorghum bicolor
  Clone ID: 6675238.pep
LSSITHVFFFKKKTLGNQLHSRPKILHHALQYGIGKSPNCRAIRRTPRITRKPHLPISLKPIHLLHKASPQHLRLLRPPRPRVIRRRLEIHTAVHGSSGIRQPSFLNHLVNFLHHKRLELVNRKRVIGAENSAEQVCA

SEQ ID NO: 58807 - protein, 59 aa, Sorghum bicolor
  Clone ID: 6675252.pep
TGTIDAKDEGILDLLISKQWAIKLATEAARTVLSVDQIIVARQAGGPKPPGPNPNWDED

SEQ ID NO: 58808 - protein, 65 aa, Sorghum bicolor
  Clone ID: 6675259.pep
AKPFKKFRCNIYDIFPVLFPEFFFLESMRLALCFLNYLRPMIIWLNVLVPTCIAISSLKKGHCFF

SEQ ID NO: 58809 - protein, 77 aa, Sorghum bicolor
  Clone ID: 6675260.pep
HRYQPPQKKDTAECKSAPGLYHYSNEYTGLKRCICLSNTIQLQVTNFLLTTGMYINQTSVRTDLISAFAFSSCCLES

SEQ ID NO: 58810 - protein, 111 aa, Sorghum bicolor
  Clone ID: 6675263.pep
VNVHAMHRDPRVWEEPERFSPERFEGGKSDGKWMLPFGMGRRRCPGEGLAVKMVGLALGTLVQGFEWRRTTGDEEVDMTEASGLTMPKSVPLEAFYWPRMEMLSPLTALHS

SEQ ID NO: 58811 - protein, 131 aa, Sorghum bicolor
  unsure (1)..(131): unsure at all Xaa locations
  Clone ID: 6675264.pep
RAPPFKCYKVSPEEEESGDGHAAFLEDFSSKIWITYRKGFDAISDSKLTSDVNWGCMVRSSQMLVAQALIFHHLGRSWRKPPEKPYNPDYIXVLHLFGDSEACAFSIHNLLQAGRNYGLAAGSWVGPYAMC

SEQ ID NO: 58812 - protein, 90 aa, Sorghum bicolor
  Clone ID: 6675281.pep
RQAHRLRRVGCLEGWRCVLIEALRCRLPGRKRRSPGCRGTQDGAGSQAHAPLMCLFMPHLAAPRSFPGHTLIGHVPMPEPMHKSRAQIQM

SEQ ID NO: 58813 - protein, 126 aa, Sorghum bicolor
  Clone ID: 6675282.pep
SQTPKINRPKVYNPLSSFFSPRLSAFLSCYRVIYTTFRREKKKAWQNKTKTRLLTFPMSPQINCNDRYPFVCPRRFVKNAPKIPIVKSVTLLDSRTEALCKDVIKLTLVSLTAGKQRRDPWRPEHQ

SEQ ID NO: 58814 - protein, 92 aa, Sorghum bicolor
  Clone ID: 6675285.pep
SIKGGMAPGVLSNLQGNYSQTVSKLSMAAGGKNKSDNTGGYSRNKGGEVSSQMAAIFGKTPPLSKEKENNVSGFGDPKKYARNITGIFESHK

SEQ ID NO: 58815 - protein, 102 aa, Sorghum bicolor
  Clone ID: 6675296.pep
LIVREKHFWLVVRQTLTVSSVSDDFIKKVLEVLIEFICNPSDCPPVDNYTVICFLIPSLMDVPCGVVLADVSDGTCTFSLIPTFSLSRLTVKKKKNKVGGGP

SEQ ID NO: 58816 - protein, 87 aa, Sorghum bicolor
  Clone ID: 6675305.pep
TNGLRAFSTSTRIAAKVFPSKELFSFLVGEGRDARVRGFAGLHEGLAYSLSNLQKLVLAVFAKVETLASMPQRLWTPACLVEHDDKE

SEQ ID NO: 58817 - protein, 122 aa, Sorghum bicolor
  Clone ID: 6675316.pep
ATKLSFIEYADGRTRDVMKYPKTDADKISLPGALKVVRNAQGVPIIYPAEADVAGEDLLRVVYDHGPVEGAFPEDFSTLKKRVQSEWTALPRQFDPISPELRLKMDAWVLSMRDVLAQNRAA

SEQ ID NO: 58818 - protein, 89 aa, Sorghum bicolor
  Clone ID: 6675337.pep
PARRIQLEKMCSITSSMRQRMIYKCSAAGNHLQCLMILLTKRNSTTSGFRQTRPSELTYAKTSFAGNKWTYTSVFSERLMEVFVTFIVA

SEQ ID NO: 58819 - protein, 86 aa, Sorghum bicolor
  Clone ID: 6675348.pep
FRGITTPKAYAGCGWLYPWPNQGLKECVQVECTKLAHRRNHQKYMSSSAIVAMAYKSLFRILALIYRQHWRVGSLNASSLLLIMNN

SEQ ID NO: 58820 - protein, 40 aa, Sorghum bicolor
  Clone ID: 6675349.pep
SNNIADCLSNVSKLKEIVTKANRIIYFRSQINHQSKNKAT

SEQ ID NO: 58821 - protein, 84 aa, Sorghum bicolor
  Clone ID: 6675366.pep
LLTTAIKANYVISANSNSSRAVVCSISDSRDKRRLEHACFCLVASGNKIKKIACCKVNKAEKSVVLEACNFLLGSSTSNKGGFL

SEQ ID NO: 58822 - protein, 64 aa, Sorghum bicolor
  Clone ID: 6675378.pep
DFHNVLPSNQFCGVINGSYIARTQSGFSQFMSGNVSMFGESPACLDEGIFLLVLMSLVSSKYVA

SEQ ID NO: 58823 - protein, 75 aa, Sorghum bicolor
  Clone ID: 6675384.pep
LDNNYQIKAKVIHDALLNKFRELELQTQKIPRAEFGTRERTSLEFFFFFFFFWRNKALLLGTDYKLHIFHATDRL

SEQ ID NO: 58824 - protein, 90 aa, Sorghum bicolor
  Clone ID: 6675462.pep
NHKRVPLAFEKTSIEELFKRFSDATGIKITYQHTSKELDPNNLFDIVIGVINDGIYFNWDCKVPEEARELNPNWHSLEDFAKNKWKKPEA

SEQ ID NO: 58825 - protein, 50 aa, Sorghum bicolor
  Clone ID: 6675472.pep
NMGELFESITGEHLMPKKRRVEIRSPNISGGSRHGGRFWRIPALDMVDED

SEQ ID NO: 58826 - protein, 61 aa, Sorghum bicolor
  Clone ID: 6675482.pep
AKLAKKKVQSNLGMHSRFFFFHKPGNKKVLPHHLRPKKQKKFYGQISKFEGKKAQETNRPF

SEQ ID NO: 58827 - protein, 30 aa, Sorghum bicolor
  Clone ID: 6675510.pep
PKVITETFSDRPFKFCQNRKFYIRSATSIL

SEQ ID NO: 58828 - protein, 51 aa, Sorghum bicolor
  Clone ID: 6675515.pep
NPTHWTGLTSSHRLFLNNDLKYREGTKPFLLLNYYDLKGFQGADALLSFSS

SEQ ID NO: 58829 - protein, 87 aa, Sorghum bicolor
  Clone ID: 6675517.pep
NIEVDLFSAFNAGLITGTWMPTAIQSHFGGYHLSSIHIRICYRLRSLFGYLPKIILVNPLPPLGPPSTASSRMYAATGWFPKPKTAR

SEQ ID NO: 58830 - protein, 68 aa, Sorghum bicolor
  Clone ID: 6675523.pep
TCIHLSGGSKADAAVGSIKNGVVVFQELLANNGVDTRAATVVNPSVVLSRAESVEAVLRGGHQVLRRC

SEQ ID NO: 58831 - protein, 62 aa, Sorghum bicolor
  Clone ID: 6675524.pep
YTGDGESTNATKHYCVNFTLNSLFWLFPSTCIAIVYSFMKLKPCSSNRVSYSCFVHHRSNLW

SEQ ID NO: 58832 - protein, 91 aa, Sorghum bicolor
  Clone ID: 6675535.pep
PQLKRVNDWLGEIGKRSETPSLPPADADGEATTASTAPVPANGGCGVPEETIERLRKKIYEYLLTNVDSAAAMLGGGGGGGAAAPTNGKKG

SEQ ID NO: 58833 - protein, 113 aa, Sorghum bicolor
  Clone ID: 6675548.pep
ISYVQKWRSQGIPIDGIGSQSHIGPGGGPKNAAALKALSAAAPEVAITELDITNAPSSDYVAVTQGCLAVSNCVGITSWGVRDVDSWKASSNPLLFDANYQPKAAYNAVISAL

SEQ ID NO: 58834 - protein, 84 aa, Sorghum bicolor
  Clone ID: 6675553.pep
QRDIKRAVDYRIKRSEELSQGRIKSKAVDVKVISHHMQRFAVWFGGSMLASTPEFYKVCHTKQQYDEVGPSICRHNPVFGAMTM

SEQ ID NO: 58835 - protein, 85 aa, Sorghum bicolor
  Clone ID: 6675561.pep
RGCPLAKVSSQESVNSKLQSFNFNPKNLHSTFCNPYKLFPAGNSPLQIPQLHQLQVPRQGSMQPYLSSYFSLPGNTMMPQILLLG

SEQ ID NO: 58836 - protein, 77 aa, Sorghum bicolor
  Clone ID: 6675573.pep
HMTLPCSSSSEHCNLTLCTVTYSFLLFINENLVFIKKKKHQLVVTYKLQFHAVYCKPGHHLQTILEPSRSFARLQTT

SEQ ID NO: 58837 - protein, 161 aa, Sorghum bicolor
  Clone ID: 6675579.pep
NNITLDENRSFMLPAIQAFQVTVLLELVLDPPQEVLQTRHFTIDLLPRPLHQLLLVFSIISIVSQQHKHLQHLIADRLRKESLDHLIRQLHMPHLLARHATHNLRHFIRRIKRLCRRKKLALVLVWRRQNRSHPLPRVRDINTRQARIPSERIRKHKLSIT

SEQ ID NO: 58838 - protein, 35 aa, Sorghum bicolor
  Clone ID: 6675676.pep
YIGIPKLLSAIYLSLCKTPVKFATLMYFFLGQIYK

SEQ ID NO: 58839 - protein, 49 aa, Sorghum bicolor
  Clone ID: 6675718.pep
SPLSPHHPASQQFFYLSPFAVSTTTIPANTHTTCSKLYNSELDDQTIQT

SEQ ID NO: 58840 - protein, 120 aa, Sorghum bicolor
  Clone ID: 6675993.pep
IHKPVNTYIQDNTVQKGLQRSPRLGFQGIDCITSASSSPSTSFVSGRLVKNQVHLCIPMCFFYYCKKNIYYTSTTAKKIYIINNTWLQLKFTHFENIDSLPALIFIYLSEFMPALLFVSL

SEQ ID NO: 58841 - protein, 90 aa, Sorghum bicolor
  Clone ID: 6676020.pep
FVLRVDHEMCTYLTSGKKTKLGLLSSSLKVWILLKIARGFSRGAFELLPYSEKENCAEKETSSELPQKEGRPKLSVFPIKKWMSRAKRAK

SEQ ID NO: 58842 - protein, 127 aa, Sorghum bicolor
  Clone ID: 6676022.pep
TLGLIPDDLPVRSLESYFRGRIRSANSLVNEARIVAGLRQAEGISIAARLHLGDDIQGGQGGRNRHVAITDERHCVVCHKKLGGGMRIGGSVVAVLPDNTVVHYGCLNRATGNKVNASQAPSWGRGF

SEQ ID NO: 58843 - protein, 141 aa, Sorghum bicolor
  Clone ID: 6676023.pep
NLKSQDSISYMQFLSNITAPLNLALGLKNAGDIIPAVLPIVHFSVNEQCVQYEECSTFAPFIQAGKPVFHIEYPNGAGAEQGLQENVLGDSCSKSGKGAGSDGFSTVLKKMELDGWVEYCDGKVDVTNINESLGGHDEGSS

SEQ ID NO: 58844 - protein, 103 aa, Sorghum bicolor
  Clone ID: 6676030.pep
QAKTSENSIAPEEVRARISTLISRYAVSVVSFAVPDALEALIINQLVFRWTISPLLCLRKAWTVVHRKDLLGYRIQLFTWLFGSLTSSKLTTGLWTTQIVRRL

SEQ ID NO: 58845 - protein, 56 aa, Sorghum bicolor
  Clone ID: 6676042.pep
LSLQAKLQGLRNKAMEKELQIVYLESELLKIELHYSCTNQSDKSVDDIVAQNAIIR

SEQ ID NO: 58846 - protein, 105 aa, Sorghum bicolor
  Clone ID: 6676063.pep
SAWFSSCLTHFNAIPHALNFPHTERVFIQKKLQQTKKHRLESPEFVSTFSQSHFISFQVQHRGLVVSDAMCQQNILLNTISSFFFSDSFGAFFRASHDQMYRLVK

SEQ ID NO: 58847 - protein, 62 aa, Sorghum bicolor
  Clone ID: 6676083.pep
IHKKEKTQLVKSARSKKPPQETLIIPRSAHPKNLLFTEGPYRGRRYQRRPCRRRRQSHRGKR

SEQ ID NO: 58848 - protein, 86 aa, Sorghum bicolor
  Clone ID: 6676092.pep
GGNVSGEYLELEEPKKITQSWRLNQWPAGHFSKLHIEFDQNDVDHVTVMRVKWEGVPIGQEDVTKRNWLEYYVKSIKQTFGFGTIL

SEQ ID NO: 58849 - protein, 115 aa, Sorghum bicolor
  Clone ID: 6676093.pep
IYKYPASARLVREGNKAWFTGISCSIISSLYQLYRLRERSAKLSSSKSAEAEPVVEAKKIAREVDAVRLQLLSDLCDLTIPASALGWAKLDDGIVGIAGTVSSLLGLYSQWKKVA

SEQ ID NO: 58850 - protein, 162 aa, Sorghum bicolor
  Clone ID: 6676101.pep
SFAKTSPLTCLKDSPRKGERLTLSPSGTLAAITDSLGRILLLDTQALVAVRLWKGYRDASCLFVEMLLNKDKALLRSMHIEYTKSDYCLCLAIHAPRKGIIEVWKMRTGSRVLTIPCPKGSRILQPSARLSTQSFSSSYSPLEVYLFNGDSGQLSVLNRHIG

SEQ ID NO: 58851 - protein, 138 aa, Sorghum bicolor
  Clone ID: 6676109.pep
ASKGAIARASGNHRSLNNFVENTFGWEGGFFAPLFWNLGVQSKNNAAEAPAGVNVDGVNEEARHMAPPSEETLRLRSLVGRAYMMDLAVLSESSDKIVCTVSASGCRLLAVMMGWEDSMENGGWHNVDGTYGWAGIDW

SEQ ID NO: 58852 - protein, 53 aa, Sorghum bicolor
  Clone ID: 6676110.pep
YIILALFLRGPQCFRQNPREKHRLKSETVVVCVLVNEPESGFLLCLFVISLDS

SEQ ID NO: 58853 - protein, 46 aa, Sorghum bicolor
  Clone ID: 6676118.pep
IQSTSNFLIFSNLGPKSVNLKREHVVYLPASTGFFNSNNIFQSRVS

SEQ ID NO: 58854 - protein, 104 aa, Sorghum bicolor
  Clone ID: 6676127.pep
PALRPQGCAAFLMSSLKREKRRKKEQKPEARSECPILSEMYNNTRSVSKCLVQIIEVFPFYPFRKLYPKPKKKPVMPKQTKQNPVLKKPPGAVIFPHLFSWCCM

SEQ ID NO: 58855 - protein, 100 aa, Sorghum bicolor
  Clone ID: 6676133.pep
QRDSPRTNRTSHRSVTIDLSVNRLGHRRRFLVLVPQRREQRARGREQNAHGNRKPPNSLGLEAVAPRDARPVSQAQLVAHLVQVVLDRCGESVSVRSVHL

SEQ ID NO: 58856 - protein, 156 aa, Sorghum bicolor
  Clone ID: 6676143.pep
EIYKTLSPISPYFSIAAGFGNVHGVYKPGNVKLQPGLLKKHQAYVKEQIKSSEEKPVFLVFHGGSGSSVDDFREAISYGVVKVNLDTDLQWAYLTGIRDYVQNKKDYIQTQVGNPDGEDKPNKKYYDPRVWVREGEKTMSARIKTALEDFYTAGKL

SEQ ID NO: 58857 - protein, 49 aa, Sorghum bicolor
  Clone ID: 6676162.pep
MACLSKANFKPFSKHKPRRAPNKSVTLRFFQSVVSELDMSASLTAIETY

SEQ ID NO: 58858 - protein, 70 aa, Sorghum bicolor
  Clone ID: 6676164.pep
PVAVQMPAGMTCQGTVGGVSNVCVARLANTAIAGPFGGSVLFTQSNAAKKRAIEFNLAKRRFARALQSDE

SEQ ID NO: 58859 - protein, 115 aa, Sorghum bicolor
  Clone ID: 6676167.pep
PAESDTKPPGRLKWRKRRVCTTSCAYGGRTRRADSRQDRFNQGSGLQHMRLLAAIVVKALDDVSFELSDLASKQASDLAFSLSSSPTYKFCMRDRIFGLDMPKPQWLYPGQTNFV

SEQ ID NO: 58860 - protein, 117 aa, Sorghum bicolor
  Clone ID: 6676170.pep
VDHFSFSSLALFFLTLSCFIAIGVNLSQFICIGRFSAVSFQVLGHMKTVLVLSLGFLFFGKEGLNLQVVIGMVLAVLGMIWYGNASAKPGGKERRSVLPVRSASLKGSSEEKDGAEK

SEQ ID NO: 58861 - protein, 98 aa, Sorghum bicolor
  Clone ID: 6676174.pep
IAEAMIRGLPIIVNGYIAGQEAGNVPYVVENGCGKFSKSPEQIAKIVADWFGPRSDELRVMSQNALKLARPDAVFKIVHDLHELVRQKCFVPQYACAT

SEQ ID NO: 58862 - protein, 52 aa, Sorghum bicolor
  Clone ID: 6676180.pep
EKACIDTVDVDKIMPKDLALACGKKDRASWVTPNEYLDAVKRRLKSSLKGKL

SEQ ID NO: 58863 - protein, 113 aa, Sorghum bicolor
  Clone ID: 6676186.pep
GKDSDDDASSDGDMEKTVPAPRRKTKDEDVVMRVSSTSNQGRAVKDTVLGSRQQKSGRTHQARGEVVGERQVSFIPESRRKQKKREEELPAEPRDKRTGAARRSASGNTFRRI

SEQ ID NO: 58864 - protein, 126 aa, Sorghum bicolor
  Clone ID: 6676194.pep
LRIVAGSGAEGWSSVTLNDKLIDQSSGLKTKGAIIVQVYSSHHLSVVFNEFSLFIENSDGFVNLASVVVDRKQWSAMTAHGLIGQSWHRPRVHGRNKHFEGEVDDYLINENDLFGVDFMYNRFNMA

SEQ ID NO: 58865 - protein, 110 aa, Sorghum bicolor
  Clone ID: 6676198.pep
VAEMYPSQYRSRCMAIATATNWLFNFLIGFFTRFITDAIDYFYGLVYAGCCAALVFIVFFFVIESKDRTLEEIDTMYRQKVNPITSSKWVPSNNNSKVAREGVTDEEASS

SEQ ID NO: 58866 - protein, 146 aa, Sorghum bicolor
  Clone ID: 6676209.pep
WRSAVFHTYVTVEWTDKWMERDMRGFIAKVKQALRPLSVSGVASFVNFPDRDVTEAVHERAYFGDNYEELRKIKKIWDPDNFFDWVQGVRLPGAPIDRGELTVDPDEEEDKTDKIAGEQWKKWSEWKTYKPDDWQKDMDMLADMGY

SEQ ID NO: 58867 - protein, 92 aa, Sorghum bicolor
  Clone ID: 6676212.pep
YRNVLCPPRSFFFVFPKALSRTKLNPRRYVDSCSFQRVKDTATKRWNVCWCKGPCLRSDQISHCRSKIRSVTPEEIVKETKKRKAKNLQTCS

SEQ ID NO: 58868 - protein, 69 aa, Sorghum bicolor
  Clone ID: 6676215.pep
LFVSHKTDDAGARLINLIQRYISSGLSESWTLSPSTSLSTSFVALLPFASFKIGDLHKRTWEYHLKIDI

SEQ ID NO: 58869 - protein, 103 aa, Sorghum bicolor
  Clone ID: 6676219.pep
LASMPVVYICLTIFPCRETPIQNLCNHAIPSFIPFNKKRQCDAANESLVKNTDARKQIHMLNLYHPSPPSNATGISTSSTLSRLGYIIGLRRQTHSFVPLFPL

SEQ ID NO: 58870 - protein, 117 aa, Sorghum bicolor
  Clone ID: 6676220.pep
TIIFTTADGFPYPLRHVSPTDGFDPGHPGRIWTNQTSSSHKPVAITLPATLRIETDVVNGSRVWIDDAFAGRFEVFVYGGRNTLFSWSQMALVAPLERMSGGVDSLVLESEVSLGKD

SEQ ID NO: 58871 - protein, 148 aa, Sorghum bicolor
  Clone ID: 6676221.pep
HAQLDTTHNAWKGRNEKCQGGDRERREKTRRIDREREGGRGEDREKDTRRTVDTCSGSHLHFKYRIHNTQRTAQPRTHTHIPQQPTRPHTLTSHSQSHIHRHTQTSQRCSDRDTFSGQYNTAQILQHLLFSSSPAVLAVRLTALASFL

SEQ ID NO: 58872 - protein, 109 aa, Sorghum bicolor
  Clone ID: 6676240.pep
PAKVPAMEDLNYPSIVVPSLRGTQTVTRRVKNVGRPAKYLASWRAPVGITMEVKPTVLEFSKGVGEEEEFKVTVTSHKDKIGLGYVFGRLVWTDGTHYARSPVVVNALA

SEQ ID NO: 58873 - protein, 74 aa, Sorghum bicolor
  Clone ID: 6676255.pep
GSTMFPGIVERMNKELVALAPSPMKIKIIAPPERKYSVWIGGSILASLSTFQQMWISKEEYDEFGPSIVHRKCF

SEQ ID NO: 58874 - protein, 83 aa, Sorghum bicolor
  Clone ID: 6676256.pep
TRESSFRYIACVISAFSSFQPPKTTHSQPMREMPDNPINKESKETRDNNSIPKRPYRKTGSLLGPMEKRSLWKSDIHYRGATT

SEQ ID NO: 58875 - protein, 146 aa, Sorghum bicolor
  Clone ID: 6676268.pep
MSRMFGRGGRSHSHSRRRGGGAGFTGKLFGLRSANGPTYERVLEDGPSAVNASDFEFGPYSDNSDNEHSDSSSDGTRFGRTSGWATPQIKGGGGAAAETGHSQDIMTQGASLGLGGFMARTDSRERLAVRSRANSPRRKSPMGKFS

SEQ ID NO: 58876 - protein, 64 aa, Sorghum bicolor
  Clone ID: 6676287.pep
TPSYESAIAHTCFQSKTYDTASSVARPEVKVVRDKVGASNAISSVLAADLSYSNGHLSNYFAPP

SEQ ID NO: 58877 - protein, 86 aa, Sorghum bicolor
  Clone ID: 6676290.pep
KNDLNLSSRLLRSSPLNRQVVTRNLISQTSTYRAPFSQPNHYLLYVPIRKNRQIEYEHTSARPTLHKPLHLLLVARRRLNICSRLS

SEQ ID NO: 58878 - protein, 46 aa, Sorghum bicolor
  Clone ID: 6676295.pep
RIDTIFSSNIILKSEILTTIKSSPLPVPYPHYHGFSVLAALSGESR

SEQ ID NO: 58879 - protein, 45 aa, Sorghum bicolor
  Clone ID: 6676297.pep
NQLFSRELDPMKTKPLSSPPTISLNLGIFTSFHFLASLKHPTNWH

SEQ ID NO: 58880 - protein, 106 aa, Sorghum bicolor
  Clone ID: 6676309.pep
LSPRSCFNGTNKRSRLVSYFNYRSQAIFHSFYFSFPLNQGELYNTFGDHAEDISASRLCLNTYTSCSVLFNLRIYGIHGLVTGETEFIGVSGGTDIHFTWCFHLFC

SEQ ID NO: 58881 - protein, 75 aa, Sorghum bicolor
  Clone ID: 6676321.pep
MQSSMGELANCRKAVAFTPTYLPICNVPVDYSLQKDCFRKAWVANERIYCLKKEGIANPFQSWGSSGIACPFFTW

SEQ ID NO: 58882 - protein, 88 aa, Sorghum bicolor
  Clone ID: 6676339.pep
SMAYAGARFALSLVRAIKGEKNIIECAYVKSNVTEATYFSTPLRLGPNGIEQNLGLPKLNAFEEGLLKAAIPELKTNIKKGEDFVKNN

SEQ ID NO: 58883 - protein, 78 aa, Sorghum bicolor
  Clone ID: 6676368.pep
VDVVLVIGIFGGPDAAVVHRQILGFMLAMQLFDVSSGLSSHIQEYGPQPMAIDHSTVSTSAIFRLPPYSVALDVEKLE

SEQ ID NO: 58884 - protein, 72 aa, Sorghum bicolor
  Clone ID: 6676391.pep
TMVAAIDLLIERGVTSKQIKVVSAVASPPALQKLNNKFPGLHVYTGIIDPEVNEKGFIVPGLGDAGDRSFAT

SEQ ID NO: 58885 - protein, 114 aa, Sorghum bicolor
  Clone ID: 6676425.pep
PTAHIVRSLFSLDSSILKRPHLRNALGIPKGHTKQTKKVTWQVSWLTRTQRRLMTCNDYENRLLYYQGFSYFFLSLSLLPIDTTGSLLALVREGLMSEYEWEQHVYLDVAGRRM

SEQ ID NO: 58886 - protein, 103 aa, Sorghum bicolor
  Clone ID: 6676432.pep
AHQRRAQLALSFLEPRGIWREQRAFYFYRYPPKNQLTIIHECFHQIHTDHYNQHLAKRGRPDDEKQIYTRHIYIYVTHSLFLSMSSGKAGLAQQSKSKLHWFF

SEQ ID NO: 58887 - protein, 78 aa, Sorghum bicolor
  Clone ID: 6676443.pep
PFPIMFPMRSLSWGEKGLDPWRRARCVVTRAPISSAIGQTEKLARLRSRGSLGQGIDYDTWAYVAVEYGCIAEKSKLA

SEQ ID NO: 58888 - protein, 144 aa, Sorghum bicolor
  Clone ID: 6676449.pep
EFLLKPIAGVDTVNRTINAPGSFDTKLTVASLADIAHQTVDAIVTGRGRNQAIHLGSATLSWADIRRILEQTTASEWTAKTISVKELEQAVQANPNDYVARFGASFALGKGSNWPLSQTYAVKHGLKSRQTLEEVVEQELGRGQ

SEQ ID NO: 58889 - protein, 88 aa, Sorghum bicolor
  Clone ID: 6676489.pep
PSTQKIAIPTVCAGCVIGKNGSVIRDLRAQSQTNISISDPEPDAPNERVVTLTGTAQGIQHAVYLIRQLVEQYQPHQHQSQSPQAAQY

SEQ ID NO: 58890 - protein, 67 aa, Sorghum bicolor
  Clone ID: 6676492.pep
PSIQPTSSAPSKMHHPQPKLDKSIATISRTYWVTSPFRLLIGSFTFGRQLSLMPRLLGIGFSSADSS

SEQ ID NO: 58891 - protein, 101 aa, Sorghum bicolor
  Clone ID: 6676505.pep
SGNSSSRIKEKFKNFNLAFEEIYRSQTLWKVPDPQLREELKISISENVIPAYRAFTGRYGSLVDSGRNTGKYIKYTPEDLENHLSDLFEGSLGSANHSRRR

SEQ ID NO: 58892 - protein, 136 aa, Sorghum bicolor
  Clone ID: 6676506.pep
EKSQTFLLGKFKAFLQGCHHIVLPFCSSPDGQASWLPGSTPNHQIYTSYIFLRASNANNSFSFSVYAYSKPKRITTYFIDPGNADPYLLCCHHRHRQGNPQVHLQAAVSTFGICHQEIQVKRHLNSEQILDLGAKE

SEQ ID NO: 58893 - protein, 91 aa, Sorghum bicolor
  Clone ID: 6676508.pep
NAGTARYFSEGDSVLVAQGVSGAVAHRGSINKFVPYLAAGLKHSLQDSGMTSLKTMHESAEAGELRFELRTASAQLEGNVNMESYEKKLYA

SEQ ID NO: 58894 - protein, 104 aa, Sorghum bicolor
  Clone ID: 6676513.pep
TYMLLENNPQTAHGHASETVLTQSGYSEPKFRNWGGKRKDAVIKMRNRVNAKKIEIKKECDREASPDIFHRVKGEWKGKTKIEEGLPADEHYMMTHLAQHPASS

SEQ ID NO: 58895 - protein, 77 aa, Sorghum bicolor
  Clone ID: 6676516.pep
LWEELAAIGEEFVEFLENELKIDDSSPEDVTGNDPYTQFGQQAKNPKDDKTSTNSFDDGLSEIEAALEKLKKELGLG

SEQ ID NO: 58896 - protein, 59 aa, Sorghum bicolor
  Clone ID: 6676535.pep
MAHPMYGSGPLRSRNAANSDEIQLRIDPVHGDLDEEIDGLHSRVRMLKGVAQEINSEAK

SEQ ID NO: 58897 - protein, 87 aa, Sorghum bicolor
  Clone ID: 6676559.pep
IDEKFPVVQKPTDELYQDTRALILFPIQKGLEGKDHVFQVYNSEIKKVEQGGLVAHGKADVTTVLVVSNETLSWLSSFLHQKKAETT

SEQ ID NO: 58898 - protein, 89 aa, Sorghum bicolor
  Clone ID: 6676970.pep
RSKKRTAPAQTGSQLASAHRRGSISIEPARARARATMARSVRKQPTERRRDKERPRFGDEQEGTQTRRDLRDGGRGRRGRRRREGGGTS

SEQ ID NO: 58899 - protein, 84 aa, Sorghum bicolor
  Clone ID: 6857830.pep
VVKVMCPPANQCMKETPMPMGPWRKPKYMQAKWLGTPERTAPAPVAATPVVVPSVTVVGSPEKQTKFRGSMLPFDFGRNPVEVA

SEQ ID NO: 58900 - protein, 58 aa, Sorghum bicolor
  unsure (1)..(58): unsure at all Xaa locations
  Clone ID: 6857832.pep
VKEIKNGRLPMFSMFAFFIQAXVTGEGPVENLAKPLRDPLGNNLFPVISGAPERTPTL

SEQ ID NO: 58901 - protein, 33 aa, Sorghum bicolor
  Clone ID: 6857836.pep
HIAKCYIPRPSKCCEQFWPQEIHQATSLMNHCQ

SEQ ID NO: 58902 - protein, 54 aa, Sorghum bicolor
  Clone ID: 6857845.pep
FSLGLDSVASIALFSVSSSIITVQACDTPVPCYWGKGAIFLSCLQKGGRHFSIL

SEQ ID NO: 58903 - protein, 45 aa, Sorghum bicolor
  Clone ID: 6857846.pep
NLCFQKKRNRSGAQCFWKNVFFPAQKSAYEKNYLGLDYNWFSYPN

SEQ ID NO: 58904 - protein, 40 aa, Sorghum bicolor
  Clone ID: 6857853.pep
IAPNHFFMSFTNLAIPGEGRKGQPKQAILSFKPPPTTSCT

SEQ ID NO: 58905 - protein, 55 aa, Sorghum bicolor
  Clone ID: 6857854.pep
ENSRMGMHPRHATHDASCSIIYQILYHLLYFPHCKNPCFISFSCLNKWRYVVMNW

SEQ ID NO: 58906 - protein, 89 aa, Sorghum bicolor
  Clone ID: 6857859.pep
LAHLLLPPCWSVPHTQVLSRSGRRRTQAPRVLLFRRAHEHTWTIRRKPRWVASTAAATYGARQRPRTATVSPKPFAGWCLVLSSWLRRR

SEQ ID NO: 58907 - protein, 160 aa, Sorghum bicolor
  Clone ID: 6857861.pep
LQASDAEKSVLEFVLSDDAFKGKDQAKIIETLHSVGFDEEKRALPVAALSGGWKMKLELARAMLMEADILLLDEPTNHLDVSNVAWLTKYLTSLKNVTSIIVSHDSSFLDDVCSHIIHYEYRKLKTYKGNLSEFVKVKPEAKSYYTLSDSVINFKLPEPG

SEQ ID NO: 58908 - protein, 53 aa, Sorghum bicolor
  Clone ID: 6857863.pep
PHGGGRGKSKGNVHPVSPWGTPAKGGYKTRPKRNKHPFLVQDRPRNQGKRRSK

SEQ ID NO: 58909 - protein, 82 aa, Sorghum bicolor
  Clone ID: 6857875.pep
GLDKVYPGGAFDPLGLADDPDTSAELKVKELKNGRLAMFSMLGFFVQAIVTGKGPIENLFDHVADPVASNAWAYATNFVPGN

SEQ ID NO: 58910 - protein, 212 aa, Sorghum bicolor
  Clone ID: 6857942.pep
LHDLPNELLSCIAEVLSSEKDINAFVQANRRIYCILNPYLYRHNIQQSGSSALLWAAQHGQERTAANLIEEGRNHQVKCDYGTPLCVAAEMGHEKIAKLLLEEGVDVDAHGGEYGNALQAASCGGHRQIVKLMLEKGADMTKRSNEGWTPLYSAACNGHLNIVRLLLEKGADMTVHGNNGWTPLREAAGRGHLEIVKLLLERGADMSVTDNR

SEQ ID NO: 58911 - protein, 35 aa, Sorghum bicolor
  Clone ID: 6857945.pep
MWVCAEGWRCFHRTFVISCSPSFKICPARPICQKD

SEQ ID NO: 58912 - protein, 46 aa, Sorghum bicolor
  Clone ID: 6857965.pep
QVKSSSTALEKLQQTKKSKNTTNRSTQLSVHCVVPADRSFTILLAK

SEQ ID NO: 58913 - protein, 82 aa, Sorghum bicolor
  Clone ID: 6857966.pep
KKGLATKKSSQKYDYEKIAESLEKLEEEDLLRVIQIINENKGPDTYIRSDVDAGEFSIDLYTMPDGLTSKLWEHLSKKGLVG

SEQ ID NO: 58914 - protein, 46 aa, Sorghum bicolor
  Clone ID: 6857968.pep
GADVLASQAVTDIGKWKCLLVTVAWGFFFRALFYVVLLVGSKNKRK

SEQ ID NO: 58915 - protein, 28 aa, Sorghum bicolor
  Clone ID: 6858004.pep
TSVVSNGHLVFNQIPDVVCNPNRSSLGA

SEQ ID NO: 58916 - protein, 109 aa, Sorghum bicolor
  Clone ID: 6858025.pep
PHAVILVAVNEKPFQQAAEYVRSRGTVICIGLPAGAYLKAPVFESVIKMIRIQGSYVGNRKDSAEAIEFFARGLIKAPFKVVGLSELQMVYDKMHAGAIAGRYVLDTSR

SEQ ID NO: 58917 - protein, 58 aa, Sorghum bicolor
  Clone ID: 6858026.pep
RGELRNNHYAKCGEFVYSILAGKKIQQVCLIIFDNSINLLLFCQNSDGLFNLGVVARP

SEQ ID NO: 58918 - protein, 70 aa, Sorghum bicolor
  Clone ID: 6858037.pep
QPKKKGDFLGKCTQDSYPQSTCFCFFFLLDHSGSSSRGGVGVSLPFFAIFMKRRRWVGKNDTPKCPAGGI

SEQ ID NO: 58919 - protein, 64 aa, Sorghum bicolor
  Clone ID: 6858038.pep
LAAREAPIHKNGGDLRLCGQTATGDENSRAKEKFRPKGAKKKRSQTKKVGFPILGNAKLKKPNP

SEQ ID NO: 58920 - protein, 155 aa, Sorghum bicolor
  Clone ID: 6858070.pep
TRLSGVNTPGNVPGSYKEPAIGWMTGFLLAVSFVGLLTLLPLRKVLVIDYKLTYPSGTATAVLINGFHTPQGDKNAKNQVRGFLKYFGISFLWSFFQWFYTAGDNCGFAQFPTFGLQAFKQTFFFDFSLTYVGAGMICSHLVNLSLLFGAILSWG

SEQ ID NO: 58921 - protein, 49 aa, Sorghum bicolor
  Clone ID: 6858072.pep
HINYGGYTVWRTGYSMAGGGYTLGALVHAFFMWDFSQRGVPALSEYCEK

SEQ ID NO: 58922 - protein, 53 aa, Sorghum bicolor
  Clone ID: 6858085.pep
FTIDEPAGFADRIHKLVQLGLNIEEDDSAPAEADAAADAPAAATGDSAMEEVD

SEQ ID NO: 58923 - protein, 185 aa, Sorghum bicolor
  Clone ID: 6858087.pep
GERIKPVIIINKVDRALLELQVSKEDLYQSFSRTIESVNVIISTYLDKSIGDIQVYPDKGTVAFGSGLHGWAFTVRQFAVRYAKKFGVDKNKMMERLWGDNYFNPKTKKWTKNGTYEGKQLERAFNQFILDPIFKIFSAVMNFKKDEIATLLEKLNLKLTAEDRDKEGKQLLKAVMRTFLPAADS

SEQ ID NO: 58924 - protein, 45 aa, Sorghum bicolor
  Clone ID: 6858096.pep
PISFFTLTFDGSSYVPVFIVRLKYMTRSDNDPPDAELNFFFAVLH

SEQ ID NO: 58925 - protein, 55 aa, Sorghum bicolor
  Clone ID: 6858109.pep
RCKAQNIQWKLNIGSREWKIREQSTKYPVEDKHWHERAKHILTQQRDKLNGTIIN

SEQ ID NO: 58926 - protein, 60 aa, Sorghum bicolor
  Clone ID: 6858112.pep
APLIRLNNHIATRRFPNNRILMLGFLLLLGLDNHVLLMLNSKSSYANVSKTKSTEPFPRP

SEQ ID NO: 58927 - protein, 81 aa, Sorghum bicolor
  Clone ID: 6858113.pep
RTGKVLEAGPKFIKSGDACIVKLIPSKPLCVESYNEYPPLGRFAVRDMRQTVAVGVIKSVEKTDKSGGKVTKSAEKAAKKK

SEQ ID NO: 58928 - protein, 105 aa, Sorghum bicolor
  Clone ID: 6858126.pep
AVPALHSGSSIVYSIIYLCSDPTPFLPSKHNPSHCIPFIGRQTFFNPFPAVLSIRHYTVFAFNQVIVQAYASETFVTRVKPGFAQPSADVKIKHNGLSRHSQSPH

SEQ ID NO: 58929 - protein, 154 aa, Sorghum bicolor
  Clone ID: 6858141.pep
MGFSGFPLAGRVFAGDPRTFPGHREVLAFLDAFAVDSGVAAHVRLGAEVLRVRPLCRGQQGEQWAVAWRGEDGGVAEEAFDAVVVCSGHCSVPLLPKIRAMLVLCVTGINEWQGKQMHSHNYRTPEPFQDQSVVIVGLGASGIDIAREISHVAK

SEQ ID NO: 58930 - protein, 47 aa, Sorghum bicolor
  Clone ID: 6858143.pep
LFIAHCQLLHACASNHNVFPVDPIHIFFPPEPLLLCTEQPLPTKLCL

SEQ ID NO: 58931 - protein, 30 aa, Sorghum bicolor
  Clone ID: 6858147.pep
VWDKSFTLGETIELSTFTATYYLTRTTNQR

SEQ ID NO: 58932 - protein, 73 aa, Sorghum bicolor
  Clone ID: 6858150.pep
DFEGGETTYFLPAAREGILNAYPVRPVMGGAAIFPHGEINAPLHEGTGVRKGAKYVIRTEIEYDVEPTEEVKI

SEQ ID NO: 58933 - protein, 31 aa, Sorghum bicolor
  Clone ID: 6858173.pep
LFLMFAPIEVTTLIPVGPIPHEKLAASVTRT

SEQ ID NO: 58934 - protein, 127 aa, Sorghum bicolor
  Clone ID: 6858182.pep
LGTNDFGYLAYDASGTAYDARPPLNATTYTDAMVSFVRSIQTHYKNAQFFLMTSPMLSDYYPTTEDAQHTTMSNALKDAISQIGENAHLVDWPTQGSEVGCDYHPNAATHANEAEVLASAISSVLGW

SEQ ID NO: 58935 - protein, 48 aa, Sorghum bicolor
  Clone ID: 6858187.pep
QNLSLFPQNLILCLVKQVIRLLNRSPLCWNFFALKLTLCMPIEVNLSS

SEQ ID NO: 58936 - protein, 52 aa, Sorghum bicolor
  Clone ID: 6858188.pep
IMIIDTRNRELILSCNLCTVLDLNAINPGRCPLSKTTCIKNKTTPKRHRLPN

SEQ ID NO: 58937 - protein, 156 aa, Sorghum bicolor
  unsure (1)..(156): unsure at all Xaa locations
  Clone ID: 6858192.pep
GRYKIALGKYFEKQGKTAVYFEWVSPRSHHANLQVVPVPLPKADAVNKIFHLAAKKVGFEFSMVNPDGAKTARESLMSQCESKSGMFYVELLEGRILLHMIDSNEKFPVQFGREVLAGLLSMADCADWRNCKISKXEEIKMVDDFKQGFHEFDPAE

SEQ ID NO: 58938 - protein, 39 aa, Sorghum bicolor
  Clone ID: 6858205.pep
GKKLFSFGLGKSSVSKPETNGIITFWAAINLVILGFHWC

SEQ ID NO: 58939 - protein, 78 aa, Sorghum bicolor
  Clone ID: 6858207.pep
VYGSFNCIMFDHAHPEPIPAYRFMKDRISLDRRQKTTYHPISLNGSAINLGQSAELSYMSARGMHSGSARDQNCVATV

SEQ ID NO: 58940 - protein, 130 aa, Sorghum bicolor
  unsure (1)..(130): unsure at all Xaa locations
  Clone ID: 6858230.pep
MAAAAAAISLLRSPPLLQPTRRRPAPPACTHSERGVSFDPGSAFYRSDSAAGRDLAVLAATLNRRRGRADPSAPFLCLDAMCGCGVRALRYLAQAGADFVWANDASEALRPVILANLSRXEWGSPAAEAG

SEQ ID NO: 58941 - protein, 91 aa, Sorghum bicolor
  Clone ID: 6858234.pep
GWVLGFAQQEREEKGLAHLVAAMSEGVAGVEEVMVCSDVVYGAAVAAVSFLSPSLGCLWHHAAATSIDLDLGIGLGCWCRSWRVGRKDPRA

SEQ ID NO: 58942 - protein, 135 aa, Sorghum bicolor
  Clone ID: 6858238.pep
HEVIFEHLSAYNNPEEQKFVLGVILMVPCYAIESYVSLVNPDTSVYCGILRDAYEAFAMYCFGRYITACLGGEDRTIAFLKREGGEDSGEPLLHHISEKGVIHHHFPINYILKPWRLGVRFYQIIKFGYYKDTHS

SEQ ID NO: 58943 - protein, 190 aa, Sorghum bicolor
  Clone ID: 6858242.pep
ARGRLLSSVCSKLGVLQSSHACEVQELIDTLREYLCDKRYLIVLDDLWEVKHWDIISCAFPKNSQQSRLIVTTRIEGVAQACCKDHGRIHYMKPLSDADSRKLFFRRIFGTEDTCPPQFTEVSSEILKKCGGLPLAIVTMASSLADQPKEHWDYIQRSIVTESAANSLADMMQILDLSYKHLPHHLRACF

SEQ ID NO: 58944 - protein, 121 aa, Sorghum bicolor
  Clone ID: 6858250.pep
MGIPSRHPDHEEEEEYDDALFYEDIQAPKFVDLTAPDAGRPDDDPAWFCIRVGCDQNHEQVDPEALDRSFFMRVMAARSPNVRLQKAISRKNQSSMMKCPQSAPPKPPRARFARLSADTEA

SEQ ID NO: 58945 - protein, 64 aa, Sorghum bicolor
  Clone ID: 6858263.pep
LALVLLSTCKPLWKTIDRVDLRGDHAWMCRGYFSREAGFLCLCRQISWRRESSIKPNDTLGLLN

SEQ ID NO: 58946 - protein, 99 aa, Sorghum bicolor
  Clone ID: 6858267.pep
MATPSAIPLNARRDTIARLHRVTRGNRSLWYQMTVLQQPERARACGSGMKANSDRRPVDPPPVVELRIIEGPTVEEGKDITFDYNANFFLYASLEHARP

SEQ ID NO: 58947 - protein, 90 aa, Sorghum bicolor
  Clone ID: 6858284.pep
MTSQRSSSMETSQDNIRKRVCKACDRCRLKKSKCDGASPCSRCKADNAICVFGERKKSQDKVYPKGYVEMLEQQQSQLVAGLRELYTRLR

SEQ ID NO: 58948 - protein, 144 aa, Sorghum bicolor
  unsure (1)..(144): unsure at all Xaa locations
  Clone ID: 6858297.pep
MFPRAALLALSTLAVVSAQQVGTNTAESHPKLQVAQCTKSGGCTTATQSVTLDANWRWLHSAASGSYTNCYTGNTXDPTLCPASSPTTCAQNCALDGADYPGTYGISSSGNALTLKFVTNNANGKNVGSRTYLMDSSDSKYQMF

SEQ ID NO: 58949 - protein, 161 aa, Sorghum bicolor
  Clone ID: 6858302.pep
WHEGKLKTEKRIILSGTPFQNNFLELYNILCLVRPRFGEMFLTKGRVGRRHYVSKKQKDKFSDKYEKGVWASLTSNVTDDNAEKVRSILKPFVHIHNGNILRTLPGLRESVIILKPLPLQKSIIRKVENIGSGNNFEHEYVISLASTHPSLVTAINMSEEE

SEQ ID NO: 58950 - protein, 134 aa, Sorghum bicolor
  Clone ID: 6858314.pep
MAEEQKNIEVPQETKPEIVAPAAGISAPAVEAPVETKPVEETPVVAAETAPATEEKPAEETKPAEEVAKAEEKKEEEVKPVEEGHLNHKAQGLSFPKNLIPSKEFFFFGTEAVEPKALSNYLKSEKSTETAHSN

SEQ ID NO: 58951 - protein, 57 aa, Sorghum bicolor
  Clone ID: 6858324.pep
MAVEEASSSGGGGEEGCGAWTREQEKAFENAVATTMGGEEDGDARWEKLAEAVEGKT

SEQ ID NO: 58952 - protein, 122 aa, Sorghum bicolor
  Clone ID: 6858325.pep
MHVNKGMPTMPAGVSVAAAGCCPTATPANEVVEDIFGLVRVLSDGTVVRSPAGPVFCPTTFPENHPSVEWKEAVYGKANNLLVRMYKPSASPAGGKKAPVLVHFHGGGFCIGSCTWGNVHAF

SEQ ID NO: 58953 - protein, 127 aa, Sorghum bicolor
  Clone ID: 6858330.pep
MQNQLSPRPTSQLSPRPPHMQPQAPPSPLPLQPYQQLIAEIMKLHVTQKEQLEKMKLIQKQVMMHPQKDTFAMLDNEQNSLKKQIDAELTSLQQIDSSYLLSPTEIRHVIYLIHELTIQSIQLELFH

SEQ ID NO: 58954 - protein, 143 aa, Sorghum bicolor
  Clone ID: 6858332.pep
HEANAKLRLVLKIAVSEGARAALLSISPVVLSDDLSVLHEECMDIVMNAARISKQEEYQETVLEAHKLIVLGNWSDELFEALTNTLQSKASDFANIYGVEPPPCPVASSRRKKGKALKIIPLRDTVVGKGSSKSKVSNEELAA

SEQ ID NO: 58955 - protein, 166 aa, Sorghum bicolor
  Clone ID: 6858334.pep
HEAMQGASNVQDFVPVLALLDIGGVNKRAIRLSKARNEWAQRLIDEHRAAAAAGTELGKTMVGDLLEMQASDPEAYSDKVIRALCLSILQTGTDTTSATIEWGMAQLLNHPAAMAKAQAEIDEVVGTARILEEADLPNLPYLMCIVTETLRLHPVAPLLAPHESAS

SEQ ID NO: 58956 - protein, 110 aa, Sorghum bicolor
  Clone ID: 6858338.pep
HEGGRTARREEISQRPTHTRPQPAIAPHGPTTSPILFSPRIGERASGWSSNLGAPDLRVRPSSLNPATPAGEERRRRRLIDQSLPNGRLISPCPSFSGVAFPLLPPLVVA

SEQ ID NO: 58957 - protein, 147 aa, Sorghum bicolor
  Clone ID: 6858353.pep
LAGSERAAATENRGIRMLEGANINRSLLALGNCINVLSDSSKKGAFVPYRDSKLTRLLKDSLGGNTKTIMIACISPSFLCYEETVNTLKYATRAKNIKRKLTRNVKEVELHVSQYKEIIENLKSEVESLKKQLKAKGHHSQSQDNLD

SEQ ID NO: 58958 - protein, 102 aa, Sorghum bicolor
  Clone ID: 6858369.pep
HEGTSCSSSSQSLSDLNLLLAPVHTSLKLVHSTTYSLTRDRLYRRPQQQHHNSQASQLSTSSQCLPSDLLTFLPARAPLPADLFLLCLNECRFSEDHHSTSE

SEQ ID NO: 58959 - protein, 103 aa, Sorghum bicolor
  Clone ID: 6858373.pep
DAWCHLSSLSNSGIYAKVATKNSHPVPLPRLVRENLVLTSSILRNLQRTSFLCHLHWSAIWGRGGGGSVKANKQNNQSHQCPQYFSSTCCCFLRVRSLPHLLV

SEQ ID NO: 58960 - protein, 148 aa, Sorghum bicolor
  Clone ID: 6858397.pep
TRRKAYGESWFPATVRVVVDDLSYVVEYFDLEEEGEGGPEKATEYLHWRFIRPAVEHSPRESEFQLRPGAAVEAYCDGAWSPGVVRRVLGEGEYEIGIVVAKKSEMLVTKVVPLLKPQYKWNGKQWRIATPKRQANSRRRSVSGKSPR

SEQ ID NO: 58961 - protein, 74 aa, Sorghum bicolor
  Clone ID: 6858402.pep
NLGQRRIALGIGKDRLFFQLPWGQCTRDKAPNFHSPAERLPLPELFRLPSPKRPATRLSHPHKTELLPNRVDCV

SEQ ID NO: 58962 - protein, 153 aa, Sorghum bicolor
  Clone ID: 6858415.pep
CFILKLCADPETLRARSEGLAEIIRHVLFGYFSQKTGLLVHLEDSHLTRIQSTTGGDAVYWETTINSFIEDYRPVEGIMIAHSGRSAVTLFRFGEAAMSHTKTRMEEAWSIEEVAFNVPGLSMDCFIPPTDIKSGSISETVELPQGEKSKVGL

SEQ ID NO: 58963 - protein, 111 aa, Sorghum bicolor
  Clone ID: 6858431.pep
ASPVQPDYTPSQSSHMSTMAGYFSQIDIDREFSIDYLRHLVNNPEWEIPDNSGSYSSSGSYFQEVQNHPHYPSQDLDYMGSPVSTNYELNAGYQSQAYTNNPSAITPRPQL

SEQ ID NO: 58964 - protein, 94 aa, Sorghum bicolor
  unsure (1)..(94): unsure at all Xaa locations
  Clone ID: 6858435.pep
MAATLTVEQTKIVKSTVPVLAQHGESITAXFYHDMLEDKPELKNVFNSTHQATGHQARALAGALYAYAANLDDLGKLAPAVELICHKHASLGIT

SEQ ID NO: 58965 - protein, 111 aa, Sorghum bicolor
  Clone ID: 6858448.pep
MSYFSSQFSSSPVLTMSPQHAHQSMGMASFGHHTPPRFAPMPSQFAAQPVRPSAAGRKRSRDEASENLEPDMKSLPVEEPEEEWIYGPGMTLIKKSTRYVTDASSQSGTWV

SEQ ID NO: 58966 - protein, 114 aa, Sorghum bicolor
  Clone ID: 6858453.pep
TRNGRHSPCPLITGNCHSGQIVIVVSASNFGPIITLLRHRHRHRKLSRLCAIVRYFYFRLERLLTLYLDCYYSVNISRHLRLVSTFSAFGAASTTSSILCSLDWRNSRLARLMK

SEQ ID NO: 58967 - protein, 125 aa, Sorghum bicolor
  Clone ID: 6858526.pep
HEERQALARLFISDEHGNQSASLSKDCLDLSEEDIFPFSVFETSFFQSLYKNIDSHSPMMSCSDCFRGGVSENHPKGKEVTMNGVRTYVAEPEAGVTPMGIIVVITDAFGWNFVNNRVLSDNYAK

SEQ ID NO: 58968 - protein, 141 aa, Sorghum bicolor
  Clone ID: 6858527.pep
TRIRQLCVEGKRVLLSQPNLLRIHAPVKICGDIHGQFVDLLRLFDLGGYPPASTYVFLGDYVDRGKQSLETICLLLAYKIRYPEKIFLLRGNHEDAKINRVYGFYDECKRRFNVRLWKIFSDCFNCLPIAALIDDKILCMH

SEQ ID NO: 58969 - protein, 48 aa, Sorghum bicolor
  Clone ID: 6858532.pep
SSMYIRTHYIVYTIKQAFTIIYIVHLYIHLLYSIPLYILYSIHNNLLV

SEQ ID NO: 58970 - protein, 125 aa, Sorghum bicolor
  unsure (1)..(125): unsure at all Xaa locations
  Clone ID: 6858533.pep
MSYGYGGQNPYDSPDQGYGGNNGYGNGGGYNSPPAQGYGGSVEMAPLAHNAGGFGQGDPNAILNECRDIDRGIDTVEQNLEQLRMIQQRTLDDAXSSGSSAASRQLDSLSTDTISLYRELTERVR

SEQ ID NO: 58971 - protein, 145 aa, Sorghum bicolor
  Clone ID: 6858549.pep
ARGQLTLSHSNYIVMDPRLATKDQTAIFCALNRVSPDGKTGHYYFILLWVDQDAPKDASKKRWTELASQEELAAFARERTRGYPENLRKLVDQIPTERYNTPGFQLQGVELEPEQLPAGRVLLIGDAAHSMAPFRALAANTAFVD

SEQ ID NO: 58972 - protein, 156 aa, Sorghum bicolor
  Clone ID: 6858557.pep
MPAAMPSFSRRRLLCLFLVACLAALLFSIADRAGRTKETDNGEARFRVLRGLDTLGLRQKQQRHAHGHGISPAPAPARARLPLLHKDARLPVPGKVAHNDNHTRGGNATAARQSPPRGGGGEQGSKKKSTPLVVVAAAAALSGAALVLLAVLVVFL

SEQ ID NO: 58973 - protein, 67 aa, Sorghum bicolor
  Clone ID: 6858576.pep
DMLMYVTSTVGLFALNRQVNLTYYSIVFSIQLHFEFQCMGNYDFKFICYIHQDIITDTFNSTTVFSI

SEQ ID NO: 58974 - protein, 60 aa, Sorghum bicolor
  Clone ID: 6858582.pep
AIYHHKRSPITSIDYRLNPFYKQYRSIIGMFMLCYSVIGMFMLYSKRMKGISSGIREYSS

SEQ ID NO: 58975 - protein, 167 aa, Sorghum bicolor
  Clone ID: 6858592.pep
HEGPKKWTIPGLGYDTRGNNKVLFRTTNDMYSLDEIPIKSKRIADTVEALTGAYLSACGELAAVHFIKSLGMDVELHSKMQVERIVSTKSEEFIDVESLQTIIGYVFDDSSLLIEALTHSSYNTAGITTCNERLEFLGDAVLDYILTDYFYRKYYPKCTPALLTNLR

SEQ ID NO: 58976 - protein, 42 aa, Sorghum bicolor
  Clone ID: 6858605.pep
LFPGWSNPWGCHLNNPFLHGGLSIPGVCLPLHSKLGLMCACD

SEQ ID NO: 58977 - protein, 47 aa, Sorghum bicolor
  Clone ID: 6858608.pep
VDDTVDAKRPSKTPPHNVDRSFDAIRSINKYLTEKALAELVLPCIDR

SEQ ID NO: 58978 - protein, 53 aa, Sorghum bicolor
  Clone ID: 6858616.pep
EIKNGPLPMFSMLGFFVQAIVPGKGPLKNLADPLADPVKKNAWGYAPNFFPGK

SEQ ID NO: 58979 - protein, 72 aa, Sorghum bicolor
  Clone ID: 6858620.pep
HHFMYWHSNTRVKFWANKIPHNTDFYTYPKKLRPKKKKKKCCELPQLFLGMKSIAWVIHLKHQSISKLEYGS

SEQ ID NO: 58980 - protein, 46 aa, Sorghum bicolor
  Clone ID: 6858623.pep
FCLSSYLTTCKVGALLAFAFKLTLCCHHTHMQLCTLSGLVLWFVTK

SEQ ID NO: 58981 - protein, 134 aa, Sorghum bicolor
  Clone ID: 6858629.pep
MLNPPEMAPQQGQDSKETSDGSCADGAISLEEVLQEPLSNISVENIGRLEGQNATDDSINVDDLLSAYPRKDNGYVGQDNTMNGSGPADGDHTSWPLRAYSNQNYVNGPLADEFFDTGNDTNGVAYSGQQQADG

SEQ ID NO: 58982 - protein, 132 aa, Sorghum bicolor
  Clone ID: 6858644.pep
MEWRYNQFLGEKLTYEQIKSDPDNESFLVTNTKFSKDGKHCVVSDKGGRVILFKKSDSNNRSVKLDYFYEFAAQEKEFDVHKSIEYSEEIKGLSILPNLSHNKLDLLTASSRTIKLDRVYKDKIKCFENTHN

SEQ ID NO: 58983 - protein, 94 aa, Sorghum bicolor
  Clone ID: 6858658.pep
NILRTVLSSVTQLQNTLLLLSYSVRNSPLYLSFQFPSRYFIRDQLRSMYEYSVNGTRHFSAAALNFLEQYTTSFTLCSVTFGGVDYTNPPRRDQ

SEQ ID NO: 58984 - protein, 95 aa, Sorghum bicolor
  Clone ID: 6858661.pep
RCSPCVKHRSENLGEVVHHLQRGIAPRRSRPHASSRHVTRGRISTETRPAERSSLALNADREGWPGWVEAGKASSARVLRSMSHIRPKCSERCRR

SEQ ID NO: 58985 - protein, 119 aa, Sorghum bicolor
  Clone ID: 6858664.pep
ARGFIKHLREMGDEVLVVTTHKGAPEEFHGAKVIGSWSFPCPLYQNVPLSLALSPRIFSEVNKFKPDIIHATSPGIMVLGALAMAKMISVPMVMSYHTHLPAYIPRYNLNWLLEPTWSF

SEQ ID NO: 58986 - protein, 142 aa, Sorghum bicolor
  Clone ID: 6858673.pep
RRCTPWKSSVVSFAFLLLPFCLPSPSLCVLVSLAWLLLRLPPHHPPTPRHDGCRQPPARPWGERLLVWWHRSPLRTCHHHRCGCLRSRSKSGHFCCCLVTNEELPKASATEICRPYTAHGSDLLRRIMGQLGLHHGSVLRRA

SEQ ID NO: 58987 - protein, 132 aa, Sorghum bicolor
  Clone ID: 6858677.pep
LQEAEEQEQAESGGDQLGNVFGQMLQGDIWTKLRQNDLTRAYLDDPAFVSLLSRLQKNPNELPMYLQSDPRIANVFAVILGISQKPPGAESQEPAQPKEAPKKEEPKKEEPPKAQEKPKEPEPELPAEKKQA

SEQ ID NO: 58988 - protein, 106 aa, Sorghum bicolor
  Clone ID: 6858678.pep
ARGFHVAGHGCATCVGNSGDLDQFVSAAIIENDIVAAAVLSANRNFEGRVNPLTRANYLASPPLVVAYALAGTVDIDFEKEPVGVGKGGKEVFLRDIWPSNQEIDQ

SEQ ID NO: 58989 - protein, 123 aa, Sorghum bicolor
  Clone ID: 6858689.pep
MLLRRPLQTLTLPLLRRHFAAAAAAEALVSPHQAVDPLSPPYDYLPGHPRPDAKHDEVILAVPRASSGRHVAAKERKAGRVPAVVFEQENGQEGGNKRLVSVQSKQIRKLVDHLGRSFFLSRL

SEQ ID NO: 58990 - protein, 105 aa, Sorghum bicolor
  Clone ID: 6858693.pep
MMSGGGYSALDDPKASGSVPAATGTDPPAIRFADSNLQTFPPSEARGKIAGAYRPPTDADDTFSSKGGGAGSGGRGSSAGSDDAAQGGWFRMFSVAAYKPYFDVD

SEQ ID NO: 58991 - protein, 170 aa, Sorghum bicolor
  Clone ID: 6858730.pep
ARGNCQACCEGFFCPRGLTCMLPCPLGSYCPRATANQTTGLCDPYKYQITPNTTNSCGGADMWADIQSTEEIFCPAGFHCPSTTKKDNCSSGHYCRLGSTAEKKCIIKGSCDENTENENIKILGACIVGALCLLLLIIYNFSDKFLSIRERRKARSRENAIQLARQQLKA

SEQ ID NO: 58992 - protein, 140 aa, Sorghum bicolor
  Clone ID: 6858734.pep
TRDGPRSNLDSVRYAECIHYLQDYARPQMLAFMFRHGHYSEACSLFFPFSQPTTEGETSLSSIPWSDPLTTDYGTIDDLCDLCLGYGAMAVLENTIRTITQSPTYHEAHVTQYMNTVLTRICNYCETHRHFNYLYNFLVL

SEQ ID NO: 58993 - protein, 75 aa, Sorghum bicolor
  Clone ID: 6858741.pep
SVLVFFSIFLPILGFRRAIIMRLRLTLGSDDVLDAVPALTPAAAGGGVVGHLVRRCSRVGRGGFGGLSPACSPRA

SEQ ID NO: 58994 - protein, 71 aa, Sorghum bicolor
  Clone ID: 6858744.pep
HEAPSSLFRLFIFLFLKSVCVVLAELPGLLTNLWLSMMSCCVTGFLIQFSISVASFLAAARERVEQAMISC

SEQ ID NO: 58995 - protein, 129 aa, Sorghum bicolor
  Clone ID: 6858747.pep
MSQLADIGLIGLAVMGENLILNMANHGFTVCAYNRTTAKVDEFLAGRAKGKSIIGAHSVEELCSKLKKPRKIMMMVKAGKPVDDFIEHILPHLEKGDILIDGGNSNYNDSTRRVKYLTAKGIHFVGSGV

SEQ ID NO: 58996 - protein, 157 aa, Sorghum bicolor
  Clone ID: 6858752.pep
TRKSRNCWAVPDSKIFKVRSKTFPHDKSKVPAGKYLMELVAIDWFKDTKRMDHVARRKGSAAQVAADKGMFTFLVNIQIPGPSHYSLVLYFVSNSLEKGSLLQRFADGDDDFRNSRLKLIPSVPKGSWIVRQSVGSTPCLLGKAVDCSYLRGPDYLE

SEQ ID NO: 58997 - protein, 68 aa, Sorghum bicolor
  Clone ID: 6858754.pep
SGNQVNFFIYLVPISALWMICVTIWLGIELILGTKVTSVDVRGKTLDTSTGETISYATLIVATGAQVC

SEQ ID NO: 58998 - protein, 106 aa, Sorghum bicolor
  Clone ID: 6858759.pep
PRLPVPPPRAIDLVGSAGNSGRRPMATARRRGGGRCYTARRGKRCFAPGVPLTTQAEEGGGRCCTAPSPDALPLPQEEGEGGGGGPPPPWLCRERGKEREEERASC

SEQ ID NO: 58999 - protein, 141 aa, Sorghum bicolor
  Clone ID: 6858790.pep
HEAQVLQAQAESMGDGRRPEWGYQDCVIRALLRWFKRSFFSWVNNPPCPVCLSPTIARGMTAPSPEESACGALRVELYQCSAQHCGAFERFPRYGDVWRLLQTRRGRVGEWANCFSMLCRAVGGRVRWVWNAEDHVWTEVY

SEQ ID NO: 59000 - protein, 62 aa, Sorghum bicolor
  Clone ID: 6858793.pep
WFIKWLSHCTQLHMFLPLDSEGIILSYRLSNSLQKALGAFAPSDQVQTGARIHTCYFRLACD

SEQ ID NO: 59001 - protein, 154 aa, Sorghum bicolor
  Clone ID: 6858794.pep
METSFLPTTLPTAKPLPAFRTHAAAASIRPQQRLRRSTIRAAITRGRKEETVATVREQLEGCYLLAGIKYEGLTVKQLQGIRDALPETCSLLVAKNTLVGKAIEGTPWEALKPCMKGMNAWLFVHTEEVPTALKPYRAFQKEERVEETNDFVGA

SEQ ID NO: 59002 - protein, 117 aa, Sorghum bicolor
  unsure (1)..(117): unsure at all Xaa locations
  Clone ID: 6858799.pep
MDALSSPGTAMVPVNGDTAGPSSSQDDSAVTTKKRNRPQYHPFTQQQLPACKPILAPQTVIPVLLFVGIVFILIGLXCIAASNRVVEVVYQYETSCIPRYMLDNKVAYIQNPSIDKT

SEQ ID NO: 59003 - protein, 158 aa, Sorghum bicolor
  Clone ID: 6858826.pep
TRVKVDKDSKLIVAQGGCLWEDVDNAAIEKGLATVGGTVNHTGIGGLTLGGGMGWLTGLYGTVVDNLVEAKVVVADGRILSVSENENADLFWAIRGAGHNFGVAVEFTLRGYDQTNEIYAGGLVFTPEKLTSLVEGFNTRMKTSEPQAAGILLAKPPG

SEQ ID NO: 59004 - protein, 129 aa, Sorghum bicolor
  Clone ID: 6858831.pep
ARGSAPSSMAADLGSGAADPVGSILDGSRSGLRGSGSGWPTPAAPRRGLPRYVCAAAEVVGPVAACSAPSSLSRASTPTLSCAPTTTLPISVVCSIDCSISMLMSRKEAKAPFRPATLHCLHANMDAPW

SEQ ID NO: 59005 - protein, 147 aa, Sorghum bicolor
  Clone ID: 6858835.pep
ARGRDEFSFGNRGAMDRDAEAGDEKAAAATAVAGGDPNAVAAPTAMPPTSVMTRLILIMVWRKLIRNPNTYSSLIGVIWSLVCFRWNFQMPAIVLQSISILSDAGLGMAMFSLGRYQLRPKLPSLDRPYIHLDRFHSVFFLGLMIKQ

SEQ ID NO: 59006 - protein, 66 aa, Sorghum bicolor
  Clone ID: 6858840.pep
FCAFQNQIEILPSSHVHCPIDNLYLKQLQSQTFYQASRQLECAFKWVVSLLPKIMTEIQKLHSVSY

SEQ ID NO: 59007 - protein, 157 aa, Sorghum bicolor
  Clone ID: 6858841.pep
LIKSSRPWLVEMVMLLMLGDSRICILAPDRRPRRPLLPLLLPRTTRASGAAAAGGGAQRGHASPAHWERGAPPAGSGIGAGEPTAPRSDLDCSPRPRLTSPGFPCPVLDLISHWCLGAANHAPGSRNLGGRSRFRLLPRAGREVRRKRIAPVEWASC

SEQ ID NO: 59008 - protein, 150 aa, Sorghum bicolor
  Clone ID: 6858842.pep
TRADAFTELQQLKALSLSFNHFNGTIPDSLAALPELDVLDLSSNSFSGTIPSSICQGPNSSLRMLYLQNNYLSGAIPESISNCTRLQSLDLSLNNINGTLPASLGKLGELRDLILWQNLLVGEIPASLESLDKLEHLILDYNGLTGGIPP

SEQ ID NO: 59009 - protein, 154 aa, Sorghum bicolor
  Clone ID: 6858847.pep
PFKTPYHLDCCLPRYPATTTPPKLNKLLQEDQGTEPWSLQSSRRFPISLTRLTTRSQEPAAQPIPEAQRTRPLNSKGRNQNLNPSNLRKSQTSTSKATRSPWLLTRKSARAPRTGLTPTAEALRPTRTSSPSTPPMSPTLMRRFAPSTPTAPPK

SEQ ID NO: 59010 - protein, 84 aa, Sorghum bicolor
  Clone ID: 6858862.pep
SRGTHPELFGKQFNEASWLFMTLVCSLEKKEVGRSPDINDFKRDMRGTTSLLVYNLLLIRLKTLVFLLQGQPLLTEFRANPSIV

SEQ ID NO: 59011 - protein, 128 aa, Sorghum bicolor
  Clone ID: 6858882.pep
MAAGGAAAASTGYWSLAIGAMRAAMVCWVCLAYMRGVCDWLPPPLPAAAAGSTSTPRVGLLSVLFLAAVALSLVAGWFLNAVRPPPPTPCGTPGGPPVTAPRVRMRDGRYLAYAESGVSKDRARFKVV

SEQ ID NO: 59012 - protein, 127 aa, Sorghum bicolor
  Clone ID: 6858887.pep
MTLAAPTCVSAPGSAAATNSGRAQLSFHRRGVRARVIRASHRRPHHPSFSLEDEGVLEWLRGAAAALAIVAQISVSLPANAVLYSPDTKVPRTGELALRRAIPANPNMKAIQESLEDISYLLRIPQR

SEQ ID NO: 59013 - protein, 149 aa, Sorghum bicolor
  Clone ID: 6858895.pep
HEENPDTSVANPVSHSLSRSLLLRYQHGALIGALVLVLVAAVGIELVQVLDDLAALEVGHNLLAVLAKSVLPPVRHGRQRTQRVTQRRHNDLTALALEHLPDNGLGDRLGLEGRYHKLGVVAVAHKQRRLGVSLVNDNGAHLGRLVPRG

SEQ ID NO: 59014 - protein, 165 aa, Sorghum bicolor
  unsure (1)..(165): unsure at all Xaa locations
  Clone ID: 6858908.pep
ARGLQRPLDSVYEYIDPVPIASASIAQVHGARLKSSQKDVVIKVLKPGIEDTLVADLNFIYVVARVLEFLNPELQRTSLVGIVKDIKESMLGEVDLRKEAANIQAFQGYLDAMGFDRQAKAPFVYQHCSTKRVLTMERLYGVPLTDLDSIRSLVPDPELTXVTAL

SEQ ID NO: 59015 - protein, 172 aa, Sorghum bicolor
  Clone ID: 6858921.pep
TRAVLGFLSPSNRGGLMTAMLLLWVFMGLLAGYSSSRLYKLFKGSEWKNIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLHQFYYIF

SEQ ID NO: 59016 - protein, 127 aa, Sorghum bicolor
  unsure (1)..(127): unsure at all Xaa locations
  Clone ID: 6858924.pep
MGRDQQAGAAAMAPEKLKLFIGVLALQFLLAGFHIVSRAALNMGVSKIVFIVYRNVISLALLAPFAYFLEKKDRPPLTFSLLVEFFLLALCGITANQGFYLLXLYHLSPTYASAIQNTVPAITFVMA

SEQ ID NO: 59017 - protein, 165 aa, Sorghum bicolor
  Clone ID: 6858927.pep
HEAGGLGQSSGLPTSPSGAAESSGPNQANSAASGINATNFVSRSGYSCQQLSVLMIQACGLLLAQLPPEFHMQLYSEAARVIKDCWWLADSSRPVKELDSAVGYALLDPTWASQDNTSTAIGNIVALLHSFFSNLPQEWLESTHTVIKHLRPVNSVAMLRIAFRI

SEQ ID NO: 59018 - protein, 83 aa, Sorghum bicolor
  unsure (1)..(83): unsure at all Xaa locations
  Clone ID: 6858938.pep
MTTHRKHGFHLPALYYARTLSPXIPKMYRGALTDPNWRSAMQGEHDALLVNHTWDLVLHPPXANIVTGKSVFXYKFTADGMLE

SEQ ID NO: 59019 - protein, 131 aa, Sorghum bicolor
  Clone ID: 6858947.pep
MLTSLRYLAGTAGPSGFGSRTTAEEATAAGRDLAHITAIITGATSGIGAETARVLASRGARLVLPARSLKAAEEARARVRADCPGADVTVLPLDLSSLASVRRFVKRFLHLGLPLNLLVNNAGKYADRFAV

SEQ ID NO: 59020 - protein, 75 aa, Sorghum bicolor
  Clone ID: 6858949.pep
LIKSVFSHRVPIELFCCCVRQNERRAARNHERTWKHASIPTNNPCSGYNAPTSSCTSIKCKSVCKSADSNGNRCQ

SEQ ID NO: 59021 - protein, 173 aa, Sorghum bicolor
  Clone ID: 6858958.pep
HEALVVIPNEDKTSAAVHFLDLAAKLDQTADFECGVKWAIARSPAALGLTNIAPSADGKINIDAGPPMEFPAPFGRELTKEEAYIADLDAKTGASLKLTVLNAKGRIWTLVAGGGASVVYADAIASAGFADELANYGEYSGAPTESQTYHYARTVLDLLLRAPQSDEGKVLFI

SEQ ID NO: 59022 - protein, 95 aa, Sorghum bicolor
  Clone ID: 6858967.pep
METRIGESERKRKKRIKERDVSEVTFGFGFGFGLGVTRRYTSHINQRRHLWSRPIIRLLTGHSLLVFGEEDGGREEKRKRSEASMGTFGNGGKGE

SEQ ID NO: 59023 - protein, 131 aa, Sorghum bicolor
  Clone ID: 6858968.pep
MPEFTEADTIRILVATDNHVGYEERDPIRRDDSWRTFDEILNLARTEDVDMVLLAGDLFHDNKPSRKSLYQVMRTLRQNCLGMKPCPLEFLSDAASVFEGAFTHVNYEDPDINISIPVFSIHGNHDDPSGE

SEQ ID NO: 59024 - protein, 147 aa, Sorghum bicolor
  Clone ID: 6858969.pep
MASAATLPRLQLRPRCNSYFQVTDQVHAHIKTAVPASAQRISTDGGRRRWRHTFLPVSAVGTGRGSSVTEADRKSDLSLENVKTSIVSRDDEKINVRVQLPGKATQKVFDEALTILARDAPPVPGFRKSKGGKTSNFAHRKCIQRWC

SEQ ID NO: 59025 - protein, 151 aa, Sorghum bicolor
  Clone ID: 6858975.pep
TRVAAAPISPDDATNDTCQQNGFGPDTHLGAEIGKIATYKIRPVLRMITGSTISEFDLTGDLFKALEDQRDLIRDLNASTSVPPSRCQAFKDGMKQGIINPSDIDVTFENFPYYLSENTKNVLLSCAFIHLEKKEFIKQFAEISSINQRIL

SEQ ID NO: 59026 - protein, 136 aa, Sorghum bicolor
  Clone ID: 6858979.pep
MRFAIGATSLLAAAVVRADDASSSSSEVQSSTSVAKPTFTPTKLKAPLLEQFTDDWESRWKVSSAKKDDKSTEEEWAYIGKWAVEEPTVLKGVEGDKGLVIKDKAAHHAISAKFPKKLDNKGKTLVVQYEVKLQDG

SEQ ID NO: 59027 - protein, 49 aa, Sorghum bicolor
  Clone ID: 6858980.pep
ARGINVPDVVVFPSSQDEVQKIVMACNKYKVPIVPYGGATSIEGHTLAP

SEQ ID NO: 59028 - protein, 136 aa, Sorghum bicolor
  Clone ID: 6858987.pep
VANTNLPQAHAVLDDVLYNVLSDLLMKTHREEKTARATTAAIRIEKLASDASDSSTPDSKPDVRIETDAAIYEDGKVLLKGNPLKTTAEILCPRCHLPRLLYPTDGKGAQKPDPGVIYCKKHPYIDKPGCDIYGQS

SEQ ID NO: 59029 - protein, 143 aa, Sorghum bicolor
  Clone ID: 6858991.pep
MVAGVSENPALPDECVDDKTEEDTCTAPSPSEVDISEEQTLSCGQIPSSEVELYDIQEEHAETYDDDQIHSSTQADACSTSSEVDIPEEHAKTYDDDQIHSSTQADAYTSLSSKEFTISEEHTPISHDSQMHSFQISKPIEGT

SEQ ID NO: 59030 - protein, 71 aa, Sorghum bicolor
  Clone ID: 6858998.pep
SGALNIQSNHYDHHLDHNGPDNPDLDWELNIVPSIAAWLDEELQTSKLRDTLCDESSGIAECDVPLGNLES

SEQ ID NO: 59031 - protein, 42 aa, Sorghum bicolor
  Clone ID: 6859012.pep
MRDIKTYLSVAPVLSTLWFGALAGLLIEINRLFPDALSFPFF

SEQ ID NO: 59032 - protein, 176 aa, Sorghum bicolor
  Clone ID: 6859016.pep
TRTLHETGYFLSVRKGSWPRFVCDCMSRGSCGTGCALGVRWWPLGVEAAGVTSLDMPVSCSTRSTRFSSSILNSSTRIKRSPCVLISLLNSVVLSMTASTRSSMVTLRFLMFSYIFNSMARLTLINSSLAILSLNNSCFRSCSSVSKRLMSRLIFFICSMAWTYSSMETVDSGSSC

SEQ ID NO: 59033 - protein, 70 aa, Sorghum bicolor
  Clone ID: 6859025.pep
LLTYMFLSRDGFGSSTSTVILIAKFTNNSCCYLFLLLHIGNLMTSVCLSECINIRWVYGMNINTFVCISS

SEQ ID NO: 59034 - protein, 121 aa, Sorghum bicolor
  Clone ID: 6859027.pep
HEAESVEGMFPMASSSLSPPPLSLILLRPLPCRPVLLSRQRKPFPTVRVEARPEQRLQRRPVTGRWRRGGGFACFSYNANNKTPPPSDKSSDKWAILRRWDVPWEWQTVVLSMVGCGVRIG

SEQ ID NO: 59035 - protein, 88 aa, Sorghum bicolor
  Clone ID: 6859053.pep
RVPSMYHFVELLQILLRCRKYSFFVQLSAACACTYFLMHFIWFIPCCRFHLLVFIISFLSMHFVVMHICLLFMYSAYLSLDLIVGSKQ

SEQ ID NO: 59036 - protein, 170 aa, Sorghum bicolor
  Clone ID: 6859057.pep
TRLAAAVAEGPVRPKDLFPGEAVREVVEDLGLNRAKDPAAMGFRPPKASIADRLMLTKRKMEEVKEAPVQSTVSAPQTVVLSGMSEFHGLNGTTKFGVGVPRNPPVPSLAATAPLTSTSAATLKPPGSSPVKPVANSSVVPQLHTGPSNLKLDKNVSGPQNLARSGVTVV

SEQ ID NO: 59037 - protein, 144 aa, Sorghum bicolor
  Clone ID: 6859059.pep
HEAGAAPAPPHLLLQFSSANMLGLRRLLVVSGRHAPEVTSACAASSHSAVFFRALQILAQPGPVRLHKLSAPDTGIVELRLERPEAKNAIGKEMLHGLRSAIQEVVADTAANVVLVASSVPKVFCAGADLKERRLMGPTEVRDF

SEQ ID NO: 59038 - protein, 117 aa, Sorghum bicolor
  Clone ID: 6859075.pep
LLPVAQPYFATSQPRPPVLRLPLVRLLDCSMSALPTIQEKPSPLDQPVGSEQHPLHYSFIITNLERAIDFYEHVLNARVLRHEEHDTDCPATCNGKPSASSSSPATASPTSSNWSKT

SEQ ID NO: 59039 - protein, 123 aa, Sorghum bicolor
  Clone ID: 6859101.pep
MTGFLFNIDGGYLEGLCRGFKCGVLKQSDYLNLVQCETLEDLKLHLQGTDYGQFLANEPSPLSVSVIDDKLREKLVIEFQHMRNHAVEPLSTFLDFITYSYMIDNIILLITGTLHQRPISELI

SEQ ID NO: 59040 - protein, 107 aa, Sorghum bicolor
  Clone ID: 6859102.pep
MESSPNDNDQSSTSEARQKRSRVLLSCAPCRNSKLRCDREQPCGQCSKKGRASQCTYAPKPERKRPAKGMSARLKRLEGMVREMMDSEGAAPVTQVGNGTGAAMANG

SEQ ID NO: 59041 - protein, 79 aa, Sorghum bicolor
  Clone ID: 6859109.pep
KSITVAPRVSLIEGTHVPRWKEAFEASARRMREKEGAFGPHQRCRARARAAAQPLPACCATAARRAAAPGGGRQGESLV

SEQ ID NO: 59042 - protein, 151 aa, Sorghum bicolor
  unsure (1)..(151): unsure at all Xaa locations
  Clone ID: 6859111.pep
MAIILCASPAAPLWSLLFCALGALAVAALWGAWRALDRFWLRPRRLGRALRSQGLPGTAYRFPSGDMTEFLRLAAAAYSEPMPLASSPHAVAPRALPFDHSITRQHGNLAVTWYGPEPRVIVNDAKLMREILXNKHAGVFGKQKSVLWVER

SEQ ID NO: 59043 - protein, 121 aa, Sorghum bicolor
  Clone ID: 6859125.pep
PFGLPSESTGLRLGIILDNYRLDRPAMSRNRSDRTLRLKFSFTLSMMMRKRSLEKGFGRTFFLALTKLASPLACVGVFDFTFWFFSVQYTRPYVFLCVYLSCVTALSCGLRVGFISPHREV

SEQ ID NO: 59044 - protein, 56 aa, Sorghum bicolor
  Clone ID: 6859126.pep
YKSHGRCSPFPFTTRHVVLHGHYILLKLSHYAQSTLQPYYQSYCHLHKSSRMCSKY

SEQ ID NO: 59045 - protein, 59 aa, Sorghum bicolor
  Clone ID: 6859129.pep
LERSTLMLADTACRVLVGVVSTRLGSRCLMVGHYSDCGGWFRWSCSDLVRNRGPARNYR

SEQ ID NO: 59046 - protein, 147 aa, Sorghum bicolor
  Clone ID: 6859135.pep
MAMAEPNQQYEVIIAGGGIAGVTLALMFEKLGISYFLLEGRDTLESDRGAGIGLQPNGLRILDQLGLVEDIEDATIPLEKWFSYDSEGNLMNDSDAMGQYRDKIGYPVAFIERRKLLPILVRRIQRTECVMTSARVASIEESEDHVT

SEQ ID NO: 59047 - protein, 85 aa, Sorghum bicolor
  Clone ID: 6859142.pep
MDAFSSVMDKVKSHPEVMEKVSAVMDKVKSHPEVVEKVKDEVKSLADALHLRRHGKDKEPESEEKAEEGEVAQSVDESASADKTE

SEQ ID NO: 59048 - protein, 71 aa, Sorghum bicolor
  Clone ID: 6859150.pep
MAALNGGKTFVQDEEKQQLLLEEHTEKHFTAGEVVRDIIIGVSDGLTVPFALAAGLSGANASSALVLTAGL

SEQ ID NO: 59049 - protein, 57 aa, Sorghum bicolor
  Clone ID: 6859154.pep
LYCHALINRYTCSLKNWEALVFYSLQSPDHISTLFSYCSMLKCQFCQFQIIEIAIVL

SEQ ID NO: 59050 - protein, 140 aa, Sorghum bicolor
  Clone ID: 6859159.pep
TREELGVGKEAGKKEDVEPKSEAAPGSDKGGSHLETMSSDEEIKVLENMSSAPSRKASVQSKLPTIPSCVAWRTRSSWGINRDRLSYNTYFEALSDEPKEDDDDTEVELDEDEDGNNDDGSSDAYDKDDEEKEEEEEEEE

SEQ ID NO: 59051 - protein, 145 aa, Sorghum bicolor
  Clone ID: 6859162.pep
MNQALTDLYNTAIRLTMPILQAPVKPLPQGIDLSGQTAIVTGSSNGIGTEIVAQLLERKISTVILAVRNVAKGEAARTEVLSRPSVKKVASKAVVKVMKLDVEEYSSVQSFAKQFLAEHSELHILILNAGIGVLKRDVVASTGHE

SEQ ID NO: 59052 - protein, 157 aa, Sorghum bicolor
  Clone ID: 6859165.pep
HEDGNGSANGVADASDDAPRENIFLFIPNIIGYARIVLAIASLYYMPLHPRTCSFLYSVSCLLDALDGYAARIYEQSTRFGAVLDMVTDRCTTACLIVFLSSAFPRWAIVFQGLIALDLASHYMHMYATLVVSGTNASHKSIDESKNWLLRLYYTNK

SEQ ID NO: 59053 - protein, 115 aa, Sorghum bicolor
  Clone ID: 6859166.pep
MPEIPKEQWAQVIEKTGGPVDYKKIPVQQPGPDEVLVNIKYSGVCHTDLHAVNGDWPLPTKLPLVGGHEGAGVVVAKGDLVTDIEIGDHAGVKWINGTCLACDFCQQSDEPLCSK

SEQ ID NO: 59054 - protein, 139 aa, Sorghum bicolor
  Clone ID: 6859183.pep
MSGKQSILVVGGGQGIGLEATKHILKLSSQANVVVFGFDIAPEVSSLADTGRLVAIRGDVTKAKDREEAVTKCLDHMGGVDTLIYTAGIATPIQRIDNLSLEAIKKTFDVNVFGCIAMCQLCLPLLRASFGTNITNAAY

SEQ ID NO: 59055 - protein, 101 aa, Sorghum bicolor
  Clone ID: 6859224.pep
MARSSRNASKRSTWSIAFYLLLVLVGGLMLAKTAHADDTESAKDDKSITGPVIGIDLGTTYSCVGVMKNGNVEIIANDQGNRITPSWVAFTDEERLVGDAA

SEQ ID NO: 59056 - protein, 104 aa, Sorghum bicolor
  Clone ID: 6859236.pep
CSTSRYRTGARALRLYIQPPRSAAALAKKLPSFASLASRLSLSLPGPCLRCVARLGLARTAPMATATRCCILLRDAPGMCLLLCSWSEGKSSRCAGAAPLARSR

SEQ ID NO: 59057 - protein, 175 aa, Sorghum bicolor
  Clone ID: 6859245.pep
ARGRYIVLSIDYKTHTVLVSDADIADEYAAGGCPRLHMNLTIDTAWLWLAPSSSNITFLYSCKKNITLSSAVELSGCQQQQDGNNRSYVLPDGGITGAEAYEFQCEEVVVAQVLDAHKKAIVGAPGTPPPGNGSFREVLQGGFELNYDTHNHQCDRCEGSGGWCGYQRDDTHAGG

SEQ ID NO: 59058 - protein, 110 aa, Sorghum bicolor
  Clone ID: 6859256.pep
PLTSAASMMTSAIRPSSQVSISGSGTTTTMAASQLQPLTYDGGELRIVLVPTSEDGNDAPEHDIGGSEVDRRFSSDSYRSYRAPNQSIPTHPIPSLQDAFAESLDEVTSE

SEQ ID NO: 59059 - protein, 164 aa, Sorghum bicolor
  Clone ID: 6859273.pep
LPHWLWYVLMAPIVCLELKIYGQWISGGQRRLSRVANPSNHLSIVGNFVGALLGGIMGLKEGPMFFFSVGLAHYIVLFVTLYQRLPTSETLPRDLHPVFFLFVAAPSVACLAWARITGAFGYGSRVAYFIAMFLYASLAVRINLFRGFSFSLAWWAYTFPMTSA

SEQ ID NO: 59060 - protein, 130 aa, Sorghum bicolor
  Clone ID: 6859275.pep
NTPFISQSIIHSLVGNMLFSLVLPTLVFQASLALGDTSVTVNTNKKLQVIDGFGVSEAYGHAKQFQNLGPGPQKEGLDLLFNTTTGAGLSIIRNKIGCDASNSITSTNTDNPKAQAVYHFDGDDDGQIWF

SEQ ID NO: 59061 - protein, 153 aa, Sorghum bicolor
  Clone ID: 6859279.pep
TRINTDTMMLPTAPVVPMDLGDDFKFGPTVLDPIQPEDQENLVPVNGFPSVDPAGGDVAMSQLDVLAHFFGTYSGFGFNTIFRPNGTTTPTPLPILPPSQDPNDNILQLNLTSESLAFAKGRLDDVPNRGLDTQADIMLNGVPYTQTIADITE

SEQ ID NO: 59062 - protein, 124 aa, Sorghum bicolor
  Clone ID: 6859280.pep
MMRRCVSELARRRRPDRTVDTMKAGFQCLVNVSSSIRATDSQRCSSTCATSCATDPDVLSRETSSSSEMLVDSFGRFHNYLRISLTERCNLRCQYCMPAEGVELTPKSELLSHDEIIRIADLFV

SEQ ID NO: 59063 - protein, 123 aa, Sorghum bicolor
  Clone ID: 6859284.pep
PPSRPPWCRPLRARRVSSPAPRTSRSRRLSQRRRPPTPRVPASLPSPPPPPATARCLASRSPSAARTPGSTGAGCASRSNLTWWSLDAPPTWKPMLKAHGPAAGRSVRWSVAVECWVDKERHS

SEQ ID NO: 59064 - protein, 106 aa, Sorghum bicolor
  Clone ID: 6859285.pep
MAQDDPVVSPQWLHEHLGMPDVKVLDASWYMPVENRDPWEEYQVAHIPGALFFDLDGIVDPTTDLPHMLPSEEAFAAAISELDIKNQDKVIIYDGKGFFSAPRVWW

SEQ ID NO: 59065 - protein, 162 aa, Sorghum bicolor
  Clone ID: 6859294.pep
NIAPTVARQALRIASRRYPSSTFSRVSPRAVTGLAHARRSYVSETKPSKATINVDTTIKAERKAFLDQTGERAQDATMPTTGLGADAMMSPTAGILKQATVMDQGSRPIYLDMQATTPMDPRVVDAMLPFMTGLYGNPHSRTHAYGWETDKGVEDAREHIAN

SEQ ID NO: 59066 - protein, 53 aa, Sorghum bicolor
  Clone ID: 6859314.pep
IGVCNICNGEATSHCLEIRTVHKPSMNRRCHQSISLKHIGCDTILFFAHLYRT

SEQ ID NO: 59067 - protein, 134 aa, Sorghum bicolor
  Clone ID: 6859318.pep
TRHPLPLNAPSRRARHSCPTCLPGFETLAPCSSGATTMVAAPALRQRLIAVSLQALNPFSPVHSGLGSNGEVSSEVDQDHALLAEEVIVEVRLQQGQGFIVSRSPMCWEFRNGYFILEVILGAVIFSLIQIQYV

SEQ ID NO: 59068 - protein, 96 aa, Sorghum bicolor
  Clone ID: 6859325.pep
TRLLSTTASAVAKQLWSLKSAATKTATAAVAARPKVRYEGGYAVDTVFDGSKLGIEPHAVEITPAGDLLVLDSINSNIYRVQLPLSPYSRPKLLAG

SEQ ID NO: 59069 - protein, 152 aa, Sorghum bicolor
  Clone ID: 6859340.pep
TRLLLIITLSAPSNCFLVREGRRATSDSPSPETPDRCRQGLTSELSLLGPVSSSLDSCIHRPHTQSHTHTTSIHPTHSSRLSCSITTPSPTTPSSVGTISFPTSTPSARPKTPFQLLATSPPPPPPIFTRAVATPNPARPHSTLSFTAPRCT

SEQ ID NO: 59070 - protein, 139 aa, Sorghum bicolor
  Clone ID: 6859348.pep
MQLQILSVLAALPTAALAVLTTTVTFRVPVSQRLPNPYDLPPSTHATLSSFHKSHRAPISTVNTFVFHNVTTGSYLVDVHSPTHMFMPLRLDVLAPVEDGVSDVENALSLKAWETYRGNDWDNKGEAATLLNGDVFDVR

SEQ ID NO: 59071 - protein, 169 aa, Sorghum bicolor
  Clone ID: 6859349.pep
TRAANSPSAFTRHSPLSPRITPSTAHHGLPYPAHFGDLQPLAELIARASDPVHTSLVAQELAESDGPVTAAAGGGGGGGSVAELWDQLSAAAEGPAAEVEKGRVPMPQDVAIMPEKSADNPTPDDVQVRKALEDFGHLRDITAIADLYIAMSNINKRTKRGHPEEYRIT

SEQ ID NO: 59072 - protein, 77 aa, Sorghum bicolor
  Clone ID: 6859351.pep
PADNAFKDPSECFLATVAARPLSALETNPPEIDLFFAVPEEFQFDPARKWIMVESRSSFFESSRHTLLALQKMMRET

SEQ ID NO: 59073 - protein, 62 aa, Sorghum bicolor
  Clone ID: 6859369.pep
KSCSFPPMRNMHNNIPVTWTSALEGTSSGKYGPLLMSSHLITSCSTFSNTTSFSARASPFST

SEQ ID NO: 59074 - protein, 91 aa, Sorghum bicolor
  Clone ID: 6859376.pep
GAKKGYNGQYTIECDKRASLPDITFNLAGSNYSLPATDYILEVQGSCISTFQGMDFPEPVGPLVILGDAFLRRYYSVYDLGKNAVGLARAK

SEQ ID NO: 59075 - protein, 58 aa, Sorghum bicolor
  Clone ID: 6859384.pep
LLNINYLHPGFQTKKTRSTDAGNSTRQSRKPIQLFLGDFRTSIKYLFCSTSSSPPSYS

SEQ ID NO: 59076 - protein, 141 aa, Sorghum bicolor
  Clone ID: 6859395.pep
SYGVNYPVYYVIADTPLEFGKNVDTPLVVNNTLAPNASPYVVWSPIGGKNGTIVVSDADTGGVYTNTYGGATDKWEVHETGAGAVYSRAIQIFKNKPDHLMIYGGDTYDGLSLKYNVPFSATVVDLNKVLKAPAFGYAKLT

SEQ ID NO: 59077 - protein, 76 aa, Sorghum bicolor
  Clone ID: 6859401.pep
APAIDEPEQAATPAKTPKKATGGRKRKTATPAAAAEEAKPAPASPDKKRRRTSTKAAAAEPQEEPKKSGRKKTKSS

SEQ ID NO: 59078 - protein, 61 aa, Sorghum bicolor
  Clone ID: 6859424.pep
PLPPSREPDYRVFKFHHYHPLDFLHGGPNGQQFNLGYFFRFSKHNIKGPNCMLKCSYKLSS

SEQ ID NO: 59079 - protein, 113 aa, Sorghum bicolor
  Clone ID: 6859445.pep
SSTLSITLSPLIRRVLHFTMAILKHVLLAVAATAVSVLAGPLSTDGTSTAIVDAPQSAVTEVSKPLEGKELEDFLANGPHIPEGSIDITNTTLATELMKFREAHINETSLTKR

SEQ ID NO: 59080 - protein, 144 aa, Sorghum bicolor
  Clone ID: 6859447.pep
HEAHLTFIITRHPRTRLSGYMVPAILKDHEGLKRRKRSLQAPRRPPRTRAEEEAREARRRVAEEVMRDVSLGWYLVADGTKYGFSETQEYGALNTIYVPPDDDEIHRWKNPTRPIRYPFIPPVPATMSVVLSSALKAVHYLNRS

SEQ ID NO: 59081 - protein, 141 aa, Sorghum bicolor
  Clone ID: 6859457.pep
ARGPCPVPPHRPRPRPPPPFLAVAAPHSYHPTSHRRHHRRRGPASDPEIQKDARSIRRRAARPPGSIPGSDRPLGGWNIVVLIILTLSYGIGAVMPHPSLKLYRIHCLDQCSEVLSNSQKWTEPSLKILLLGAHPRNLADV

SEQ ID NO: 59082 - protein, 153 aa, Sorghum bicolor
  Clone ID: 6859465.pep
ARGNGKRTLAVKSSTPSSSSTKKKLNTKLIHGIMEAMPQLAPATVRSGSPTDMLRRSSISSTPQPLAKLKDICLDDEISMVTPSVGKLKDIVLDSDDTTEDPSCSNSSMDDGCGTGTAESAARKHGCGNGRLINICFGAQGLTVEDSASGQQT

SEQ ID NO: 59083 - protein, 120 aa, Sorghum bicolor
  Clone ID: 6859472.pep
QTSRFTWTIENFTRFNGKKHYSEVFVVGGFKWRVLIFPKGNNVDHFSMYLDVADSANLPYGWSRYAQFSLAVVNQIQPKYTIRKDTQHQFNARESDWGFTSFMPLSDLYDASRGYLVNDT

SEQ ID NO: 59084 - protein, 82 aa, Sorghum bicolor
  Clone ID: 6859486.pep
ARGPRSTTLKQTSPTCNYNVQRGRAARAPHRLAEALAELERARARAAELQRHLEQTYGKRARGQRRRDRLPGTREGNRLHRA

SEQ ID NO: 59085 - protein, 159 aa, Sorghum bicolor
  Clone ID: 6859502.pep
TRARAKIKGRIGQNHSELVDDEDRRSPPPKNDNLLTENENSGVKENGTFVEYVKVNDKISSDTAIRIPQDDFTEEYTSDEGWQAAVPKGRSTGSRRTGAGTRRPNLAKINTNSLHSENGRYKGRGTSNFSSPRVSPSEATVPMGSSPLAKKLAKSSSFN

SEQ ID NO: 59086 - protein, 134 aa, Sorghum bicolor
  Clone ID: 6859509.pep
GNGWLLTVALMEGTNLAATKSSGYSDPYVVFTCNGKTKTSSIKFHTLEPQWNEIFEFDAMEDPPSVMEIHVYDFDGPFDEVASLGHAEVNFLKYNNISELADIWIPLKGKLAQACQSKLHLRIFLNNTRGNEVV

SEQ ID NO: 59087 - protein, 142 aa, Sorghum bicolor
  Clone ID: 6859510.pep
TRICNGIALHSPGLIPYCSTYLAFSDYMRAAMRVSALSEAGVIYVMTHDSIGVGENGPTHQPIEHLMSFRMMPNMLVLRPADGNETAGAYRVAVLNRKRPSVLALSRQNLPQLPGTSIEGVEKGGYVISDNSSSNKPDLIVL

SEQ ID NO: 59088 - protein, 123 aa, Sorghum bicolor
  Clone ID: 6859517.pep
ARGFFQPLDEAEVRLQRAIQRYVEQLRHDRAMVERDEQYVSSMGSKDVRRQRMINNIARARRDIQHKETELATLRRQLLESRQRREAAADIAEPVAHSSSMPSYHTSRAVKARPQTSGAGSAS

SEQ ID NO: 59089 - protein, 101 aa, Sorghum bicolor
  Clone ID: 6859520.pep
ARGDVLGFVPIRRPGSLDLHGAWLFNYGIGVHLLQAEDPASMPPKKTEINPKDNHICFQCESMEAVQRRLKELGIRYVQRRVEEGGIYVDQLFFHDPDGYM

SEQ ID NO: 59090 - protein, 117 aa, Sorghum bicolor
  Clone ID: 6859521.pep
HEADADPIDALKELELGNGRDESSVSDPASASAEMALKGPSDGNAKKRKASGKGKGKDGPGSTAAKDLAKEESGGKRCKSADESNGAEDNSTKGKAAQSNSENGGKKQGKDSTSKPP

SEQ ID NO: 59091 - protein, 161 aa, Sorghum bicolor
  Clone ID: 6859527.pep
TRISTPPRQTIKLLPSHLDSRPSAPKTLRPPGAPCQSQTRLGANKHGHQSTAGLKSTHWNTLVLVHLSCQARWLHKQPQNPRRSHTEAHPEADATKHASVYSLISHLSLLHRNAAGPIPIHINKHSSPAKTKPADAPATPRATAPGQSLMLSRVFHSRDTR

SEQ ID NO: 59092 - protein, 77 aa, Sorghum bicolor
  Clone ID: 6859536.pep
ARGRRSRRCCRGVPLARPRAAAASLGAGQLRVGTEHGWLWDCRSGGARDYAREMEVAVRIVQVACTLCQRVQDSLLR

SEQ ID NO: 59093 - protein, 61 aa, Sorghum bicolor
  Clone ID: 6859545.pep
MKKVPITNLKFGVCPNNPLNKHLVQFTLSNYFNWSNLHLKKIFIFCSSMYNLQFSFKFMRL

SEQ ID NO: 59094 - protein, 139 aa, Sorghum bicolor
  Clone ID: 6859555.pep
ARGAIVPTKKNDNPFVESEKPAAQGGLLFMLFLVGAFVLSSRSTPAIPRVSEDVRAASATILDNVLKDAGVNSQSASLQAAPHPSGTANWGNAISMNDMAMDGVAPSMLGELGDQLTQPTQEQTNEQIFSLSAAQYNGV

SEQ ID NO: 59095 - protein, 145 aa, Sorghum bicolor
  Clone ID: 6859556.pep
TREQWANEDEGAADAAAAETAPLYEAPGGLRCGVTENPGWAPLIFYGIQHYLSIAGSLVFVPLILVPTMGGSDEDTATVISTMLLVSGLTTILHTFLGSRLPLIQGSSFVYLAPALVIANSEEFRNLSDNKFKHIMRELQGAILV

SEQ ID NO: 59096 - protein, 147 aa, Sorghum bicolor
  Clone ID: 6859561.pep
TRALSNLSSHLQKIPVVPRQTIMVSFRLIGCVLSAHMVANTVGSYIPRDVVVDRAAAASATTDPQITTFVTSIPVPTPQVAAVSSALQSDPNVSLLLKGQPFVQAAITTVACEVLKLILGSAKVDTKPVDTSLVELNWSQTCWKTPS

SEQ ID NO: 59097 - protein, 162 aa, Sorghum bicolor
  Clone ID: 6859576.pep
TRAFKDYISSLNLNVDVLSVDDAINFASKLLLPSESDLPSESEKIFLNNIESAKQGLLSTSGYLKCVQNNLHVTVSSLVASAVVWMSCLPSKLNPVILPLMAAIKREQEEVLQDKAADALAELIFSCVGRKPGPNDKLTKNLCTLTCTDASETPQAAIINSM

SEQ ID NO: 59098 - protein, 120 aa, Sorghum bicolor
  Clone ID: 6859585.pep
SNGNTPFSGGTGLTPLFPPKAPPALICQKVQTNASRNKVRSLTVVWTMLSTAVLLLPDALTPAGRCGLSHAQQCNVYPPGQRRSQAATTRQHEDGARVCPRGRIQFAHADLPRRAAHLVC

SEQ ID NO: 59099 - protein, 153 aa, Sorghum bicolor
  Clone ID: 6859586.pep
MTVSAGSVDMISHQLVSYHELVRATNNFSESNLLGSGSFGKVYKGQLSSGLIVAIKVLDMQQEQAIRSFDAECSALRMARHRNLIRILNTCSNLDFRALVLPYMANGSLETLLHCSQETTHQLGFLERLGVMLDVALAMEYLHYEHCNVVLHC

SEQ ID NO: 59100 - protein, 82 aa, Sorghum bicolor
  Clone ID: 6859591.pep
RRQERHGGLEFWLRWRNREGEVVGVYGAIPRAAAAAEQVLADEVEGETVGVSGEGHVPLLVVAPATGDPRVLCCASVFLPRA

SEQ ID NO: 59101 - protein, 122 aa, Sorghum bicolor
  Clone ID: 6859596.pep
HEEEFQAIVLSLSSTYSSVNGMEMPSPDDNLKFSDHRPTSQELTYSAENNADNGKVTSTGESKVESTSQTENNVAGNLKSTLQTIVHGGVGYHMVNCGLILLKMLSEYVDISKCLPSLSLEV

SEQ ID NO: 59102 - protein, 69 aa, Sorghum bicolor
  Clone ID: 6859600.pep
FEHTTNSKINNASLITQRRFDIDTNKYYSTNVTSDYSQRLYHHLSKYLKHLEIGSNGQEHKCTYDSREL

SEQ ID NO: 59103 - protein, 100 aa, Sorghum bicolor
  Clone ID: 6859604.pep
TLSIPVGSTLPCPAACRASFTSSMDATRACIAAPGIRGYNLASVESTRFELESGISPARLHEAGSSAPNRGAARTRSGPGLAGRRWLDGASLGSGRPRAE

SEQ ID NO: 59104 - protein, 68 aa, Sorghum bicolor
  Clone ID: 6859608.pep
LKQITLVCFDFGFVTETEWARGMRRHTFIYSIVGSVASVREVTNVKLSVCLPPEHTGGIWTVTSESKR

SEQ ID NO: 59105 - protein, 108 aa, Sorghum bicolor
  Clone ID: 6859613.pep
MSGRKLGGGRVLGSGRGLAPPTPPITNAPRVGSPLAASESSISIASSSISPPVSGISPDIPGQDIGNSISVGAQGKGPADGALVCPICNEEMMTLLQLNRHIDDNHQE

SEQ ID NO: 59106 - protein, 68 aa, Sorghum bicolor
  Clone ID: 6859624.pep
ARGKLPSHVTRDAIAFDPQVPMEKVANASKSHVKIVHANDMSMVTDKSKDLRQPSSMLEAQKASSGGM

SEQ ID NO: 59107 - protein, 137 aa, Sorghum bicolor
  Clone ID: 6859632.pep
MTDGARVEAAPRLAQWRVEALPCYTYRKSLPFRIGLWNWYLSVERNNKQTCVKLFAENPNSPKNGPSAPIASFITKLLISLPPNQQTIVHPGIFDKQLKHDGFVWAIDSTVTGRFVIEIEFLDLKVADPSGGEPASI

SEQ ID NO: 59108 - protein, 128 aa, Sorghum bicolor
  Clone ID: 6859638.pep
MGADGHAPAPLAAPAPAPAPALVQINACLTPAEVYWKLVEAGTLKMKSSWFKLAVGGLLAGMYVSFGFTFCCCAIGLLGNTIYGALAFPTGLLLIILCGAELYTGNTCYMFAANIERKAALWHHLKII

SEQ ID NO: 59109 - protein, 94 aa, Sorghum bicolor
  Clone ID: 6859642.pep
ARGDRGPQLIWFRVLALVFSSNLPSEFWLAILWYQVQHLSCPKSQNLVLIQERKYCKSAALVACRLQPCTRLFLLVLLKEASSKFVFQFLFASS

SEQ ID NO: 59110 - protein, 114 aa, Sorghum bicolor
  Clone ID: 6859643.pep
MASSSRSTVSSFLLVALLLCCSRMSSAARLLEEAPPKEEYPHPAVPELPKPELPPHPTDVVPPEVPHPVPEQPKPELPPHPAVPELPKPEVPHTVPEQPKAELPPHPAVPELPK

SEQ ID NO: 59111 - protein, 160 aa, Sorghum bicolor
  Clone ID: 6859660.pep
LRQAAAAATATCSSPVAATLHGKSSPSSLAHGRLSFSHMSLQTTPDHRRHRAGWAVRVLPLTEENVEKVLDEVRPSLMADGGNVALHEIDGLVVVLKLQGACGSCPSSTMTLKMGIETRLRDKIPDILEVEQIVDTETGLDLNADNVEKVLDEIRPYLSG

SEQ ID NO: 59112 - protein, 135 aa, Sorghum bicolor
  Clone ID: 6859665.pep
VIEKGNYFTSSDYTAVEAPSMEHLYEGGGFVSTLSGSALLLAGSTVGGGTAVNWSACIKTPDDVREEWARNQGLPLFATDEYAAAMDKVFERLGVTAGCAEEGLQNKVLRKGCEKLGYKVESVSRNSSEGHYCGS

SEQ ID NO: 59113 - protein, 93 aa, Sorghum bicolor
  Clone ID: 6859678.pep
EDSLAPAQAVNLDFEARVPVPFSIFPSTYKDNEAARPQTQITTHEEVQLTLPQKKPAGREGQLSSFPPSTDLAPPRVEQRFEEEVRITREEER

SEQ ID NO: 59114 - protein, 55 aa, Sorghum bicolor
  Clone ID: 6859686.pep
MADTIVVPEVEQTAGNVELKDNTVIVVLGASGDLAKKKTFPALFGLYRNNFLPSD

SEQ ID NO: 59115 - protein, 159 aa, Sorghum bicolor
  unsure (1)..(159): unsure at all Xaa locations
  Clone ID: 6859687.pep
MNAQVSFLDGTYTLIHIPLNLYSTLLQPILRVLLPQSQSLGNLRDSPEYELQGLTSDGQHGFLNISITPXECSVVCHSSWAQNVFEPVLKTLPRDIAKSVSVSKDSYMILSVISAGLDAGGRVMELTSPLALAGIPIFFITTYYSDXILVPTKERDNVA

SEQ ID NO: 59116 - protein, 151 aa, Sorghum bicolor
  Clone ID: 6859695.pep
TRASALSPQDIPADLPVANLLTKAQSHLSRGETSEALVYYDAAIARDPTNYLSLFKRATAYLSLGRTSQATDDFNKVLSLKPGFEGAHLQLARLRAKAGDWDAAKAQYGLAGKAPKSAEFVELEEAKLAAHLADMASKGGKWEECVSHAGT

SEQ ID NO: 59117 - protein, 137 aa, Sorghum bicolor
  Clone ID: 6859696.pep
MASPAAVTRHPSPTVLASGPRYCRRGHPPSKVGFRSLAPRLKVNALFGWPKGDTSTRQLIPPAAESYTLSGSALEVGAKPREVSISVASSIMDIPAADWDACACDPDDPENFNPFLTYAFLSSLEESHSAVKETGWL

SEQ ID NO: 59118 - protein, 151 aa, Sorghum bicolor
  Clone ID: 6859699.pep
PMPLPQSYHRSDDTNNASSRALSAQYQARNNNQQSHTPFIPEGIYFTPLASGAPMENHYSQQMPSNSSQLETSQPSQYRTTAETVAGTSSASEPKSDIRPDRLRIAIKWNETRFKAWLKPEESCQTFFETFQSEASKRRKTLNRSTTRILL

SEQ ID NO: 59119 - protein, 168 aa, Sorghum bicolor
  Clone ID: 6859701.pep
MVAEDFEAVLKGKYPGKSHARRVVDLIRKKDPNANGVLYLEGRHTKLLEDNDSPEPFRQRRFFYYLTGCNLADCFFTYDIQSSKSTLFIPPIDPHDVIWSGLPTTIDDALKLYDVDEVKLTTEVNATLAHLAGTNSNSTIYAIKDQVSDHITFIGFENKDFELLKPAI

SEQ ID NO: 59120 - protein, 155 aa, Sorghum bicolor
  Clone ID: 6859706.pep
ARGPDVRTYALLVQRLAAALRVAEAIMIIDYVSRAGVSSMDEVPFGVIVRCPTCMIAVAVVQPQDGTQIVSCSKCRYQYELFSGDIASIESEEVSMDISALEKALRYINMWKEGLPTAVHSIVIRTPSGTARTHRFATQTVNLPAQEGERVTISL

SEQ ID NO: 59121 - protein, 55 aa, Sorghum bicolor
  Clone ID: 6859710.pep
FTQCIKSFKSKLDQKLHHRCSSKIESLIQNCIENLLVCHSIIWKRKPICVATLSD

SEQ ID NO: 59122 - protein, 82 aa, Sorghum bicolor
  Clone ID: 6859715.pep
MSSPIANGSPVASRDSPTPSGKESPFVERTNPMGSGNAQTVSSRDPKAVAQAANDMKNVVRRKLTGYVGFANLPNQWHRKSV

SEQ ID NO: 59123 - protein, 152 aa, Sorghum bicolor
  Clone ID: 6859726.pep
SDIGVENSSYIYLKHEYEKQTNGDLSGYDLILKVAERSTGETEYIYVHKCLISSRSTYFKDLLVSLNDVDMVDGKSLIELKDYHLDTMNIFIRFLYTGDIIIPDTVDTECLQELLNISKMDIDRYEIILSVCDQKRLYLDSSTAVLNQLKHD

SEQ ID NO: 59124 - protein, 134 aa, Sorghum bicolor
  Clone ID: 6859728.pep
ARGTDECFNCVYQREDEVGKVGVSLARELMAVAGDALKTNITTLGPLVLPLSEQLKFLKSLMMRRVFRVKGVRPYIPDFRRAFEHFCVHAGGRAVLEEVQRSLSLQDTDMEPSKCSLHRFGNTSSSSLWYELAY

SEQ ID NO: 59125 - protein, 140 aa, Sorghum bicolor
  Clone ID: 6859731.pep
MSQQQQTVVPAPAVAHPTPVFDLMYYVKSAVAGGLCCSVTHGAVCPIDVVKTRMQLDPQKYNKGMISAFRQVVSTEGAGALATGLGATAAGYFVQGWFKFGGVEFFKVNIAQAVGERAAWENRTGIYLASSAMAEFIADL

SEQ ID NO: 59126 - protein, 165 aa, Sorghum bicolor
  Clone ID: 6859737.pep
LPIIVVVVVSLAQLRQALFQLFRGAQQAGRCRRGCVVVGAKVQRVRAHRAGLGAVGVLADAGLPLGRRADAVVGGARAAGVEAVADHGVAVSLALIEPAQRLLADGRERLVAQQAVGRRQHAQVCSEAQACCSGCASNGAGPSRSRSMARQARPPKPSSSPNPRA

SEQ ID NO: 59127 - protein, 204 aa, Sorghum bicolor
  Clone ID: 7217079.pep
TWLWKIARPKKLSVCVRARKAVRDGMRFLQNTLYTRTPKRARPKRSVKDSTLMSPRPTTPNLSTTSIIHLQWKDRARRSSESKISSPTSRAKPITGKHARSATVMEKTRSGSVRHMEVSETSGMPGARTDDVDTGRLVSFLSCIRTWGKVYVKFVRFSVRFIPDVNFGVHDTPRAVDLRGAASAGWLVSFLSWHTHNTRASVMP

SEQ ID NO: 59128 - protein, 172 aa, Sorghum bicolor
  Clone ID: 7217081.pep
PDAIKHYTEAIRRNPTDHVLYSTRAACYMKLGEFPYATKDCDKAIELSPTFVKAYTRKGHCQFFMKQYHKCLETYEQGLKVEPNNEELNEGLRRTMEAINKRQEGTNEADDKEAMAAAANDPELQRILGDPMMKKVLSELGSNPAAVQAYMKDPVIMNNIQKLIAAGIIKVK

SEQ ID NO: 59129 - protein, 121 aa, Sorghum bicolor
  Clone ID: 7217087.pep
VLPRKVHLHAGTDEPLNITFMRAPSSALLKIDVPLMFIGEDASPGLRKGAYFNTIKRTVKYLCPADIVPPYIEVDLSELDVGQKLLMRDLKVHPALKLLQSPDQPICNIIGSRAPEQKKGK

SEQ ID NO: 59130 - protein, 63 aa, Sorghum bicolor
  Clone ID: 7217092.pep
KHPNMKELCNEVKQLKENFDSFEITHVRREWNAEADRQANIGITRESTKHTSSLNSIFLFLFS

SEQ ID NO: 59131 - protein, 125 aa, Sorghum bicolor
  Clone ID: 7217095.pep
AAVQALASQHTVLKSIVLREPGQVKPVSPSPPPSTGKRRDGSGGYDHDDVVGDENDGQVILYAGRLDLSLENQNLRSLLDGMHWRVMELEKVCSRMKTQMSKMKQARRGGGGGGRTARSLPRMCS

SEQ ID NO: 59132 - protein, 175 aa, Sorghum bicolor
  Clone ID: 7217098.pep
VFPFRGTFTEKTSENPDLYGPFWTCTTLIFVAASIATFVTYLSHKWHKKEWNYDINLVTWSAGLFYGYVTFVPLLLYVILKYFSAPAGLVQLWCLYGYSLFIFIPASLLSIVPIEIFRWVIAGVAGFMSATFVAVNLRAHIVNSGERWFLIVAGIFLLQLGLAVLLKLYFFTITV

SEQ ID NO: 59133 - protein, 186 aa, Sorghum bicolor
  Clone ID: 7217106.pep
VLHPDVLEKLQAEIDEYKNTHDEYDLVSLSKLQYLQACIDESLRLYPVVPSGVPRMTPPEGMQLDGVYIPGDTIIHNPSYTMYRDERCFEKPNDFIPERWTTRPELIKDASVYAPFSTGRGVCAGKQLGLMEMRYVLMDILSRYDIAFAPGTNPQAFIDGLRDCYTLELPRLDMVFTPRTEGNIKA

SEQ ID NO: 59134 - protein, 127 aa, Sorghum bicolor
  Clone ID: 7217112.pep
TPARRTCRSAAVGVGILRPDWLRPGSVYLGRRDAGGFDCHVWAKADFITYYEDVKTKRPVKWVFYTGRIAYVMSFEVGAVLEDAAWQAPEYCFTKDGGGLADAAETTTEISDGGHHGSSSFIPRSVL

SEQ ID NO: 59135 - protein, 102 aa, Sorghum bicolor
  Clone ID: 7217114.pep
MVKPHKCDRCPRSFEKRHQLNRHIRWHEKPEKCPKCPYTAQYKKGITRHVWVHHSKWAENTNYPSIQETCKICKTILQRPDYVKRHMKEVHRGIKRQRGPRG

SEQ ID NO: 59136 - protein, 118 aa, Sorghum bicolor
  Clone ID: 7217117.pep
GSRIIGASFPFSPTKIKRNVGTSGLFDQLMQEPFSRTCTLAEPPGHFQVECFREARSHDDFQQLLIPPDAATGLSPRPDSRWHLVAMSSCDGAGHEASPEPLCSILLGRLIMIECKVP

SEQ ID NO: 59137 - protein, 216 aa, Sorghum bicolor
  unsure (1)..(216): unsure at all Xaa locations
  Clone ID: 7217120.pep
NIRLCDMRTSSDQNQXSKNFNDENSNLNKTVFANSLLSVHDINMNLSNNYTIATRHYLSVHLWDMRKQNEPSNKFLVYEPVINKLSYLYQNNYLEDKFSLSIDKDGKYILTGGYNNMFHVIDIEQKLNTQIVIDDTNEKLMNTNVIRKINSKGSCFYKKDDPSLNNINFDKKILHQAYSPVDNFSLLILYNCIYSYSGTIKESASSSQKRAANSHN

SEQ ID NO: 59138 - protein, 168 aa, Sorghum bicolor
  Clone ID: 7217121.pep
DFIKINWEHEVEDYVKTFEVNTAGYWYTSLAFMKLLHLGNEKKNVPQRSQVIATCSTLGFGRLAPTARFAYGQSKAASTHMMKQLATSLVPYGIRANILAPGLFMTDMTSVMTSTSYDVGKLVPEGRAGDDQDIAGMILYITSKAGAYLNGSVLVCDGGRLGVVPSSY

SEQ ID NO: 59139 - protein, 44 aa, Sorghum bicolor
  Clone ID: 7217122.pep
SKGPKGKGNPPFLYNQTIQRGSHLKTSFHGKYFQFVFFKQMAIN

SEQ ID NO: 59140 - protein, 80 aa, Sorghum bicolor
  Clone ID: 7217136.pep
STKNGHFTCISFQLTSHTFVMPLRLHGQLYVVLSRASTRLNIKILAVPPDEKVVTKGKAKKKPTKDVFTKNIVYKEVLTA

SEQ ID NO: 59141 - protein, 100 aa, Sorghum bicolor
  Clone ID: 7217137.pep
VLKTENEFRYGYKVVEKGNIRSALTTSNVIELPKKDELKTVVDKVKDFFGDVTAGAKESFAQITGSAVSKEEEEAENKEKFRSKRRKKQRKSKEGLKTEK

SEQ ID NO: 59142 - protein, 80 aa, Sorghum bicolor
  Clone ID: 7217141.pep
SRVRMLKGVAQEINSEAKFQNNFLHELQMTLAKAQAGVKNNMRRLNKSIIQQGSNHVLHVVLFALFCLFVVSLLSKFSRR

SEQ ID NO: 59143 - protein, 128 aa, Sorghum bicolor
  Clone ID: 7217148.pep
AIATLWDSLHFGGMGGSGRKIQKMLGGPRQSGNLSKKALAGASITSAALMDATEIFRAKQTPAALAAALATGAQVGVGHHPLAIAHWASLLVVNLECFARPKLADATLALALGAIKRLEGNGLSAVAR

SEQ ID NO: 59144 - protein, 217 aa, Sorghum bicolor
  Clone ID: 7217237.pep
TPGQFVTLQCDVGDKYAARRHYTVVSRPGDDHLAIAVRAVPPASEGVPAGLVSNAIADRVQVGDVMKLMAPFGGFESKAASLAAEGRPVVLLSAGIGITPIQSFLHDFREAGCPLVVSVHQDRSPSSHPFRDCHALAHRSFVRYSTVDSDDFPMGHLCADDLRHVFDECRIDPKAAVAFCCGPASFMLDCSRYLKQLGVTAFHAEFFGPQLSTSLEI

SEQ ID NO: 59145 - protein, 75 aa, Sorghum bicolor
  Clone ID: 7217239.pep
PRQLLLLPWMYPPPAHPHRLITVPHQEKVHRCCNLDIARLPSACDLPDRVVDSGGCEDATATYKGPVNLVACLVA

SEQ ID NO: 59146 - protein, 180 aa, Sorghum bicolor
  unsure (1)..(180): unsure at all Xaa locations
  Clone ID: 7217258.pep
ITVFKALSVTATKKQADFDKDILSGLNKAGFKTDAGPDDAGLLLKYFQRGGGYYIDVGASQLIADGKIKVKHGQEIETVLPHGLRFADGSELQADEIVFATGYQNMRTQPRVMFGDAIADKVNDVWGFNDEGEMRTIWQKSGHPGFWYHGGNLAMCRYYSKXLALQIKGLEEGLYGYDDI

SEQ ID NO: 59147 - protein, 84 aa, Sorghum bicolor
  Clone ID: 7217260.pep
ARLSIGALALPEPEPSDDLHWKPRSLRHKNAGCHPATSPWNSGSPLVVLGAFFVGRNPKDSSPFLRDPQRRSGPCMHNTPHKLH

SEQ ID NO: 59148 - protein, 131 aa, Sorghum bicolor
  Clone ID: 7217265.pep
LTIKDLSALQCLRGLEYLKMVEHNTDRFCNGVFIVEKKGFESLKSLCIDAPKLPKMQFKEGSMRSLTSLYLLCPNSQLPSGTIEGISHLANLSEVMLHSSMEKAWETVANGHPNRPCVKRQPAEPIGITAA

SEQ ID NO: 59149 - protein, 163 aa, Sorghum bicolor
  Clone ID: 7217270.pep
MAAENYWRYADARQQQQAMVAAAAAAAGMPPAATQAAAAAPPLKRARPDFGDVCGGQDMTGYYPRETDRAGYHSLRDNDAIGASYDRYLRNGMASVGANDTTRAAGMGAGMGAGMAAGMGAGMGAAMGAGMAGYGVDDRRMMGVGMGYGGRPEPPLPPDASPT

SEQ ID NO: 59150 - protein, 116 aa, Sorghum bicolor
  Clone ID: 7217280.pep
DADSKAEIREECPPPLKFKPGPSSSDPDHDIRMSIADVLQASMEDELFAARESGILAGGAGTSRRCPGENSKGGRNSRRAPQDAMDTAPAMKRLPPAGRSCFSSKSGRGRDSDLPM

SEQ ID NO: 59151 - protein, 71 aa, Sorghum bicolor
  Clone ID: 7217282.pep
FRTFPSVRRLFSTSESKTQDPHIFLFSTVLLDRVIKAFVALFVPVWLVLPTIILQASSGSLPRSIVFAFFI

SEQ ID NO: 59152 - protein, 33 aa, Sorghum bicolor
  Clone ID: 7217283.pep
KDWNTIYRIKKKFSTCIKLVPMHYQFLITIQRL

SEQ ID NO: 59153 - protein, 61 aa, Sorghum bicolor
  Clone ID: 7217285.pep
LFFLVKHMHPKKKYFRTNIFLRAMINPKLIGGPLTLKMKKLNHPWHLVLLKKKTSLVDSTK

SEQ ID NO: 59154 - protein, 177 aa, Sorghum bicolor
  Clone ID: 7217305.pep
GTEFYVHHKELESDGFNSHALIYAPVVVFFRDDNGRTVAPSKASVVTSAAVNRGVVYQHFEPSSNLEQRIEDVMRERMGRILRLFEECGDRHLVLGSFGTGVFQNSVKTIATIWADLLVGDSARFQKSFEQVIFAIKDQATFEEFKEEFGKRVQTVSAVPVNSPLGTLDIDSDPDQD

SEQ ID NO: 59155 - protein, 38 aa, Sorghum bicolor
  Clone ID: 7217319.pep
PVAVGRGMKRPPTCAPRLVRWWCLQALASNPGAAAGIN

SEQ ID NO: 59156 - protein, 57 aa, Sorghum bicolor
  Clone ID: 7217325.pep
EGRWQTVMVLDPEDPEHKRLIEKKIHKEEYEGQDLWKDMVAAEERRLAAKKQAESKA

SEQ ID NO: 59157 - protein, 140 aa, Sorghum bicolor
  Clone ID: 7217330.pep
MDTNLFKFLMGIIGTIGTCFIINRILNRVVLYKSSTAQPWGWSKEIVLVTGGSGGIGSAMVHKFSRRNIRVVSFDIHPPRSTLSTNAHFYKVDVTSPHSIHEAMDQVRRDIGDPTVLINNAGIALGKDILACTADQIQQM

SEQ ID NO: 59158 - protein, 127 aa, Sorghum bicolor
  Clone ID: 7217333.pep
MARPRKDVKFQHQVRSASNGRTRRPSQSMSEFSDPGSPTIKEEPAPPASEQPPQSEYEKKKANFITRTIWTLVMIAAFFWALGAGHLFIIIMVTAVQCISFKEVIAIANVPSKARSLRFTKSLNWYF

SEQ ID NO: 59159 - protein, 161 aa, Sorghum bicolor
  Clone ID: 7217334.pep
EMEEVVMKRCWLARYWGLAVQYGIYPDISMSKHEYWSSLAPLPFEYVTSAGQRAKNGSETESNGLEDVDKLVHDLTVTAGEGNVETMLAVDKGLQELAFLKVEDAVLFALAQHHRSNVAGAADPDIKSSGDEKFTEAFDLSKEEEEDVQFKQAWLIYFWRR

SEQ ID NO: 59160 - protein, 126 aa, Sorghum bicolor
  Clone ID: 7217337.pep
ARGRCIKDLEERFSKVKLVVSDPLVSFKETIEWEGVSLVESLKNPHEFVERTTPNGMRTVRVQVLRLPNALTKVLEESEHLLGQIIDGKTAKRDGVLDPRLSQEDGDSAATLRQRMIDAIDSELDT

SEQ ID NO: 59161 - protein, 127 aa, Sorghum bicolor
  Clone ID: 7217349.pep
AVSSAFLAAVLALNYFAFAFAFAFVLLSTSPAVCGRNLASGAVRTRLVRQAAEIACDASRVPSHCARGTPGRRAIKSAASHRSRWCVMRPASLKESLVVTGSFMCSGLRMAKDVPGMASAGWSDPRA

SEQ ID NO: 59162 - protein, 176 aa, Sorghum bicolor
  Clone ID: 7217352.pep
TRAIFTWHGATVELDGVSESEYSSDETPMVIYVNTHAILDARRARARAAAAQGGDMEASQGPRVIVVGPTDSGKSTLCKMLLSWAAKLGWKPTYVDLDIGQGSITIPGCISATPIEKPIDIVDGIPLEMPLVYFYGHSSPSINADVYKVLMKELAKTLEKQFSGNAESRAAGMVIN

SEQ ID NO: 59163 - protein, 148 aa, Sorghum bicolor
  Clone ID: 7217357.pep
ARGNSGVMVIEPSACTFDALIRDRRTIRSYNGGDQGFLNEVFVWWHRLPRWVNYLKNFWANTTGERALKERMFRADPAEVWSIHYLGMKPWTCYRDYDCNWNVADQRVYASDEAHRRWWQVYDQMGETMRGPCRLSERRKVEIAWDRH

SEQ ID NO: 59164 - protein, 177 aa, Sorghum bicolor
  Clone ID: 7217361.pep
TRKKRKQAQAQAQSENPQKVAKTTSPSIPTPPPDGTTTHFEPKNLHTVVSEEELEITIDTLNSLAQYPGLIKSKLCKDLRVAVYDFRQACTTGVNNAAGANLTAQVTAALADRKYTEARILLAEMKIRGEQPKLGALCRWVRDLDVISGLSTIPDQQGLVKRSEREETLIKVIDAVL

SEQ ID NO: 59165 - protein, 71 aa, Sorghum bicolor
  Clone ID: 7217365.pep
NLIMDLYGVLLWSISSSQVGTKKCPFWFSCKIVVLANREPSSLTLLQRYMCMLFSRKIKFELGSHCRLFLV

SEQ ID NO: 59166 - protein, 130 aa, Sorghum bicolor
  Clone ID: 7217371.pep
TRERPASSMGFRQQQPSPSNVGYPHDEFEEEEEQPDPRLIRRASRSKRPQQNDQDRRRMPPPDSIPRPKSAMPPPTTPFRPPPQSLTRQKTMTPSRPPPSGRIRVGFVDQGYDDEDYNDSPGLFADSPEA

SEQ ID NO: 59167 - protein, 79 aa, Sorghum bicolor
  Clone ID: 7217376.pep
FLLRLQPHEVPGGALRRPPPLPLRGSGGRSAAEDTPAARIWPLDVAASAERTSGGRRSLGVRSGRSVEWRDPRRAISSC

SEQ ID NO: 59168 - protein, 97 aa, Sorghum bicolor
  Clone ID: 7217378.pep
SDPSNIETTILHTRYVGPSLAFLLFKTEIMYLDLSYFVICTRFPIATGEWQHVGHAVNGVAAKCTRWILSRRRYLVSVLVIYENLIICKYLFCIEFN

SEQ ID NO: 59169 - protein, 124 aa, Sorghum bicolor
  Clone ID: 7217385.pep
HEGHITTTTTDQENSLAISAGELYEIVKDVKLLDQPSSLILLRESQQSQESLSSPFIRMTATPHGLDNDQLDFLAVLCTLVKILFVEGGNLPLIHSLVQRIEPARAGREIHTTSIRNEHAYYCC

SEQ ID NO: 59170 - protein, 64 aa, Sorghum bicolor
  unsure (1)..(64): unsure at all Xaa locations
  Clone ID: 7217386.pep
LFQLSSKCDNKLFRIQFSTLHMQRYPFLEAYSKPIRCISRSRTVHPLXPXKRASSATVDETDLL

SEQ ID NO: 59171 - protein, 66 aa, Sorghum bicolor
  Clone ID: 7217390.pep
NSWPWISIACCVRCFRCLDSSPCVFLGYLDSAEEGRRPHRMALTGNSLLPPCNCRFFNPRSCLAAM

SEQ ID NO: 59172 - protein, 150 aa, Sorghum bicolor
  Clone ID: 7217391.pep
MSEDYANNPEWADVTPIELDDGSESGAMPLATIAYPSDYLEATSYLRAVMAANEMSERALKLTKDVISMNPAHYTVWTFRAKILFALDKDLLEELEWLNGVSLKYLKNYQIWHHRQVLISSQKHFPTMPAKEPEFLMEMFTQDSKNYHVW

SEQ ID NO: 59173 - protein, 85 aa, Sorghum bicolor
  Clone ID: 7217397.pep
PDGSDVVFLFGEIDCREGILLAVEKCRYDSVEEGICHTVDIFLTLLDTIIKTKKIRAFIHPVVPVLNETRLMVKHFNMVFERKVR

SEQ ID NO: 59174 - protein, 75 aa, Sorghum bicolor
  Clone ID: 7217414.pep
DIRKSIARVLTVINAKQRAQLRLFYKNKKYAPLDLRPKQTRAIRRRLSPDEKSRVLEKTKKRTVHFPQRKFAIKA

SEQ ID NO: 59175 - protein, 159 aa, Sorghum bicolor
  Clone ID: 7217427.pep
TRALTSKLLISKHQQVQLLEAASVLVTMNGVENSADTPPESTKDFQSEAGSSSPAASGYSDPAERQSSADTTPPPFAEGVNVDGTSYRNKRFSSNGGYATSFQSASAASFGAGSMPYGSGFGHYRQPSHEHRPGSSGRNATGEDDRDLAAAVELLSCSF

SEQ ID NO: 59176 - protein, 63 aa, Sorghum bicolor
  Clone ID: 7217439.pep
MPGVDATITTDDTIILGQDPLIPPALLISEIPMTATAVETILKGRTDAANIVMGQDDRLLVVV

SEQ ID NO: 59177 - protein, 46 aa, Sorghum bicolor
  Clone ID: 7217441.pep
ITYEISAMLLHPRRIVFQKNSAQTYFIFLENKSAQISMQEYLPNVN

SEQ ID NO: 59178 - protein, 44 aa, Sorghum bicolor
  Clone ID: 7217447.pep
FTVRLGCLLEGMRFSVEDIFVSFSAVVNELVNRMSALPRFVPRA

SEQ ID NO: 59179 - protein, 113 aa, Sorghum bicolor
  Clone ID: 7217449.pep
HEGQAHRAIERARAVPNKDHPPTHYQPRFLSVSPPLARGGRRGSEGGKRGLGGATRRRRPAGLGMRGVTHAAPTGSAPCPLRGRLVMDGLLIFVFYLSLPIRGGRDHSLISNC

SEQ ID NO: 59180 - protein, 141 aa, Sorghum bicolor
  Clone ID: 7217450.pep
TRIPISVVADSYKASHFTMYPDSRKAVAYGEFRKPFGGDKSDNRFVFYGIRYLVENFLCRKWTKEDVEKADLFYSTHNAGHTPFPFPKHLFNKFVEENNGYFPVKLQALPEGTCAHIHVPVYQITAEKEYTHLLTYFETLL

SEQ ID NO: 59181 - protein, 61 aa, Sorghum bicolor
  Clone ID: 7217487.pep
TLIIPGKPQQNPGYKANFMHMTTIAFLAVNNNKASSIWKAYLSCCISSRMGWSSQVTQFMP

SEQ ID NO: 59182 - protein, 162 aa, Sorghum bicolor
  Clone ID: 7217491.pep
TRLRQPACQLLRRSALDFRSRTIRPAARAFHASTPRQDPLIDTILYLPHELISVIHTTVPWYAAIPLSAFVARGLLVTTAGTRARALMARYIGLHPLRQALAFQKRDEILKRGNFRSTKQALVTVKKEVKDVTSALDKRWNVSLSGQISWTLAQIPIFFAMA

SEQ ID NO: 59183 - protein, 125 aa, Sorghum bicolor
  Clone ID: 7217492.pep
MTHLAWNCRGSGGSLRSSTMAHLSRLLVYTRAQVCCISETRNSSITKTSITNHFNLNDAFVVPAQGQSGGLWLMWNNEVDITVIDHNHNFIFALCINKTSMRQYGLVCIYGDPHHRTTRAIWEQC

SEQ ID NO: 59184 - protein, 152 aa, Sorghum bicolor
  Clone ID: 7217499.pep
TRPRAFYLGGYGHRPFPLGYYQGFPVPQYSYPSYGTEYIYPQGTLNPYSGQQYLPIYGVSAAANTGNQTFSQLSPSISGGGNGYLSVHSYNMPGNQYVQLTGSNFSSASPTARPSIQTPFLVATPVPAHPHLIIPAPSPQFTQASGSDQRAS

SEQ ID NO: 59185 - protein, 47 aa, Sorghum bicolor
  Clone ID: 7217538.pep
NVLVCYFVNYLCYISLFFGSYVILLFLATLEYSMFCADIPLVSLTFY

SEQ ID NO: 59186 - protein, 159 aa, Sorghum bicolor
  Clone ID: 7217544.pep
TRWKPRFFVLKGRRLAYYYSEDDDQEKGLIDISFHRVLPADNEKLTGLHATITSLGGQSMPASQNGDDNLEKGDDSIFIFKLVPPRAGLSRAVNFTKPTVHYFAVPNLKQGRLWMAALMKATIDRDDTKPITTTYQQKTISLSKAKQMRHRPPALMNLD

SEQ ID NO: 59187 - protein, 178 aa, Sorghum bicolor
  Clone ID: 7217545.pep
NHGLLQHASRMSTSPPVDAHSPHGLTRTLHQESSNQNSNHNLPELDMPQNLQSPDTPGHDELYFGSITERSPRRPVGASPDTYTHTTTTKPAHEPRPSLGGFDFGTGNAYTQNDHAEVPTAHETISTSHPVGLPRLSLPMSETSDYGDEPKSNLPPANSMPEPEHHDQRESDHPHPAE

SEQ ID NO: 59188 - protein, 81 aa, Sorghum bicolor
  Clone ID: 7217552.pep
FGDPAVRVHEIECFSSKTAGYLAVCTVHCMRALDLKTAHAKCKASTEPSAPIRPFSWVFLSPRNDEHRPAGGHPAANQQCH

SEQ ID NO: 59189 - protein, 174 aa, Sorghum bicolor
  Clone ID: 7217553.pep
MKFVVAIFATTFLFFGICHSQDTVQTPNGKLKYDEDWGYVTVRQNAHTFWWLMTVKSDPTRPLILWLQGGPGSDSTGFGNIEELGPKDINLQDRNNTWLQVADLVFVDNPVGAGFSYVDSNSAFTTNVKQIGQDLMVWAKAFFKKHPEYQTRDFYIFCESYGGKMSAEFGKQLQ

SEQ ID NO: 59190 - protein, 104 aa, Sorghum bicolor
  Clone ID: 7217555.pep
RWAQWRFTDGTSCLATDAAVAPKAENTRRYGLEPYPPKTRWVGLLIQRFFSLASYFSLILTAKDCGRALCDERRCGRARGAAGDEPASMRAARPTSEDASGASC

SEQ ID NO: 59191 - protein, 105 aa, Sorghum bicolor
  Clone ID: 7217560.pep
TRGMRPKSSALTPPHDPHAGHLPPPGLQDVLNLDHDGVNSVVRPSASSSFTACPTGADRHIAINDTSTDANPKSGRRHPRSSPRRRPQLLGSATMPPRPRRRARS

SEQ ID NO: 59192 - protein, 170 aa, Sorghum bicolor
  Clone ID: 7217567.pep
GAQPDHGVRRGELTEREAWNQAWSINTASTQVMTTTFMPLLLKGTDPRLLFMTSGTSTLAGSENQALAVNKYPPKGWPKPFYGVPAYRAAKTGLNMLMREWHKNLHEDGVKVFGISPGFLATGLGGMTEMSKKMGAGDPEIAGPFIKSVIEGERDADAGKVILKDSIQPW

SEQ ID NO: 59193 - protein, 78 aa, Sorghum bicolor
  Clone ID: 7217570.pep
RHAFPEDGDPPVLLMELVVFKNYDFFFLTKKVFFPLPKLKKPFRPVNKLGSVLPFLGPLTGWVVFWFFGPFPLVPLEI

SEQ ID NO: 59194 - protein, 71 aa, Sorghum bicolor
  Clone ID: 7217571.pep
MALRYLEYYVGEEETSLKDKYPRDHVVFRDPMSLHTQGWQALAQTIMKQDVAVNLTKFRPVLLQALDKLQQ

SEQ ID NO: 59195 - protein, 141 aa, Sorghum bicolor
  Clone ID: 7217572.pep
SSLIAASTRHYLLRSIINDHPTLRSLVLTDADGQGTLCMGAEQLKEFRENQLSASACSNRTQVPACNMKLKYAPYLELPGGMALQGATLVAIKPSPEGSNGGHPNRKEADGFVFGAFDGPFKAAVKALMKRRTYLLEMNGF

SEQ ID NO: 59196 - protein, 54 aa, Sorghum bicolor
  Clone ID: 7217583.pep
RTTPPETMLRRKFLSDGEIPGAGSGTLGSTSAAATGAGAAHSLAGCCFCCADPR

SEQ ID NO: 59197 - protein, 77 aa, Sorghum bicolor
  Clone ID: 7217600.pep
PYLHESRHLHAMKRARGTGGRFLNTKQQPESPGSGSGGGSSDAQRMPMNGGGLFTKHEHSLPPGDRHHYHARGGGGA

SEQ ID NO: 59198 - protein, 95 aa, Sorghum bicolor
  Clone ID: 7217602.pep
FSSKICVAISHYLDGLFLATVCNLLGVMMVYKYWDSITKEDLEFSVGTRMNNWEVKELLPEEDRRATVFSEDPYAQSSSYDLPYSPGAARYSAKY

SEQ ID NO: 59199 - protein, 88 aa, Sorghum bicolor
  Clone ID: 7217604.pep
LSRFQAPVLAFAVTPLIRQEYKKPGLEDIKEVELFIWSRHSHQRCMLYYEPDSVSISHCGKFSAAVNVYDVISIGHRCALIFFLLSYF

SEQ ID NO: 59200 - protein, 127 aa, Sorghum bicolor
  Clone ID: 7217611.pep
MNEGLGSGKVENGKYLKMYLKEELPTRLHYSESYRIPPIIGLVEEGYKIEMKHSKKNECGGAHGYDNAFFSMRTIFAAHGPRFQGGRTVPSFENVEIYNVITSILNLKPAPNNGSASFPGTILLPSK

SEQ ID NO: 59201 - protein, 91 aa, Sorghum bicolor
  Clone ID: 7217612.pep
SISSAWAIRFFSTKHFEKKTYDGSVMANAWLDSLYGVWVGYSGGRTGSTFTTFAIRRWNVRLLGSSSIFLFFFLCAFLFSYFSTPLHDVEG

SEQ ID NO: 59202 - protein, 149 aa, Sorghum bicolor
  Clone ID: 7217616.pep
LFIQDFTHKRTTPYAVDSKKMTSLVSESGAAIQNCYARLTSKLGETPGEVDYATLDYAALEVEDYAELLRIMAQYPDTAQASFKTLEPSLIISYLLRLVDQVMMTLDDDDEQDWADKDETNKARMALYENARQVFENGLRVLCVSPYSS

SEQ ID NO: 59203 - protein, 54 aa, Sorghum bicolor
  unsure (1)..(54): unsure at all Xaa locations
  Clone ID: 7217622.pep
YTLVCIYFGGCFIXGHGLTIGIFSYPIRFWSKGTKRAFFFPHEGFLGSKGAWIK

SEQ ID NO: 59204 - protein, 203 aa, Sorghum bicolor
  Clone ID: 7217623.pep
PFSIYVENGATFPLSNKSTWDNDVARDLEKIRAALRLVTSADKWLDGYGATLNLPTNVNILSMRGPSSWAKFGNGDAKVRYDTWTQALVYDGSNTLTTTHENATQGYNSVKWGSLVNNRPYRFSVEGSTGISLTLNIIKADKTLLATSGPLINGQGWNFNYTPNTKLYMRVIKSPGGPGSIRGKLVHNTVYTIPYQGNNTLPF

SEQ ID NO: 59205 - protein, 136 aa, Sorghum bicolor
  Clone ID: 7217626.pep
NRWRYRHTNYIFRNTGGEYIERKGRGCLEAGKGPLYEFGPMRSHAIPHRNRIRYDHTASPNFNQVNWGGGGTGESLNRKGSPLGTTTRDETDSPKPVFKSVDWNAKGHPERSVSPRGTTSRLVSDQDLLMRMCADT

SEQ ID NO: 59206 - protein, 203 aa, Sorghum bicolor
  Clone ID: 7217634.pep
MAPAAAPEPQFKKDEKALCFHHELLYEAKVLEVAPVDEDDKKSGFQYKVHYKGWKNTWDDWVAEDRLRKLTPENRELANNLRHEVLELQRAARAQPPPSKKKPQGSVRDSEERLVPAQSNGPRGQKRVRDQELEKEEVFQSRRAVRITMPDRLKSLLVDDWENITKNLSLVQLPVKVPAAHILDAYYEFASAPGTRSSAEKDI

SEQ ID NO: 59207 - protein, 156 aa, Sorghum bicolor
  Clone ID: 7217714.pep
ARGAGGDPVFPENLFRFGDYDGTGSDVLLQHPLGVAYASDNQVYIADSYNHKIKKLDPVTRKVTTIAGTGRAGYKDGPGLAAQLSEPAGLVEVGDGRLLVADTNNNTIRYITLSDKGAEVKTLELIGVQPPSPKPKALKRLRRRLSADTDVIIVDG

SEQ ID NO: 59208 - protein, 161 aa, Sorghum bicolor
  Clone ID: 7217719.pep
TRQPSALNSFQEHSLQSSVNTLRAVIAAAAQPTAGKIADVFGRVELICVSVFFYTIGTVIEAVAQNLDTYSAGAVIYQIGYTMILLLVEVIIGDITSVRSRLFFSYIPALPFIINTWVSGDVAEAVLGATTWRWGIGMWCIIYPVCSLPLIISLLVVGHRA

SEQ ID NO: 59209 - protein, 113 aa, Sorghum bicolor
  Clone ID: 7217721.pep
TDNDTKANEILRIIEQYGLNYERTGKWDGFETFLPIVKGQVERKEPVRMLLPGFPFKSPNTKDKVLGVLPDLGEELALKHLDGLCEKINAVYEHGAECHITSDGLVYNGVLIQ

SEQ ID NO: 59210 - protein, 159 aa, Sorghum bicolor
  Clone ID: 7217722.pep
TRLNPRVVIPLIGEVDLKEWLELRPGMMGWIIFNCSWCAQQYRNYGYVTDSSICITLVQAVYVFDSWWNEPAILTTMDITTDGFGMMLAFGDIVWVPFVYSLQTRYLAVHPVSLGPAGLAVMLSLIGLGFYIFRSANSEKNAFRTNPNDPKVSQLKYIQ

SEQ ID NO: 59211 - protein, 75 aa, Sorghum bicolor
  Clone ID: 7217730.pep
KHIPCVVESDTTTLPPMPQNKKQKPMSQVLKPDHVNLSRTHLVNTTLHKLYKFLKKKKEHSKSKQITHRICEKAD

SEQ ID NO: 59212 - protein, 62 aa, Sorghum bicolor
  Clone ID: 7217731.pep
HEAADTVTANVLALSRAGGLVVAVVATASARLDLVVAGSGSSDGSGGHGEDGGDLGELHPRA

SEQ ID NO: 59213 - protein, 102 aa, Sorghum bicolor
  Clone ID: 7217732.pep
GSSQLIFRPEFGAGPLVLLGFYKIQLPASVYSILQRGSGAFPSPLPIRIKSTNPTSMKQQVPSSNGHGSSIHSKSPVPQTRTSRAPPPKVKQPPATPGPGVK

SEQ ID NO: 59214 - protein, 137 aa, Sorghum bicolor
  Clone ID: 7217735.pep
MALRSPELRWLGSLTRPGRLAPSPLAALASPRRRRRAPSPSQPPSSPSPSPSDSSTPSTAPASAGAPGAEGLDGPEWKKVSAKRFGIKESMIPAEAWNVLHRLRSRGYDVYLVGGCVRDLIMKKTPKDFDIITTADL

SEQ ID NO: 59215 - protein, 80 aa, Sorghum bicolor
  Clone ID: 7217740.pep
RTRRVVVSILLLEVRAGVLGLVLDVVALVVLAVGGLDKDRLVGVVAETDGVLVFAHLDVRALNAATVFIHGGTLDAAASC

SEQ ID NO: 59216 - protein, 160 aa, Sorghum bicolor
  Clone ID: 7217741.pep
HEASESVGEGHPDKICDQVSDAILDACLKEDPLSKVACETAAKTGMIMVFGEITTKAHLDYQKIIRNAIKDIGYDSSEKGFDYKTCNVLVAIEQQSPDIAQGLHYEEALEKLGAGDQGIMFGYATDETPELLPLTVLLSHKLNAAMTAARKDGSLPWLRP

SEQ ID NO: 59217 - protein, 157 aa, Sorghum bicolor
  Clone ID: 7217745.pep
TRDFTRNGQRSVETVEARFTRNGQRSAEPEPFTRNGQRSVEDVDEEEEEGELEARFTRNGQRSVEARFTRNGQRSADPEPFTRSGVHKRSVEDEAEEEDEEQLEARFTRNGQRSADPEPFTRNGARAAEAEPTPFTRNGQRSVEARFTRNGQRSADP

SEQ ID NO: 59218 - protein, 155 aa, Sorghum bicolor
  Clone ID: 7217746.pep
RLTRDRFNPSTCKLEQEQEQVENCEVKHSFQDSNTAQTNETHEHIRECITASHNSTCESEQEQVKTCEVEYCIPDSNTARTNETHEHIRECVTASHNSTCESEQEQVKTCEVEYCILDSNTARTNETHEHIRECVTASHNSTCKSEQEQVNNCKG

SEQ ID NO: 59219 - protein, 109 aa, Sorghum bicolor
  Clone ID: 7217754.pep
GGLQPSSRLQAFHCPGPVRSGQLRGFTHKLTLPLLRKAQRGIPQAPAGHSRSTEHGRLLLSNLLPGRLRPPRHASGQGRAAHLAHAPGRRARRQPPPVRPGMRLPGARR

SEQ ID NO: 59220 - protein, 128 aa, Sorghum bicolor
  Clone ID: 7217755.pep
HEEHFRSLRDGVAAQMQVVRRALGEKDADGGVPAAGGMVKGETTPRLRVIDQCLRQHRAYQAGVLESQPWRPQRGLPERAVYILRAWLFEHFLHPYPSDVDKHILARQTGLSRSQVSNWFINARVMLW

SEQ ID NO: 59221 - protein, 185 aa, Sorghum bicolor
  Clone ID: 7217758.pep
MASVYKTLSGAEKEEKDVGVKRNKQRVLILSSRGVTFRHRHLLQDLYSLMPHSRKEAKLDTKTKLYQLNELAELYNCNNVLFFEARKGKDLYCWMSKPPNGPTVKMHLQNLHTMEELNFIGNCLKGSRPILSFDAAFDKQAHLRVIKELFTQIFGVPKTSRKVKPFVDHVMGFTVADGKIWVRVF

SEQ ID NO: 59222 - protein, 119 aa, Sorghum bicolor
  Clone ID: 7217773.pep
MAAIQLNFTLRTSSNCKTVHLLGSWDGYQGQLPLSKDPKKSGGWVGCFKFQGQTLKQGQRYWYYYIIDGYHVSHDPAKDHTTEPTTGRKLNIIDIPAAKSSSKTSSSSADRKSRRVSTA

SEQ ID NO: 59223 - protein, 143 aa, Sorghum bicolor
  unsure (1)..(143): unsure at all Xaa locations
  Clone ID: 7217774.pep
MVFSIPRVVTTLGLLLPTVTSLALSYEDRAPQTPSVPWKDTGLFSGHVKRSGYNTSCNNGPQSRDCWYGDFNIDTDMDIEWPDTGKTVKYHLTITNSTGAPDGFERPMFLINGQYPXPTIVADWGDNLEITVTNNLENNGTGI

SEQ ID NO: 59224 - protein, 162 aa, Sorghum bicolor
  Clone ID: 7217778.pep
AHENDLDVAAGFFAVCREYTPMGINAKPIERSTPVGSTTVAPSSPSVYQTMYRSIFERKPTPGPLDNNSNSTSQRPKNAGNVFYVVLRHGHLMLFDDEEQVEVRHVVSLAYHEISIYSCGDVTPEGELFIKRNAIRLSRKQAGTELTSDSPVSKPFFLFSEN

SEQ ID NO: 59225 - protein, 62 aa, Sorghum bicolor
  Clone ID: 7217780.pep
MEQALFQARDGRQHILNEMSKSSPPPSKALSAYAPLIHVMKVKPNKVNLIIGSGGKTIKSII

SEQ ID NO: 59226 - protein, 128 aa, Sorghum bicolor
  Clone ID: 7217788.pep
ARGQRPTGDALITSEDPNHPANLIPSLCAKFWTLGWVTGTGGGCSIRDDDLVYIAPSGVQKELMKNTDIYVLALSEQDPNHNKLNQRTYLRSPPCYKPSQCTPLFLAAFTRRGAGCCIHTHSQWAVLV

SEQ ID NO: 59227 - protein, 150 aa, Sorghum bicolor
  Clone ID: 7217795.pep
MTEFLVIALLLCHLKDGAYKTTAWDDADFFSNCPPSRCSEHGPEIRAMAWDDADFFSNCPPSRCSKHGPEIRYPFRLESSNTSSLCGTPCMKLGCYGDDTILVLPTAVIHYKVTAIDYRRGTLTLAPRVDDSSSSCKQKLMSVSLPASII

SEQ ID NO: 59228 - protein, 151 aa, Sorghum bicolor
  Clone ID: 7217797.pep
TRLLTTGWSAFVNKKKLVSGDAVLFLRGEDGVLRLGVRRAAQLKIVTPIPALHNQCSSQTTLGNVAQAVATRTVFHIYYNPRLSQSEFIVPYWKFTRSLNQPISVGMRCRMRYESDDASERRCTGIIIGSREAEPIWYGSKWKCLVVRWDD

SEQ ID NO: 59229 - protein, 132 aa, Sorghum bicolor
  Clone ID: 7217814.pep
MGISRDSKHKRRATGGKRKIHRKKRKFELGRPPALTKLGSQRIHPVRCRGGRIKYRALRLETGNYAWPSEAVTRKTRVLGVVYNASNNELVRTNTLVKSAIVQIDATPFRQWYEQHYGINLGKAKTVKTEAK

SEQ ID NO: 59230 - protein, 125 aa, Sorghum bicolor
  Clone ID: 7217819.pep
MSWWGKSKDPKPEEKKNEATQIKDTIVEKLPSKDQLPESIQKAVNKTGRDGNVFDDITNGYGPDSTDTNFRYAAYATRIRTILLSAHRYVAYTSDIGESFRPVAHPNLVRAAYGVSWLYLIGDVS

SEQ ID NO: 59231 - protein, 134 aa, Sorghum bicolor
  unsure (1)..(134): unsure at all Xaa locations
  Clone ID: 7217835.pep
MRHSNSSNISPGSGFFNTSFSVPIQNLMVEASRLYEQNEQKLQNLQFEKEQWSHMLQQKEAIIQSLNSARFEQQNKYQAELRRFEHDLNVMAQLVTTYKKALKQTRASFDEYRKKFPCNVPXYGDVAGGGGLVL

SEQ ID NO: 59232 - protein, 147 aa, Sorghum bicolor
  Clone ID: 7217847.pep
TRLELNLPGGKKKSKVELGVSDEKLGGAINDSLDHVGCVKSKAVAELTRGIRLHFAKFIKEFKEGDYEKAQLGLGHSYSRSKVKFNVNRADNMIIQTINLLDTLNKDLNTFSMRVKEWYSWHFPELVKIVPDNLQFARVVKFLKNKA

SEQ ID NO: 59233 - protein, 173 aa, Sorghum bicolor
  Clone ID: 7217867.pep
TRDKLINHIAKYGHGCWSSVPKLAGLERCGKSCRLRWINYLRPDLKRGAFSQEEEDLIIHLHSMMGNKWSQIATQLPGRTDNEVKNFWNSYIKKKLRQRGIDPATHKPLPLAADASRAAAAGSSRTAVFSDAELILSSTTTAAAGQHMPPPPVTAAAAESYDVYSNSYSRSSG

SEQ ID NO: 59234 - protein, 110 aa, Sorghum bicolor
  Clone ID: 7217869.pep
MSYMQDPDSVPATPDEFDDSNPASPGSDADSSEASTPYDPASSSSETAPSPLGSGLSLNDNPRRVPSLRTVSDPQNSTLLNSSSSVTGVLNNARRPTPSASALPTDLMAK

SEQ ID NO: 59235 - protein, 111 aa, Sorghum bicolor
  Clone ID: 7217873.pep
HEATNTSRRPSHSCPRAAAMARTLLQPNRADQATASSHSHTGAPVTSLLFLLLVVAAAVAAVVVSLCTSGKNAGPRKQRRSSSLAPAPQQEDGGGRNKQLLASFSGIGVKA

SEQ ID NO: 59236 - protein, 165 aa, Sorghum bicolor
  Clone ID: 7217880.pep
MPFSKLVKNDAYYSRYQVKYKRRRQGKTDYYARKRLITQAKNKYNAPKYRLVVRFTNRDIVAQIVSSEIGGDKVFMAAYAHELKPYGITHGLTNWSAAYATGLLLARRTLKKLELDEAFTGVEEADGEFTMTEAAEVDGEERRPFKVFLDVGLTRTSTGARVFGA

SEQ ID NO: 59237 - protein, 162 aa, Sorghum bicolor
  Clone ID: 7217885.pep
ARGRTPRAPKAKRTSPLTHVYESFEHTPKPTSSASPSSAISPKPARPATNRDDSDYNAIPDYSPPLDTLPKGNNKILKAEWKGQALSLADDPDRDMLHEAELNLAGTLRLNCATYLTSKRRIFQARIEALRIGKEFRKTDAQQACKIDVNKASKLWQSYDRV

SEQ ID NO: 59238 - protein, 113 aa, Sorghum bicolor
  Clone ID: 7217886.pep
AATASNAASPKAEAPRATPTIPLRVLLPPPIKNSSAAPHCAALPPTPAALQQHGASEVSALLLNALAPRSHAVAEADACLGPEGRRSGEAEEDAAAAMDSGERRGEDRGKPRA

SEQ ID NO: 59239 - protein, 134 aa, Sorghum bicolor
  Clone ID: 7217887.pep
MAPQPEKSQLKRPRGSLPDDETETKKPRRAERLEADPDKTPIVNKQHLPSPLTHLTDDSNELNKEPTATPPGQKQHEITPKKTEDTYSQGQALSSPPQDTQPLSQFVDRHPAISDDIEDEIREGVWGYLVPLDP

SEQ ID NO: 59240 - protein, 115 aa, Sorghum bicolor
  Clone ID: 7217893.pep
MATASGVSAGSVLQLPSLRVPAKRSLLPRRIAAGAPAGTFFVKRDVVYNRRSYHQFLPWKQRGGLQAAVLPVTSPLVDDEGERKQMAEDYGFTQIGDELPDNITLKDVMDTLPKE

SEQ ID NO: 59241 - protein, 168 aa, Sorghum bicolor
  unsure (1)..(168): unsure at all Xaa locations
  Clone ID: 7217902.pep
LVPTSPLSRWAVXGDKITLYTNHRCPWAHRAHIAIKELGLEYEEVIIDLDTPREPWYLEINPRGLVPAIKFNDQIITESGVVARFLADAYPSHLVPNTGSADAALTRARINFFVDTWFDKVGSYWFQILRAEDETKKEELVKEFLEKVGKEIEPLLKNAKPFFGGSSK

SEQ ID NO: 59242 - protein, 163 aa, Sorghum bicolor
  Clone ID: 7217919.pep
APKRRVLICDGWRTRWSCRKANRNHLSLDTLTFTLSMAIPELLGSVTSSQLWSFGALFLILSFIVDFASHPQYPSQIPVMGKGHGMLNALLDSFRYLTNYHRWVSDGYVKFGKKGLPFVVRSPLSRPSEVVIPRNQIGWMMDQPDHILSTYDAHNAVLYSEYN

SEQ ID NO: 59243 - protein, 135 aa, Sorghum bicolor
  Clone ID: 7217931.pep
TSFGMGSGRASTNAGNVILRGPGLLESLATYRHALGFYTAVCLSARFTATMPEGAHSATSLPPTFTIPRLYAALRQVITVHPSLSVGIEDEPLPSARYIRLASIDLERIVQVQTLPRGTDEAVRLRLLNELIESR

SEQ ID NO: 59244 - protein, 37 aa, Sorghum bicolor
  Clone ID: 7217943.pep
HEAGAGKQHQEISPRIHVFGTRAKQSGDGREGQDGEQ

SEQ ID NO: 59245 - protein, 150 aa, Sorghum bicolor
  Clone ID: 7217946.pep
HEAGLLARALSLYPGPDDALRAFSSSPPAARSDVSLSALLSAFLRAGRLDEIKSTITLAESSHGVAPGRASHNVLLHALVKNSELAAARKLLDEMANKKLKHRPAPDIISYNTVLAGCSVQDDEEGFEKLLKEISLSNLEPNVVTYNCRI

SEQ ID NO: 59246 - protein, 149 aa, Sorghum bicolor
  Clone ID: 7217959.pep
TRETMTTFEFLESGLVKSLSNYLSNGKYLQVENNMNCSSDHFLAVVKRFQSFARMSFSRMGQGWGDMLLTLLVSKLQNALTSVDNFPLIMSHNFKPRSSISDIPTRHSTITPCIRVRFKKDEDETNLSSYDSAVNVEISSSLHTIEEFL

SEQ ID NO: 59247 - protein, 136 aa, Sorghum bicolor
  Clone ID: 7217965.pep
NSRDSKPSKTLATRRRRRHGPCPAARRAPRRCRPAVARRLRLPGRALGRRFRAPPRGVPARPQPPTPRRPHRPPPRARPVPLLRRHGAPRARAPPHRVPAPAASPAAPERSRDRPPRRGRHALRGRRGGDATRGRR

SEQ ID NO: 59248 - protein, 32 aa, Sorghum bicolor
  Clone ID: 7217989.pep
MGDEVQALVINNGSGMCKAGCSGDDAPRAVFP

SEQ ID NO: 59249 - protein, 126 aa, Sorghum bicolor
  Clone ID: 7218016.pep
ARGRGVKGPVCSAAIRRSEATNPQNLRRHRHCDMPVPHLLSPLSLPCPLPSLLRNGAPWRCPTLLRAVLQVPPPAPLHLGLAVARGDGGRRFVGTLGSKRARAAGAVRVSAMSGDGGGGAGSTGIA

SEQ ID NO: 59250 - protein, 188 aa, Sorghum bicolor
  Clone ID: 7218029.pep
HEAPIGPGADRAKPATPSGQAAPPTEPKSLAQGVRQPSHAPTPPVESKPSVEEVKQTAASLAANGQAKPEDISKATPTGPRNHRVNPVIPLTGSAAKPFSLPGAGGDAASKAPAATAPPNVQDATNAARAAVAVAMAQLGNNSGNAMDNLTNKVNEMRVNAVRGGPASRGRGRGGRPAAAKVAVPDSD

SEQ ID NO: 59251 - protein, 158 aa, Sorghum bicolor
  Clone ID: 7218033.pep
MAEIEDAMGAPPTVTTTESEGTTTDEDVHLSPTCICGGAGGAGGRRGGGRIKILCSFGGRIVPRPHDGVLKYVGGETRVLAVPRSICFRELKKKVEDMFKTEVAAIKYQLLSLAEELDVLVSVTCDEDLVHMLDEYDRLEAKRSPTTSPRFRVYVFTP

SEQ ID NO: 59252 - protein, 108 aa, Sorghum bicolor
  Clone ID: 7218034.pep
ARGCSQAGKPQIPAQEAERVAISIATNAHVNTTPLQVAKQRPATGGSWVVGFFFLGVCDCDAGMGYHQLLLSPPEAQPPRPALLPPPRGTSGAGRVATAVFASASSAA

SEQ ID NO: 59253 - protein, 166 aa, Sorghum bicolor
  Clone ID: 7218035.pep
MATSSDGGGDQRRLLSIPKEGERIIAPTRRPDGTLRKAIRILAGYVPQEEVAIYQSKGALMRKSGPDVPPGYDPALVADAKPKTKAAKRNERRKEKRQQQASSANDKGKSTDIEETDAGETDKALSSKADKQKDSVESVTKQISSIAISESHATPSTNSTNNSQPE

SEQ ID NO: 59254 - protein, 184 aa, Sorghum bicolor
  Clone ID: 7218043.pep
STSRSTSLTLASGLDAARRTFSSSNLGLPQMPGGQTGATSSSMEGGVSRFIMSNKSGLQSSSRTDSDPNTPSSFLPHYHPQTPPSPNHGSKSTASPARPRGVDLPSRTQQKLWLQRTATLNNSPPDSHGVSANIPPSTLDPAFITGSHSRASSTFDGSRGMNGGGRAGVPGHDTEARQIRKAYE

SEQ ID NO: 59255 - protein, 168 aa, Sorghum bicolor
  Clone ID: 7218059.pep
MAVGAMEQASSPAAFDHGGGTTIDDLPADVLALVLRRLDGASLAAVGCASSGLHGLATDPDTWRALCLAMWPAVRDLLPYTVDHRALFADAFPFPCSPDSSSPSQPPTLPARLVSAVDLRHAGVSILSRVVETDAAASDWFLGAPFRVDAMVQEGFTSPTAGGASSSG

SEQ ID NO: 59256 - protein, 102 aa, Sorghum bicolor
  Clone ID: 7218071.pep
MVNDGEQSAIATATAVEPGVVERGRVSGGGRRLAGESSGEEEGSQRFSDAEDRSWHSHSRQGSALEVCISASASISCDADAASAGGVDTAAERARKSCVSEC

SEQ ID NO: 59257 - protein, 180 aa, Sorghum bicolor
  Clone ID: 7218075.pep
DGEKWAKHRRILNPAFHAEKLKGMLPAFLACCNELVDRWEKHISSSVEPTELDVWPEFQNLSGDVISRAAFGVGYEEGRRIFLLQAEQAERLVQSFRINYIPGFSLLPTENNRRMNAIDREVKTILRRIIEKRHKAVTDGEATKDDLLGLLLESNMNYSDSDGKSSKGITVEEVIGECKV

SEQ ID NO: 59258 - protein, 152 aa, Sorghum bicolor
  Clone ID: 7218079.pep
MKLSSFLYTASLVAAIPTAIEPRQASDSINKLIKNKGKLYYGTITDPNLLGVAKDTAIIKADFGAVTPENSGKWDATEPSQGKFNFGSFDQVVNFAQQNGLKVRGHTLVWHSQLPQWVKNINDKATLTKVIENHVTQVVGRYKGKIYAWDVV

SEQ ID NO: 59259 - protein, 146 aa, Sorghum bicolor
  Clone ID: 7218080.pep
MPTVYSSQQKAAIQQFINFTQVDRNSAIRILKSHGWDPQSAVNAYYGGGGSPQPSSAAKSALNTLFDKYREADAQDKDIVGAEGTMKFFEDIGVNAEDLDALATFEIVQAPTMGEMAREGFVKGWSERNCDTVEKQKAYIQSLKDE

SEQ ID NO: 59260 - protein, 185 aa, Sorghum bicolor
  Clone ID: 7218092.pep
TRGSTRNPYNASKVAGGSSSGSAAVVCAGLCPVALGVDGGGSVRMPAALCGVVGFKPTAGRLSNAGVLPLNWTVGMPGILAGTVEDALIAYSAIVDQSQPSYLRPELNLPQLSSTPSIGNIKLAKYGKWFNDSAEDIRSCCDKALQALHAHYGWQTVDVTIPEIEEMRLAHYVTIGSECTTSLAK

SEQ ID NO: 59261 - protein, 71 aa, Sorghum bicolor
  Clone ID: 7218093.pep
HTKTFRLETKQGLIDKYLPNCYATQVFVLSTLSFELAFDLSFFSNLVKGWNLGHHFGLHPRLWCQLTCPRQ

SEQ ID NO: 59262 - protein, 195 aa, Sorghum bicolor
  Clone ID: 7218096.pep
VCPLSSSHMDLLDRELGSLHIQDGASQDGYYSLFKYARENDVTRISQLLVTYPTLDINRRDSDGDTVVHMAARGACREVLRWLAVHCDTLDLSLYNYHGYTPLMVATSTYLSSIHNPAYALFIQLLLQLGADLHQRTPNGITAMDMLHTSRMTTTSDIQNLAEVMQQAQQHPARDVLAAKNRTIASLRAQLQAEQ

SEQ ID NO: 59263 - protein, 194 aa, Sorghum bicolor
  Clone ID: 7218102.pep
HEDNEQLIEEGKVGQEEYEKTDEKARELLRRLANSKPYFRKGRTIEEGESSKGGNAAVGAGLGGPGPIRTRDSKAAAAAGARTGGKGRQVFPSAAQLPPNPRDWAPPADKNIMSLFVTGIEDDLPEYKLRDFFKVHGKIKSLVCSHMSHCAFVNYETREAAERAAEACQGRAVIAGCPLRVRWGQPKAIGTMDK

SEQ ID NO: 59264 - protein, 205 aa, Sorghum bicolor
  Clone ID: 7218114.pep
VGSFCPLLEILSLNNFEGFTDRSLTSIAKGCKNLTDLVLNECHLLTDRSLEFVARSCKKLARLKISGCQNMESVALEHIGRWCPGLLELSLIFCPRIQNSAFLEIGRGCSLLRTLFLVDCSRISDSALSHIAQGCKNLTELSIRRGYEVGDRALLSIAENCKSLRELTLQFCERVSDAGLSAIAENCPLQKLNLCGCHLITDSGL

SEQ ID NO: 59265 - protein, 198 aa, Sorghum bicolor
  Clone ID: 7218115.pep
MSFNQPGRVLAPGQFAGGLVRGASPALVASTGPLLTASTGPIGAQVLASPSRVVGAPYLAGGAGYLAHHGVVAAPQVITASQPIIAQQFYQQPLVVGVGNEGEIANLRARILGLEPQFAALQAENARLVAELNSRIQIIQETQARVHLLASAPPGVVTNEHVVDKVVDVPQIVERVVTREVEVPVVVDRPVERFIERP

SEQ ID NO: 59266 - protein, 194 aa, Sorghum bicolor
  Clone ID: 7218116.pep
LVPIQEHINRLVAIRAQADIMGSDLLAIARTDAEAATLLSTNIDPRDHAFILGSTNPTLKPLNDLMIAAEGAGKSGVELQRIEDEWLAKANLSRFDDAVTAAIDAGSSSDKAGLKRDYLTKAKGKSNLEARAIARQVLGHDIFFDWDAPRTREGYFRLKGGCDCAVNRAIAYAPYCDAIWMESKLPDYAQAKEF

SEQ ID NO: 59267 - protein, 143 aa, Sorghum bicolor
  Clone ID: 7218122.pep
LDLPPPPPPRRGPRLPQFLLPTPLFNSPPLPKNAPVNLIQTRNRLAPPRSAPDLSPANPQARPLARRQDPAAIGSGGRLTSSHCGGGASPHGRSSARGGARRVGGRFLSGRALLSRPAVPGQCGQFVELFEALGLGDLSEGAR

SEQ ID NO: 59268 - protein, 52 aa, Sorghum bicolor
  Clone ID: 7218123.pep
VPCSLTLLLAFRCRATMQAHAARRAFGYLASKIHPQLPLTPLESHQMLNLLT

SEQ ID NO: 59269 - protein, 120 aa, Sorghum bicolor
  Clone ID: 7218126.pep
IANYFIGGLGEGYKKTLQTANTCSTCALRTLVDRCWGGVGVGVPCRTERGSGETFRLGRFTVLAIVHPTLISLELHRHRWRVSCSGFTGENYKVKLLTVARPRAQCNPAASLYKSAIYEF

SEQ ID NO: 59270 - protein, 79 aa, Sorghum bicolor
  Clone ID: 7218141.pep
HNRPLYSFFFNSAELVVPDRHSIAYLALPCLACLASHSLPCVALQFRALFFLENTIFARGSAWSLIHCPLRHSTSSSFG

SEQ ID NO: 59271 - protein, 181 aa, Sorghum bicolor
  Clone ID: 7218147.pep
TRIYHGECCKRPISWVEDKWDKKLTALTSLRKENDRLKQKVAELEGRDRTYESRVQREVDEHKQAVVMLQEKLKDMEDRCHTLEADNAKRRSSTSKPPSKMAMPRPYRSSTTNLEYGPGLESSPKSKSTPVTPAARPSFQPWSRSYQRLPPEQRASPLQRQAVSPRPPNDITPRGSIEFPT

SEQ ID NO: 59272 - protein, 106 aa, Sorghum bicolor
  Clone ID: 7218149.pep
MRLNKVEVNLIRLLEAAPRQQNQAKLVYYVTTARELLEQLGAETTPEGISSISKAKLSEYSEKIEALASRLAASVPENEKPIIESRDEISYEEAKPESPISLSSGL

SEQ ID NO: 59273 - protein, 176 aa, Sorghum bicolor
  unsure (1)..(176): unsure at all Xaa locations
  Clone ID: 7218156.pep
MQVSRPTQGARGITDEAMNILRRMWKHKMLPPNIKTFGWRLIRKAIATGARAGNLSSRISKQCDRCNDMENDAHLFFHCSFARAVWFSSNTPIYTSMLPIEQDGVQEILAGIITSNTSEQQMQRIMTTLWYLXKARNDLRFQKKTWTVLQVKHAVEADIKVSFLEAGDNAATNLSA

SEQ ID NO: 59274 - protein, 174 aa, Sorghum bicolor
  Clone ID: 7218157.pep
TQPTSYPPPHPRPRAPGRAQARVPALGTMSLSPADGAAYWLRWEVLVCGALIALPTAAAAALLPRLRRAAPPLRAADLWVTCWARLHPGWLLAYRAFALAAAVALLARLLVAKGLTVFYFYTQWTFLLVTIYFAFATAISAHGCWVYSRKSLRKADESHGFLNPDVENLDVSNS

SEQ ID NO: 59275 - protein, 180 aa, Sorghum bicolor
  Clone ID: 7218161.pep
MVGVAGYVDLLSRCGEARAIVRIQAALVTSGHLRRSVELHDALIRALSRSARPHLALPLYAHLLRAGLLPTPHTLPSLLKSMALSPAAPGVAVLALTVHAHAVKLGLERFVLVSNALIRVHAGFLGRLADGLLLLRTAAAVDASTFNTLITAYARAGRVADARALFDEMPVRNAVSWSAM

SEQ ID NO: 59276 - protein, 185 aa, Sorghum bicolor
  Clone ID: 7218171.pep
MANYSYKVAHQNLLVNFLPHLFPNAEAHVNTRRVEVRKEDEQLETPLVYPSSLSSLELDVWIPSLSLSFEFQDAYHYVTTWYSHLDKEKIITKDNIKRNLTQQHGVSLVDVPCWWDGSIESLIATIQFQRPDLLDNNYSDPISLNPPPKFFESLTIPEVGELMLASFPAYNLEILPDSWWIGEKY

SEQ ID NO: 59277 - protein, 123 aa, Sorghum bicolor
  Clone ID: 7218173.pep
NEAPTICGSGFSPGGGRGAAFRGSGIKAIDQRITAAMAYSHHMEQGNGKAILVLRVSSRMSSSRFRLVVALLQAKAVAEWWLARKKLGSGIDGHDCLHNNAVAISRLGINTSANGEEDSSSCN

SEQ ID NO: 59278 - protein, 116 aa, Sorghum bicolor
  Clone ID: 7218175.pep
TRLKLKAVYMYAAGFYTYSIFALLFWETRRSDFGVSMSHHIATVVLIVLSYIFRFARVGSVVLALHDGSDIFLEIGKMAKYSSCEWLAVVAFLLFVASWILLRLVIFPFWILRSTR

SEQ ID NO: 59279 - protein, 82 aa, Sorghum bicolor
  Clone ID: 7218176.pep
TLLLFVASVYHYQFIGHCFLTKSPHGVMDVFQLGRTITHPVDHFFLTIFLHGYVPAGNDHSLPFFCWKLLQLAVINMMLVAD

SEQ ID NO: 59280 - protein, 144 aa, Sorghum bicolor
  Clone ID: 7218182.pep
MPNQRDNIKDPRSEQTKKKDLIARGDYTPTPAGKLTFFVLRGVEPVLQYSILAHGLGTSVLHRVGLRTLPSGLPAHTGISLIDGLGLSPYRLVLLGMAVGAAVKQNIWVTALSGEPMPVGAAVAVGVFNAVFNSLSSYAFLTSV

SEQ ID NO: 59281 - protein, 105 aa, Sorghum bicolor
  Clone ID: 7218192.pep
MDSFRSSNSLASRSSLTLGELACAALFPVLAVVDAVLHAALRCFQKTSPSLLPVLDICARHRAGRRLTFRELAELADESRCFSVNEVEALYELYKKISCSIVDDG

SEQ ID NO: 59282 - protein, 75 aa, Sorghum bicolor
  Clone ID: 7218195.pep
HEALSLSLSLSLSLSPSFLLVCPATETRSQTRVTVSTPTSSIANLVSYSFTIYDLRYRKYGSVRPTIIATQPGSL

SEQ ID NO: 59283 - protein, 131 aa, Sorghum bicolor
  Clone ID: 7218198.pep
HEARRQLDNATVVIKKVIGQVNAEALPLFDTVALDYLAYFCTALDDVRDYNDAAWAKMSPILEAFVAPAQAAEIYSTLNAHFVEENTKRGIKVVEVDPEEGEELCNCEFSLAYGGMILLNNTKLRLTRGQR

SEQ ID NO: 59284 - protein, 125 aa, Sorghum bicolor
  Clone ID: 7218200.pep
FVHLFLVNRYSAVIFLFNMDTMTYYDLSGKSIPKPRFSTQEDIDEVQLDEGRFTLDCFVSDISATIKVNTSNGMKKMLKIVLSGEQGASFHGEVWQPHHETFLEVCTIGTCLRISFVPKPIYGNL

SEQ ID NO: 59285 - protein, 133 aa, Sorghum bicolor
  Clone ID: 7218201.pep
MASATTSISSHPADLRDVVQAARIGALRQQVGVAPAAARGQRARAVRPLRAAEPARQPVAASAAAAAPAAPMADEAAAALAAVDYEALARELDGASPLEIMDRALAMFGSEIAIAFSGAEDVALIEYAKLTGR

SEQ ID NO: 59286 - protein, 107 aa, Sorghum bicolor
  unsure (1)..(107): unsure at all Xaa locations
  Clone ID: 7218212.pep
HEARIYISLSRKEKEDDFLAMKGSKLPQRPKKRAKNVDKTLQVYNQTTWPXARSDPVPIRSDPISLLVVTKLTCAAFIMQFVFPGMWLPDLTKGRYEVREKKCVKKV

SEQ ID NO: 59287 - protein, 164 aa, Sorghum bicolor
  Clone ID: 7218217.pep
ARGYKLREEIKNVLGTRKCLFVLDDVWNKEVYHQMMEDIFNTLRASRIIITTRREDVASLASSGCHLQLQPLGSSYALDLFCRRAFNNTADRKCPQELEDVAVSIVERCKGLPLAIISMGSLMSSKKPTKHAWNQMYNQFRVELAKPDNVQTILKLSYNDLPGN

SEQ ID NO: 59288 - protein, 45 aa, Sorghum bicolor
  Clone ID: 7218229.pep
TSALVHSASEGICLLLSFELFKLWCASKVSDPTTGLFISATCLTP

SEQ ID NO: 59289 - protein, 166 aa, Sorghum bicolor
  Clone ID: 7218235.pep
ARGIVERIEYDPNRSAHLALLTRLATGEKSYIIAADGMRAGDEVESYRSGIPQELIASMGGGIDPGMLAAKTAARGNCLPIHMVPLGSQVYNVGSKTQGGGVFCRSAGTYAIIVNKEEVEKGSRTEIKHVIIRLQSGEIRKVSADACCTIGVASNPQSHFTSLGKA

SEQ ID NO: 59290 - protein, 131 aa, Sorghum bicolor
  Clone ID: 7218239.pep
MIPGIAPKTAAAVPVAWAPQPRHMFVFGAGFVGRYVSERLLAQGWQVSGTCTSVNKKRELEMLGMNASVFDATESSLENIHNLRQATHLLISIPPIPGIGDPLLNLGEDLRRTLSHGNLEWLCYLSSTSVY

SEQ ID NO: 59291 - protein, 102 aa, Sorghum bicolor
  Clone ID: 7218250.pep
WVLVNFNLIGILAFHFSQYGIPVLFAVWLRDFIPCNTNIVCNICNLSAVNSINLMLNPVEKAYKLVAHCVAVLSNFLMCLSLHQNHGVCLSKTMLTSSVCNL

SEQ ID NO: 59292 - protein, 107 aa, Sorghum bicolor
  Clone ID: 7218253.pep
SGIPVTSAKMIANKLTILTATTALLEPALALGHRHAHHQHAQKRGDWVVATIDGQVVSWENNYFGPGGSAPAATQPAAASQPEVSSAPAPAAAQPTTIIKVAKPSQA

SEQ ID NO: 59293 - protein, 147 aa, Sorghum bicolor
  Clone ID: 7218257.pep
MNKPMSSLLLAATLLAGGSIAQQTVWGQCGGQGWSGPTSCVAGSACSTLNPYYAQCIPGATTMSTTTKPTSVSASTTRASATSSATPPPSSGLTRFAGVNIAGFDFGCGTDGTCVTSKVYPPLKNYAGTNNYPDGVGQMQHFVNDDE

SEQ ID NO: 59294 - protein, 201 aa, Sorghum bicolor
  Clone ID: 7218258.pep
TRVTSKKDQQQYWYLDQEQYHYVSVPDFAQRFKSFHACQQMQKELQIPFEKSKTHPAALTTRKYGLSSWESLKAVMSREQLLMKRNSFIYIFKVTQLIILALMSMTVFLRTKMPHGQIADGTKFFGALTFGLITIMFNGFAELQLTIKKLPVFYKHRDFLFFPAWTLGVANIILKVPVSLVESAVWVALTYYVMGFAPAAG

SEQ ID NO: 59295 - protein, 68 aa, Sorghum bicolor
  Clone ID: 7218259.pep
ARGNVSLKARGASAYSVGILDIYGFEIFDRNSFEQLCINYVNEKLQQIFMQLTLKTEQEEYAREQIKW

SEQ ID NO: 59296 - protein, 43 aa, Sorghum bicolor
  Clone ID: 7218261.pep
FSFVPSLHKLKFLAAKQALTSYFVKQEHLNRHVLREQTSLLRW

SEQ ID NO: 59297 - protein, 85 aa, Sorghum bicolor
  Clone ID: 7218264.pep
MTARRSCRAPRCRPATPTTTSSRAARRARCTPAAWAPGPRTSTWPCTRATARARSRSRTRPSRTASLARRTTPSRRSSRAPPARP

SEQ ID NO: 59298 - protein, 90 aa, Sorghum bicolor
  Clone ID: 7218265.pep
RAGPVFDCTLRLCLFLATFCSHRLWASLLLFFCFSRLVECAIVLVLIYDTVALYQIIDSRSISFIDPLTADCLASHVSPRSALDVSALSS

SEQ ID NO: 59299 - protein, 173 aa, Sorghum bicolor
  Clone ID: 7218266.pep
HEATMGDVHWYDYSSDLYEVSNFPRPRFLSEFGVQSQSSLISYSAVSQSIDWSWNSDLMLFRQHHPDGNQQMIDQISMHFNQPNSTNQTLLFSDQIYLSQVSQSMIYTTAFHHWRRIQSEKGYCKGIIYWQLNDQWQAPSWSSIEYNGRWKMTHNHVSNAYEQRLISGYLTPL

SEQ ID NO: 59300 - protein, 97 aa, Sorghum bicolor
  Clone ID: 7218267.pep
HVLQAWKKQICKGQLVSNDQDVTQFESRFYFCGLEVWTWSQNGVIRVNGTFLSSKEPLISQRIRRGDYWVIIRQAPKKEALLEMQKRRKKQKRKTET

SEQ ID NO: 59301 - protein, 157 aa, Sorghum bicolor
  Clone ID: 7218270.pep
SIIAIHIPDTRKLHHTMLFKPLALAATTAAVLIVPETSDKDDSIFRALPIEVDTFEVPETAYGQVIDVPCLQCRGHNSQLELNFGIQDRRLVLNGFELYPHADPWNGDLSAAVIKANGKSDMRRLGYGLAIRPEGVDKDQHLEVVNVEVRIIEVGDR

SEQ ID NO: 59302 - protein, 161 aa, Sorghum bicolor
  Clone ID: 7218276.pep
MSSQRDLESRNVPDERAPLLAHEERREYSAVPSEHEDVPEDSQEEVSKTWTYVWRGFWAIFSILIIVVFVKAWIDADDVKFDLKGALKRALGGGVSGAAAMVLQVLLLMPIRTIMNYQYRHGTSTTTATKTLYRDGGIGRYYQGMGAALFQGPIARFGDTA

SEQ ID NO: 59303 - protein, 190 aa, Sorghum bicolor
  Clone ID: 7218283.pep
TRVLRSSEYFTRPSIDELVEREVANPGYCSRVPNFIIGRAGYGQVRFLGDTDVRGIDLNEIVRFEKHYVVVYEDETCKPPVGHGLNKAAEVSLLLSLKDLPEPSILVEVLRCRARKQGSRFLSFNPVNGKWKFEVDHFSRFGLVDEEEEDAVMDEAAVRQPITEVRERDPPSNGHEIELSHSLPAHLGLD

SEQ ID NO: 59304 - protein, 152 aa, Sorghum bicolor
  Clone ID: 7218284.pep
HEGERERERERERERERERERERERERERERERERATVREALGIHKGTVPLWLRCNKGITYVKDIQSSVKYHLDVTTKGYRSLVYSGDHDMAVPYIGTQSWIRSLNFSVVDDWRPWYVDGQVAGYTTLYSNNLTFATVKGAGHTAPEYMPRQ

SEQ ID NO: 59305 - protein, 126 aa, Sorghum bicolor
  Clone ID: 7218288.pep
MGSIDIPSEQWAQIVEKTGGPVVYKRIPVQKPGPDEVLVNIKYSGVCHTDLHAMMGDWPLDTKLPLVGGHEGAGVVVARGELVKDIEIGDYAGIKWLNGSCLSCSYCQNSDESLCHKALLSGYTVD

SEQ ID NO: 59306 - protein, 167 aa, Sorghum bicolor
  Clone ID: 7218290.pep
MTAGLWPKPDPLSTALCQAALRGDVQQMSGLLAQGANINGRNGEGNSPLGCAILANQEDAVRFLIGSGADTNGKDMKIPPVFLAASVGSIGVAKMLIDQGTWNVNAASWSGQSYFVDVCNSENLEGIQLLLDNGAKPNTTNTSGRPVLAQAVKKGNLELVRMLLRHG

SEQ ID NO: 59307 - protein, 196 aa, Sorghum bicolor
  Clone ID: 7218291.pep
HEVQLLYLYHPYPIMSLNVTIVGANGEAGLSIIDALSPSPNEFKLTAIVRPASINKPEIQQIKNKGVSVVPINLENNHDELVKALTGQDVVISCLVPFTTGPEIALANASKEAGIKRFLPSAFGPPCPPEGVMLLREFKETIINHVKKIYLPYTVVDVGMWYQVSLPSLPSGKIDYALKFPAAVVAEDGSHATSLT

SEQ ID NO: 59308 - protein, 169 aa, Sorghum bicolor
  Clone ID: 7218296.pep
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEV

SEQ ID NO: 59309 - protein, 91 aa, Sorghum bicolor
  Clone ID: 7218301.pep
CQGCHQLPSSHHLAMRMTCWTECSVEEMEVEGDFGNPVAPAWQQIHGAAWAPYPLTPQHTTPAACPAPTTMPMPPAQLVKNQSPATWRSMK

SEQ ID NO: 59310 - protein, 162 aa, Sorghum bicolor
  Clone ID: 7218303.pep
HEVIRYFWWCWNKLKDRIGDDVPMPAYFRFLALLAFKIFSDEQVDVAVLEVGLGGKYDATNVVRAPVVCGVSSLGYDHMEILGSTLGEIAGEKAGILKKGVSAYTVPQPEEAMSVLVQRASELGVSLQVVQPLDPQKLEDQPLGLHGEHQYMNAGLAVALAN

SEQ ID NO: 59311 - protein, 187 aa, Sorghum bicolor
  Clone ID: 7218312.pep
MPAVIFARNDALDVNPQSGDARLSDAGSDWLWAVTAIYVVSFLAYFALSFKPRNNERIFHYLFTIALFVGAVAYFSIASGIAYSVIPTQRNLGRALSYQIYFAKYINWVVAFPIIILALGLMSGVSWATILFNIFLAWIWIISYLCSAYTTTSYKWGFFGFGTFAYLMLAFQTLHPGRTSAARLGLS

SEQ ID NO: 59312 - protein, 183 aa, Sorghum bicolor
  Clone ID: 7218316.pep
ARGAVTGSTTTRAALYMARMHALAISLGVGKLFWYHYQDWSFDRNEAEENFGMITFDGYLQPTYAVMINQQNKLDGTVFVSSTTLASGSINSYHYQQSSANKDLFILWNPTSTTPTSVALSSIKSGLSSTNAQVYDKVGHPVTITSNSFSVADSPLYVVTTINSATTTTTTTTTTTTTGGSTT

SEQ ID NO: 59313 - protein, 171 aa, Sorghum bicolor
  Clone ID: 7218323.pep
HEGNLGSPGINRSHAARPIRPFPAFQSPPPPAAAPPTRGMPPAVGPASPRQNPIGAELPAAAACMANPGLGLGLAPPGPEPSAGAPPPSSRRAPRLAKRRHAPASSRSRAPQASAGTWNPFGGGGGGGPDGQTGGFVFGSASAVSQQPSEPAVGVAPPTEAPFVFGSVRES

SEQ ID NO: 59314 - protein, 148 aa, Sorghum bicolor
  Clone ID: 7218329.pep
MATATAATVPAGGGRPYRRARSRCGPPRLHRLRFPAIAAAAAAAAAASSSPPAPSSSTLPPLPADGGGRLVVELVCAFNELTERMGEDLATSSSSRLLFRALKLALPALRDVDGGRALARALAVGATLADLQMDAEVISAGILREALD

SEQ ID NO: 59315 - protein, 132 aa, Sorghum bicolor
  Clone ID: 7218336.pep
LAGGSLSLWSSPSASQAACRPWTRRRSGARSGCWRRAYGGGCGGVSRRRTAAAVFLGAAWTPCPCPCRGGLAWLLYRLTPSSTSRLLLDGDDNASACVCAFLSGSIGGRSCWPWPREGEEGSRNPWRGYPRA

SEQ ID NO: 59316 - protein, 173 aa, Sorghum bicolor
  Clone ID: 7218342.pep
PFMIFPLIQILGLPLSSLGSLLLSLVLPLTQDLGSPRPSLILPLAQDLGSPLSSLGPPLSSLLGSPSLPWPRWNATSCISTTPLKRSSYVKRSELSWRLTACRTRLALEGCTYTVSSASAIRSASIARRRLPASLTQRRRRTRQATRIPPAWTRGETLGVGGRRPARGEARAA

SEQ ID NO: 59317 - protein, 122 aa, Sorghum bicolor
  Clone ID: 7218353.pep
IKLLSRASLRIRLSLAVPTAVNQSISQPINQSINQTVNISSLNRHQVRLNNAAFFSVGASNSQSSQSNNQSKMSDSKTNDMFDLLVIGGGSGGLGCARRAASYGAKAAIVEKGPIGGTCVNV

SEQ ID NO: 59318 - protein, 150 aa, Sorghum bicolor
  Clone ID: 7218355.pep
TMHPLLCLVTWTWFMSQVLCSDISTFLTELPSCAESCVLDLVSASSCGTNATCLCADPKLQDDVLPCVESHCLPREALAAINLTSVACDFPIRDKHQQFNILTITLIVITGITVGLRFIEKIRYGPGLQVDDYVITGAFLVNLGNSIVCL

SEQ ID NO: 59319 - protein, 143 aa, Sorghum bicolor
  Clone ID: 7218362.pep
MAVRPPISVSPVGATPPQGPVALAPSNMPTMYRGQHPPVPNFTGSAPFVSRPPGGPQSFPTAVPQGPSSVAFPGGASPQSPYPPTPDQMRGPPPAFSPVGSTPGMVPPSIASSGPPAPGPASTSGSQAQMAPLRPPLPVMGDF

SEQ ID NO: 59320 - protein, 118 aa, Sorghum bicolor
  Clone ID: 7218363.pep
MSRYGWSLGREQISPYSSMPSGVPAVTDDDFSYITSQDLDGVTEDRYYPRSHSTAPPPAPEDDVLLIKNRGITYPAHFPAYAIGDGKLRVIDVKDRVGLMMELPERGTSRIKLLYKGK

SEQ ID NO: 59321 - protein, 130 aa, Sorghum bicolor
  Clone ID: 7218364.pep
HCSQTNLSVLLTAAVTVVHSNKSTLETSARSNVNAVQSSNQMVKNQDTKPVAVQAMTVNPVIGHRATPGVAFVPPKPTFVNHNEIAKNVQQFLHQPANHPSWTPPSTEYMHSCLSCQICKVVIIGTDSVL

SEQ ID NO: 59322 - protein, 175 aa, Sorghum bicolor
  Clone ID: 7218367.pep
ARGRPANGLPRSSRRTSSANVPRPKSMPVGFGDFGDDAKLNFDQPIHEYLGESENSTGGLRLKSKSTGNLASDNLSKDFGSPSGLAFSNRYDFGASLSAAVQASKDKEASQDKDGLYMKANVRTPKPTLTVPEPPTNAKSRSTAGATSPKSTISSSSYEELVNKYCFFGSKQSSP

SEQ ID NO: 59323 - protein, 103 aa, Sorghum bicolor
  Clone ID: 7218375.pep
HEGAQQTQQRPGSLSPNPMMNPAASPDSPSLYKEEAPSSSHCRRIPPKSPKLRGTQATAIHSGGQKERKKKKSVASAPAQSFGFPVLVLLVLVASQLARSLYP

SEQ ID NO: 59324 - protein, 137 aa, Sorghum bicolor
  Clone ID: 7218376.pep
ARGEKEVFLASGDGSGLADINPLEAIAGKCTVICISKDERNRQPSPQEQTMADYIFYRCFDVKNCTLSDELPDKITGLEVNVLLNPKDEQGMSSASAANVLLNPNVDEVLAATFTAPCSVTKEDDESLATAIPLPQA

SEQ ID NO: 59325 - protein, 148 aa, Sorghum bicolor
  Clone ID: 7218383.pep
TRDDTAAMYDAITLTQQLKYYKEYQSKLGAVAGRAKAGAILADALYVVSTGTGDFLQNYYHNASLSRRYNVHQYCDLLAGIFSGFANELYRLGARRIGVTSMPPLGCLPASIRLYGEGKDACVPRLNRDAETFNQKLNATVRALKRRH

SEQ ID NO: 59326 - protein, 58 aa, Sorghum bicolor
  Clone ID: 7218394.pep
MPSFKPFASVTGRNSYSLFDIRLDSDFIVFRGSDHESSGQVLKGTLVLCLQTSLKIED

SEQ ID NO: 59327 - protein, 101 aa, Sorghum bicolor
  Clone ID: 7218420.pep
MWRLKISKGGGPWMQTVSEFHGRQVWEFDPDAGTDEERAKVELLRQDFTENRFRRRESQDLLMRMQLTGEKHLRADMPAATKLADGDEVTEEILHESLRRA

SEQ ID NO: 59328 - protein, 141 aa, Sorghum bicolor
  Clone ID: 7218423.pep
TRHDRSRPAEALSARYWNHSVVNYDEHLPDGFYDVCGAQLHPGFQAKFPSLHYLRAVPPGRDVPFLAILVDREHDPALKRLEDRAAQIAAQARARHGGIASAEIAQKIVGLIVNAMGGLVEDADGMNREWSIKSRELSLQL

SEQ ID NO: 59329 - protein, 116 aa, Sorghum bicolor
  Clone ID: 7218455.pep
TRLAGLAAARQLLRFGLRVLVLEGRSRPGGRVYTARLGEDKAAVELGGSVITGIHANPLGVLARQLGLPLHKVRDRCPLYYPDGRIVETRLDRTIDLVFNTLLDHATKVRESLNEA

SEQ ID NO: 59330 - protein, 77 aa, Sorghum bicolor
  Clone ID: 7218463.pep
QEQDEAGRGARRRAPIRLAPPAAGDSAPPPPRPSDRAPPPPLAALAAPRSAARAAWWGSPVATKRRRARRVRRCASC

SEQ ID NO: 59331 - protein, 102 aa, Sorghum bicolor
  Clone ID: 7218469.pep
HPCCKSPDLTSRACASHIHHHLASRLHTNLVMKVSQFLTCLAASQVISAASIPESSNALNLLEERRVVPASELVSPHHTLERRKGGGGRSGGSSSGSSSSSG

SEQ ID NO: 59332 - protein, 108 aa, Sorghum bicolor
  Clone ID: 7218470.pep
TRASGPAPAASAPAKSNKNKGKKHNSSSGSGYKPFCGGKKAKRATLEDIAAKGNTGVPGDFGCNMMTVDEDVADKYDYTTTFKNDHDEDKECVCFNKIGPNGLIDGFF

SEQ ID NO: 59333 - protein, 85 aa, Sorghum bicolor
  Clone ID: 7218472.pep
LSDSYAPCSTSTVLVCAQVSRICFYCSTTSTSSTRNASITSQNIDVIDNVFLHQAHRPSGPRRRRLGLSSHAAPEVPPQGCLPRW

SEQ ID NO: 59334 - protein, 64 aa, Sorghum bicolor
  Clone ID: 7218474.pep
MSTLFGGASAASTTSNTVGDLKQDVALSDPPTDTISDLSFSPAPNGPDFLAISSWDNKVRIYEI

SEQ ID NO: 59335 - protein, 93 aa, Sorghum bicolor
  Clone ID: 7218494.pep
MAAMDMKKCLLVLTLGLAMAATSSAVIYKVGDTSGWTILGNINYTDWTSKKNFRVGDTIEFTYPPGIHNVLEVKKADYDSCTNSTPIATHTSG

SEQ ID NO: 59336 - protein, 86 aa, Sorghum bicolor
  Clone ID: 7218500.pep
HLPNGYIQQHLCQPTMVQLLADPAFSPAGTPTHEGTNGPLMKRPGPVRADSSTPMTREEHAKRMQELNKKRGLMRAPRRGWSMTDY

SEQ ID NO: 59337 - protein, 94 aa, Sorghum bicolor
  Clone ID: 7218506.pep
MVVLSTSKLVKPAGQQATDLENQVAQTLLDLEANTDLKAQLRELHITGAREVDLQGGKKAIILFVPVPELRSFQKIQSRLVRELEKKFSGKHFV

SEQ ID NO: 59338 - protein, 34 aa, Sorghum bicolor
  Clone ID: 7218508.pep
ARGDGASGTSTVESTYLVPSTSYTAHVRAKKQSR

SEQ ID NO: 59339 - protein, 73 aa, Sorghum bicolor
  Clone ID: 7218533.pep
MLQRVDTNFLSYAIGDAQKYQYIASMGIYVFKKDALLDLLKSKYTQLHDFGSEILPRAVLEHNVQTCIFMGYW

SEQ ID NO: 59340 - protein, 50 aa, Sorghum bicolor
  Clone ID: 7218543.pep
SSGYLKIHTAAAYNITQAYQDNKHHVCLLYKQYLLNCSSMLRHVSKHVYI

SEQ ID NO: 59341 - protein, 123 aa, Sorghum bicolor
  Clone ID: 7218550.pep
SASCAFNHSIIQSFNHSITMSLFACPNSSRVLLRSALQRAVSKASVSAAQPFAPTRWISSCASRNRSGLLPSSTCCRSTIFRNNNNSYETRRTIFFDKTIRNYEDLPRDYRDQVGLQFGSKDL

SEQ ID NO: 59342 - protein, 67 aa, Sorghum bicolor
  Clone ID: 7218552.pep
MRVTTRACKRNASYIYICMHACSGPYVDIDMRSGEMDGYDAVFLSPHKFVGGPGTPGILLMNRALYR

SEQ ID NO: 59343 - protein, 94 aa, Sorghum bicolor
  Clone ID: 7218558.pep
MRFSTTVAYLAACLAAPATALAIWGDSASALDASLKVPGENPIEYCSADRGDDLIDIKKVDLAPNPPKPGTPLLITATGNVKGRIAKGSYVKVV

SEQ ID NO: 59344 - protein, 151 aa, Sorghum bicolor
  Clone ID: 7218574.pep
RFKTYDDALKYYKQYAEDSGFSAIILKSSYLKSGVCRRLVIGCSRAGRGRANACYLSRESTKINCPARISLKLRQDRWLHIDDAKLEHNHPLNQSSTSLINCYKKLTDAKNGGAASRLKGRRNIPSEKEQGNFTEIGRLKFGEGDDEYIQR

SEQ ID NO: 59345 - protein, 68 aa, Sorghum bicolor
  Clone ID: 7218583.pep
NLENSYGHTPVFLAANHGETELVRLLLDTKKVDIHVESYYGETALSLAQKRGHSDIVELLELYPGPYK

SEQ ID NO: 59346 - protein, 85 aa, Sorghum bicolor
  Clone ID: 7218585.pep
HEGIFRPGRVSHALSEDALAHALMDNKFPTETLKDYEEWTIDLRNLHMGMAFAQGAFGKLYMGTYNGMDVAIKLLERPEADPEKA

SEQ ID NO: 59347 - protein, 155 aa, Sorghum bicolor
  Clone ID: 7218593.pep
TRVASVTPAAAAPSPDTASFLHCLAVHLPPRAVYTNASRSLYTLALESSIRNLLFVTPATPTPIAIVAARSASHVQSAVRCGVRHGVSVRPRSGGHDYEGLSYRALRAAGRPFAVVDLALLRAVSVDVWNETAWVGSGATLGELYYAIANHTARL

SEQ ID NO: 59348 - protein, 72 aa, Sorghum bicolor
  Clone ID: 7218599.pep
MATAMMAASTTSCSPRRAAPVLKPVASSSSSSSSSSARSRRPLAQQLPRLLATAAAAVAAEPLPVLADQMEK

SEQ ID NO: 59349 - protein, 143 aa, Sorghum bicolor
  Clone ID: 7218604.pep
QAVVVLLVVVVVEEQGQLFLVVVLQGHCFLVVVLQGHFFLVVVLQGHFLVVVLALRTPQSSSSSSPSSQSPPLRPWSSSPHRGRSLRSASSAETTTAAQKRMAAKARSRKKGFIVVVAELLVAPRSRSDCWGSVGKQLFESSC

SEQ ID NO: 59350 - protein, 113 aa, Sorghum bicolor
  Clone ID: 7218608.pep
MAISTTATQPADAQKPENTTNNAAAAPRKRRRRAPATGASEDCFACRKRGAKCDRRRPYCGQCIELGKECSGYRTTLTWGVGVASRGKLRGMSLPVAKSTTQSASTTRDSKPQ

SEQ ID NO: 59351 - protein, 150 aa, Sorghum bicolor
  unsure (1)..(150): unsure at all Xaa locations
  Clone ID: 7218617.pep
TRISYLQQXGFPEVALHFVKDEKTRFNLALESGNIQIAVASAKEIDDKDHWYKLGIEALRQGNVGIVEYAYQRTKNFERLAFLYLITGYLDKVGFMCKIAGQNNNLMGQFHNALYLGDAKKRVEILENAGQIPLAYVTAVTHGLTEIAER

SEQ ID NO: 59352 - protein, 157 aa, Sorghum bicolor
  Clone ID: 7218623.pep
TRNRQATSVVNDEQYQRVSYYTLSRGTNGFSEANLLGKGRYGSVYRCTLEEEGATATVAVKVFNLQQSGSSRSFEAECETLRRVRHRCLLKIVTCCSSVDPQGEEFKALVFEFMPNGSLDDWINPQSSNLTPENTLSLSQRLCIAADIFDALDYLHN

SEQ ID NO: 59353 - protein, 52 aa, Sorghum bicolor
  Clone ID: 7218629.pep
FGTRTALSVFDGPYRSFIFFSLCRLIIQKLFIPSFHAFSVTPGKNDSTGNVY

SEQ ID NO: 59354 - protein, 181 aa, Sorghum bicolor
  Clone ID: 7218633.pep
TRSILTKEENMEPEDITVFKKKKRSRKDKEQAQNESANEVVVDTDVQTEQVEVSEKRKKKKKKEKALVEEPQQEETQEVVKTKKQKSSKGDNRDYYIEHEDLASFTAAEVNEHRKKLNMTVSYMDNSNPKDVFESEPVEYQENSESSTFKDLKPIRLFSELVLPDERLLESTKNFKTPTAI

SEQ ID NO: 59355 - protein, 124 aa, Sorghum bicolor
  Clone ID: 7218637.pep
HEAAAGQATREGDVYSFGIVLLELLTGRRPGMFAGEEEDIVKWVKRQLQRGAVAELLEPGLLELDPESSEWEEFLLGIKVGLLCTASDPLDRPAMGDVVFMLEGCRVGPDIPSSADPTSQPSPA

SEQ ID NO: 59356 - protein, 55 aa, Sorghum bicolor
  Clone ID: 7218639.pep
GFTFDVGSSVMFGFSDKGNLNSITQALEADGRKMEVLPDPSTDHFHLPGDLSVLV

SEQ ID NO: 59357 - protein, 111 aa, Sorghum bicolor
  Clone ID: 7218652.pep
MANIKLSTMQLQLILVSMALATAAATTTTTHLQFYMHDIFTATADSPATGVTVAKGTAGLPGDPNVHFGDIHVIDDPLTEGPDPSSPAVGQVQGFEVFAVQQEISVMLSAN

SEQ ID NO: 59358 - protein, 141 aa, Sorghum bicolor
  Clone ID: 7218656.pep
ARGRNKIETALDSILAFSQDVVSGKIQSPAGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARI

SEQ ID NO: 59359 - protein, 132 aa, Sorghum bicolor
  Clone ID: 7218688.pep
MASRLARSAVGAPLLRPVLARRAAPTISVAAARYNSNVPAEDPKKKAQSIIDALPGNSLLSKSAILSSAAGLSIYAISSEYYVMNEETIIAISLLSVWGALIKYGGPAYREWAETQNNKIKNILNSARADHT

SEQ ID NO: 59360 - protein, 82 aa, Sorghum bicolor
  Clone ID: 7218693.pep
TTRYPLSLCPSLSTHNTRIHAAKNSSSIAAATPSSRCILSFHFEKSEHTAYYRRKIIALFFGAIETTSDTSPAAFRNGYSQP

SEQ ID NO: 59361 - protein, 61 aa, Sorghum bicolor
  Clone ID: 7218696.pep
YWSRDAWFMRSWLAGSASQRRGASTEKMETLAEVAALHLLPWRRRGRDGGAARVPVKSPRT

SEQ ID NO: 59362 - protein, 47 aa, Sorghum bicolor
  Clone ID: 7218700.pep
SFKFPTLCDVPKIDLLQYTASAPSVFLGMAIPLRSGIDGTTIPEPRA

SEQ ID NO: 59363 - protein, 45 aa, Sorghum bicolor
  Clone ID: 7218704.pep
TKTLSDMGAKKIGFLGVPPLGCCPSQMTLGGSPSRLCEPQRSQAS

SEQ ID NO: 59364 - protein, 117 aa, Sorghum bicolor
  Clone ID: 7218714.pep
HEAPPHPCLLLPAGCTVARISLLGALSPARLLIWRSHRNRLPTFSCPASWQAPSTSCLAHVCAGIPFPASLAVPFLLIGLTCGSSPIDIVVPASHRHVSSGSSCPSGPSSGNHHHSS

SEQ ID NO: 59365 - protein, 154 aa, Sorghum bicolor
  Clone ID: 7218715.pep
TRLLLGSVFDANSLGKWIYDWTVYHQGPATPISDMAGEMWLLLIQLAGKVKRAEETVGRVRTPDNRDLVEEFIEAGERLTEKLRSLLKACEAPMLKAAKRKQAGLGKNAGVEFVETLFGRDRELDKTEKFMQNVRLFNLRFDANCEEILRNPTK

SEQ ID NO: 59366 - protein, 196 aa, Sorghum bicolor
  Clone ID: 7218718.pep
TRRYLSKKQYHECVKLINESASESQSSSGTTLFLVLLAALLVGGIVMGALGTSFKYIVLDLVVFFVVWIGLFRGNKEEHQERSKRMFDCLNSLNKRLLSQESNESNLPCYFVLGFRLLPASWVATIDATIIPHEQLFLMVPKSSNSTILANVQSESQSNVNDTSILINEVDDGETESLVQVPSAFHDSEDESDDDG

SEQ ID NO: 59367 - protein, 172 aa, Sorghum bicolor
  Clone ID: 7218728.pep
MAALSLRQKQLDLILRMLHLNQPPPPPGAAAEQEEEVYKILVLDTFCLSLLSPLLRVADLRKHGVTLYFPIDKPRQQVADAPAVYFLRPTQANADRVAADAAASLYASFHLNFSSALPRPLLDRLAAATAASGSAHRVARLADQYLDFVSLEDNLFSLAHPRSYVALNDPKA

SEQ ID NO: 59368 - protein, 158 aa, Sorghum bicolor
  Clone ID: 7218731.pep
TEREAIRCIEKKMCSIENGGALRSLPTATATAVADRVKLMAVPNPLTVKRDNQWQALRTLAQLLCSAVCSPATARPRLVGLASQRGSDGSRAESAGRCAESSGRRLAEDLRKEPSRPRSAERRGRGREGQNGDGRTAARLGGRWRVVAVGRRRRPPSC

SEQ ID NO: 59369 - protein, 118 aa, Sorghum bicolor
  Clone ID: 7218733.pep
LRHSIIISTTAPKLSFQISDVVQHVLHGAFVLEWRERERGRNSLEKRSLASERACTCALVPCAAHHLVQIQRMEREGGRNKGRTARERVQLVASWEDRQPPPTPTVSSQKLNLMNPRA

SEQ ID NO: 59370 - protein, 151 aa, Sorghum bicolor
  Clone ID: 7218739.pep
MSLHVPMAHRTKDQGATKAVILVGGPSRGTRFRPLSLDVPKPLFEVAGHPIIWHCLSSIARVPNKQIQEVYIIGYYDESVFRDFIKDSAKEFPAITIKYLREYEALGTAGGLYHFRDAILKGRPERLFVLNADVCCSFPLDEMLKLFNDKD

SEQ ID NO: 59371 - protein, 187 aa, Sorghum bicolor
  Clone ID: 7218758.pep
TRVGVHACRRAGVGPETGVLVVGAGPIGLVTLLAARAFGAPKVVIVDVDDHRLSVATSLGADATVKVSTRAEDLESEVERIQAAMGSEIDVSLDCAGFSKTMSTALEATRPGGKVCLVGMGHNEMTLPMTSAAAREVDVVGVFRYKDTWPLCIDFLRTGKVDVKPLITHRFGFSQRDVEEAFEVSAR

SEQ ID NO: 59372 - protein, 212 aa, Sorghum bicolor
  Clone ID: 7218760.pep
ARGDTGTELASFDKSLESVEEALVKLENLLQELHVSSSNSGKEDLQAACSDLEMIRRLKKEAEFLEASFRAKAEYLEADAPAEEGRVKTGSRTNDTSAPQKSGSRVDNKRRPFWDFFGRSLGKKVDPALADQDGTVDNVEKKDGESNDILRFEQLRRELIELEKRVQKSADEAQKEEEMVVTDEIIAPSPGSSVPSGQATKKENVITKSVEK

SEQ ID NO: 59373 - protein, 118 aa, Sorghum bicolor
  Clone ID: 7218766.pep
KNSVGHVLHYDRGGRSSKRRGDTTSPDVRREHRICALTQLPLASHTQTSSTAQVTNTMHPPTPPAPTHRALTPTTHPHRTTLPFTPTPNTNEHSSPQRHVARKVLYDGSPSGSRHGDE

SEQ ID NO: 59374 - protein, 169 aa, Sorghum bicolor
  Clone ID: 7218768.pep
MTPAQDPFYIVKDEIQDSIDKVQDTFLQWKQTPENPGEYVHLTKELLTSCESIQWQVDELEKAISVAQRDPAYYGLNEAEIGRRRSWTSTARNQVLALKRNVEGGRQKSVFGRSTNPSESIRSKKNIVQDNDEFIASESDQQILLIKRQDEELDALSASVQRIGGVGLT

SEQ ID NO: 59375 - protein, 214 aa, Sorghum bicolor
  Clone ID: 7218771.pep
TRETSMLHKNAEEKVKVLLRVPEQKTRLVGLHTLPLTFIRKYDAKLGLHGKTLVKTIRSTMMDSRHKEIHPTQNSFTVSGHYYHPREFTVSALNGMAWSSESHVQVNFERQSECADAIELLITSRLFQSTEISSAKPQFDQFYQDAKKFQPVFDDDVEADNDDETDTHNDRRSRLTTYLSDEYKPRAAYRHFVNAVVKTIGGSVDHQASAKLEA

SEQ ID NO: 59376 - protein, 186 aa, Sorghum bicolor
  Clone ID: 7218778.pep
MAAPKPIWVRQAEEAKLKSEAETAAAAKAAFEATFKALAAAPGDADNDADPAPPSPAEPASPESDEDDAPAPPGPVDPSKCSAAGPGIAGGSAGTPSTFTVVAKDRHSRRLTAGGARVRVRVSPAAGVGGDDLEGAVKDNGDGSYTVTYVVPKRGNYMVHIELDGAPVMGSPFPVFFSGSTATPSA

SEQ ID NO: 59377 - protein, 182 aa, Sorghum bicolor
  unsure (1)..(182): unsure at all Xaa locations
  Clone ID: 7218780.pep
TRVPYTIESPGYLKVAGESLPRRHPRAKHGLLRYPSAGVLTVFDIVRRSAKLYPDNKAVGSRRLIKMHREFKIIQDKEKEWIYYELGPYNYLSYSQYELLAIQIGSGLRKLGLSSSNKVYLFGTTSANWISMSHGCASQGIPIVTGYDTLSATDIQHSLSXTHAEVIYLDPHLLGTASIALE

SEQ ID NO: 59378 - protein, 209 aa, Sorghum bicolor
  unsure (1)..(209): unsure at all Xaa locations
  Clone ID: 7218789.pep
VAFVAANKALLAAAWVVGFALVFLWQSASMSFGSAGAGGAAGGGFLRLLSAPPPPPRPAPRLRPTAYNLTDFGAVGDGRAVNTEAFERAVETIAALAERGGGQLNVPPGRWLTAPFNLTSHMTLFLAEGAEILGITDEKYWPLMPALPSYGYGRERKGPRFGSLIHGQNLKDVVITGHNGSINGQGEVWWMKHRRRILXYTRPPLVQLM

SEQ ID NO: 59379 - protein, 199 aa, Sorghum bicolor
  unsure (1)..(199): unsure at all Xaa locations
  Clone ID: 7218795.pep
MMGLFTTATNAVKGAAGKPPSSGEDKPPSDTEADETSILDENEGSIITHMVSQLRVGMDLSKVSFPTFVLEPRSMLERITDFMAHPDLIFGAENVEDPDERFIKVLQYYLAGWHIKPKGVKKPYNPVLGEFFRCRYEYPDGSRGFYIAEQISHHPPISAFFYTSPANKLTIIGELRPRSKFLGNSVSTXMDGENRVILH

SEQ ID NO: 59380 - protein, 101 aa, Sorghum bicolor
  Clone ID: 7218796.pep
ASIIPSGDLPERHVRYSYFWVYRTCGAIIATRKIALPRNATCHGVDNTKFAPGAEFGSTSRYGSPFRRSGSARSPSRHFLHRIFLCFLLICTDVCSGLLSL

SEQ ID NO: 59381 - protein, 184 aa, Sorghum bicolor
  Clone ID: 7218814.pep
IVEAVGDHRAIHVVDFDVSLAQHAALIQYLAERRVQGRSLKVTAVTDPSSPFSQAQTASLTTIAEPLKKLAERAGVEYRFNVVSCRAADLDASRLCCEPGEAVAVNLAFALSHVPDESVSPANPRDELLRRVRALGPQVVTLVEQELNTNTAPLAARFTDACAHYGAILESLDATLGRETSAEK

SEQ ID NO: 59382 - protein, 151 aa, Sorghum bicolor
  Clone ID: 7218818.pep
ELSSDKSSVSDITPSAISRSNSLGGNLDSLPSAHHNWPHSLQEHLSGSTSTSTVDAQSISPCTDGSSNLRISEKSPTVSRALQELMLSEDEVSHAFSSNFILLHYGVESLYMRIQSIHARPLYLCLQLVVCTKAALQSHITFCIVFILLVS

SEQ ID NO: 59383 - protein, 89 aa, Sorghum bicolor
  Clone ID: 7218822.pep
DGHAEQQELDILNTLLIIDNRRSAKKAKHHKLKTRLKKHFHLIILDMLECLQMPSNTASASKCLPAVPKALINKFRITILLPPLTEVHL

SEQ ID NO: 59384 - protein, 208 aa, Sorghum bicolor
  Clone ID: 7218823.pep
ARGEGGAMWGTYMDYWKCTGDSTYNKVVMQSMQFQVGDDQDYQPANVTLSLGNDDQGFWGMSAMLAAELDFPNPASDQPGWLALAQAVFNTQANPDRHDSTCNGGLRWQIPRTNNGYDYKNSIANGCFFNLGARLARYTGNKTYSDWAEKTWDWMEGVGFLDPDTYKIYDGAHVGTNCTDINKAQFSYNSGVFLQGAAFMYNHTNGEQ

SEQ ID NO: 59385 - protein, 206 aa, Sorghum bicolor
  unsure (1)..(206): unsure at all Xaa locations
  Clone ID: 7218835.pep
HEGVAMSLTVRSLNGDTAFLLTFSPLEAPPSSPGFFPGSFTVLIDPWLVGPSIIFNSVFSISHQKAQPCISHLKELGREPDLILISQDKPDHCHEETLRQLPPECESTILATPPAAKKIRSWRHFRPELVHALPRYVQNDDRTIHRIVLPPPTPRGSCGEVTIAWMPEKRDVSRLHHAIGITYRPPCTVLSAAKSGFYLDLPMSPX

SEQ ID NO: 59386 - protein, 68 aa, Sorghum bicolor
  Clone ID: 7218842.pep
IVHESLAGFPSLPYRRLYLSLYDVCLHVLTNIAKPFYFSDACKHQPMNCKPKKVEKQHQSGTHGSTNG

SEQ ID NO: 59387 - protein, 187 aa, Sorghum bicolor
  Clone ID: 7218843.pep
STLYKRFLFSTAGVQSYPPVSSNQRLFLVNTHQAPLNPKNFYYHNLSRSSILRGFNWAMEALCQNMGGIDRQVLTSLLARRVERKLILDHLLSSYPKKLIMPSFLLYRIMRSGKVQSKKMAYPSPPSPKPMVGLLTIPCDAATAGCCFQSSIFSISILKNTTHHSSALWISVARLSDTKKTLSVIKR

SEQ ID NO: 59388 - protein, 209 aa, Sorghum bicolor
  Clone ID: 7218846.pep
HEAEIIRMKETRIAEVGAAEPVTQKEYATPLWHQIKHVNKRQNLAFWRTPNYGFTRLFNHVIIALLTGLMYLQLDDSRSSMQYRVFVIFQVTVLPALILAQVEPKYAISRMIAYREQMAKAYKTFPFALSMVIAEMPYNVLCAVCFFLPIYYIPGLNPESSRAGYQFLIILITEIFSVTLAQALAALTPTPFISSLINPFVIVIFALFC

SEQ ID NO: 59389 - protein, 210 aa, Sorghum bicolor
  Clone ID: 7218849.pep
HEGDSVHNVIEQVHGDKRSSITAESDMHDPSLLAIAQNHRVNNLTMAPSTLFADIAFTLAKHLIENHGLDTQSNLPSINNMAVEKALIVGETGPQLFRASLDMDWTTMQGSARIFGVNASGKQTTLHAVCDVAVDNPGTHRESWQSHAYLIQRSIKQLVQGASDGSAHMMRRGLLYKIFSNSVQYGSAFQGIEQVWFDSEGLEGTGKVLM

SEQ ID NO: 59390 - protein, 140 aa, Sorghum bicolor
  Clone ID: 7218851.pep
HEAEKSNIPWREMTKEVLESDVYEVFERIQDPNLVYPDYYLNPFHAYDEGNLSWLAAAEAEPATMSIAKRAIPDATSIEEANQIVRGNWLNVIEEHHVKYSGNCQVNDILDIGCSVGVSTRYLAEKFPSAQAVVSSQISS

SEQ ID NO: 59391 - protein, 89 aa, Sorghum bicolor
  unsure (1)..(89): unsure at all Xaa locations
  Clone ID: 7218855.pep
MKVVENQVSPPFIIVSPAGHVESVRNCLVENDYFGLDTEKVWVLEELELPVVSISSEGNRXKVLMKSPXEIIKRPAGSGGIFSLLASNK

SEQ ID NO: 59392 - protein, 214 aa, Sorghum bicolor
  Clone ID: 7218858.pep
ARGISTLGTIANSQSLDTIGWFARDPCILHRVGEVLLPTAAGGLKQTRQIVFADDCFQLLKVSNQKTVHAIKNAVQALRGYQPPKHINIGQYICSNVPSLKEFCEPATKLQEGTSALKAISTVMLLLQRYEFKANHEEWVNTVKPKLGLDISTRVLQAVNFAHENIKSLYAVRNELRAALKNLLKDTGILVLPTTAGYPLKRNSKERLSSGFED

SEQ ID NO: 59393 - protein, 169 aa, Sorghum bicolor
  Clone ID: 7218861.pep
MKLPLNQVPSALFSKLTCLRALDLSYTELDFLPDSVGFCLHLRYLNLRNTLIKTLPKTVCNLFNLQTLDLRDCYWLMDLPADMSRLVNLRHLSLHIDWDRVTAFRSMPSGIDRLQSLQTLSRFIVVSKDGGKCNINELKNLKIRGELCLLNLEAATNDGVMEANLRGKE

SEQ ID NO: 59394 - protein, 208 aa, Sorghum bicolor
  Clone ID: 7218866.pep
HEAAIAVYESPQARQFAEDVRRRIAIALHSLGDEINPRPNSRQPRFNRPEDADGFYESRGGADPGVDADEESQRRQREELMYWNAVALEKKEKEMRMRSSRSLSMNEKDDIAEPRSPASRFEDFLQEHPTEKGTYVYNTGSDAHDTVDYGLIHRRGGVEGLRGLGASIYSNPFADEHHIDIEEQRNLMAPDESEKVEILSDIYNASER

SEQ ID NO: 59395 - protein, 181 aa, Sorghum bicolor
  Clone ID: 7218867.pep
MDAVIAFTSGSPSPTRFYYSASPSIRVPQSLSVCGPWRGRGRPLLALRHRSQTQATAAAAGAAEVSHHDVVVVGAGIVGLAIARHLLLHTSLSVAIADAAVPCSGATGAGQGYIWMSHRRPGSDTWELALRSKQLWEELAAEVDGQGGGGARERLGWTRTGSLLVGRTSEELDTLEERTKV

SEQ ID NO: 59396 - protein, 124 aa, Sorghum bicolor
  Clone ID: 7218870.pep
MRAARYYGKEDVRIEDVEQQKCGAGQVRIAPAYVGICGTDLHEYLGGPTFVPTEPHPCTNDKIPITLGHEFSGTITEIGSSDSAFSLGQNVCVQPSIYCGVCEACKAGCENVCFQGGFIGLSGG

SEQ ID NO: 59397 - protein, 165 aa, Sorghum bicolor
  Clone ID: 7218889.pep
QAWKGTANSSRTRHCKPTPSNKLVHSFGYYSTLSILLQFTPRDLHAELAPAFAHSSSRYLGGRSTAVSSLGDLFAIREQTCAQDRTWGPYFLISGPQQTSNLYTEHHVSVTTLCLVATARPGPGHRGFSNDTLTIPIQRLPQQCTDIGQRFINLFAITRSPQHQQ

SEQ ID NO: 59398 - protein, 191 aa, Sorghum bicolor
  Clone ID: 7218891.pep
MDSNNNRLHLNFGFNNNNNNNDRNYNAANNHVYPTTPSAFPQPIYQGQDFVDPHGAQNTAYGQGYFVNGPYSQQAHYSMQQQQQQQQQYAQHNLASPQPAYGARAYNNDGTNGLIQQFSNQDLSASPRPGLSPRAASPAQRPRTAGSTGPQQHGGHLAPGMGNRSSKPPGEEEELQRYPERYSENVHKRGK

SEQ ID NO: 59399 - protein, 143 aa, Sorghum bicolor
  Clone ID: 7218895.pep
MLGPLLRLLSACGGVWPTSPAPGAAGAAASASSSSGDDSEGRDGLLWWRDLARCHAGDVSVAVAQANQVLEDQCRLDSAPPLGTVVGVFDGHGGPDAARFACDHLVPNLREASSGPRGVTADAIREAFLATEEGFLALVSSLW

SEQ ID NO: 59400 - protein, 117 aa, Sorghum bicolor
  Clone ID: 7218902.pep
MQRARSAVDFSNLLNPSSATPSQDQGSGAMSTAAVTVIKPNGPIPGAQASESANELPRPYKCPLCDKAFHRLEHQTRHIRTHTGEKPHACQFPGCSKKFSRSDELTRHSRIHSNPNS

SEQ ID NO: 59401 - protein, 134 aa, Sorghum bicolor
  Clone ID: 7218903.pep
MGASISKMMNKIFGSKEMRLLMLGLDAAGKTTILYKLKLDQDVTTIPTVGFNVETVTYKNTKFNVWDVGGQDKIRPLWRHYFSGVQGLIFVIDSNDRDRIDEARTELTRIIQDREMKDALLLVFANKQDLQSAM

SEQ ID NO: 59402 - protein, 193 aa, Sorghum bicolor
  Clone ID: 7218907.pep
HEGNLLFFLNRYLTMVTSVIFVSIRELVSTSSQCQLYNYCHEFALVMAQVIVIAIMFLRTYALYNCSKRVLILLLVAAAVAFAVMTWSFFGQHAKPIQGKASQVGCQIETSEETARRISMAWMAQLGLDILVFCLTFFRTFHAYSKQSRLNLPSILFRDGILYFGAITIANLANIVALWKLPGPLCASLTQFV

SEQ ID NO: 59403 - protein, 191 aa, Sorghum bicolor
  Clone ID: 7218912.pep
TRTIENVIDLEAERWIFKSGFVQWLIALILGTYFKVGSSYIALIWLVSPAFAYGFLEATLSPVRLPKQLKVVTLVLGLAAPVVSSAGLAVRMADVIVGSIVRIDRNPGGLPDWLGNVIVSVAIAVVVCSTFVYLLSYVHISGDKIILGLLLFISFGLSLALASSGIVPAFTADVARSVNVVHVVDTTGIDD

SEQ ID NO: 59404 - protein, 43 aa, Sorghum bicolor
  Clone ID: 7218914.pep
KLTRINDDVPAHNWPGEINAIWQAEGDHWELPADVVPLLEPRA

SEQ ID NO: 59405 - protein, 70 aa, Sorghum bicolor
  Clone ID: 7218915.pep
RAWSNRWLAANGVAQGADTRLTRRLGLRRRLGLDCLFLGDQNDVLPDISDGIERSSRHLMQSAIEGTPRA

SEQ ID NO: 59406 - protein, 46 aa, Sorghum bicolor
  Clone ID: 7218917.pep
HEGQIAREIAILRTAEHPAVVRCHGMYERGGELQILLEYMDGGSLD

SEQ ID NO: 59407 - protein, 88 aa, Sorghum bicolor
  Clone ID: 7218929.pep
MASMQSMTSAAARAQWTPKQNKLFEQALAVYDKDTPDRWHNIARAVGGGKSAEDVRRYYDLLEEDVGHIESGKVPFPAYRCATGYGAA

SEQ ID NO: 59408 - protein, 47 aa, Sorghum bicolor
  Clone ID: 7218933.pep
VSPKGVKFLSTADKMDGAPLVFQLTAEMIELEEHGSSHHKEGGGLNP

SEQ ID NO: 59409 - protein, 84 aa, Sorghum bicolor
  Clone ID: 7218961.pep
SRDSPSLYSLHCNLNKFVKKTMRVICIELEIVGRGICWYFHFSCRLSFLKEISTVFSQCHLFLPPPSPQLSSETISHFKPETKA

SEQ ID NO: 59410 - protein, 61 aa, Sorghum bicolor
  Clone ID: 7218964.pep
GLPPVVEVLVENRTEALQRRAVWAVERILRVEDIALEVAADQTVASALVEAYRNGDVRTRQ

SEQ ID NO: 59411 - protein, 139 aa, Sorghum bicolor
  unsure (1)..(139): unsure at all Xaa locations
  Clone ID: 7218966.pep
YDEHWFVLXVDIKDRSFVFLDSYYGLQDEYQVEMRDKLISNFKFWWKKFGLIDMGFHGYTVSYHFVPKQAANNLSDSGIFAMMFLEHWKSPRSSIFTLFKESDIPNLRIKFANDLVFSAKNTGRKDLVTSYQFEDDQDV

SEQ ID NO: 59412 - protein, 50 aa, Sorghum bicolor
  Clone ID: 7218969.pep
DNPGAWFKHCHFEFHLAMGMAPVFIVKDGPTPNKSLPPPPPGFMEGSPCQ

SEQ ID NO: 59413 - protein, 92 aa, Sorghum bicolor
  Clone ID: 7218971.pep
VLRRLLVKYRASGKIDKHLYHELYHLAKGNTFKHKRALVEHIHRAKAEQAREKQIKEEMDAKRARTKAARERKQERQAAKRNALLGEEEETK

SEQ ID NO: 59414 - protein, 40 aa, Sorghum bicolor
  Clone ID: 7218974.pep
LLNLLYTKINSCLSSFHQTTIGLFLTGASLQKGANNSHLN

SEQ ID NO: 59415 - protein, 145 aa, Sorghum bicolor
  Clone ID: 7218978.pep
VSDDIERRCERANVLCEALRALDATDLPAMGVRDLLLPSIQNLLKDLDALDPAHKEALEIISRERSGGTLESISKVMGAHLGIASSVSSFFGESSLLTKKEGGEEHDPAGPTVPEPNLQAQPESTRFGRIMRSGFGDILRGQSKG

SEQ ID NO: 59416 - protein, 24 aa, Sorghum bicolor
  Clone ID: 7218982.pep
MWHVCETTFMPVKPHGPFVSPPLV

SEQ ID NO: 59417 - protein, 44 aa, Sorghum bicolor
  Clone ID: 7218990.pep
TFTYMGELGYTIPQNKKKGGIHYVGYIDTSSKRKGNLTNKSSFP

SEQ ID NO: 59418 - protein, 133 aa, Sorghum bicolor
  Clone ID: 7218991.pep
ASKASLAMIFIFGGIYSIGITPLQALYPVEVLSYEMRAKGMAFSSLAVNAGGLLNQFAWPVAMRNIGWKTYIIFTIQDACQAAIIWWMIPETKDRTLEELDEIFNSKNPVKMSTQKKAVAVNSYGEVVNIREV

SEQ ID NO: 59419 - protein, 43 aa, Sorghum bicolor
  unsure (1)..(43): unsure at all Xaa locations
  Clone ID: 7219002.pep
FEKTFIQAIVFNHPTLKELGGXSEVKAKVKIMAKGKEYVVEDG

SEQ ID NO: 59420 - protein, 179 aa, Sorghum bicolor
  unsure (1)..(179): unsure at all Xaa locations
  Clone ID: 7219003.pep
VFFIGSIAETNRAPFDLAEAESELVSGFMTEHSAVIFVFFFLAEYASIILICILNSILFLGGYLFDFNYYLYPYFYLLQFIAGDSYMYLTENETNFNVIDFDNYNSVIGTTISGVVIGFKTCIMVFVFIXARASFPRIRYDQLMSYCXTVLLPIVIAFIILVPCILYSFEIMPVNIPLL

SEQ ID NO: 59421 - protein, 45 aa, Sorghum bicolor
  Clone ID: 7219006.pep
PIKPLNANSLNKQTSVSGGEKFLISKTGLQLCLHWKLKPGNPKGK

SEQ ID NO: 59422 - protein, 119 aa, Sorghum bicolor
  Clone ID: 7219011.pep
TTAPSRLSRPRPFTSTAPTPPALFTPCRPPPVPPRPPPCPRCRPPPPVLMATSRPSPRSVMTTTTSCRPRNSPSPPSSPPLTARPLPSASSLSSPSLSVSSSLWLLLSWLSVRSVVLKK

SEQ ID NO: 59423 - protein, 111 aa, Sorghum bicolor
  Clone ID: 7219012.pep
AALAEASTENRADPGALSQNTPHEQDGSAIAREAFVGVPNPVVATTAGTEADEPSNAHQLPATTPALDAAEEGKLGNGEPAVGHMGVKRTDTGFSVSDLHVPGEYPKTKGA

SEQ ID NO: 59424 - protein, 67 aa, Sorghum bicolor
  Clone ID: 7219019.pep
LGGINNLLCSSLVQISTKKMKSLGTNCKAKSFYYPHSTGTCLPAGRELQFLQPCRTTANSKNKLISK

SEQ ID NO: 59425 - protein, 148 aa, Sorghum bicolor
  Clone ID: 7219020.pep
MSVSMPEDPFVILGGTHKSGYSSFGLFSDLLNNIGMPVKEGNTKVDAPDNTSGIFQGSDIFTDFPKAMPPFSFTSENQSDTNERRHAENINSMSHSDRVPQEKPVQRASTEAPDNKLFEMNFPEASVIHEVPVTTGFQTLNPFAEEDD

SEQ ID NO: 59426 - protein, 134 aa, Sorghum bicolor
  Clone ID: 7219021.pep
LCVAVDGLHITTLRYMDACVRSIMTTHRPWTSPYPRDRFSSVGIPGFGLPTRKGLRLDSRRGVFVAVLLLRFLYLRLQLLFLLGKLFVVLKPLRICVIAEGGLRWDGGSLLHGRPRADTICPLLDIWKVIYFYP

SEQ ID NO: 59427 - protein, 203 aa, Sorghum bicolor
  Clone ID: 7219026.pep
HFTLTLALAHLHSLTYTEFLSAILQHTNTMAMEAAHHALIDPLIEPDPSDETGLNSHFRSTFAPAAPITPPGSAGHPKEHPSVSIQHTGSSVETNPYRRSRAASDTKGMSPSMTHYGQNWSQNRKYDYPSPPSSASPKRSRFPNNYRAEALGSLNEPKPRRASNPPPSTLNKDELSRKSSLKARYPGDKSHRPLDQLRHDEKV

SEQ ID NO: 59428 - protein, 172 aa, Sorghum bicolor
  unsure (1)..(172): unsure at all Xaa locations
  Clone ID: 7219031.pep
MDTKPTVRSQARRRKLLCIVLPIVAVCILAIALGVGLGIGLGGSGGDDDDNNNNNSPSPLPTPNGTLPWVPAVSSTWQIILSHPPDLTDSSSSLTPNVSIYDIDLFDTPQSTIDELHARGVKVICYFSAGSYEDWRSDAKDFKDSDLGKPLDGWPGEKWIDLNXRNVRNIMK

SEQ ID NO: 59429 - protein, 77 aa, Sorghum bicolor
  Clone ID: 7219033.pep
ARGFFTTASGLLVGYAYFLITSRDPTYQDFMERLFLSRQKKLCAAKKFDMERYLELQKHCRCPLEGHRPHGPKLHDL

SEQ ID NO: 59430 - protein, 210 aa, Sorghum bicolor
  Clone ID: 7219036.pep
DAFITANDDDYYKLGGVAINDPIIGDTTLQQQAVIYPYIESWSNLFYFNQSFMNGLRWTHQHCGYEKYLEKYGTFPPPEEKFPLLPDPTADTNPKSNYTCDIFDWAYYAALDSNPCFNIYHITDTCPQVYSQLGIVNEGDYSPPGAKVYFNRTDVKKALNAPIDVTWYQCTPNKVFGFGDPNSNRSDTSLAPAQNDVLKRVIEHTNNTII

SEQ ID NO: 59431 - protein, 211 aa, Sorghum bicolor
  Clone ID: 7219040.pep
ARGEDDRNHGRYLNRAPDWPDSGYGAANDGPGVTQREGLMTYKQFMQVLEDDISPSEAERRYQEYRTEYITTQKRAYFDLHKNEDWLKDKYHPTNLLSVIERRNERCKVIAKDFFLDLQNGTLDLGPGITAGAASKPGGSDGNSEDDMDNDKRRKHGKDSSKATDSLSGAPKAHPVSSESRRVQADIEQTLALVRKLDAEKAIEGNVLSSC

SEQ ID NO: 59432 - protein, 110 aa, Sorghum bicolor
  Clone ID: 7219046.pep
SSVLHAARSMITTTHPTLGVMARSQSVIKQRNGENVFRSATAPISPPPLTRPRKIIKHNSPPNESSFLCKISANARATNHEYSQANVASDTTKNVPRCRACRQKIIKDFD

SEQ ID NO: 59433 - protein, 111 aa, Sorghum bicolor
  Clone ID: 7219049.pep
MAPAAPVLQQIQSGLSDKERIPQDGLAYSDEPKARLWRRVLGGTNAPENSTQRGMKSRHLTMIALGGTIGTGIFLSAGASVALAGPGATLLSYIVVGLFVYSVVIALGEMA

SEQ ID NO: 59434 - protein, 198 aa, Sorghum bicolor
  Clone ID: 7219059.pep
MAEVETNGAPEASLLIPCIKSLKRTYDLFLTNQLNPRALDDLESQRIKVYSKVQDEYAMVRDMPPPAPPSRAVTTTTPSTTGSTAVTTTHAAAEGTLALPSTSEVPYGEIRDEESQITVVGAHSYPSGPGVSLSQDGKAVGITEKGFDELLHTLPNKNAQEKAKISHGLVEYRQAAGIGERINPPAPGTALAGALTPI

SEQ ID NO: 59435 - protein, 207 aa, Sorghum bicolor
  Clone ID: 7219060.pep
ARGTALDGNSPASSNSVTSQLSSASPPPVIPEGPSNLSKNPSNIRALVPQIKASGPAANLTIVATASSPQDDGGPSSSGAGPMKKTYDIPPRPKPGRKPATDEPQSKRKAQNRESQRAFRARKAQRVQELSDKLATSRETFDQERNTLLVELDQWKSQTQELQAQNAKLAMEVEYWKQQHDHLKNGTSAPDTVPSMVNAHPETPHAY

SEQ ID NO: 59436 - protein, 152 aa, Sorghum bicolor
  Clone ID: 7219062.pep
YLWVSIYFLSLSIDDVRRTREERNLRLRARRAEMSDERKEEMRRKQREYSRQYRQRKNAESQKSALCLDKENIQPNDTSNGTTTTSRNTEPMTIGKYRIHDMNYSRDTRCHSILIYITATNIYYCNNLYEMSLYFNIYCNKYNAGNFACTFS

SEQ ID NO: 59437 - protein, 188 aa, Sorghum bicolor
  Clone ID: 7219073.pep
MQCFSLCCIPLVAMAPAHADHQLRLSFLVVVAGAAASALLLASPADAALPRVEHAPTKADGSLAILAVGDWGRRGQFNQTLVAQQMGVAGEKLDIDFVISTGDNIYDDGIANTSDPLFKESFSNIYTAKSLQKPWYLVLGNHDYTGNALAQLDPAIRKVDSRYTVIAKSFIVNSGIADFFLIDTTPFI

SEQ ID NO: 59438 - protein, 206 aa, Sorghum bicolor
  unsure (1)..(206): unsure at all Xaa locations
  Clone ID: 7219077.pep
ARGEPIFDVYNIEKEIDSILCKRVPLCNGGSLVIEQTEALVSIDVNGGHSMFGQGTSQEKAILEVNLEAAKQIARELRLRDIGGIIIVDFIDMSDDSNKRLVYEEMKKAVEKDRSTVGVSELSKLGLMEITRKRVRPSVTFMISEPCTCCHGTGRVEALDTSFSKIEREICRRLATSRRXSDPEKPKSWPRFVLRVDHEMCTYLTS

SEQ ID NO: 59439 - protein, 180 aa, Sorghum bicolor
  Clone ID: 7219081.pep
MATLNYVKRSSETITDIAKDVIRLLKEEKETVGVAESLTGGSIMAALTAVEGASSVCRGGIVSYSIGIKVNILGVSQSIITKHGAINGEVVEQMAAGARSITTLDTPTTWGLSTTGVAGPGTEEGKAPGTVFIGISRAGQDRAFGPFYFPGDRDAVRKATITKALEQLRELLRDRDHMDE

SEQ ID NO: 59440 - protein, 200 aa, Sorghum bicolor
  Clone ID: 7219091.pep
MKEIVQRQADEVQRSLKEKKVLAAPRNPPTFEKEDSYQIAHDIVSGLVDCIRQNGGANPDGDLSTVASAVSAIVVNAGHVIAKHLDFAGGNYQGVNSVSNSLNFVRHTLRVHINSLCLLKETLGDRFSRAFEIALAVETSAAVTAAFAPPKMHRNQFQPSPEVHDAYGNHTSDLSNSGKGFVGRAAKVSAAVSALLVGAV

SEQ ID NO: 59441 - protein, 196 aa, Sorghum bicolor
  Clone ID: 7219094.pep
TRAESPKEKPTATKRNSFFGNVFSKKEKKTPELKPTEPEATKEVEAETTAPVIPPVEATTPLAVDVSNPATVPTETTETAAATSPAPEAKKDLKEKRKSSLPFAFGKRDKSPAPAEGEKKESPFSKLRNTIRGKSPKPAEKRAEENKEETVREEPTDAKAEENKTGEAPKIEEPAEPETEDKPKDAAPAPVVTAAA

SEQ ID NO: 59442 - protein, 205 aa, Sorghum bicolor
  Clone ID: 7219095.pep
ARGSGSQVASLETYGTLGAIVKSRTGNKQVGFLTNRHVAVDLDYPNQKMFHPLPPNLGPGVYLGAVERATSFITDDVWYGIYAGTNPETFVRADGAFIPFADDFDITSVSTSVKGVGVIGDVKAIDLQSPIGSLIGRQVVKVGRSSGLTTGTVVAYALEYNDEKGICFFTDFLVVGENQQTFDLEGDSGSLIILTGQDGEKPQPI

SEQ ID NO: 59443 - protein, 109 aa, Sorghum bicolor
  Clone ID: 7219103.pep
WVCFVSHTCSRWTHAAALQLHLIRCTDRLPAYCAKIWKVSQALVIEQWIFSAAAKARHAALQNFCAAAKNRHVAAEIPALGEKNIHAKSLAQRGVEPCPHNTIQSIVTN

SEQ ID NO: 59444 - protein, 76 aa, Sorghum bicolor
  Clone ID: 7219172.pep
NSLRDVDEGFDDSFGGEGMDFPLFPSGNGMTNKANEYQQPLFGEIPSANLGFSQTSQQDLFQMDLSNMDFQQNFTD

SEQ ID NO: 59445 - protein, 155 aa, Sorghum bicolor
  Clone ID: 7219183.pep
MRAKGVTDDDLLAILRLLDLSHLVDLYPEGWDAEAEWRDVLSGGLQQRVAMARLFYHRPRYAILDECTSSVTLETEKIMYDNAKSLGITLMTVSHRRSLWKYHSRILQFDGQGNYVFTKLDADKRLKLEDEKEDLDVLLRQVPEIERRIAELTAA

SEQ ID NO: 59446 - protein, 125 aa, Sorghum bicolor
  Clone ID: 7219186.pep
IEVPHRQLALLSAMQLAIRNKNYNSALSFANRIIANGGATKIVENAKKTKAQCERNPNDAIEIEFDQFAEFDVCAASHTPIYSGTAYEECAFDGSKYHPKYKGPVCRVCEVCEIGKHGSGLKLFA

SEQ ID NO: 59447 - protein, 131 aa, Sorghum bicolor
  Clone ID: 7219191.pep
DWPLDEAEMFARLGLRCTALKCRDRPDLESEVLPKLDEILHRITSAVYLRNPKLSVPSHFICPITQELMEDPHVAADGHTYEHYAIRAWLKRHKTSPVTRRKLPNSSIVPNHSLRAAIQQWKSQLPAQTNE

SEQ ID NO: 59448 - protein, 142 aa, Sorghum bicolor
  Clone ID: 7219201.pep
PQVIENTKKNVEKEQDEDLQKIQMISGSMFEPYPESVKGALIYQFRRILNDFPDEDVLRAFHNVRKAVAPDSRILIIEEMLNPKRIPMNVGLDICLMCAAGKRRNAAMFSELAAQAGFKLNAEFQQIAGEFDDFGVLEFVLA

SEQ ID NO: 59449 - protein, 104 aa, Sorghum bicolor
  Clone ID: 7219203.pep
PTENGYPTPSATPPPALESKPINVVKNDALDPKPIKADVDEGDSPKVLAAEPNGKPLEEQKLSGSAMSQEEDGEESADREGDIYSDAVLACSIENKEACIMCSG

SEQ ID NO: 59450 - protein, 128 aa, Sorghum bicolor
  Clone ID: 7219205.pep
VEETPPSSSSALVKDGSSELFFDLTEANVGFRHWHPMPVTSRGNKLAGQSEMGGVWEWTSSPLERHEGFEPMSLYPLYTTDFFDGKHNVVLGGSWATHPRIAGRASFVNWYQRNYPYAWVGARLVRDV

SEQ ID NO: 59451 - protein, 87 aa, Sorghum bicolor
  Clone ID: 7219221.pep
SGIHSDASNLLSKHVSSESVESLPLHFERSQSNGETQLLPHAPVVRVTDQSVQHSGYESVPRSHGTISRTVVRSCSFTRLVLGLLLC

SEQ ID NO: 59452 - protein, 128 aa, Sorghum bicolor
  Clone ID: 7219226.pep
SLAVEKPGAASGKIFNCVSDRAVTLSGMAKLCAAAAGADAVEIVLYDPAAAGVDAKKAFPFRNMHFYAEPRAAKAALGWTSSTNLPEDLKERYAEYAASGRGEKPMNFDLDDKILAAVGKAAPASVPV

SEQ ID NO: 59453 - protein, 120 aa, Sorghum bicolor
  Clone ID: 7219228.pep
SQVPKMLSVLRNQWAPLAFCISFKLETDSDILVQKAEMALNKYRMNVVVANLLATYKEEVVIISNGESNTIRRCNKDEDLEEHIIKLLEKSHSKYIYSSTEGRNKNDYGKVIPLGIKSLA

SEQ ID NO: 59454 - protein, 151 aa, Sorghum bicolor
  Clone ID: 7219231.pep
HKVSPSGERYIFYKIFVSELNYVLDQNKPQNDSDSTSPPSMPSVTPQMQKENECIGRLRLWQVFFANPYEWWDNRQSKPWPTYADFKHKDTREKIWLRPDDPPWVRKQLELHDLEVAENGHRGNSRLLKSQNWKAQDFDYSDDEAQHCAEA

SEQ ID NO: 59455 - protein, 69 aa, Sorghum bicolor
  Clone ID: 7219250.pep
NKGILVSCAGLCCKVNCTVRLISILQSTQGLHAIPGPVELQTCSHAGTKPSALNFYCFGTEHDHLSLIH

SEQ ID NO: 59456 - protein, 140 aa, Sorghum bicolor
  Clone ID: 7219262.pep
AWKLTSKPDYTESNPNYDEQKYIHALSPLLEQEGWSGAKFLIDQGRSGKQPTGQKAWGDWCNAKGTGFGLRPSPNTGDALADAFVWVKPGGESDGTSDTSAARYDYHCGYDDAVKPAPEAGTWFQAYFEQLLTNANPSFL

SEQ ID NO: 59457 - protein, 141 aa, Sorghum bicolor
  Clone ID: 7219267.pep
MGNARPNAQVDETTQCAAKCDQGDGSPQATEKYAKCQQDCFASLFPSSQTNFQGAAGGQVSSAASAATGAAASATSAANSAASSAASSARSGAESATSSIAGSGSATGTGSQSTSSPGAANANSVKVAAAGLAGFMAIFAL

SEQ ID NO: 59458 - protein, 188 aa, Sorghum bicolor
  Clone ID: 7219276.pep
IQTFLRQYHADDTGPFGVKRETLDIFIKSLAGYCVITYILGIGDRHNDNLMLRSEGHLFHIDFGFILGADPKIFPPPFKLTSQMVEAMGGEMSEEYEQFKSYCCSCFLILRKNANLILNLFSLMVDADIPGIAALGGEKSILKVQEKFMLDLTDEQAIKEFQDLIQSSVGNVWAPIFDNAHDIAMKFK

SEQ ID NO: 59459 - protein, 114 aa, Sorghum bicolor
  Clone ID: 7219283.pep
RSRWLRLSAVVSRSRRISLQKIMPEYCTYFNRVRQPSPAYAWVKCEREEDGDCYEALLKANIISRTGVQYEASSRYTRISLLKSDDDFDVLMERLQELVDAEKHDDASNGSSSM

SEQ ID NO: 59460 - protein, 129 aa, Sorghum bicolor
  Clone ID: 7219294.pep
GRGIGLGQKLRAYNLQDQGHDTVEANVELGLAVDAREYGIGAQILRDIGVRTMRLMTNNPAKFIGLKGYGLPVVGRVPVISPITEENQKYLETKRTKMGHVYGSDLPGSLPEFANPQDTPTEQEDDNQN

SEQ ID NO: 59461 - protein, 108 aa, Sorghum bicolor
  Clone ID: 7219306.pep
SALKDKSKRPLRTPLRCTSNRHSSSATDQKDAAQEMYTKSRRCSGRRFQVPSSVLDMLGHRRPARMQGSDVARNFCECRYAGRKSNQPAHIYGGKNAMTMSDRTWGIR

SEQ ID NO: 59462 - protein, 174 aa, Sorghum bicolor
  Clone ID: 7219327.pep
DEVQMLRIDELAQLGCCCFCSILYIGNNAFVQENPDKIRAFLRACKRATDFVLSNPDEAWREFCAFKSAMDTPTNRKIFERSFAYFSPDLQNVRRDWEKVTKYGKRLGVLTETFAPNYTNEYLDWALEHEASDPVGDQKKMVVLQEEIKQKGGFKRLEGVAGKTVVGAAAPAAI

SEQ ID NO: 59463 - protein, 105 aa, Sorghum bicolor
  Clone ID: 7219329.pep
YSLRNTLSDSKVDEKLDAGDKEKLKAEIDKVVSWLDESQQATKEEYEAQQKELEAVANPIMMKFYGAGGEGGMPGGMPGGAGGFPDGAPGGAGHNDDGPTVEEVD

SEQ ID NO: 59464 - protein, 95 aa, Sorghum bicolor
  Clone ID: 7219330.pep
DEDDDSYIDSDNDSDVPSLTSRSTNSSSPSSVSSRSSCCTCERYGITRSGDRVRLDCGGSRCGYSDDSSDCSSEDEQLLEYEAKTTRRQGVLIRF

SEQ ID NO: 59465 - protein, 228 aa, Sorghum bicolor
  Clone ID: 7219339.pep
YKGKLKEGSLVAVKRCVSMTSEQQKKEFGKEMLILSQINHKNIVKLLGCCLEVEVPMLVYEFIPNGTLFQFIHGSNGCHNIPFSTRLHIAVESAAALAYLHSWASPPILHGDVKSSNILLDENYAAKISDFGASILAPTDESQFVTLVQGTCGYLDPEYMQTCQLTDKSDVYSFGVVLLELLTGKKAFNLNGPENERSLSLRFLCAMKEGRLMDIIDDRIKNEDDMGL

SEQ ID NO: 59466 - protein, 155 aa, Sorghum bicolor
  Clone ID: 7219341.pep
HFQYVFAVSSDYEDFIRDLTRQLCQLSHGRVDSYLESAIQAFDAPWPVIRANAVCLVSCMLSFLDDQRFIAPYFSQVFATLVGRMSQSPDAIVRAAASSALGILIKRSNMLKSLVSRYDRADLSRNSQSGDSNSKTPSEFQEQTEGSPNDAQVEQ

SEQ ID NO: 59467 - protein, 96 aa, Sorghum bicolor
  unsure (1)..(96): unsure at all Xaa locations
  Clone ID: 7219352.pep
GITKKYAKEIEVIGKQFPAESFKWRTKEQGGTLRLPWGDAIAILREAGVQIGDFEDLSTEQEKTLGALVREKFDTXDYYILDKVPNRGSXPFYTYA

SEQ ID NO: 59468 - protein, 135 aa, Sorghum bicolor
  Clone ID: 7219353.pep
HRGLEARRLTTHCSPTAQQHSSKANTGHVHPQPPPFPHAPTKSERIKNGGGYRGGSFPPTALLCHVYESIFRREGGKGSHSVQAQQVLFFLEREGRSDRQTEGDESYIPPPPFFIRLGDHQQLDSATLSLLFFLC

SEQ ID NO: 59469 - protein, 210 aa, Sorghum bicolor
  Clone ID: 7219354.pep
EFLTRELSEDGYSGVSVRVTPAKTEIIIRATRTRSVLGERGQRIRELTAVVQRRFNFPEGHVELYAERVQSRALCAVAQAESLAFKLQGGLPVRRACYGVLRFIMEEGAKGVEVVVSGKLRGIRAKSMKFTDGYMIKTGEPTRVFVDKAVRHLKMRQGVLGVKVLIMLAADPTGRSGPKNDLPDCVRVSLPKEDDNEVAAAAPAVRAAAQ

SEQ ID NO: 59470 - protein, 79 aa, Sorghum bicolor
  Clone ID: 7219370.pep
SVYSIFTSIKGSKKDITMKILGQISNLPMGLQSTLSLTMILKPKMIQADLNVVECRLLYALAFPEKQDHLCLHSLAFTG

SEQ ID NO: 59471 - protein, 176 aa, Sorghum bicolor
  Clone ID: 7219374.pep
KMAGMIPGMSNMMQGMDDEEGGAKLKRMIYICDSMTDKELDSDGKILIEQPTRMTRIARGSGTSVREVEDLLTQQRMMAGMAKKMGGNMKNMQRAQQAMGGGNKAQQLAAMQKRLQSMGGAGGAGGMPDMGSLMKMLGGGGGGMPGGMDMQAMMRQMGMGGGGMPGMPPSGGRGRR

SEQ ID NO: 59472 - protein, 136 aa, Sorghum bicolor
  Clone ID: 7219382.pep
SYSFQSGPEPVLLDATAIASDKILLLDSYFTVVIFHGVTIAQWRNAGYQDQEGHEVFAQLLKAPHEEANLIIKERFPVPRLVVCDQYGSQARFLLAKLNPSVTYNSDNASPGGDVIFTDDVSFQVFMDHLQRLAVQ

SEQ ID NO: 59473 - protein, 193 aa, Sorghum bicolor
  Clone ID: 7219385.pep
NNPDLMFADFARRWMVKIVKSALPGDTIATVELSKRGAVLKNFGKRDYDLIPSYLLLRDDDYDHFIPNEGKWEKNPTSYDMRLVRRLGTLFSRDESKKVLGFRDVVKAFKYASSELQWEKTYGFTSFTLRWAVSLAYQQSPIPVFNQDKIQQVIDILNTWIKNQQFPDPYTKKTVPLLPAHLITRDSVLGVLQ

SEQ ID NO: 59474 - protein, 27 aa, Sorghum bicolor
  Clone ID: 7219436.pep
SISLAKFNSSIGEMYTYFAMEGVLVNY

SEQ ID NO: 59475 - protein, 62 aa, Sorghum bicolor
  Clone ID: 7219471.pep
WGSQSEYEIFNVPSSSHKGMRGLFLIRKGTIQRIPPINGTKSNFTDFQGTRMNSGIKKSILG

SEQ ID NO: 59476 - protein, 97 aa, Sorghum bicolor
  Clone ID: 7219475.pep
KKIILYWVFLIFISTVTKHTDRIVSKATVNWKEAHENLILAFVNPTIILYINITEPMYWRVFKFIVLPMNLGTLTTDTCGQLHILGHNSHTLGVDSA

SEQ ID NO: 59477 - protein, 91 aa, Sorghum bicolor
  Clone ID: 7219484.pep
SPAPYWRSWFPGLFSSFLAARTARLLILAGADRLDRELMIGQMQGKFQMTVVSNVGHMLHEDNPVRLAEIVVDFWRKNDRVVPGVKKVGEL

SEQ ID NO: 59478 - protein, 162 aa, Sorghum bicolor
  Clone ID: 7219486.pep
QTRVIRSKKRAVGITSSMRSNKKVSSLVDKWKAAKEELRGEEEEEPESALEALERKRQKEIEEWRKQQITSGEAQENANFVPVRGDWRDRVKRRRAEAKKESKDDTVAASLSSSEQHKGPPDLAELSKGLPTSWQAYLDESTKQVYYGNTLTSETSWERPTK

SEQ ID NO: 59479 - protein, 131 aa, Sorghum bicolor
  Clone ID: 7219490.pep
NTVTAWGSADVPYHVTSLDYIAAAFASLFPSTPIESLAGRRIGVYEVEVTGNKLVEALEAKNGTKPTFKLVSLEDAKAQQKAVIDANEKNDLIRLGVTLHVKIAQGTANVGKDVYEVPGYKKKTFQELLSF

SEQ ID NO: 59480 - protein, 98 aa, Sorghum bicolor
  Clone ID: 7219498.pep
PDLHFDIAYNACPKTPNENFHPVICHISYLVFVLWEQNHHQTLAVWAGLIYSGMLTAIELAGLEESYALPGKPKQLLWVRICRPMRKSGPLVLRLAEV

SEQ ID NO: 59481 - protein, 56 aa, Sorghum bicolor
  Clone ID: 7219507.pep
VHTTREKTLLTTPTGLIRVSKPMTIYIFPAIHFCARHNTSQSHYFTSLYGFFQTPV

SEQ ID NO: 59482 - protein, 64 aa, Sorghum bicolor
  Clone ID: 7219528.pep
MYSHSFFLLIADAPFPLKMDLIFIYSAFVKGDHTFFEFDLSTEGTQLYPHVNYTTMNEYLDTLV

SEQ ID NO: 59483 - protein, 81 aa, Sorghum bicolor
  Clone ID: 7219533.pep
TIKKWGKQLGKSWIFLTPLFSSGHKAKRIAGAWPNDFKGSPPMLAPHFILKTFFMLFKGTVSSWVRLHVFPFFFYGLIKDS

SEQ ID NO: 59484 - protein, 71 aa, Sorghum bicolor
  Clone ID: 7219544.pep
TPFSPYTNYPDFKPPSPPGSPPIEGPAAVNFAPVANVSTESFPPGPTPRPQSPYPNYPDFKPPSSPLPSPP

SEQ ID NO: 59485 - protein, 131 aa, Sorghum bicolor
  Clone ID: 7219555.pep
DSAQLIIPQSQVGRKNDIYIACVSSAHNVCPKGYWIAIVSTISETAANHHLELQPGLERLGAIEEQFMGPPIPIYEPLEDGTKDNIFISKSYDATSHFETTTDDVKDIYRRATGEELKVEGLREGITVAEE

SEQ ID NO: 59486 - protein, 26 aa, Sorghum bicolor
  Clone ID: 7219559.pep
YKLFNLKAILTRVFGIYWQMMGALIF

SEQ ID NO: 59487 - protein, 101 aa, Sorghum bicolor
  Clone ID: 7219564.pep
ESEEIEHTEVTTTTSETHKPQQHNNINTPNGNLTDSGTVEEKVVLVKVRGLFDYAATCDTELSFKEGDILSITEQDESGWWYAEIDGRAGFVPQNYVEVAE

SEQ ID NO: 59488 - protein, 110 aa, Sorghum bicolor
  Clone ID: 7219569.pep
SLPMLQWRKYGGTLVVQSARKLEWKKQPHFDVIHANAPKPWQCTNSHSRLQTTIGTRPMDPDSSQNLKLKGCTIILKTWVIFFCKMTRMPSPQHKSPPASTPSNQLHRSR

SEQ ID NO: 59489 - protein, 98 aa, Sorghum bicolor
  Clone ID: 7219571.pep
PSSQGYGPRRFALFEVGTAEQMRGIAPLSSLGDRALFLGLDRCLSVSANNLPSISSDAIYLCSDGLYPLLMYSVSSSTCEKLSTLSIIHDGPLCGPSH

SEQ ID NO: 59490 - protein, 124 aa, Sorghum bicolor
  Clone ID: 7219585.pep
MQSVNLPRSNSSTSKLPVPFFGLAFVLLSCASLASSCTEQEKSSLIDFRDGLSQEGKGSLSVSWANSTDCCRWEGITCSFDGMVTGVSLSSKGLQGRIPPSLSNLTGLLHLNLSHNSLYGNLPA

SEQ ID NO: 59491 - protein, 65 aa, Sorghum bicolor
  Clone ID: 7219588.pep
LGTGAKLHSASRWHKCLHVYMLGRGLIGLYKQPWPVHAPRRITGPCVSRIRAMPPLVQFLTKDPV

SEQ ID NO: 59492 - protein, 72 aa, Sorghum bicolor
  Clone ID: 7219593.pep
WCAPGLLPRRPGANDCAPQPDQAGSMKVLKQMERYLTFESCNVVGWLHFVITGDQALNKYTSVLSCLAGRLR

SEQ ID NO: 59493 - protein, 121 aa, Sorghum bicolor
  Clone ID: 7219599.pep
CSLDTFHPLDFFYLLSLFGTKPKTPIFNIPSTGRNPRVHGTSTIHEFVALEIPFPCSPLLSTSQQTDTHLHLSTSCSLPLHASSHSSLCDVARCIILRSYFWYLSPLLSCLGALQTAYGRG

SEQ ID NO: 59494 - protein, 204 aa, Sorghum bicolor
  Clone ID: 7219602.pep
LYSKQRIDDALNSPREKVCSCCGQHFKQRTVALSSRKTAELEPTGAFGSPEIYTEYSVVCQVDEPLEPKDIYHQTDYRSNERDDLLQMTSDSEIEVPCANDVKSSQSREASVVDEDLQEDAACEQPVLPSPVVIKESEIIVKKEPSVEDTCNTSLACPAVDDHPNSGGDVDRTEEKESLSRKLASRHDPVLVIENSGLEGKFCF

SEQ ID NO: 59495 - protein, 77 aa, Sorghum bicolor
  Clone ID: 7219605.pep
STTRIKHMDTFITQDITNHNGSNLHLSSSGLLDSTQDHFSLSSLSPLLSALWYRESQYVRYGAGGCMIRFAASTPSA

SEQ ID NO: 59496 - protein, 168 aa, Sorghum bicolor
  Clone ID: 7219609.pep
PLLQGVRLTAIFDSCHSATVMDLPYVYSTKGVLKEPNLAKEAASGLFDAFSAYSRGDLAGAASSVFALAKSAMTGDEVYEYNKQTRTSPADVVMFSGSKDDQTSADATINAQATGAMSWAFISALKANPQQSYVELLNSVRDILEEKYTQKPQLSSSHPIDTDLLFVM

SEQ ID NO: 59497 - protein, 90 aa, Sorghum bicolor
  Clone ID: 7219610.pep
FQVGTKTNFSPCHWYSWFLFGSYALHCSTLIDIRILPTPHCVTYPAKSVVIGATDVFLTGSKEFYVVFNVTRGYVPLGKCPSVIGRQQVF

SEQ ID NO: 59498 - protein, 106 aa, Sorghum bicolor
  Clone ID: 7219611.pep
RHKRRRRYCQAAPRPSLAKQCLVWLRAMALGVALLPLSTPRPLDLPGKGQLTDQPQQKIDDNGVDSKGDVQADLLQNHLPLPMSTCLTKRPWIESLVSLVCLSVSS

SEQ ID NO: 59499 - protein, 121 aa, Sorghum bicolor
  Clone ID: 7219624.pep
VNMLWLDSTYPTNATASTPGAKRGSCSTSSGVPAQVEAQSPNSKVIYSNIRFGPIGSTGGNTGSNPPGTSTTRAPPSSTGSSPTATQTHYGQCGGTGWTGPTRCASGFTCQVLNPFYSQCL

SEQ ID NO: 59500 - protein, 95 aa, Sorghum bicolor
  Clone ID: 7219626.pep
LELPLPEDISLNLHLFHDTMEDQRFQKSQKQLYLLEITPYIAHEDSPKGLLLIPYDMHPNGTQIFWRCGIFECLRRSEFTRTCFDGCTDTNVDIL

SEQ ID NO: 59501 - protein, 194 aa, Sorghum bicolor
  Clone ID: 7219627.pep
HNATHVLPLQDFYRDAANGNLPQFTWINPECCSYQSFHPASPIDEGEKFVKGIYQALRNSPQWDNTLFILTFDEHGGFADHVPPPVGVPAGDNLTYTEKAADGKPITFGFDRLGLRVPTLLISPWVRKGSLQHRGINNGEQYTHTSILGFVAELWNLPKLTPRVEWSATFEHVIESQPRDDKDVIRDLPDPAHF

SEQ ID NO: 59502 - protein, 61 aa, Sorghum bicolor
  Clone ID: 7219637.pep
FNWGTKQKCVKDTSFFFHAGIMDLQQLKTQYRAAQAFKAESILVKHAQTCHELLMLISKSD

SEQ ID NO: 59503 - protein, 62 aa, Sorghum bicolor
  unsure (1)..(62): unsure at all Xaa locations
  Clone ID: 7219644.pep
GLASDPDQAPILKVKEIKNGRLPMFSMFPFFIQAXVPGEGPVENLAKPLRAPLGNNLFPVIS

SEQ ID NO: 59504 - protein, 186 aa, Sorghum bicolor
  Clone ID: 7219654.pep
ASCKDLNLLRKRLSGLSLGYASTFMLKDGNYVFCADDGTVVLPEAWESLRRPGMTLKIQSPSVPTPPGWPVGGPTTLNRPGMMPPHITRPLNVGPASTTTSDSSSTHSSASPTMKHVHSEMEGLLQLSDSWCPDPDTMSAGLGRLLGLWTNALDPHVDVTEDSDSGSVWSCSSTGDSDYSNRSICD

SEQ ID NO: 59505 - protein, 102 aa, Sorghum bicolor
  Clone ID: 7219655.pep
QGVILVAVNEKPFQQAAEYVRPPGTVICIGLPPGAYLRAPVFETVIKMIRIQGLYVGNPKDSSKAIEFFPRGLIKAPYKIVGLFELQMVYDKMPQGPVVGQN

SEQ ID NO: 59506 - protein, 109 aa, Sorghum bicolor
  Clone ID: 7219665.pep
QYLLEWAWKLYETDNLMALLDESLDPEEYRPDEVKRIMDIALLCTQSAVAARPMMSEVVVMLLTKNDPEIQPTRPTFIDATSRVRGETSSSSSSSASKATISVSQFSAR

SEQ ID NO: 59507 - protein, 72 aa, Sorghum bicolor
  Clone ID: 7219673.pep
NDPVNPIALEPGSAIAGMPVLHAWKSKQVFFMKGGFLSGYANVPTPMFYMPNAKMLFGDAKDSCDAIKRGLE

SEQ ID NO: 59508 - protein, 88 aa, Sorghum bicolor
  Clone ID: 7219678.pep
SVPSKAKRIRKARMPKDFDPDRKMDAERWLPMRDRSYYRPRGKKGKKRADGLTQGGAVSEDKDKGSPAPQVQKAGGGGNKKNKKKGKK

SEQ ID NO: 59509 - protein, 139 aa, Sorghum bicolor
  Clone ID: 7219683.pep
RSFGIEKILKLFHCSLLERLFGDERSRTKSSNLEVYYARARIAHLANCIITMMILVLLIVPIYTLYHLVNDVSTDRAYAICMGILVVATLAFSAVLSLFTKAKRHEILAAAAAYCAVLVVFLGNVGPSNLGGRQPQIPM

SEQ ID NO: 59510 - protein, 132 aa, Sorghum bicolor
  Clone ID: 7219684.pep
SSRIITQFQYTSWPDHGLPVSTTAFLELVRMVDKLKKTAPVIVHCSAGIGRSGTFCTVHSTITKYRHDLSTKPDVPPTFDILHTVIYMRQQRPGMVQTKEQYMFCYLSIDEEASQVTRKFNPLGRAALSYSH

SEQ ID NO: 59511 - protein, 102 aa, Sorghum bicolor
  Clone ID: 7219690.pep
NRDIEIDLPNQLIKNADGETICSFEVEEFRKHCLVNGLDDIGLTMQQEDKIAEFERRMTQNTPWLDGTGYLKRPGQGGKLAAKAVPVPKTNRGEEKKEPLEW

SEQ ID NO: 59512 - protein, 109 aa, Sorghum bicolor
  Clone ID: 7219697.pep
RVTVKLTIQNRQAAVSVVPSASSLVIKALKEPPRDRKKEKNIKHTKSIPLDEIINIARTMRFKSMAKDLKGTVLEILGTAFSTGCKVDGRSPKDISDDIKAGEIEIPEE

SEQ ID NO: 59513 - protein, 160 aa, Sorghum bicolor
  Clone ID: 7219699.pep
LPDAPNKEHYNSAGIIQACKLLDELVVLDPDDFQLIEWLFLTDTIDAVYKPASPPALQSFTDEINEVLTQTSSAPLITPTVQDTTRDGEPVRSLFLDPLIKALEEEEGAPVLDMARGELIDRVVRPFLGNLAMVAFEARYGGGEADWKGVWESVVRDAAT

SEQ ID NO: 59514 - protein, 121 aa, Sorghum bicolor
  Clone ID: 7219701.pep
AEFSQGQIQGGGGGMPMSELRFNLPTAELFKSAEGREEVKTQLQGHFNKLLRRDERGDGYDNDGMVSPFDINLGKEKAGGGNRGKRAKLGKLIIYPDGLKMLDLLVSANMGLWWQAWEKSF

SEQ ID NO: 59515 - protein, 203 aa, Sorghum bicolor
  Clone ID: 7219708.pep
MQWMELKAESPVLASNPPKRRNLSADYSEKAQQTFTSSTVTETESSEYVSFPIHDNCAVQIEVMSPDEPKDQNINQQQDEGEHLLEQSSEYGKRGVTSLSHWLKPSSADDESKCSPDDGNVGKETWYETSVSDVPIFPAFGFNWETDNPTPVLPKAWDGNGIPNTTTKYKEDQKVSWHATPFEERLLKVLSDEKPRQKGKSAE

SEQ ID NO: 59516 - protein, 72 aa, Sorghum bicolor
  Clone ID: 7219709.pep
VTIVRLLLRKFGAASLGFFSSNIVANIKDKVNILWANFVNGSKHVVQYVLQPRTNEKGEATRIPLEKPCLFI

SEQ ID NO: 59517 - protein, 169 aa, Sorghum bicolor
  Clone ID: 7219713.pep
LAKGAESGSTEGVRESAMQVIQTTASLQIAELKRIMPSMPTAGAARGRAKEKSGLGGENKTSPLVVKRTGAGARRRRILDSAAHYRSQRPAQANNHPTIRDLVSQHTSETKFHSPPTSTCCSPQACAAQVSSVRLRAAVKLESDVSRSRGSGAELAAPHRTTTDWGRTE

SEQ ID NO: 59518 - protein, 207 aa, Sorghum bicolor
  Clone ID: 7219714.pep
SDLSVSNVVFRKLHKLLTTRHQPSAQHPESAGKSNIFTVLSQYTVILDAEPQIGKTGAVLSALEILLTKYVNRPQDMPRQVLPPAVPPPAVSLPDNQYDYGFLKHWTKELAKLIDTRGFLAVQEKWAQINNGMSLFDQYHESMRLAASTVLAFVRFGTSAAISSYCVMPDPPRPITVVDAGCGLHGIVTTLRADICRQTWHVIGIDF

SEQ ID NO: 59519 - protein, 56 aa, Sorghum bicolor
  Clone ID: 7219718.pep
MDKVKLDAIEKVLDPLFSYWKSPPQEGEFFGSFPTRTGFDKLKNVVNKWAKSPSPA

SEQ ID NO: 59520 - protein, 150 aa, Sorghum bicolor
  Clone ID: 7219729.pep
GETIVPLFSKASPAVDIPKDKYDALVNRVQFGGDEVVKAKDGAGSATLSMAYAGFRFAEKVLRAVKGEKGLVEPSYVYLPGVPDGEAIAKETGTDFFSVPIELGPNGAEKARNPLEGITEQEKALLAKATEGLKGNISKGVSFVHNPPQK

SEQ ID NO: 59521 - protein, 72 aa, Sorghum bicolor
  Clone ID: 7219730.pep
GVEVWNRSDDRPLRFLLIAGEPIGEPVAQLGPFVMNTEEEIDMTVNDFECYANGFEKARHWKSQAMVALGVE

SEQ ID NO: 59522 - protein, 125 aa, Sorghum bicolor
  Clone ID: 7219740.pep
LTLKDEITRICLGGSGKLPQFIMPSIAEQIVAGGPLRRLTLATAAWFRYLRGVDEQGRDFQLSFDPRNDELQQIARDEGNPMKLLSIKDLFGDDLRGDERFVKELTEAYNGLEREGAMKMIEKVA

SEQ ID NO: 59523 - protein, 129 aa, Sorghum bicolor
  Clone ID: 7219742.pep
GHGAKNISPEHRSNFGEQSARIRDKLDVSVNYKFWGPMPSIIVWRCLFSTIFLGDSAPLHSSKELENMIKLGSCLHSEMLSLFLRKQGYLSESGNALVERRRRQICSQMILDCQYMLKFIELSRWTQVT

SEQ ID NO: 59524 - protein, 98 aa, Sorghum bicolor
  Clone ID: 7219751.pep
ALFNENMKPGPTSERSYGLFKPDGTPAYELSYRLPQDNTTTSSSGGSVTGGGGYHGHGYGSDNAGYYSISAAAKATLGWWTWPQVAVAARVAVLAMPL

SEQ ID NO: 59525 - protein, 181 aa, Sorghum bicolor
  unsure (1)..(181): unsure at all Xaa locations
  Clone ID: 7219766.pep
FQFFQEPPRPACGALVRPLRRAEQSRAMSSNGKPTPQPPAAAAAGNGAGAGGPPKXYQRPIYRPQQAPAKRRRTGGRSCPFSCCCCFFWTVLVILLLAFLAAVVGGAFYLLYRPHRPAFTLTVARVTKLSLSSSATAPALSDAIDVTLTAKNPNKKLVYLYDDFTVTAATGANAVPLGEAS

SEQ ID NO: 59526 - protein, 103 aa, Sorghum bicolor
  Clone ID: 7219770.pep
GHIFFYICSYRPTYKSTCAPIHYTRLVLNYDTYIWNTYVVVSHSLSVHQNAQIITQPHPREVKAPPNHITTISPDQDHSIRAATYATNIIMASNEKPRQSSAP

SEQ ID NO: 59527 - protein, 137 aa, Sorghum bicolor
  Clone ID: 7219783.pep
GRLMKRLRPWSTKSLREGKDQLYTIVSAAVALDLRMKKQRADYRFVTFTGGQPNQFWGYGFYDSEMEDIDEGEERKGRRVQMSLAPALERCGNANGHIFDQNFILVKADVTCKRLDKTRPRTGKKLGTKKNFWSSRS

SEQ ID NO: 59528 - protein, 46 aa, Sorghum bicolor
  Clone ID: 7219784.pep
PLSFKFARTGLRQICNVTVKAFIFFNTPSDHEPFSNLYKTKQSLTC

SEQ ID NO: 59529 - protein, 109 aa, Sorghum bicolor
  Clone ID: 7219785.pep
GITHDHLFLIIQGFVVISQVIIVQYGGLAFKTAPLSLSQWLITIGIGSLYIPAGTFIRLLPNRLPCFWSENNDDEFNHEISYSRLYWESAVQHVMKDVQNKKAVHEYKF

SEQ ID NO: 59530 - protein, 80 aa, Sorghum bicolor
  Clone ID: 7219792.pep
NLPTFTQDQVTLSNDMIDFWNNFVWSGHVNSPAATVDYWKPYNGTFDTLNVITTPQDYADIGFYDDICDFWDTIGYNHWG

SEQ ID NO: 59531 - protein, 101 aa, Sorghum bicolor
  Clone ID: 7219796.pep
QVITIGWFTMIVRVIIKVLKGGDAEDVRSDDEGGEEEEEEEFVYEEAQPLEEEVGVEELDLRNWERRSGVKKQASSSGVSLPGHSDRKELLGRIGCEKQVD

SEQ ID NO: 59532 - protein, 61 aa, Sorghum bicolor
  Clone ID: 7219797.pep
MKIPNGRTTQFVLVTAGATLPFNTHGISENEDYNVRLRDLIVLVMRTFQKKALDAKRKGKA

SEQ ID NO: 59533 - protein, 114 aa, Sorghum bicolor
  Clone ID: 7219798.pep
SAFNMRCNTYFPLSAQSIDDGTELGRRRHYRRTLVNLAGALADTVELPGIRQDRRSSDVMLFDRRGKKETVLSYVLRAMPTVATELACLGWKLRRRIGLQRFIFNYFIIYIALS

SEQ ID NO: 59534 - protein, 126 aa, Sorghum bicolor
  Clone ID: 7219813.pep
YRSKLETVKNLPMAIIAKTYEMILGPPSSLIRLILKVAAKIASGQWRGLVYGYGEDGEEIPVQWDYSEGEFSDWSDDEHEHDGSHKQGKREHRHSRHRSNAQDMAVEDEMRRRPSSSDDSRSWGVD

SEQ ID NO: 59535 - protein, 62 aa, Sorghum bicolor
  Clone ID: 7219817.pep
INYPFRTKCNGPQCGAEKPSQPNNVNDSAPDQANQFLSCNITKLLSKLRLLHEFQDSSEQTE

SEQ ID NO: 59536 - protein, 129 aa, Sorghum bicolor
  Clone ID: 7219823.pep
ASLHAEIETRQAASGAGSGQSIGAAAPWFKEVPAALTATFASEADAPTFQTAILRLIKKRFSNLILMPADRIDDRTPLPDFGVDSMIASEFRSWFWSAFKVDIPFLNLMSAEKSLALLAELVEEKIPKA

SEQ ID NO: 59537 - protein, 43 aa, Sorghum bicolor
  Clone ID: 7219837.pep
TVSCLLFRSVLLCYNNLPLKQGTPKNLAYNGKLAPPGQAPFTN

SEQ ID NO: 59538 - protein, 76 aa, Sorghum bicolor
  Clone ID: 7219841.pep
ILHRLFNRSAKVNLHLIGDQILLLGGPPYCEPLPCELLPLAPLIPFCWDDCPLNPLNGHGRDTLNLLSTTLGLSWL

SEQ ID NO: 59539 - protein, 45 aa, Sorghum bicolor
  Clone ID: 7219845.pep
TKMLRWLRFVLILRCYCNTSTSSTLISSFPIDYAIYFKKFLIPPN

SEQ ID NO: 59540 - protein, 71 aa, Sorghum bicolor
  Clone ID: 7219847.pep
CWRHWRPCYSRCHFGCPGCLYFARRFASCQEVDACSCWRISGRSSQGVNMNRWVVGKQMFLVRICMTHAML

SEQ ID NO: 59541 - protein, 102 aa, Sorghum bicolor
  unsure (1)..(102): unsure at all Xaa locations
  Clone ID: 7219848.pep
CDKTTCRTQTSAVAVSGVQYENIRGTFTIKPAHFACSDSXACSEITLTGIQLKPLLVPQYHLYNPFCWQAFGELYTPTVPPISCLQIGKPAGNSVLSDGDLC

SEQ ID NO: 59542 - protein, 100 aa, Sorghum bicolor
  Clone ID: 7219849.pep
EFSSNGNTYSAGSCYDGGHYSNRPNGAGGNSNGAVSAFSGAGGNNSNGAGGDNGEWWWRAPGAAAADDEVQRQQRQVVGFDDEEELWATLGDMLSVNLAS

SEQ ID NO: 59543 - protein, 131 aa, Sorghum bicolor
  Clone ID: 7219861.pep
WSTVMSVITLVLAMAGRESLFVVFQNFVSLMGYWVMLMICIVMEEHWFFRGRQGFDWTAWEDKNYLPVGLAALASFIIGWVGAIVGMSQVWYVGPVSKAASNADLGMWLGCGFAIIVFPVLRYFELKAYKR

SEQ ID NO: 59544 - protein, 184 aa, Sorghum bicolor
  Clone ID: 7219863.pep
TLMRAINNEQVEGFPKQSEVKTVFVEHDLDSADTEMTTIDWTMKKLEEAGVTTTQADVEKQLIEFGFTEQMIKGEISALSGGWKMKLALCRAVFEAPDILLLDEPTNHLDVKNVKWLEEYLINSPCTSIIVSHDSGFLDNVCQHIVHYERFKLKRYKGNLAAFVARNPSAKSYYELGESEMEFT

SEQ ID NO: 59545 - protein, 71 aa, Sorghum bicolor
  Clone ID: 7219869.pep
ENLEKLGSKHDWSHIPSQIGMFAYTGLTAEEMTPLAEEFSVYATKDGRISVAGITFENVGRLAEAIYKVKG

SEQ ID NO: 59546 - protein, 104 aa, Sorghum bicolor
  Clone ID: 7219873.pep
SVCVHGTYRKNLDSILQSGLKRMTRLHVHFSSGLPLDGGVISGIRQNVNILIHLDVSKALKDGMKLYISDNKVILTEGFDGVVPVKYFERIETWPGRAPIPFQR

SEQ ID NO: 59547 - protein, 146 aa, Sorghum bicolor
  Clone ID: 7219875.pep
QLPLKRQPMLFSKKTSSASAPRSPPAALQRRRQGATTARSPTSPVRARLRRRQRTTAAVAPTTAPSSSRTPCSPRAWRRASSALPKRTMALGRSSTTGHGYGTISSIRECTHDIIAVQIWSRALLMLIRCILLIGQVVDLCLHIVH

SEQ ID NO: 59548 - protein, 61 aa, Sorghum bicolor
  Clone ID: 7219877.pep
SLPNPCKRGIPTHWAPKLFWEIFFVYHVKNGPLGLGPWPFAPLQLPSTIGPKKAGCYILKI

SEQ ID NO: 59549 - protein, 170 aa, Sorghum bicolor
  Clone ID: 7219878.pep
ELAIASHQNIPKLVPDYALIDGMMHPKDVNASSTGFLDSVLSATNLGGSQGSEGSVISVQLAESSKSVSDYGAEDYSTTMDCGGVYKEGISKVDCSHVLDDGSRSIFHIDQASPFLELASSGSSTSTDNQDVLNGELVLIEAQYKHFVDELTRMREEAMEGARKKWLPDK

SEQ ID NO: 59550 - protein, 169 aa, Sorghum bicolor
  Clone ID: 7534829.pep
ARGSDPVKIAVEGVERFKKENCDLIIVDTSGRHKQEAALFEEMRQVSEATKPDLVIFVMDSSIGQAAFDQAQAFKQSVSVGAVIITKMDGHAKGGGALSAVAATKSPVIFIGTGEHIDEFEVFDVKPFVSRLLGMGDWSGFMDKIHEVVPTDQQPELLQKLSEGSFTLR

SEQ ID NO: 59551 - protein, 186 aa, Sorghum bicolor
  Clone ID: 7534833.pep
ARGGTLPHSLPAATFAHSTPASFISLTSSQPLPLQLFLRPNNTTQHAAERSTPHSSTRGSSDGEQQHALHRVGSVCQQPAGVQAAPRREEATTAGPGTGPHAPRRSGPLRRPGGRQGGPPVGARRGLPGRRRRRRQRLRPAQPGQQEPRPGRGGARQPRGGHDDERELDAVVGLGRPVLLQRRGVL

SEQ ID NO: 59552 - protein, 173 aa, Sorghum bicolor
  unsure (1)..(173): unsure at all Xaa locations
  Clone ID: 7534837.pep
TRLAVTALEHTSSFAKAYAKGINKKEYWGYTFEDSMDLIAKXPRGASRIYQNVFKGGKVAPIQKDKDYSFNFANQLGFADNADFVELMRLYLTIHTDHEGGNVSAHTTHLVGSALSSPFLSLAAGLNGLAGPLHGLANQEVLNWLTEFKKSVGDDLSDKAITDYLWSTLNAGR

SEQ ID NO: 59553 - protein, 155 aa, Sorghum bicolor
  Clone ID: 7534841.pep
MSAVNPHGVLSLLKEGTRHYSGLFEATVRNIQACRALSETTRTSLGPNGMNKLIIDSRNKLFVTSDAATILKELEVIHPAAKMIVMASERQENEFGDGTNLVVAFCGELLLQAESLLTAGLHPSEIIAGYSKAGAHLHQELEALAVHRIDDLRNV

SEQ ID NO: 59554 - protein, 141 aa, Sorghum bicolor
  Clone ID: 7534846.pep
MNHPGPGNRPPSYTANFPPGQAPLGRTSPLAQQPNRTPPTQMVGGPPPINTGAPMGYPPGMAPMGQGPPPMGGPPGFGQQPPPPQGYPPPGPPGAPMNQQFQRPGPAAEVEGASKSKAQLIVGIDFGTTFSGVAFAFATNN

SEQ ID NO: 59555 - protein, 107 aa, Sorghum bicolor
  Clone ID: 7534855.pep
MGNDSSILADGSAMAMPGTSFNHTLFETALPPLPTFSLEVQPDLFPWVSDFWLNLLLPVVVYWVLSLTFHAIDVNDWFPQYRLHTPEEITKRNHVSRFEVARDVILQ

SEQ ID NO: 59556 - protein, 130 aa, Sorghum bicolor
  Clone ID: 7534862.pep
MAAAAAQLLGEDGRGYELARRLEACGAWREWLGDDSAHAALAQHLTSPATWDAFLYPAASPSPPPRPLLLLQLRVRALLFDKASAALLLPPRSAAPVGLHSINANYLRLHGDDIYFSLEDEQEDNAQHQV

SEQ ID NO: 59557 - protein, 187 aa, Sorghum bicolor
  Clone ID: 7534865.pep
TRGICGGLHVSLASSAQTPTELCHQIKDSNPSHILVHPDLLPVGGEALKLLGISPKDMKHRIIILAPDSSIPESILSQEWITMEATMHHKRPYMTDKRDGLDADETAIIFYSSGTTGLPKGVELSHYALIAATQMMGASSMYQMKYQQDICIGVVPLYHVYGSLMLIFHGLDSGVPSVLLPKFEPVN

SEQ ID NO: 59558 - protein, 166 aa, Sorghum bicolor
  Clone ID: 7534867.pep
MGDANGGSMHVVLLPWLAFGHILPFTELAKRIARQGHRVTLFSTPRNTRRLIRIPPELAGQIRVVDIALPRVERLPEDAEASIDLPSDDLRPYLRVAYDAAFADNLSAILQEPGPERPDWVVIDYAAYWAPAAAARHGVPCAFLSLFGAATLSFYGPPEGLMGRGK

SEQ ID NO: 59559 - protein, 155 aa, Sorghum bicolor
  unsure (1)..(155): unsure at all Xaa locations
  Clone ID: 7534871.pep
ARGRCLGNAEWCMTYPATTIYHLPMMYSDHAPILAVXNSKHNRTNKPFRFENWWLMEQDYHDVAKQSWRKSSCRNFSQKTRYLVADLRKWRRAKPRNSDLLAQIENQILDEQSKPPAQQDQSLQQQLTEQHQDLLTKEETYHIQRAKKKWATQGD

SEQ ID NO: 59560 - protein, 104 aa, Sorghum bicolor
  Clone ID: 7534873.pep
TRQSCCVRFFVYSFLSLPPFSSLTLSTGLVPSNHYTTDDLFPQAPIFFLAIIQFFVAGPLQRNTQLYLLETNDQNHTDNVTSHPSARLSTYTHSTSSAILTSIH

SEQ ID NO: 59561 - protein, 181 aa, Sorghum bicolor
  Clone ID: 7534874.pep
ARGRFDADNDTKLPPLSSLTSEMAMEPTKTWPPLHPMPYPPVLTRSIDSPTRMDLDGSSNSVSAASPDALLDARAGSVSLDDPDVRLAAEALGDLRADFISSPPHRNSSLPVSPPTSGLQSNQPQSPQPEPLLSLLTTTHPLLASTIEGATSAYGGAKNFSPRFRSGAEYVEGYLTPIANT

SEQ ID NO: 59562 - protein, 165 aa, Sorghum bicolor
  Clone ID: 7534876.pep
TRLGHAMDAFDRMREEEIEPDVVTWNTLIDAHCKGGRHDRAMELFEEMRESNCPPGTTTYNIMINLLGEQERWEGVEAMLSEMKEQGLVPNIITYTTLVDVYGRSGRYKEAIDCIEAMKADGLKPSPTMYHALVNAYAQRGLADHALNVVKAMKADGLEVSILVL

SEQ ID NO: 59563 - protein, 95 aa, Sorghum bicolor
  Clone ID: 7534880.pep
MAVTATTVAAATTMLAAVAAVFLTLVLCFYIFLCAKRYRGGAPPPPPAHAGAGGVRAWLRTVFGGGGTRADGGATEWCYDGGLDEKSMAKLPRRE

SEQ ID NO: 59564 - protein, 168 aa, Sorghum bicolor
  Clone ID: 7534896.pep
TREYMALGSVESHLFSRTSPPLPWSTRMKIALGAARGLAFLHDAEPRPVIYRDFKTSNILLDADFNAKLSDFGLAKDGPVGEQSHVSTRVMGTYGYAAPEYMMTGHLTASSDVYSYGVVLLELLTGRRSLDRSRPPREQALTDWALPALPHKKRVQGIVDPRLAGGAG

SEQ ID NO: 59565 - protein, 62 aa, Sorghum bicolor
  Clone ID: 7534899.pep
AVRTLNFHSDIYSIRAQCICITHECEELMRRLASISCCNISRCYVQYARKGVNPKLILLQKN

SEQ ID NO: 59566 - protein, 126 aa, Sorghum bicolor
  Clone ID: 7534902.pep
MGKDKTHVNVVVIGHVDSGKSTTTGHLIYKCGGIDKRTIEKFEKEAAELGKGSFKYAWVLDKLKAERERGITIDIALWKFETPKYMVTVIDAPGHRDFIKNMITGTSQADCAILIIAGGTGEFEAG

SEQ ID NO: 59567 - protein, 129 aa, Sorghum bicolor
  Clone ID: 7534904.pep
MDGGGVDTGTTAAWMEKHRQMYERATRHPFTVSIRDGTVDMSAFKRWLSQDYLFVREFVAFIASVLLKCCKQEDSSDMEIILGGVASISDEISWFKNEATRWGVNLASVSPLKANLEYHRFLQSFTEPE

SEQ ID NO: 59568 - protein, 157 aa, Sorghum bicolor
  unsure (1)..(157): unsure at all Xaa locations
  Clone ID: 7534905.pep
HEGFLLLVCCWTVDARDMLSLRAPSAAHQQRFRDKRVNNLEIARLIRMIASLNQDAKPTVPLENDQIYQILAQIPQVGNDSICLQSESCAQSWIDYYNYALGKIYEKSAVLEYQFETNITEENGKLNDEFAPISNKFLALTKFTSAEFLKKLSSLXS

SEQ ID NO: 59569 - protein, 172 aa, Sorghum bicolor
  Clone ID: 7534910.pep
HEGYFNELLNRSLIQPADMDDDEMNPFSCQVHDMVLDLICSLSRDECFAATLNGDCKEITSSLGSKARRLSIYNTTWPTINMSTLRSLTICSYALINSMPPLSSFYLLRVLDLEDCNLSDHSSIEFVGKLLHMRYLSLAGTGYAGDIPREIGKLLFLQSFRFDGTDIKVVPL

SEQ ID NO: 59570 - protein, 110 aa, Sorghum bicolor
  unsure (1)..(110): unsure at all Xaa locations
  Clone ID: 7534912.pep
NYTISLSSVGLNSLQLDTQATIYFGHVFNKGEFQGAVTFRLWDRIRKTWTPGKCRFCMWLVAHRRYWTTDIPHPERCPLCDYXTDKMLNLLITCVFAQQVWLYLLQKVGL

SEQ ID NO: 59571 - protein, 120 aa, Sorghum bicolor
  Clone ID: 7534915.pep
METRLFLALQCVQCATMQVKQQKKSSNKWVCVVCNQRQSVLHVHARGYRAADLRRFVQDANLARGRREFAPLAEPDVDWDPAAVEEEGDVFPFPIEKRQTEWSEYLDDAGEPGNGCGGLA

SEQ ID NO: 59572 - protein, 154 aa, Sorghum bicolor
  Clone ID: 7534916.pep
TRASQGVLLSSSLVGGAKGSASWPELLGSAHWEGLLDPLDLTLRRLILLCGDLCQVTYDSFNSDPHSKYSGSCRYSRSTLFARTLFPAAADISPAAYLYATSQSSFPGGIMVFSLSREAWSKESNWIGYVSVSTDAAAAATGQRVIYVAWRGTI

SEQ ID NO: 59573 - protein, 178 aa, Sorghum bicolor
  Clone ID: 7534918.pep
HEGHTRTALEALHKNIHVFRHPDHLPTGYDLQRELGKSIKALTNFDLAKASGDAIKAVYGTADGVVLYWAHHEKLLVIDNGKIGFMGGLDMCFGRWDTNSHPIADAHPGNLDAIIFPGQDYNNARVYDFADVKDWDQNKLDRTKSSRMGWSDVALSMNGPIIRDMVDHFIDRWNFIFK

SEQ ID NO: 59574 - protein, 145 aa, Sorghum bicolor
  Clone ID: 7534919.pep
ARGMRCLCSIHIFKEVQPDRFANNHVSAALVGNEPLRAYIVMFAFDIYSASDHLPRSLFDTKTGPSFDVMDTAFQAAVNTQKARWDWLEEKVTVQNLQDGRCGTDGGPSSYPGPFGSELDKAVQGKSASDLVGRPELPIFGLAMV

SEQ ID NO: 59575 - protein, 137 aa, Sorghum bicolor
  Clone ID: 7534930.pep
YQAPDGHRTHQEHVLQDQQRRRPGAGASRQEDEARGADHRADGRRREAEQLRSREKRVGAEDAAATAEHRLAGRVGANRRRPSGSGTWRGEERRWERRVQERKAEAEARGRRGGAGAELREGTGMRQQHWVGAGPRA

SEQ ID NO: 59576 - protein, 150 aa, Sorghum bicolor
  Clone ID: 7534931.pep
MSHRKYEAPRHGSLAYLPRKRAARHRGKVKSFPKDDAKKPVHLTAAMGYKAGMTTIVRDLDRPGAKANKKEVVEAVSIIDTPPMIVVGLVGYIETPRGLRSLTTVWAEHLSDEVKRRFYKNWYKSKKKAFTKYAKKHSDNSGSSITRELE

SEQ ID NO: 59577 - protein, 58 aa, Sorghum bicolor
  unsure (1)..(58): unsure at all Xaa locations
  Clone ID: 7534936.pep
PQQSPTPSQSPSTSPRXPRPRPSPRSTPSPSTRPRPSQSTSGSPPSPRPSMSQSGSPP

SEQ ID NO: 59578 - protein, 82 aa, Sorghum bicolor
  Clone ID: 7534939.pep
HEAQPHINAIPLDRSWSQLWFKSFLSGSLLSWPYCKTRSSCSVFLAGRRCNSSAAPPTYGHHDRSNSKARSVSDWSVIPLKR

SEQ ID NO: 59579 - protein, 50 aa, Sorghum bicolor
  Clone ID: 7534944.pep
HEAPFYRVCRDWNRVYPFLWRPTSIFLFLGCRFWTSRSMAALYRSSCRSS

SEQ ID NO: 59580 - protein, 104 aa, Sorghum bicolor
  Clone ID: 7534948.pep
HEASYITGIRYKCAVCHDTDFCAACEALPTNTHNQTHPLIKFRTAVRNVTVNTLGDDGFGGQTMVMGDRTPPAVSSFANVPSSNNSVVEAPSVVEKVEPVVPEA

SEQ ID NO: 59581 - protein, 160 aa, Sorghum bicolor
  unsure (1)..(160): unsure at all Xaa locations
  Clone ID: 7534950.pep
MALGAAVVVMAQDGSVSGQTTSADAAGYSCDPNKCKLPNCHCASTDPPGGLSPSDTPQFIIFTADDAIQSYTLDAVNQFLAQRKNPNGCQPKMTYYTSLGYTNYTLVTDWYVAGNEIADHTMTHVGDPGEDEINGNLIALNELAGIPLASLKGXRAPFLT

SEQ ID NO: 59582 - protein, 94 aa, Sorghum bicolor
  Clone ID: 7534952.pep
MPDPRVFVIRHGETEWSLNGRHTGTTELPLTANGESRIRATGKALVGPDRLIVPGNLAHIYVSPRHRAQRTLELLDLGCRERYPWEANDPAAVA

SEQ ID NO: 59583 - protein, 98 aa, Sorghum bicolor
  Clone ID: 7534953.pep
YTFAALCFLCRRLFMAYAPCMIYIALCNICKSSVPMHQCCISLTHTKLKVSSLLLYLLCDTEHPNPSFRQTLWYIDVLCFSFSYQFPDQSCAFAWLHG

SEQ ID NO: 59584 - protein, 171 aa, Sorghum bicolor
  Clone ID: 7534960.pep
HEAKVKKTWSTILFLCGLTAAQNITSDTTSEIWPPTTPAPTHPPIPIASAIPLPPEFSDIPKSIVECWDSLISYDITRSFLQAELGRGQVYTYTEYPTPVTQTYTYGYPLESCSTNFPGLTTLCDGYPRAEDCSAECQYTGYTSWTNQFTISGTGSWLTPTWSTELSELPI

SEQ ID NO: 59585 - protein, 52 aa, Sorghum bicolor
  Clone ID: 7534961.pep
TRHTSFESLSWPCSVLTSTSSSSSVETQRRGQRNQGPGPTNYRFLVVLLSTT

SEQ ID NO: 59586 - protein, 36 aa, Sorghum bicolor
  Clone ID: 7534969.pep
LLFNQGSQPNEITIHLRFEPGLLKFNDQLDSIRDSL

SEQ ID NO: 59587 - protein, 49 aa, Sorghum bicolor
  Clone ID: 7534975.pep
HVRAPHGRSPACSSPWSGPQHTGHMCRPPRDGCPWVGPISHPMSAAAMG

SEQ ID NO: 59588 - protein, 127 aa, Sorghum bicolor
  Clone ID: 7534977.pep
TRDTDGVIQLQIESQDIPGLSFKTHPNINKDLFNGQQILGAKDPNRPFPSGQNETPLVKWRIQGMDESSLPLSVNCWPSVSGNETYVNIEYEASEMFDLHNVVISIPLPALREPPSVRQIDGEWKLD

SEQ ID NO: 59589 - protein, 69 aa, Sorghum bicolor
  Clone ID: 7534978.pep
LIPMLSLTTLLKLCEEVVEAASSDESSEGSYDESDVETIEEVAETVEEATGLSNEEVIEAVADQTGLDV

SEQ ID NO: 59590 - protein, 154 aa, Sorghum bicolor
  Clone ID: 7534985.pep
MPPKFDPNEVKVIHLRATGGEVGASSALAPKIGPLGLSPKKVGEDIAKATGDWKGLRVTVKLTIQNRQAAVSVVPTASSLIIKALKEPPRDRKKEKNIKHNKSVSLDEIIEIARTMRYKSFAKELSGTVKEILGTAYSVGCQVDGKPPQAIIEA

SEQ ID NO: 59591 - protein, 133 aa, Sorghum bicolor
  Clone ID: 7534989.pep
SPASGTHSTAEIRPSSGPNAGFTVTPPPPPPTTGTITSTDRAALATARARARGPSDGRTAGSSSHPSLSPAPVAARSAEAEARRATSARWWPRGAIVIGRGRGETRSRPSFRKSRRLWSRDTRDSTRKKSPSC

SEQ ID NO: 59592 - protein, 162 aa, Sorghum bicolor
  Clone ID: 7534991.pep
HEGKGSYGVVCSAMDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVA

SEQ ID NO: 59593 - protein, 108 aa, Sorghum bicolor
  Clone ID: 7534992.pep
VLTKSQHPHEKKKRPPTASWWISTRPQLGRRRRAAEVGRPYGRGRGSGSRVGVRTPRRSGQGGRRRRGLGGSWLGLVVDWRETRRGARVGGGGGERSRSPATRVQRLV

SEQ ID NO: 59594 - protein, 106 aa, Sorghum bicolor
  Clone ID: 7534993.pep
MFMARSEYDRGINTFSPEGRLFQVEYSLEAIKLGSTAIGVATSEGIILGVEKRVTSTLLETSSVEKIVEIDRHIGCAMSGLQADARSMVEHARVESQSHAFNYNEP

SEQ ID NO: 59595 - protein, 52 aa, Sorghum bicolor
  Clone ID: 7535007.pep
HEGCRKTFKRSGTMQAEMEAGGSKLFFDLFVAMCNHLDDVIDVTKNRSPKTV

SEQ ID NO: 59596 - protein, 60 aa, Sorghum bicolor
  Clone ID: 7535017.pep
FFIAGFFLSGLVNLRRNFNFSRHSFTNALATRSDCLSSGSFVANSRKKGGQHSNNNLGVE

SEQ ID NO: 59597 - protein, 128 aa, Sorghum bicolor
  unsure (1)..(128): unsure at all Xaa locations
  Clone ID: 7535019.pep
MSETVVKLSTPQTGEYDQPTGLFINNEFVKSGDGETFEVXINPATEEGICHGAEATEKDGDIAVAAARKGFNGQWRKETPETRGKLLVKLSELFEKNADLLASVEALDNGKGFNMARNVDLPAAIGCL

SEQ ID NO: 59598 - protein, 167 aa, Sorghum bicolor
  Clone ID: 7535109.pep
KFSSHFSLLPIVSPAMEFSLYPGVEPLAFFAGVLSYVAYFYHGEHHMYAVSYIQIHTILLATSTFLLYRLGSTVADAFLQTLTYDGFFLAGLFGSLLTYRAFLNPLNVFPGPYIARIATFWISFRIKRLRIYKTLEELHDKYGYFVRIGTQEVSITHPNAVVDIFGP

SEQ ID NO: 59599 - protein, 171 aa, Sorghum bicolor
  unsure (1)..(171): unsure at all Xaa locations
  Clone ID: 7535110.pep
MYIPKDLLPVQALXNTLRKVEEVLSRFAKHGVPLLDPQEDMKVQSKSFLKATRRIEALESLFEKHDIRNSPHIQQKLKVFHAKQELSAKIKSIKKTMRSSTALAFKDELKARKRVLRRLGYVTSDDVVEVKGKVACEISSADELTLTELMFSGALKDATVEQMVALLSCFV

SEQ ID NO: 59600 - protein, 124 aa, Sorghum bicolor
  Clone ID: 7535116.pep
MGNTPSCILLAVAAPAAGGGGRASSSSSSSSAAAATNTTTKVIHADGTVTRLARPVRASELMLDHPGQFVCDARRLAVGCRVPGVAADELLQPRHACYFLLPMDMLYSVLTDDEMAALSDSHAD

SEQ ID NO: 59601 - protein, 120 aa, Sorghum bicolor
  Clone ID: 7535117.pep
MTSTGDSATAVDSNHDLEKRGAETDGSANGSAPAAPPPRTVTGVLWALLVCAMMSCIFLFAIDNTITANVQIAIVHEFDAVGRLSWISVAYLLSSSAVNLFWGQVYGRFDAKWIYILCVV

SEQ ID NO: 59602 - protein, 137 aa, Sorghum bicolor
  Clone ID: 7535118.pep
ARGRLGFGLLNKVSMLFPHVFWSTDLDTFGHLVEDPRRRGEFFLFYSYATVAGGPLLMALVAGEAAHNFETTPPTDAVSSILQILRGVYEPQGIDVPDPLQSVCTIWGTDSFSLGSYSHVAVGASGDDYDILPESVG

SEQ ID NO: 59603 - protein, 109 aa, Sorghum bicolor
  Clone ID: 7535120.pep
MNDSLLVPFLQSVAAPMPDSHHDFHFGSPKASSDRTASSGTDLDVLTVESDPNSPVTEPMTPPTTPPTSEWTFNTSPGGFHRAVAAHNKGWKKVGAKLGFNRKSSSRRT

SEQ ID NO: 59604 - protein, 144 aa, Sorghum bicolor
  Clone ID: 7535134.pep
ARGNFYQGSSRRWQSTDGAQQQQQSWFKRMMESEVGFKTVHFWAPVMKWALVLAGISDFARPAEKLSFTQNLALTCTGIIWTRWCLIIKPKNYLLAAVNFFLGMVGLVQITRILSYESAKKKSLEGVVEDIKADAKETIQEAKP

SEQ ID NO: 59605 - protein, 137 aa, Sorghum bicolor
  Clone ID: 7535135.pep
IKHTEQSSLPSLHVASCIEALASRLSEQDQKNINQIFQLLIHEWFQDRNNSPKIVIELHICSCTKNGNKSGKNRVETLVSLCRPCCCSSCRVHTCACACTLGIPLSRRFTDSTSAAAAAAAADDDAAAHPPSIPLIS

SEQ ID NO: 59606 - protein, 168 aa, Sorghum bicolor
  Clone ID: 7535150.pep
MLQPIVLYDLNRQLLDGENEAERCWSPNTFKARIPLNIKNIPFTVVWLNFVDIKPTLSALGVAPNLPHENSNEYSCPAIHDPNTGKKVMDSQKILAYLEEQYSDTPTLFPPHTRALQVAFIDSIIPRLFDALPGTMILDVLGRLVDVDQPYFRAKREQAAGTKVENLV

SEQ ID NO: 59607 - protein, 160 aa, Sorghum bicolor
  Clone ID: 7535158.pep
EFVLIIHKMFSRLSIGVAQAGRTFSTSSQKNVKVAVCGASGGIGQPLSLLLKQSPLVTQLHLYDIVHTPGVAADLSHIDTPAVVRGFNGPDNLDAALKGAEVVIIPAGVPRKPGMTRDDLFNTNAGVVRDIAAAISRNCPKALVGIITNPVNSCVPIASE

SEQ ID NO: 59608 - protein, 161 aa, Sorghum bicolor
  Clone ID: 7535176.pep
HEVSLHRLPQEEDGWAMQLLAVTCLSLAAKMEETLVPSLLDLQARQLGHTIEGTSRYDFDPGTVGRMELIVLTALNWRLRSVTPFTFIDFFACKVDPGGRHTRCLIARATQVILAAMHDIEFLDHCPSSMAAAAVLCATGETPSLESVSPEAAVSWCIGLA

SEQ ID NO: 59609 - protein, 172 aa, Sorghum bicolor
  Clone ID: 7535177.pep
MAIVHNTLASLLLVLVAAQLPTVAAHVASSSGSTSCIPHEREALLAFKRGIIRDPWGNLTLWQRGGEDCCKWNGVVCSNHTGHVLKLQLGSCSLVGQISHSLLSLEHLEHLDLSGNSLNGSSAGRIPEFLGSMNSLKYLDLSDVPFSGRVPSQLGNLSNLQYLHLSSSTQDS

SEQ ID NO: 59610 - protein, 91 aa, Sorghum bicolor
  Clone ID: 7535183.pep
ARGLKYWLLTTCIFLQFICQSNNVLLLPASKSQLNIELHAPTSSTQKLKLMGRGGQFTYIPTLPLTWRLPQASDVFYLIVLTKIQTRDLWL

SEQ ID NO: 59611 - protein, 175 aa, Sorghum bicolor
  Clone ID: 7535189.pep
EMDKDYVTAETLVLVKDLLRKYPQWSHDCIAVVGNISSKNIQEPKGKAALIWMLGEYSQDMHDAPYILESLVENWDEEHSPEVRLHLLTAVMKCFFKRPPETQKALGATLAAGLSDTHQDVHDRALFYYRLLQYNPNVAERVVNPPKQAVSVFADTQSSEIKDRIFDEFNSLSVV

SEQ ID NO: 59612 - protein, 142 aa, Sorghum bicolor
  Clone ID: 7535190.pep
MSAHSSSVSSPLRVLLVGATGSLGRALANAFVEERDRVQLTVLVREATATTPGPKSDELKQLQQRGAKLQFGDIVEQSVDELAKALADQDVIVSAVGPAQLGAQHGLLAAAKAAGAQWFVPSEYGFDLEVIGTGHPWLGGLL

SEQ ID NO: 59613 - protein, 165 aa, Sorghum bicolor
  Clone ID: 7535191.pep
TRAALGAARSSSSTASASAPRLPQQQQQQEQRRPPAPPPRLAYLITGAGPGDGPRIRRLLRALYHPWNYYLVGVAGEDERADLEAFVRGQEAPRRYGNVRVAAAGEWGAVSRRGPTELAATLHAAAVLLREFDGWSWFINLSASDYPLMPQDDILHIFSYMPRDL

SEQ ID NO: 59614 - protein, 101 aa, Sorghum bicolor
  Clone ID: 7535193.pep
MDDDTKGVSGIAPGLKSDNISTDSEIILTPDHEAPSSPNNPPADSTLLDTPMMGATTPRGSMHSRNPSFSGSSSNHEDWDGLPPLDRLSVLDLLDNFALPQ

SEQ ID NO: 59615 - protein, 156 aa, Sorghum bicolor
  Clone ID: 7535199.pep
MPSEVWVATNGYSTSNIIGRGGSCTVYKGVLDDGNMIAVKIFHDTSLECANKCYSLYVLASKLQHENIAKVLGYTKGRVGQNSEQKYILIEEYIPKGTLRKFIYEQDLNYAGPQLLYHWFSLMWIIKGIAQGIHYLHEQHVVHLDLKPDNIILDSE

SEQ ID NO: 59616 - protein, 103 aa, Sorghum bicolor
  Clone ID: 7535210.pep
SNPKFCSANLPKNPLPRPRNPFLIKIGLLVNQGSRLQTMSNKVAPAGLPASACWYSTGDTPVALAKRDMRFHVFFFSKQTGPSVLDPAASNPTPPQDTNGTLV

SEQ ID NO: 59617 - protein, 112 aa, Sorghum bicolor
  Clone ID: 7535226.pep
MAEDGDKAAASAGEAGGGGGGGNEGGEEEKSVKLFVGQVPKHMTEADLLAMFREVAAVDEVTVIKDKVTKVSRGCCFVICPSREEADKAVNAYHNKRTLSGASSPLQVKYAD

SEQ ID NO: 59618 - protein, 148 aa, Sorghum bicolor
  unsure (1)..(148): unsure at all Xaa locations
  Clone ID: 7535229.pep
MKVVAFLRHGLGLLVPLSIAFTIYLYIFPIVQGCAFPVESRDSQEAYDLTKKFHWPSKPTADDHAKLAPFRLLALGDPQLEGDTSIITNYLXTFPHVQSVFKHVTFQTTHWCFRERVRKIIHDIVDIIMEDLPYYLMSQRKRFDLWGN

SEQ ID NO: 59619 - protein, 193 aa, Sorghum bicolor
  Clone ID: 7535232.pep
HEAEPRISNSLAGENVSADLFSIGHGEFPSGSIHGEETPLASGKTMDHVDLLREQLKILAGEVAFNTSALKRLTEEAGRSPKNEKIQMEMKKKTDEIKGKQQQIASLEREIAHATLGTQGKVDKLELSPSYHELLEQLNEKSFELEVKAADNRVIQDQLNEKISECMELQAEVTHLKEQLSQALEAKDLSNSM

SEQ ID NO: 59620 - protein, 153 aa, Sorghum bicolor
  unsure (1)..(153): unsure at all Xaa locations
  Clone ID: 7535238.pep
ARGTLPLPFINQSNQSIKQPINFTFIQKQPTSLFSRHFIPLYPFSRFKMTDNQPTNQDQSDASHSTNNGNDNQILEFRFLIDNSCVGGLVGKGGANVKRVRDESGAHVSVIKSESRSVNERIMLLKGTVRSIAKAAQMCGELLIEARAAGAEX

SEQ ID NO: 59621 - protein, 129 aa, Sorghum bicolor
  Clone ID: 7535245.pep
PPLARAVQGVVGSLQIRLRAPGCRFLGARRCRHWLNSAALRRRRRRRRRRRGLRWKRGWSGPGGAPPPSLLPPFRILTGIMSCDLVRCRTDRFRMSFLGNFDDGGGLEGGPNAPRNDWGFSVEFLVRPY

SEQ ID NO: 59622 - protein, 76 aa, Sorghum bicolor
  Clone ID: 7535246.pep
HSYICNLKYLSSAIPPPDILGSSTSFFRRVTYEFYNNICSCILNMFYKYLFSRFYVLFEQCGTCYVTIYFLLFLCV

SEQ ID NO: 59623 - protein, 190 aa, Sorghum bicolor
  Clone ID: 7535256.pep
CIMQIRNFGDAVAVCTRSPEKLSRILDMYEALAEVIPELKELFFGSYGDDVIHDLEGVLERLGDAVKGTLLEFGKVLQQESSRRPMMAGEIHPMTRYVMNYLRLLVVYSDTLDTLLDDSGAGDVDHNILHNGTDEDQEYLKSLTPLGRRLVKLISYLEANLDEKSKLYEDGALQCIFSMNNTLYIVQKVK

SEQ ID NO: 59624 - protein, 130 aa, Sorghum bicolor
  Clone ID: 7535257.pep
MWVFYLISLPLTLGMVVVTLRYFAGPAVPRYVVVTVGYAWFCSLSIIILVPADIWQTLTGSAKGGIGFFWSWSYWSTFILTWAVVPTIQGYEDAGDFTVKERLKTSIHMNLLFYSIVGAIGLIGLILLLI

SEQ ID NO: 59625 - protein, 137 aa, Sorghum bicolor
  Clone ID: 7535259.pep
MSASVLDYTTALEVLKEYKQKDGLDIHELMDTTKHGGLTYNDFLLLPGYIGFAASEVTLDAPITKRITLKTPFVSSPMDTVTEHEMAIHMALQGGLGVIHHNCSPEAQADMVRKVKRYENGFILDPIVIDRNTTVGE

SEQ ID NO: 59626 - protein, 166 aa, Sorghum bicolor
  Clone ID: 7535261.pep
HLPIASPKMVSNGISNGTNGTNGTTTNGTNGVNGHAALSPLEVLVQDLNKNTTTLNGYLRANKLPEPSFERDAPIINLSPDAPEEAQVAKEKILDSALQIFQLVSGPGEYLQNVITGYHYMEILRWMSHFKIFELVPLEGKISYTELASKAGVAELRLKTLARMGM

SEQ ID NO: 59627 - protein, 181 aa, Sorghum bicolor
  Clone ID: 7535264.pep
ARGADSPAAAAANGGTPRPSDLKPTRIPQRARSPSIASHSHSGGTGWSAAGTTLNGHPNGHHDYPAADLWEQQKPQPSPTVPDVVLHRKNSEIMREQAPFNKYGSAASRDTIEQVPFFPRSRDSYESEERPFEHWYRGDTSRNGGVGELRVGRRQEMLEIANYGHALRERPSFSRGPTPAN

SEQ ID NO: 59628 - protein, 189 aa, Sorghum bicolor
  unsure (1)..(189): unsure at all Xaa locations
  Clone ID: 7535265.pep
WYNAVESQLRGCSWETLSSVVLERFGKDHHELLLRXLFQIRQSGTVADYIEQFSAIVDQLGAYNHTIDPLFYTMRFIDGLQENIRVAVSMHQPQNWDTACVLAQLQEDLFGPRKPEVRKWDVSSGTKPFAWPSLPLPPPPGRHESGLWELLRXKPMPDIGRSTSADDRWQALCALRRSQGLCVRCGAKW

SEQ ID NO: 59629 - protein, 170 aa, Sorghum bicolor
  Clone ID: 7535267.pep
MALQLQAAAPCPPLPLAASRGRIAAPRPPPPFVSIAGAAASSPGPSARLSCRGPAPRWRRASVRAHAGAGGRRESPYEVLGVSPSAAPNEIKRAYRRLALKYHPDVNKEPDAQEKFLRIKHAYNTLMNSESRSKYASSSSDSSWSSSSRASKSAAAEEPFYGFGTEFSPC

SEQ ID NO: 59630 - protein, 178 aa, Sorghum bicolor
  Clone ID: 7535273.pep
MLARIVATLGLLATSASAASLYTIPDHAKPWGFFTNNTIFATSYNDSVTYPRYVELSNGNILATVSYSGPSTPYFPIFESKDGGATWEHISDLTDQVNGVDFAAQPALAQLPFQVGKYPKGTIIGGGNSWSNSFTRIDMYASTDGGRSWEFVSHIAEGTAPNTTNGATPVWEPLFMPY

SEQ ID NO: 59631 - protein, 186 aa, Sorghum bicolor
  unsure (1)..(186): unsure at all Xaa locations
  Clone ID: 7535278.pep
TRVGSSHEQEVMNGGEERKAGDEEGKWGWERWKRHFALVEESERLVDELQLQLQAAVYREDYRSAHKLRLAIAATAKNDTVGRAISDLNMAIDEERYKDAAYIRDHAGAGLLGWWSGISGNLADPYGLIIRISAEHGRYVARSYDTRQLASDSPGLPIFEIYFAEANGGYNLXAVHLKPDDSDSDQ

SEQ ID NO: 59632 - protein, 50 aa, Sorghum bicolor
  Clone ID: 7535284.pep
SSLTRGSVRSPLAQCLLIRYTSQVMRESSMNTQNGDRPFFDFLESSLRHK

SEQ ID NO: 59633 - protein, 134 aa, Sorghum bicolor
  Clone ID: 7535294.pep
QRRTMKELGLKRAREFGWPNTYVFTKAMGEMLLGHFRGDLAVVIVRPSIITSILNEPLPGWMEGIRTIDSFIVGYAKQALSIFLVDLDLIMDVIPGDMVVNGMMVAMAAHSEDQTTLSIYHLTSSLRQPAPYAV

SEQ ID NO: 59634 - protein, 37 aa, Sorghum bicolor
  Clone ID: 7535295.pep
GGAEADDAAALALADEREEVVLHLAVQVHVHRDGLLA

SEQ ID NO: 59635 - protein, 52 aa, Sorghum bicolor
  Clone ID: 7535298.pep
VKNTRWVNDNSVNLQYYSAEDAAVALSALTDPEAGDPALIAPQTGRKARPFS

SEQ ID NO: 59636 - protein, 84 aa, Sorghum bicolor
  Clone ID: 7535304.pep
PQPMHSFHRLTQREQFTWEDMIGPVRGAADGAAAGRGPICGGLGGRRVEKAQRAAASERANWLRRVRARSRTGEEEEPSEVGLV

SEQ ID NO: 59637 - protein, 116 aa, Sorghum bicolor
  Clone ID: 7535311.pep
QPRLMSLEIDRQRATIGEGDMKEFVPKKLPSVHLGVDEIGTVNYEIGNLIKWRKNFGNVVMIMHVSGPVDRTALEWRLLYGRIFKTGIILAEQSNAELAAERCTLSHAYKYLPKVF

SEQ ID NO: 59638 - protein, 57 aa, Sorghum bicolor
  Clone ID: 7535313.pep
HEASDEEAEDPQLCKPYASDIYSYLRSMEWQPKRRPAEDYRAAVQVDVTPNMRAILV

SEQ ID NO: 59639 - protein, 149 aa, Sorghum bicolor
  Clone ID: 7535318.pep
ARGGGVVVAGGWVFAAAVSAAVLAGSREYFELVRGTAGGGGTPPPRYVSRACSAICAFMPILALYYGRMDATVTFSAFVIAISLLLQRGNPRFAQLTSSVFGLFYCGYLPSFWVKLGSRLAAPALNTSIAYSWPILLGGQAHWTVGLVA

SEQ ID NO: 59640 - protein, 43 aa, Sorghum bicolor
  Clone ID: 7535319.pep
SILLRDISTNCLETSAFPDFDTTEAARTTIFNSCHSGITKAPS

SEQ ID NO: 59641 - protein, 125 aa, Sorghum bicolor
  Clone ID: 7535321.pep
ARGLSHGTLVTASPETVNGMLDSLGDLLKLLDVSSAENVLPTTYGSLQPPLGKHRLKIVEFISDLLSIGTEAAETRLIQLGAIKHAIDLFFEYPFNNFLHHHVENIIGSCLESKQDQLIYHVLDE

SEQ ID NO: 59642 - protein, 66 aa, Sorghum bicolor
  Clone ID: 7535363.pep
RISLLIFFQRRLCKIMLADRFLSEFDILYLIQYKVDVGISRTTQSLKRTLLTPPKCKVLYTLTPIF

SEQ ID NO: 59643 - protein, 168 aa, Sorghum bicolor
  Clone ID: 7535365.pep
MSREATRTRSRVLVVGATGRLGGSIARASLASGHLTFALVRPHHFARPDSPLLEPLVAAGATLLQGSLEDYSSLLEAVRQVDIVICAVPTKQVLEQKPLIRAIKDAGCVKRFIPAEFGADPTKVQICDMDYGFYEKKIEIRHSIESEGIPHTYICCNFFMRYLLPSLG

SEQ ID NO: 59644 - protein, 159 aa, Sorghum bicolor
  Clone ID: 7535368.pep
YTSRLTFFHFSFSSPIYIPLHTPFLQHQSSIAMMKSRRTQRSKSLPNNQSPKRSFFSIISRRLSLSSRRRANSVRLYDDSEDDDTVQVIPQEIQPPTQSRFSRRASRFWSTSAANQFNDDDSSPQSPTYPPYGGAYVPRHAASDFSKTASNRLTMMAEA

SEQ ID NO: 59645 - protein, 195 aa, Sorghum bicolor
  Clone ID: 7535377.pep
LSRRRLPHHRMRDLSLRHGPLMLLKICERVVVVLSSAEAAGEVFRDTAFEQRPTSPALDELYSRHGMGIVFAPYGDHWRLLRRVLVTELLSAQRVESFRRIREQEAARLVSSLQQAPAAAAASSPPGQLANIDERLAVFVTDSAVRAIFGDMAMPDRAALLDTVEEALDFSSLFDLRDLFPSSWLVRMLPRNGKA

SEQ ID NO: 59646 - protein, 185 aa, Sorghum bicolor
  Clone ID: 7535379.pep
MSTFTPFSEQPSLHTKAPYRAASLTQPANLRQALKDAQADASKSLIGIAHGIPSTFVTKLIASTKPDFIWIDVEHAMFDRLALHDAIHAAQHHSEGKSMVVCRVPKHDEISLTTALDARCAGIIIPHVESAQEVKDFLKEMYFGGGKGHRSFSPWNFTPGLAQSLYPNDPYNVATANNHVCLIPQ

SEQ ID NO: 59647 - protein, 202 aa, Sorghum bicolor
  Clone ID: 7535383.pep
ARGAVLSNASALEVKAGIKPADIVSGNPRLNLLFTAAIFNQCPGLDTLTEEEIAKAGLDEDDVGDSREERAFRMWINSLGIDDLYVNNLYEDSTDGLVLLKVLDTISPGCVNWKQVEMKPSNKFKKVSNCNYAVDVGKALKFSLVGVGGVDINAGNKKLILAMVWQMMRLHTLNVLKQLGGAKGEIGDDAIISWANERIMTV

SEQ ID NO: 59648 - protein, 150 aa, Sorghum bicolor
  Clone ID: 7535389.pep
MAVILSSAAPTTLTPPAARPRRRPRSGGLAARLSGALGLAHAGAALAAPLSYEETLRLSSDSGGDGGGFALPDLDLNVNLNLDGLVGFVNENPLVVAAGVAAIALPLLLAQILGGGGSSKPYAVVSARAAYQRLLEEPDAQLVDIRPLKD

SEQ ID NO: 59649 - protein, 85 aa, Sorghum bicolor
  Clone ID: 7535391.pep
MMTINPELEAFARAISRVLGWAYFLAWSLSFYPQPISNYLRKSTLGLAIDFPTLNVLGFVCYTLSTASFLYSPTIKAQYAYRHPE

SEQ ID NO: 59650 - protein, 59 aa, Sorghum bicolor
  Clone ID: 7535398.pep
ADVMFSLIIKNKDWKFIHSFMFHDSICTDHSLAAVFVILKIEHKIAYLTTLASNLSIKL

SEQ ID NO: 59651 - protein, 145 aa, Sorghum bicolor
  Clone ID: 7535401.pep
MAGLLEQIDGAISDALKEWNIYTTLISFAIVGFLAWIIYDNADADTHPLLLARQAQASYVRQPGESAIFRSPETPHGYPLRTGLAVRPPGTPMYSAGKDGDLRDIWRRVTGEIPLERGAKSSGTAHIMTVFGKDGVSEHAIEDVT

SEQ ID NO: 59652 - protein, 178 aa, Sorghum bicolor
  unsure (1)..(178): unsure at all Xaa locations
  Clone ID: 7535416.pep
TRGSDSAPTLCDILWSGFKEWDSNSIVWDALANSYARAQMNHDALYVLSKMSSLNMQISITTYDSLLYSLRKADVALEIFKEMESCGIPPSDYSHSILIDGLCKQDKIGEALSFLQEIRKEGKFIPLGMTFNTLMSALCNWGFIQDAKSVFCLMLKYGLNPSRHTYSTIIHGXLCKIG

SEQ ID NO: 59653 - protein, 70 aa, Sorghum bicolor
  Clone ID: 7535417.pep
SYFSAPSHIDTVVTILLCLQIFLIMPRILSCLVKFSHIYGTQNTSNNLNNLEFERCEHCRNKKIIPIVLA

SEQ ID NO: 59654 - protein, 132 aa, Sorghum bicolor
  unsure (1)..(132): unsure at all Xaa locations
  Clone ID: 7535418.pep
MATHTTYSVRVSSETHKIEAWVVSDEALARQLQEEENTHDAAADTREFAGNVSLELSSPAVEYRPTQNAAQVAREDNVDPDNMSYEQLQALGEAVGTQSRGLSDELIAYLEPFRNKCTFFSRXKNSEECVIC

SEQ ID NO: 59655 - protein, 168 aa, Sorghum bicolor
  Clone ID: 7535419.pep
HEAASLGWSNQKPIELWKPDKTSSASAAAALAKDYKMAPAWEPTSNSAGHKAALLAVGSANAALNQSPSQRKSHEGWGNSAATQAFNTNRANSMRQPDPRASDTSLQGQKSLAAAKGAMSTTRRRAKSTPSAPDSHAPSSPKTNTRPDALSGAALAHKASLRAKPATE

SEQ ID NO: 59656 - protein, 85 aa, Sorghum bicolor
  Clone ID: 7535422.pep
MAESCTVSNSENKRSLPAWMLKATSGNQVAKTEDQNKQALESDEQIGALNQSKPVKRNNRRPLKSLDSGAAGELGVLRRCEGREK

SEQ ID NO: 59657 - protein, 137 aa, Sorghum bicolor
  Clone ID: 7535424.pep
TRRQHGLTLPYRLDRSMASSGSDVPAARAAVAVNDLIQARDGAARLRAFLLQLDDQRAAWAQLQIDGVLTKLSSAMSALDVSDAAGSDDGARPRPQSGSSCGNKRKQSSSRRSQRPSDKKITANLEDGHVWRKYGQK

SEQ ID NO: 59658 - protein, 103 aa, Sorghum bicolor
  Clone ID: 7535426.pep
QLFEYTTIRLCLIISYKFLFWCSGDHDLLVPFTGTQAWIGSFNFSIVDDWRAWHLDNQAAGFTIMYASNLTFATIKGGSHIPPETNPKESFTMAKRWLDNEPL

SEQ ID NO: 59659 - protein, 179 aa, Sorghum bicolor
  Clone ID: 7535429.pep
ARGRNKMLELKHNNEKNVCIIYGQASKANYLKMGPTITFNLKREDGTWFGYREVEKLASLSGIHLRTGCFCNPGACAKYVGLSHSDLVSNFEAGHVCWDDNDIINGKPTGAVRISFGYMSTYEDAEEFLKFLQSSFVSKPVGLKNGYMVNTDTFNLVDDWRQQAISDIRLKSITIYPVK

SEQ ID NO: 59660 - protein, 74 aa, Sorghum bicolor
  Clone ID: 7535430.pep
ARGHGGGASARPWPGAGVVAGGAGHPRRAAGQVSPPDFWVLRVWEPRKAAIRVRRLLLFLNSDYWIELTGNLSN

SEQ ID NO: 59661 - protein, 162 aa, Sorghum bicolor
  Clone ID: 7535432.pep
MASAAAWEGPTAGELMSAGAAAIPGGVRVKGWVIQSQKGSILNAASLQRFEDELQTTHLPEMVFGESFLSLQHTQTGINLHFNALDALKAWKKEALPPVEVPAAAKWKFRSKPSDQVILDYDYTFTTPYCGSDVVIVNSGTTQTSLDGCSALCWEDTNDRID

SEQ ID NO: 59662 - protein, 91 aa, Sorghum bicolor
  Clone ID: 7535434.pep
YCDILQTLEPLVTVFCIEIVYLFVIGRRCQRVTYRLFNQRSFSHFSIFGFEFLNYVCLCSIWSYVFLSPVHCISLCDFPDIKGLVVYIFSP

SEQ ID NO: 59663 - protein, 150 aa, Sorghum bicolor
  Clone ID: 7535444.pep
TRTGWWGHLAPIHLQNVIIAFYAQSQSPQESAKQYVILCRASDQDRHVSYWIISLGKYGCNAAREIGRPMIIGSPLQLDKILQRLPSAYSGPPTIINGLLVWLLPPQFQVNYLVTFNIMVEVFGVIDIPDTNGLLPYQLLVVENRIAIAF

SEQ ID NO: 59664 - protein, 103 aa, Sorghum bicolor
  Clone ID: 7535446.pep
STESSSDHGIDGWYCSGSSPSTPIDIKSTPTNLGYERAIDFSPALCTDNKRERAGSEGESPPSDPHVVHRWSTAGWVAAVQPTRRPPLLAPPTWLLTRGEPRA

SEQ ID NO: 59665 - protein, 175 aa, Sorghum bicolor
  Clone ID: 7535454.pep
MIRKRNPQLGVIGVGLTPQDNAGTANAGAANAGAANAASDPNATTGTTTASSNTAKVTDTNTATAKTGTATSSGTATGTGTDTATATDKTATDTTATGTATGTTTGTGTGTDTTSTGTSTTGTTSSSSLSSSSSSSSSSSSASSSASKSTQEQQQPQTQNNNAQQTKVPADRTQT

SEQ ID NO: 59666 - protein, 203 aa, Sorghum bicolor
  unsure (1)..(203): unsure at all Xaa locations
  Clone ID: 7535456.pep
HEGQLDSLTKARGNYNKASKDSESAMIAVNKEVSGANQPKKVAQLQQKAAQAAEKAATADQEYKDTLKLTNTKQQDFYITEMPHCLNEFQQFEEERITFAKTMLTKYGDLLLELPPVYQQTSESVSKDAANINPAFDTEKFTQENKTGVTPPPPMEYQPYEINASLPNLXRSASPNSPARIASLARPEQVKEWGLSASDESLS

SEQ ID NO: 59667 - protein, 74 aa, Sorghum bicolor
  Clone ID: 7535458.pep
TRLKQTEVDCELLKRCCESLTEENRRLQRELQELRALKCAPLRPQAAQAPPSSAAHAAGVPAPPQPFYMHMQLP

SEQ ID NO: 59668 - protein, 198 aa, Sorghum bicolor
  Clone ID: 7535461.pep
FGNMTSLNHLDVSFNQLSGQIPVQGVFTNVTAFSFADNDELCGGAQELHLPACPNKPLWQSQRKHHIILKVVIPVAGALLLFVTLAILVRTLQKKSKAQLEAAPVTVEGSLQLMDGAYPRVSYADLARGTDGFSLSNRIGTGRYGSVYKGSLVINDTTTIVAVKVFDLQQSGSLRSFMSECEALRKVRHRNLVSVITC

SEQ ID NO: 59669 - protein, 169 aa, Sorghum bicolor
  Clone ID: 7535469.pep
HEAHSKTSRVPRRPFESARLDSELKLVGEYGLRNKREVWRVGLTLSKIRRAARQLLTLDEKDPKRLFEGNALIRRLVRVGVLDESRMKLDYVLALKIEDFLERRLQTCVYKLGLAKSIHHARVLIRQRHIRVGKQIVNVPSFIVRLDSQKHIDFALTSPFGSGRAGRVR

SEQ ID NO: 59670 - protein, 102 aa, Sorghum bicolor
  Clone ID: 7535475.pep
LQFFDFTTTADPRQDVCARTLSLRHPTSPSLLDLHPKTFCEAINNIPSFRSRDKNHAKRYEEPKIPRNFTARDILIPPETQLSLLSSPSWRRQPINSLHLVQ

SEQ ID NO: 59671 - protein, 180 aa, Sorghum bicolor
  Clone ID: 7535476.pep
CLRAEASEDGVWALDGPLDDPTALPWPSSLDEDWPGFSGSLVDTLSPRQLSVSVPAPGISNPEPRAPPASSSSLTSDSNSSDLNSRPSRILHIAARNETTGILLSLIKAGANVNSRDCSGTTPLHIAVRFRRASALELLVNHGANINARDSANMTALEVAVRAQDEELVNVLLSGGAELH

SEQ ID NO: 59672 - protein, 167 aa, Sorghum bicolor
  Clone ID: 7535482.pep
TRAYYRDGHKCYPKDVGCGVYYADGQGCFPDEKGNYLKAGEWCPKERECHERCIRPEHHTTSTEECPKETTTTERRTTTPKETTSTKKHYTTSTEECPKETTTTERRTTTPKETTSTKKHYTTSTEECHMESTTTPKETTTTRKETTTTPIETTTTERRTTRKHTTT

SEQ ID NO: 59673 - protein, 144 aa, Sorghum bicolor
  Clone ID: 7535483.pep
MEAAAATAAALSPPRVALDARTLFSPPRSLPASPSSQLRLAARPRALAAAKPRFLSPHREPAVDGGRGARDVVAMVVPFLRGTAWEQPPPDLASFLYKNRIVYLGMCLVPSVTELMLAEFLYLQYDDAEKPIYLYINCTGTTKN

SEQ ID NO: 59674 - protein, 65 aa, Sorghum bicolor
  Clone ID: 7535487.pep
ALYLREMVDKVKKMLANIPPGAKHHKKNEDVYTMTQTIRKDPRILHNHCRIYIMQKGWPSATTLC

SEQ ID NO: 59675 - protein, 168 aa, Sorghum bicolor
  Clone ID: 7535489.pep
MSYYPGQGYNGGGGGYGYGPPQGHPPPQQYYSGPPPQQQRSYGPPSGPPQHHYGPPPGPPPNHYGPPQQHYGPPGGPPPPTNYDAYGFPLPQGRHHHAQHARSGPPPPDVPQQFGHGAPEGYTFQYSRCTGRRKALLIGINYFGQEGELRGCINDVHNISAFLVERYN

SEQ ID NO: 59676 - protein, 92 aa, Sorghum bicolor
  Clone ID: 7535496.pep
RSQFIFMEVLGSSDMHTLFSCMRQFWKGFILSELRVSRSSERVKVCLNINIYTFSCSYNLYLILSNLLPWFHLLRYRYMKANAYVFFCAPNL

SEQ ID NO: 59677 - protein, 84 aa, Sorghum bicolor
  Clone ID: 7535498.pep
FSKLAQPPFWTLAAPDKTALHPAAITDRDLAGGLRFIRQSPGAFLLILDSLTPCLQVCNLNSPVYVMVSSRRLVSFFVCFSSFW

SEQ ID NO: 59678 - protein, 177 aa, Sorghum bicolor
  Clone ID: 7535503.pep
HEGDIKPENIFLTQSGLMKLGDFGLATTDAWSWEIAVGSDRYMAPEQYDPTSAGYSTAKADIWAIGICLLNVLFSRNPFAVPAESDPLYADFALDRQSLFDVFPNMSQDTFEVLMHCLAIDPEKRDLTSVKDALARVISFTIDDETLDDFCTEERDSVVASANREPLRTPSISTPQL

SEQ ID NO: 59679 - protein, 163 aa, Sorghum bicolor
  Clone ID: 7535510.pep
TRDEFQPRLLYMLRDCASCRLSLPSDAGNSTFCDPLSDNQSPSIRKRKLRWILSAFNEVTRLGIAGGRLRRRRVKAPLLYGGLGVSGTKRKEAPIASLAACAARPFKCSSGAAAAAAAMEVRSDWASLPPELTELIAARVLAANMVDYMSMRAVCACWRASTA

SEQ ID NO: 59680 - protein, 162 aa, Sorghum bicolor
  unsure (1)..(162): unsure at all Xaa locations
  Clone ID: 7535514.pep
SEYLMKQPASTARPSELGGHPSMFATATLRHCAQPPSPTVSTHCAAAYTPPLAAAAASPGTRGTAAARSATSARAASAKPPASTAEPLQTCVLPGSVDWSKKAALSYRSMQPSRMARPPLAAALQEARRRAAAXVEAGDTVTARDVRAALRHRERRGGGALV

SEQ ID NO: 59681 - protein, 181 aa, Sorghum bicolor
  Clone ID: 7535523.pep
ANVQFLALTLLETLIKNCGDHVHFQVVERNILEEMIKIVKKKADMQVRDKILMLLDSWQEAFGGPGGKHPHYYWAYAELKRSGVEFPKRSPDAAPIFTPPVTRPESLPSYLQAGYGMPVDSSSRLDEAMSSNGASLSISDLERMLGAVELLNEMLRAVNPNDKDAANDEIITELVAQCRSY

SEQ ID NO: 59682 - protein, 55 aa, Sorghum bicolor
  Clone ID: 7535525.pep
SPTSQNPPSNPSNHFDFGIKRTRETGFPLQVQWSKKLCLFDCSFPVNILTSSLII

SEQ ID NO: 59683 - protein, 170 aa, Sorghum bicolor
  Clone ID: 7535527.pep
TRPTDIEPVANLGLSLASSLQVQSEGNRRARQRLPKLINLINSTALTLKKVDDLVQENADVFTKPCLDDITSLTVTCEKIYSGTLMMLVRQTENIVGDKEINEIPREETGKYLHCIAHTTVWRYESWELLEVQLRYFRHRLTQLKFELTLRYLLGCIAQHQMRAQTRAPG

SEQ ID NO: 59684 - protein, 135 aa, Sorghum bicolor
  Clone ID: 7535528.pep
MSNIPTEQWAQVIEKTGGPVEYKKIPVQKPGPDEVLVNIKYSGVCHTDLHAVNGDWPLPTKLPLVGGHEGAGVVVARGELVKDVEIGDYAGVKWLNGSCLSCDYCQTADEPLCPTPLLSGYTVDGTFQQYCIAKA

SEQ ID NO: 59685 - protein, 203 aa, Sorghum bicolor
  Clone ID: 7535533.pep
HEGSPERAAGSAGSRRLLELRGQEAAEEEEERWSFLALLFELLRKSLLGCRTVSGGSGEGEHGGCGMEIGLPTDVQHVAHVTFDRFHGFLGLPVEFEPEVPRRAPSASASVFGVSTESMQCSYDSRGNSVPTILLMMQRRLYEQGGLQAEGIFRINAENSQEEFVRDQLNSGIVPDGIDVHCLAGLIKAWFREMPRGVLDSIP

SEQ ID NO: 59686 - protein, 192 aa, Sorghum bicolor
  Clone ID: 7535536.pep
HEANATLSCTRALSTSSVLRDSSSGTTFHSPFKGQSKASKIPDFSHYMSKNSKNSNILFSYFMVGTMGAITAAGAKSTVQEFLVNMSASADVLAMAKVEVDLATIPEGKNVIIKWRGKPVFIRHRTSDEIDEANKVNVASLRDPQADEDRVKKPEWLVMLGVCTHLGCVPIGEAGDFGGWFCPCHGSHYDIS

SEQ ID NO: 59687 - protein, 182 aa, Sorghum bicolor
  Clone ID: 7535558.pep
HEAQQGSVVLDANWRWTHDTKSTTNCYDGNTWSSTLCPDDATCAKNCCLDGANYSGTYGVTTSGDALTLQFVTASNVGSRLYLMANDSTYQEFTLSGNEFSFDVDVSQLPCGLNGALYFVSMDADGGQSKYPGNAAGAKYGTGYCDSQCPRDLKFINGQANVEGWEPSSNNANTGVGGHGSC

SEQ ID NO: 59688 - protein, 140 aa, Sorghum bicolor
  Clone ID: 7535560.pep
KLLLPVFMERLVTSNDDCVKILKQWTKHSYSQSLGSHSSSQNPHQCEHCRKAIVTFKPVNGKELRSSPLPYEIGTVKFTLLQVVRAALDKCQLHCYLLDLLSEKEDEVRSDIGRIDHEVKMTVQLKSYYNSILIPNAYIG

SEQ ID NO: 59689 - protein, 168 aa, Sorghum bicolor
  Clone ID: 7535561.pep
ARGFLGGLVYRNDIEGLVGREFCNPVNITDASKGQICAAQQATNVDPQDPNHSVSGGNLQLFSTFHPDEATVAGTSHAPGRYQNMGGFVEEHSRVYKTTDSAKLHEVIDYYPPEHIPVFSALVENFLLFDHWFASVPGPTNPNRAYLTSGTSAGHGSNDNAFNVYGLK

SEQ ID NO: 59690 - protein, 64 aa, Sorghum bicolor
  Clone ID: 7535565.pep
YLMFRAHVQRFDMMDKNILSVELTRHNNYQCVHDWKTHTVVLRACSFFFSAVLFLLAMSVFLLQ

SEQ ID NO: 59691 - protein, 89 aa, Sorghum bicolor
  Clone ID: 7535569.pep
TRLRSISLSSSFAWDPQCLIPPRNGRSSGCQNPSYLYACYKLVTCLLPPLIWFRYCFSGLISACFLSFLVYDCSGTKKGSFSMFKTTCV

SEQ ID NO: 59692 - protein, 170 aa, Sorghum bicolor
  Clone ID: 7535571.pep
MPPPQSGMALCRLPTATVGLPLSLPCLLSRPRMSLAARRARAVAARASSSSSSSPSPDSSFGSRMEDSVKKTVADNPVVIYSKSWCSYSMEVKALFKRIGVQPHVIELDHLGAQGPQLQKVLERLTGQTTVPNVFIGGKHVGGCTDTVKLYRKGELASMLSDLDININNS

SEQ ID NO: 59693 - protein, 201 aa, Sorghum bicolor
  Clone ID: 7535582.pep
EMKARSRPTVVSYTACVKILFDAGRAEEARRVFREMVAEGLRPTCKTYTVLIEHLADTGKFEATLEIMDKMKEACVQPDKALCNILVQKCSRAGETSVLTCILQYMKEHFIVLRRPIFLEALEALKASGDSDELLREVNPHLSYEGIENDPILSDQGYLTDRSIIIYLKSANKWSAIEQMVSQMAPKNVKMETHILSDVIE

SEQ ID NO: 59694 - protein, 193 aa, Sorghum bicolor
  Clone ID: 7535591.pep
HEAGKVPPCKVLVIGAGVAGLSAIATARRLGAIVRGFDTRSAAREQVQSLGGEFIEVEIEEDGSGAGGYAKEMSPAFIEAEMKLFMEQAKEVDIIITTALIPGKPAPKLITNAMVAAMKPGSVIVDLAAEAGGNVEATVPGELHVHRGVTIIGYTDLPSRLPTQSSTLYSNNVTKFLLSMTPPNQTGRFYLDL

SEQ ID NO: 59695 - protein, 165 aa, Sorghum bicolor
  Clone ID: 7535596.pep
TRQKAPFEYAYALYKTGDAANAVKVAQAQGPQGGRGTKHVLAQAAYRSESFAQAMNIYRQLASQGIDDEEYDIRINSGAVDAQLEWDGQGELAQKKKPTREDLEVFETAYNAACGSIARGELAQGEVCLKRAITLCNALEDLSDEEKAAEIMPMTVQHIYILTQL

SEQ ID NO: 59696 - protein, 135 aa, Sorghum bicolor
  Clone ID: 7535601.pep
MEETINPKPVQSLRDHIKKLFQSRHGIYGENGFDIEFSYIERKTEKDLYFGDYKSAIQPCNHTKNRYSNVLPLEKTRVIISKDEDGSDYINASYINGQVPGSEKAYICTQGPTKNTVDDFWRMVWEQNSTVIVML

SEQ ID NO: 59697 - protein, 88 aa, Sorghum bicolor
  Clone ID: 7535602.pep
DFKEDEFHKAFDDLLGTLNITEPFFLVVQGFLVGSYGLTWALNNSSKVLKLAILNSPLTVSSPVPGLFQQLKSVISSYLGSLLLVGIN

SEQ ID NO: 59698 - protein, 98 aa, Sorghum bicolor
  Clone ID: 7535603.pep
PPPLLLLLLPRCGGGGAPPPPPPPPPVAPAVAPSPPPHRRRYFAHPYRTLASTHRPVTAGAGACVDEEEEEEEEEERRWLRHGRVRQALIRSEKKRIS

SEQ ID NO: 59699 - protein, 144 aa, Sorghum bicolor
  Clone ID: 7535606.pep
ARGKCYFAKHKLVWEVLEGGLKSKIEIQWSDITALKATCPENGQGTLDVALARPPLFFKETDPQPRKHTLWQATSDFTGGQASMHRRHFLQCPSTLLSKNFEKLIQCDQRLYQLSQQPEIALQTAAFEPRCSIFDDPVESKCAA

SEQ ID NO: 59700 - protein, 165 aa, Sorghum bicolor
  Clone ID: 7535611.pep
HEADTQKPTEYLTTLGRYTLRDLLLANLQSSSTITATTALQLLRTIIIKHPQLASERLIIGFTDTTTRSWSDHKDTITSDDPDQEQPESTYSTHEREMGLYFTLITRVDPSHSGDAFSTGYNRYLCDALSSTQSQLATRQDLVGTAKHRLSLSDPVLTLLLDSLR

SEQ ID NO: 59701 - protein, 131 aa, Sorghum bicolor
  Clone ID: 7535613.pep
SRLPTSTRASGVARSSTSTSPTSTVSPCPSPALATLVSLVAATSTSGTLTSAPTTTVLARARTPSASTTTALPASSLPPALTLPTPTPRTTVPTLVTVSAAAASSLAASALRAPRTPASRKWWLLLQAALS

SEQ ID NO: 59702 - protein, 157 aa, Sorghum bicolor
  unsure (1)..(157): unsure at all Xaa locations
  Clone ID: 7535614.pep
MPSNRIIRKAKPSLFKRSMRKILMDAFLPVGYPHSVSGDYLAYQFFDSLQAFFSTITALLANRALLXGLGVGDANSSATFAMLLTVLKDAMSRVATIIFAQQFGLRIEPDAKRYRFLADLFNDTAFFLELYSPYFGPYGKILALTSGEALRALCGVA

SEQ ID NO: 59703 - protein, 100 aa, Sorghum bicolor
  Clone ID: 7535636.pep
MQALARASSSATFKRVVAGFSGTVTRSYRTCRGKPHVAPLSTLEPPPKGPKRVAKQERRIMIVEFVQKYRASNEGKFPSITYVRQQLGGSHYTVREIIQE

SEQ ID NO: 59704 - protein, 211 aa, Sorghum bicolor
  Clone ID: 7535646.pep
ARGLTGYDLNVDLLDVHADKSTFHRFDKFNLKYNPCGQSRLREIFLKQDNLIQGRFLAELTKQVFSDLSASKYQLAEYRISIYGRKQSEWDQLASWIVNNELHNENVVWLVQIPRLYNVYKGMGIVTSFQNLLDNIFLPLFEVTIDPASHPQLHVFLKQVVGLDLVDDESKPERRPTKHHMPTPEQWTNVFNPAFSYYAYYCYANLFTLNK

SEQ ID NO: 59705 - protein, 174 aa, Sorghum bicolor
  Clone ID: 7535647.pep
MAESYKAATEELADVRELIPEFMYLPDFLINADKLDFGKQQTGNRVSHVEMPLWSKKSPHRFIAMQRLALESEMVSRSLHNWIDLIFGYKQRGKEAEKAMNVFFYLTYEDAVDLDSIKDAGLQKSLETQAIHFGQTPSQLFTKPHPQRPPLDYSWGSSRLIADPSAELRVFRPS

SEQ ID NO: 59706 - protein, 177 aa, Sorghum bicolor
  Clone ID: 7535648.pep
LESGGASSAAQSAGPPAKREAKARMMGSGRWQSPAGAPAAADAAEEDTGGVGGPSRRPLRHGLHRASPYGGGLRRRLLKPPVASRIFPTMPRDRAASDNDQEVHRESLEVIQERHSTQPNINAAAILPPRSVSNTFNLLLEGDRNPSHGNGLADIENIINQSYFSRDETLRLIEIIR

SEQ ID NO: 59707 - protein, 95 aa, Sorghum bicolor
  Clone ID: 7535652.pep
MAEVILSHFATSVLQKVASLGRKWAINEIKSAWNVKKEIGKLERSLRSICAVLQDAEGRQSCPHALQEWLDNLKDAIYDIDDVLDDVATRDLEQK

SEQ ID NO: 59708 - protein, 172 aa, Sorghum bicolor
  unsure (1)..(172): unsure at all Xaa locations
  Clone ID: 7535653.pep
HEAQSLLINGRGRFVNCSAAAAAGMTCNATLPECAAPVFAVVPGKTYRFRIASVTSLSALNFEIEGHEMTVVEADGHYVKPFVVKNLNIYSGETYSVLIKADQDPNRNYWLASNVVSREPGTPTGTAVLSYYGGRSSPRKAPPTTPPTGPAWNDTTYRFRQSVATVAHPAHX

SEQ ID NO: 59709 - protein, 96 aa, Sorghum bicolor
  Clone ID: 7535654.pep
ERDSTASVGCDLWRPSQHSHHGHPPPAFGHKRARDPCDPTRCKRGAKECADPRGDLNLMPPSPQQGTDRSPRARNRVEERGPLGIDARSSLLPPRW

SEQ ID NO: 59710 - protein, 180 aa, Sorghum bicolor
  Clone ID: 7535655.pep
MNYSSASLYVGDLHEEISEALLFDLFHEVGPIISIRICRDAMTRKSLGYAYVNFQNPQDAERALDTLNYASVKGIPIRIMWSQRDPSIRKSGIGNIFIKNLDKSIDNKALYDTFSAFGNILSCKVCQATKKGEIESVESAGYGFVHFETQEAAEKAIAKINGMLLNGKQVFVGPFVKKTE

SEQ ID NO: 59711 - protein, 162 aa, Sorghum bicolor
  Clone ID: 7535660.pep
ARGDSARNEMGRDVLIFSEAHESLYDDVLTKFYSKKQGDSKFKLNPKKSDGLSGKVEKKEGYVPHEELKYPLERNGMPNLDYDRSVSVYYDMPSVSQTHKSMLLRGVQLPKPALTQSDIQDIRNKANRGGRNGGFGRGGHNRGGYNGPGMSRGPQHDRHQGG

SEQ ID NO: 59712 - protein, 118 aa, Sorghum bicolor
  unsure (1)..(118): unsure at all Xaa locations
  Clone ID: 7535667.pep
MASPEKKTVKCVVVGDGAVGKTCMLISYTRNEFPTDYVPTVFDNYEATVLVEGKEVIFSLWDTAGQEAYARIRTLSYQKTDIFLLCFSVAARTSFGNVTETWVPELKHHCPKAPIILX

SEQ ID NO: 59713 - protein, 175 aa, Sorghum bicolor
  unsure (1)..(175): unsure at all Xaa locations
  Clone ID: 7535668.pep
QGGNLVSSQHRRKLRCLELCPANDQLVVTSALDGLVTLWQVETRGPSLSFRGKTDFFSPKHRWPEDIAWHPDGETIFAVYTADNDDSQVSMTNLISGQRKVTFLPEKPHTKGIINNISFMPWSDACFVTGGSDHAIILWEDKDDSWKPKRVHKDFHSSAVMGVAGLQQKXTILSV

SEQ ID NO: 59714 - protein, 146 aa, Sorghum bicolor
  Clone ID: 7535676.pep
MANPRIEEIPDEPEKKNAQIEEDDSSDESEAEEGEVNVPAGSSVAVHSRNEKKARKAIAKLGLKHIEGITRVTLRRPKNILFVINQPDVYKSPSSNTWIIFGEAKIEDLNSQAQASAAQQLAQAEAQSHDHAGHDHGDESGKGKAV

SEQ ID NO: 59715 - protein, 133 aa, Sorghum bicolor
  Clone ID: 7535677.pep
MGKEVDVSTLEAGGVRDYADPPPAPLIDIDELGKWSLYRAVIAEFVATLLFLYITVATVIGYKHQTDATASGADAACGGVGILGIAWAFGGMIFILVYCTAGISGGHINPAVTFGLFLARKVSLVRAILYMAA

SEQ ID NO: 59716 - protein, 179 aa, Sorghum bicolor
  unsure (1)..(179): unsure at all Xaa locations
  Clone ID: 7535678.pep
ARGLPPEILQEIASYLHDGYERHHFGGYDPPLGQHEIAGNKRRSYLASLRAVNLLFYDLVTPILFQHAIIYSGSVIKRWGVTAVTSNGVTGTARLVKLSKNPQLREIVRRLEICLKVKGPNDFQEYKPAIEERNKDLEYIARMGSVIHSALPRFTNLKILKLNXENIPYSYNQELDDPG

SEQ ID NO: 59717 - protein, 115 aa, Sorghum bicolor
  Clone ID: 7535679.pep
MSKKLIAVLGITGTQGGSVAGRFLSHAEWRVRGLTRNPGSAKAKDWASKGIEIVKGDYDDLESLKAAFQGAHAIFAVTDWAACFSRVSENTNLQNEANKAGLSYEEYARELERQQ

SEQ ID NO: 59718 - protein, 99 aa, Sorghum bicolor
  unsure (1)..(99): unsure at all Xaa locations
  Clone ID: 7535680.pep
MVGRTFTTALAVAALAGSTLAQSGNAKGTRDKPCPADSPCCGLYGDCGIGAFCLGGCDITMSHSIKSCVPNPMCKAGEYKMNSLDDVQDIGKYLXDNSK

SEQ ID NO: 59719 - protein, 174 aa, Sorghum bicolor
  Clone ID: 7535685.pep
HEEEVKGGTLGDQGIVPYDIMLFFLSLAYIAISVDASGLIRWLAFKVLQKGGKVGHRLFFYLYAFFFGLTALIGNDPIILSGTAFLSYMTRVSSNIKHPRAWIFTQFSVANIASAILVSSNPTNLVLAGAFQITFIKYTANVIVPVLVTGIVLYPFLLYIIFHDESLIPTTIKM

SEQ ID NO: 59720 - protein, 42 aa, Sorghum bicolor
  Clone ID: 7535693.pep
FEVTPEMGGQTGSLWNLKRRDGGKTNEFFSKTLEFDHPCQGT

SEQ ID NO: 59721 - protein, 97 aa, Sorghum bicolor
  Clone ID: 7535696.pep
PGQHIEPKSLQVNDLPTPAAAQKMEKFRSTGANIQLWVSSAAELQYSSTVNGEAQPAKQTQSTLILLFLQLMQSPALSKQIPQVFMERSYFTTKKHC

SEQ ID NO: 59722 - protein, 189 aa, Sorghum bicolor
  unsure (1)..(189): unsure at all Xaa locations
  Clone ID: 7535697.pep
IPADEVNATXVERLFKLIDVFKRNSLQLSDFKRLIQDDFEKGNNTVVSGGKQLMGTSTFSWKIHARQQLGLLLSKDFVDLKASFEEISGHSVKMTYKSFAEWIAKSRALAGFDLTDKLLQVLFADLDPHKKGYLTELDWTNAFGTYSFKTQVLSEVQEALNANYNDIQSAFEFFLSHEQEINKNARDIT

SEQ ID NO: 59723 - protein, 80 aa, Sorghum bicolor
  Clone ID: 7535700.pep
RVCRLYIRYHFTLKAILRFLAMSIHITRFRVELFCARGFLCFFFLGFSRRLNLFAFFFLGRRVMHDGGMMERRSQRAKHY

SEQ ID NO: 59724 - protein, 72 aa, Sorghum bicolor
  Clone ID: 7535701.pep
VIFEVTTSIHMSADDIAVAISRRFTGCGSLSDRNYISPFRTALQSWLLKNSSKEGVLMPSSAGVLTLGFPPA

SEQ ID NO: 59725 - protein, 119 aa, Sorghum bicolor
  Clone ID: 7535702.pep
EDLEACELVFARIDENMRKIHGDKYDQAAAEKKREILHQDIIRKTGSLGEFCRRFFAEIEQEEDSDDDEDSDEIDSEEDRENIAEFLEIAFGQRAGDTSDEEDVSSDVESSDSDLSDEE

SEQ ID NO: 59726 - protein, 72 aa, Sorghum bicolor
  Clone ID: 7535703.pep
DPGDESGKGKAVEAKKEEEEEEADDEEIDDFGLETKDIEFVMQQARVSRKKAVKPLKENDNDIVNSIMALSI

SEQ ID NO: 59727 - protein, 58 aa, Sorghum bicolor
  Clone ID: 7535704.pep
VVHEGRNHEVRELVQNAGLQVYALKRVRIGRFRLPADLGIGKFVELKQADIKALEGNK

SEQ ID NO: 59728 - protein, 70 aa, Sorghum bicolor
  Clone ID: 7535710.pep
ADPLPGVASSLLCFFPCVVGCFFRALCIKCLWSWGYVVMPMAVAVSPLNNKLDPVGLKCNVTCPFTCYVS

SEQ ID NO: 59729 - protein, 133 aa, Sorghum bicolor
  Clone ID: 7535715.pep
DSIHILSPLILKDLNSIESLVYGNEKGDIYQRELPFLTLRRKISGSVGSPVLSMLLTKDRRFLLFGCGDGDISVLTETMQSSKSGPSSIAQPSSAGEKFSKAQENQEESKGESQPLLKSNSDSDIKLKDSKTE

SEQ ID NO: 59730 - protein, 153 aa, Sorghum bicolor
  Clone ID: 7535716.pep
SGPTQATSTCPSKSCSGRIPRRFMPSALGSWPWRLPGRWIRVRATPRDWTAFSVAKVPALATGTLSPRRTMIRLIKITSKSTTTASFGTRCSPRGGTWSLRLSRPKHLFAWPSCTKTRRTSEDTQTGMGYTEFWRQGTRVSPHERAMDLTCVE

SEQ ID NO: 59731 - protein, 143 aa, Sorghum bicolor
  Clone ID: 7535745.pep
PLTLYISRVPGTRDVILSPFKPQLKNVTAEDVASCLYYVHFEAPSLEPVGPPRDDEHRSSSDESSSIRNIKRKPLPGSARPLTPPSTDHLPVPGYGNEYQDPTRRRGLSVNSTFDPRQTSARRDNEQEEESPVLPPRPKNVPR

SEQ ID NO: 59732 - protein, 108 aa, Sorghum bicolor
  unsure (1)..(108): unsure at all Xaa locations
  Clone ID: 7535752.pep
MASQLPRVCVTGGGGFIASWLVKLLLSRGYAVHATLRDPCXDPKNAHLKKLDRAPENLHLFKADVLDCETLTPAVQGCQGVFHLATPVPEDKILHPDLEVLDPAVKGT

SEQ ID NO: 59733 - protein, 199 aa, Sorghum bicolor
  Clone ID: 7535760.pep
QESYPFTNLNNSCSSSTFENVVPAFSFGATNAETETAPDDHFSVKQDLPGYSRETLFGLDSIKSAYKEKREARKGKMKNKRPTSLKQHAQLHQDVSKEASTNGEASDLAGDYSPMDCSPYPAEAEHVPTEAYVASDQPVHIGDSVISNWNTSCAEDDVVSATEHLVLDADLPMFGDEGRGPKLDASEINFGSSFSSFEG

SEQ ID NO: 59734 - protein, 107 aa, Sorghum bicolor
  Clone ID: 7535766.pep
MAVVTGALPSVLAKLGDLLIGEYKLQKGVKGEIIFLKAELESMKGALEKLSSKPADELDIQDKIWAKDLRELSYDIEDSIDTFMVRGKASQSAKLHGIRKFIDRSVG

SEQ ID NO: 59735 - protein, 184 aa, Sorghum bicolor
  Clone ID: 7535769.pep
LVGWCSETEDIYVEYNGKYICAEKSERLLCLEYMPKGNLRGYLSDESSGLTWETRYKIIEGICYGLHYLHEERQLNAPIIHMDLKPANILLDNNMVPKIADFGMSRLFSEEKTWTCTISRDGTLGYMAPEYINRGLISTKSDIFSLGVIIIEIVTGQRDYPDESETGISSQEFTELVLKNWRDR

SEQ ID NO: 59736 - protein, 190 aa, Sorghum bicolor
  Clone ID: 7535774.pep
TRKTSRCTAVLAFYRPIASIAFHATGELLAVASGHKLFIWDCNNRRETLEPPIILKTRRSLRAVQFHPHGAPYLLTAEVHNLDSEDSTMTPALLSNYSFRDTPLLGGSGVDNLISELSYMHNFEQVGASSSVPVTTSSFDGSRLHDTSGHHLTTSVPGIGSSLLGTHTAEAEAPAISLSVGAEQTTSLLG

SEQ ID NO: 59737 - protein, 208 aa, Sorghum bicolor
  Clone ID: 7535777.pep
TRGDLADRMGRKWTVILGCLIYAIGVVIQMITGHGDALACIVVGRLVAGVGVGFESAIVILYMSEICPKQVRGALVAGYQFCITIGLLLAACIVYGTEKYDSMKSYQIPIGLQFPWAVILGGGLFFLPDSPRYFVKKGRIEEAIDALARVRGQPKDSKYVQSEIAEIVANEEYERQIIPNTSWFGSWANCFKGSLWDGKSNLRRTILG

SEQ ID NO: 59738 - protein, 187 aa, Sorghum bicolor
  Clone ID: 7535783.pep
MSETSVKLSTPQTGEYEQPTGLFINNEFVKSVDGRTFEVINPATEEVICNVAEATEKDVDIAVAAARKAFNGPWRKETPENRGRLLVKLADLFEKNAELLAAVEALDNGKAYNMAKNVDLPAAAGCLRYYGGWADKIEGKVVDTTPDTFNYIRKEPIGVCGQIIPWNFPLLMWAWKIGPAIATGNTI

SEQ ID NO: 59739 - protein, 190 aa, Sorghum bicolor
  Clone ID: 7535789.pep
ARGLLALLLLLPSISEATSSALLGISYGRVGNNLPAATSVPQIVASLGIGRVRLYDADPTTIRAFANTGVELVVGVPDECLATVSTPNGAASWVGSNIAPALPATKIAFLTVGNEVLTGVNSSSLSRYLLPAMQCLHDALAQAGLDKQVAVTTAHNLGVLATSYPPSSAYFRKDLLPMLCPILDFHAHAG

SEQ ID NO: 59740 - protein, 162 aa, Sorghum bicolor
  Clone ID: 7535792.pep
MPHATEPESLKLNSANLNSLENCTVPTYDRSSIKHGIVHVGVGGFHRAHLAVYVDSLLEQLKLKDWAICGVGMQSFDAEMRDALVPQDNLYTVIERSAPGSKARVIGSITDYIFAPDNSEAVIAKMAHPDTHIVSMTITESGYFYNENTHQLMTEHPDMAAD

SEQ ID NO: 59741 - protein, 130 aa, Sorghum bicolor
  Clone ID: 7535801.pep
MVKAVVAGASGGIGQPLSLLLKTSPHIDELALYDVVNTPGVATDLSHISSRAKTTGYLPANDGAKAAFKDADIIVIPAGIPRKPGMTRDDLFNINAGIVKGLIEVAAEVAPKAFILVISNPVNSTVPIAA

SEQ ID NO: 59742 - protein, 169 aa, Sorghum bicolor
  Clone ID: 7535807.pep
ARGSLGAPTPPTSAGSAPANPPPLCELERVRRIGSGAGGTVWMVRHRPTGRPYALKVLYGNHDDAVRRQITREIAILRTAEHPAVVRCHGMYEQAGELQILLEYMDRGSLENHRIADEHFLAHVARQVLSGIAYLHRRHIVHRDIKPSNLLIDSGRRVKIADFGVGRIL

SEQ ID NO: 59743 - protein, 178 aa, Sorghum bicolor
  Clone ID: 7535810.pep
TRRRRTSHGLRVRLTGRDTTPTASHARHGARLTSPPLAPSLLDFFFVSPAQSRLPSTIVRSVPPTATSTSLCPFVAPRTPIHWLIKFDSLVRLLDVYHHLPAATSGSTIAHPSPAHVLDILLFFFFFFSYHLSRPRTVYFTSLCPASFLTPRACSLILATRPSDERRPSLPVRSLRRE

SEQ ID NO: 59744 - protein, 195 aa, Sorghum bicolor
  Clone ID: 7535811.pep
HEATSLSSFSYTSLRMRNRARRLLEHLFAAEALECLETLIVSWAHAKQNDVHETAVMGLLNVLNGSRPKLTIPAIFNAVYSRTDPNALDANRMSTLTSDLSDTDLVTFLVDYTKSLEDDAMDEIWQDCTVFLRDVLANPLPHRQILPTLLEFTSVIGQKVDNTTFGEQRRMRRELTDIFARILTATFTTRPMGYT

SEQ ID NO: 59745 - protein, 174 aa, Sorghum bicolor
  Clone ID: 7535816.pep
MSTFPPPPTAARSPLARVRLDDLAPFDGASTPAYARAVEAIAASLTRHGAAAVDLPAADAAVVRCALESARAFFRARPGLYVYRAGRALDDGELSPACMADAFRCLGKAARAALCAIARNLRLRSDAFSHLLDDNPLPLDEVSASELTVSFSHGHPQSSQAPMVGLRSSMAEVD

SEQ ID NO: 59746 - protein, 142 aa, Sorghum bicolor
  Clone ID: 7535818.pep
MSYLPPFLARLARPFTQSTRLSIAPDQSAASVIPEGAQRCTVAAGCFWGTEHLYRRHFADKGLIDAKVGYIGGDLDNPSYRAVCGGKTGHAEAAQIIFDPTKVSYAQLLEFFYKTHDPTTLNRQGPDTGPQYRSAIYFHNEE

SEQ ID NO: 59747 - protein, 83 aa, Sorghum bicolor
  Clone ID: 7535819.pep
TRSRSRRITLIPPPLQLPLPLPLLRRRLWKRSNLIPDLARRSRSPSAFVCPRQGGASDGGSGGAAHRRGGGGGGPWRLAGGLR

SEQ ID NO: 59748 - protein, 193 aa, Sorghum bicolor
  Clone ID: 7535821.pep
HEGLTAGTPMEDIPVDKVFIGSCTNARIEDLRAAANVVKGRKVADNIKRAMVVPGSGLVKAQAEEEGLDQIFVDAGFEWREAGCSMCLGMNPDILAPKERCASTSNRNFEGRQGALSRTHLMSPVMAAAAAIVGKLADVRKLSHYTHQSAFKPRELPAEEPHVDERTRDDSEEREMIGDQPQDSQPHTNTLAS

SEQ ID NO: 59749 - protein, 131 aa, Sorghum bicolor
  Clone ID: 7535824.pep
TRVARRDFVLRSSELATLAAIFHLSGTKPSYLGVQKSHPSLALCPATNNCVSTSEEISDLNHYAPPWNYNPKDGQRGKPITREEAMKELIEVVAKTKPDSFTPRIVDKTDDYIRVEYESPIFGFVHDVEFW

SEQ ID NO: 59750 - protein, 76 aa, Sorghum bicolor
  Clone ID: 7535835.pep
SRKETNRPSMLRLSAFLLLPLFEKLLFQSINTMLFRRSAGSAGRCSNNNDDSGLTCNTMPLGLSSSEACRPHKIDF

SEQ ID NO: 59751 - protein, 183 aa, Sorghum bicolor
  Clone ID: 7535842.pep
KGAAETIIKACTHYMDIKGQVRPIESHIRVQQEMLVNAYAERSLRTLAIAYRDVDQATFLSFSPDDAPIHNLVLLGIVGIQDQLRPGVIESVQAFRRAGVFVRMITGDNLETAKAIAKECGILTPGGITMTGPEFRALNSRQQYEVIPRLQVLARSSPIDKTIVVSRLQERNEVVAMTGDGTN

SEQ ID NO: 59752 - protein, 170 aa, Sorghum bicolor
  Clone ID: 7535844.pep
HEGDPIFGELFAQKAKGHSSAPTATSKVAGGMKLGKAQKTDQFLESLKAEGELISEDTQQSGIQSRLPSAPTSDPITVAIEEKISATVKRDGGIHNFDIQGTLALQVLNDTNGFIQLQIENQDLPGLSFKTHPYINKELFNSQQIVAAKDPNRPFPSGQNETPLVKWRIQ

SEQ ID NO: 59753 - protein, 195 aa, Sorghum bicolor
  Clone ID: 7535846.pep
GILRKAIPTQTRLPSFPSIASQAAKRLMEKQLNASLHRAAELIKVAKQPIIYAGQGIIQSEGGTELLRELADKCSIPVTTTLQGLGAFDERDEKSLHMLGMHGMAYANMSMQEADLIIALGARFDDRVVLNTSKFAPNAKAAAAEKRGGIIHFDILPKNINKVVQATEAIEGDVATNLKMLMPMLTPTSMEQRSE

SEQ ID NO: 59754 - protein, 192 aa, Sorghum bicolor
  Clone ID: 7535849.pep
TREYSAHDNYTLQINPHSGINPEHLNYFKFIGRVVGLAIFHRRFLDAFFIGALYKMMLGKAVSLADMEGVDADFHRSLQWMLDNDISGGILEQTFSTEDERFGVMTTEDLIPDGRNIDVTNENKKEYVDLMVKWRIEKRIAEQFQAFKEGFQELIPQDLINVFDERELELLIGGIAEIDVDDWKKHTDYRGY

SEQ ID NO: 59755 - protein, 77 aa, Sorghum bicolor
  Clone ID: 7535850.pep
MRDPFDAPVDLINADHNGGSQLSRTGEVSAGNYGLQNGGPKSFAPNSDTLVRHQLQGASLHKDLAVEDPNTRIMDPE

SEQ ID NO: 59756 - protein, 163 aa, Sorghum bicolor
  Clone ID: 7535857.pep
MSKGGGKFQRKKEYFTKLSNLLVDYKKVLIVTANNVGSNQLQRVRQELRGKAILLMGKNTMIRKCIRENLTKNPDLEALLPHVKGNVGFVFTNGDLSDMRTRIGAVKVKAAAKSGAISPCDVIVPAGPTGQDPAKTSFFQALTISTRISKGVIEIVNDVHLVK

SEQ ID NO: 59757 - protein, 85 aa, Sorghum bicolor
  Clone ID: 7535864.pep
MDDSGDDLAARGPRRVSTATVPSRGPTEPETPDSDLVETLYSHPNVKIISFTATGRAYARSPGGPALSNVDPPSSLSWSSQLERT

SEQ ID NO: 59758 - protein, 77 aa, Sorghum bicolor
  Clone ID: 7535865.pep
PTQAHISVSAMSSGSESVRQPPNSNQLALSHMHGSNNWNHLIKPNGCGAAWNQEHQELPKAPGRPRAYLFSCSWLVV

SEQ ID NO: 59759 - protein, 218 aa, Sorghum bicolor
  Clone ID: 7535874.pep
HEEIVPGPSVASNETAVEETVIRQDVTVITTTDEVTGPNSALSTITNPTSPTTAAPRPRLKKDNSTPNMNGPLYMQTAGNKTVLVRRLKRKEESTWKHLSRWFVENQIGLSFNLLALIFLAQTFIPKAREHTHKFFHLSYLSSQSGQYRIGYDDAYFITFCVILFTGLRAATMEYVLAPIGRLQGISNRKNLTRFSEQAWLMVYYTVFWPWGVYIYCT

SEQ ID NO: 59760 - protein, 132 aa, Sorghum bicolor
  Clone ID: 7535877.pep
MMNKVIVVTLVAIWCSGLNNRVDAAGLSPVVTLANGGGVQGLELDSAYVFYGVPYAEPPVGALRFQPPVAAPAWNGVFNATSILPGCPQLCALPPLGCPVTQSEDCLGLDVYVPLGSLISNNLIPVAVFFPG

SEQ ID NO: 59761 - protein, 157 aa, Sorghum bicolor
  unsure (1)..(157): unsure at all Xaa locations
  Clone ID: 7535880.pep
MRYSSILSASALTSVATSSALGPRDARVTPPTNALESWRRAAPQAPNGYAPAKVDCPSTRPSIRSADRLSDQETEWLKKRRPNTIEPMRAFLERVNIDGFDVGNYFNTHRDNTTALPNIALSFSGGGYRALLNGAGGLAAFDDRTAXSTNAGHLGGL

SEQ ID NO: 59762 - protein, 137 aa, Sorghum bicolor
  Clone ID: 7535881.pep
IAPLAMADSAVRTSTLSALRQSCPSAEYLPSPSPPLAHTRAPLVTPQYPSSLAAPMDDPFNEDPEWSDEEVLLPKTVPKTKIQHVHPPTKMASPQAVGDMSDDSDSSGSGPPSVNGSPLIPPKSISRPDVRAGSTQE

SEQ ID NO: 59763 - protein, 158 aa, Sorghum bicolor
  Clone ID: 7535883.pep
MLPPPSLLLHSGAPRSALPLQGRRRRSLSVRASWQELAGVLVFSAIPFTAVKALANSPLGARLRRRLEDRKAAAAAEADALRAAARGARNNSFWYGGDRPRWLGPVPYDYPEHLTGEYPGDYGFDIAGLGRDPIAFANYFNFEILHCRWAMLAALGVV

SEQ ID NO: 59764 - protein, 164 aa, Sorghum bicolor
  Clone ID: 7535889.pep
ARGSTFACVSQEARPAAHGESAPAFRLLSEQAAALPPRPGRRLHQVPLHEAAPAHAQGGAENARARPPPWRRAQQEPPPPPVAASRADGARVLVRRQPQPRVPRGEEAAAPVTAERQWRRGRSGRGCVFLLRLVPSSSVRFTRRRRDDDGIRDDRGCGRGGSAG

SEQ ID NO: 59765 - protein, 158 aa, Sorghum bicolor
  Clone ID: 7535894.pep
HEAWLNNQKFTYRGGITEEKKIMRRKVLAKWLKESLLRLGPTFIKIGQQFSTRVDILPQEYVDQLSELQDQVPPFPSETAVKIVEEELGASVNEIFDRFDFEPIAAASLGQVHRARLNGQEVVIKVQRPGLKELFDIDLKNLRVIAEYLQKVDPKSDG

SEQ ID NO: 59766 - protein, 196 aa, Sorghum bicolor
  unsure (1)..(196): unsure at all Xaa locations
  Clone ID: 7535911.pep
NCGTREENAVVAAHAQAPXLQHPAKNALADKKHTRSSSDISDPSTPKKIEDAKNISIYNDVIAFTLFELETITKSFRADYVLGEGGFGTVYKGYIDENVRVGLKSLPVAVKVLNKDGHQGHREWLTEVNFLGQLRHPNLVKLIGYCCEDDHRLLVYEFMFRGSLENHLFRKTATPLPWGTRMSIALGAAKGLACLH

SEQ ID NO: 59767 - protein, 169 aa, Sorghum bicolor
  Clone ID: 7535912.pep
MSLPTHTAEATHEKSATVSSSPTGDESSNPPSISLSSFQKLNNRIEGLAGLEARGIERVLPEERQEPSSAADLQVAVLWFSANLSLNNLATGLFGPMVFGLGFLDSALLAVFGTILGACSTAYMATWGPQSGNRTMVVLRFFMGYWPSKLPTFLNIVLMVGYATIDCII

SEQ ID NO: 59768 - protein, 172 aa, Sorghum bicolor
  Clone ID: 7535927.pep
MFRQSSSSSASSYSDALMHHHAASFSAAAAALSVTVPAQIPRAGGYLDGGGNVGAFSSPPSSGYSSSFPSSYYNYNSIQRSISSHSLPMHLQLADVSLGGVGGGSGSGFYSPSSPSTHQLTTLPPLSSSPSSSSGEFFEFTSSCPVRRVFSTGDLQGMNGSSPPRPVPSGDG

SEQ ID NO: 59769 - protein, 163 aa, Sorghum bicolor
  Clone ID: 7535928.pep
MPAPNGGGYGYPLLTPPPLQPSPSATSPPAAPSSQDTVFNVVDFGAKGDGVTDDTQAFEAAWAAACKVEASTVLVPSEHEFVVGPISFSGPYCKPNILFQLDGTILAQTSARVWGSGLLQWLEFTKLTGIAIQGSGVINGRGQQWWTYSDPNDDDNDDAYYVE

SEQ ID NO: 59770 - protein, 121 aa, Sorghum bicolor
  Clone ID: 7535936.pep
MRSIGMLRPLLLALAVAAAATTAVAVAADKRKTYIVHMAKSAMPAEYADDHAEWYGASLRSVSTSTPAAKMLYAYDTVLHGFSARLTPQEASDLASADGVLAVNPEARYELHTTRTPEFLG

SEQ ID NO: 59771 - protein, 136 aa, Sorghum bicolor
  unsure (1)..(136): unsure at all Xaa locations
  Clone ID: 7535946.pep
LAKGIEAYLDPIPRIITPTQMISSATXVPTENILYLGGPNIGSEIYNKEYANARICGSNKWRKPLAKFLRQPHFIVWDNSDLVTHEVMGGLNNVYAIGAGMVAALTNESATSKSVYFSHCTSEMXFMTHLLTEQPE

SEQ ID NO: 59772 - protein, 186 aa, Sorghum bicolor
  Clone ID: 7535958.pep
HEVNTLLGRVDRRDKTTAVAFSGVVTALGPDVKGFAVGDRVVAYAPHHLGTGVRVPVGSVQKCLDNEDFTALPPLLVGYATALYALKYRAQLRSGESILIHDSTNTFGIEAVTLAKKIGAVIYATVNSEAKRDYFVNELGLPPSHVFSSLDAKFVQELKHATDGRGVDVVVNSLTGDLLHDSWRSL

SEQ ID NO: 59773 - protein, 178 aa, Sorghum bicolor
  unsure (1)..(178): unsure at all Xaa locations
  Clone ID: 7535959.pep
TRPFLTFSHSDAHLSIADSGDTYRPRERSRSPRRRSRSPERSHRRRSYSPRSRSGSRDEYRRNRDRSPMTSTGAPGGGQSAGYGGQAPHRSYEERAVAREQMMNNIRETSQQDRRVYVGNLSYDVKWHHLKDFMRQGEAFNAAECRWNWDXRNGIAGEVLFADVLLLPNGMSKVGFIA

SEQ ID NO: 59774 - protein, 169 aa, Sorghum bicolor
  Clone ID: 7535963.pep
HEGKLVDDPNIVAPFLPKMMPGLQKNYENLADPEARDKTKQALDTLTRVGNIKDGVIPEARHDGAINVILPKVKAALSPKFANYVEKMGPVTEYIAAIAGQLVDEKETESMIWVDNLKAYVSVIAGIDNSESLVEAIRKTALPGAVAEAEAEEDEEEGEDLCNCTFSLA

SEQ ID NO: 59775 - protein, 196 aa, Sorghum bicolor
  Clone ID: 7535967.pep
MSYFFATPVDIDVVLDDTDERSMVDVKLDKNRREKAPLFMDGESVKGAVTVRPKDGKRLEHTGIKVQFIGTIEMFFDRGNHYEFLSLNQELAAPGELQHPQTFDFNFKNVEKQYESYNGINVKLRYFVRVTVSRRMADVIREKDIWVYSYRIPPEMNSSIKMDVGIEDCLHIEFEYSKSKYHLKDVIVGRIYFLLV

SEQ ID NO: 59776 - protein, 97 aa, Sorghum bicolor
  Clone ID: 7535970.pep
HEAAAGPWGSRCTPPSRRRACRGAPASSATSSPPPPPPRPPSDQASSGRLATSVPCFNKRTRGGGAYCIHTDVQYIHRVSFFFWFVLVLGAWTTLVA

SEQ ID NO: 59777 - protein, 184 aa, Sorghum bicolor
  Clone ID: 7535987.pep
AYGPNNPALDRITTTQTISGTGALRVGAAFLQKFFPGEKKIYIPTPSWANHKAVFNHAGLEVEQYRYYDKKTIGLDFEGLIADVKGAPNGSVFLFHACAHNPTGVDPTQEQWKQISDVVKEKGHFAFFDMAYQGFASGDTDKDAFAVRYFVEQGHNIALCQSFAKNMGLYGERIGAFSLVCADA

SEQ ID NO: 59778 - protein, 187 aa, Sorghum bicolor
  Clone ID: 7535989.pep
HEAAFFSRETSRTPTSTLRPHLSRLSTTHDCLSPSESRPLANALAGPSIGDRPTSSRGPANHNNYNNTEERERLVSNDVSPPAADAVGQQPLTCQVESRRRSRGAGLRKAPELADALRSRRPGGAAPDELARRVVPSAAAASLRGLRGRAQPAVLPLVDHLTHRSRPARGCLAQGWPPVECHPVPEP

SEQ ID NO: 59779 - protein, 190 aa, Sorghum bicolor
  Clone ID: 7536002.pep
ARGANLALLAVALPKNISSSPDLFATAVVGAVPEQVSALSLCRGDANATTCSACLVTAFQDVQNMCSFDRSAAIYYDPCILYYSDDGGFLSSGDNVASASTDRINLRNVTSDPARFNRLVGALVNATADYAAYNSTRRYAAGEADFDQEYPKVKVYSWAQCTPDLTPAQCRVCLAGIIAEMPRLFTDRVG

SEQ ID NO: 59780 - protein, 170 aa, Sorghum bicolor
  Clone ID: 7536003.pep
MAKQKVCLAYSGGLDTSCILKYLLEEGYEVITFTANIGQEEDFDAVREKALKIGASKVYIEDLRREFIEEQCFPAIQCNAIYENVYLLGTSLARPVTARAQIAIAQKEGCFAVSHGCTGKGNDQIRFELAFYALQPSITVIAPWRDPVFYDKFKGRNDLLDYAKAMDIPV

SEQ ID NO: 59781 - protein, 87 aa, Sorghum bicolor
  Clone ID: 7536004.pep
ETATTSKEGSRRANYPIPVSFNQAVGATTPFFTAVFAYLMTVKRESFLTYLALVPVVTGVIIASGGEPSFNLFGFIMCVGATAARAL

SEQ ID NO: 59782 - protein, 146 aa, Sorghum bicolor
  Clone ID: 7536012.pep
CPRRASAPCTTRRRRRRRTAAPRARARSRTATSRPSSSSWAPPPSRRSWRPSPSSSSCGRRARTRRPRCSCRCWASPCRRCSTRRPARLSRPCPTCPTAPPTASASASVPVAPPPAAVSAVAPTSAARCISPSTSLSPRPSPCPSP

SEQ ID NO: 59783 - protein, 166 aa, Sorghum bicolor
  Clone ID: 7536014.pep
TRTELKSQRFDFEKIVCQECGQTSFSRDAELRRHISEQHRCPHEDCVEVKFVNSKDRDDHQRAIHHNRLGHRCGKCLLEGQPPNNLPRLDKLREHYRKVHHLKTAFEFFKCKHPSCLPSKEYGGLFFDSLDALEKHKQNAHPNPADRPAMKFYDKDFSDVSIAKRA

SEQ ID NO: 59784 - protein, 128 aa, Sorghum bicolor
  Clone ID: 7536016.pep
MSSLLLSFFGVVAIASATESLVARNNPPQPPCVYPYTKFVYSGCFVDSVSSRALPFMTELEFNNATVEQCTAYCKGNNYRYAGLEYHGQCFCGTSVSSSAAAETECNLPCNGDPTQVCGGEDRVSIYQ

SEQ ID NO: 59785 - protein, 199 aa, Sorghum bicolor
  Clone ID: 7536021.pep
MALAAKDAQSLARLVSSDIDPAISPMAGIMFNNNKRVEFSRKSMEKYFKGSIQSPWDDIAITLTQVIAYQLDKNNSQAHLEQAALTNHYFRFFINQTKWSLPALFTILIDLRTLADKADIEASQKMQKSDALEDAARICNKAFTNCLIDRINPPNQTRKWGTYRTVGLVLKCYFKTERIALAKNVLRAISAQPDLAPLT

SEQ ID NO: 59786 - protein, 171 aa, Sorghum bicolor
  Clone ID: 7536034.pep
MRFLSIAAFAGLAAATHVAGHKLEARDSHLQGRTWCNGGQGWINNRCQDCAPGQFSPGGYRPSCQTCPAGSTSSTCESYCVCKPGWYINGGKTTNNACSPCSAGWTSNQGDSSCSACPANTYSTQGGTCQACPAGYTSNRASGSCQAQCNAGSYLVNGQCRTCPAGSYSQA

SEQ ID NO: 59787 - protein, 66 aa, Sorghum bicolor
  Clone ID: 7536046.pep
FFWCCGKFLGSHITPLAFHYSMCLTVQKNPVLGGWRGWVYLTNKGHPISKMLQGASLRIACLMARL

SEQ ID NO: 59788 - protein, 205 aa, Sorghum bicolor
  Clone ID: 7536052.pep
ARGGKVQVLLWISSSREWREFPWLPRDACDDYALCGAFGLCNVGAASAPSCSCAVGFSPVNSSEWSRKESSGGCQRDVQLECGNGTAATDRFTLVPGVKLPDTDNATVDMGATLDQCKARCLANCSCVAYAPADIREGNGTGCVMWTDNIVDVRYIENGQDLYLRLAKSESATGKRGRVAKILVPVMVSVLVLTGAGLYLVWICK

SEQ ID NO: 59789 - protein, 187 aa, Sorghum bicolor
  Clone ID: 7536054.pep
GDGFKEGSGCNGVGTLTIAGVTGLALLVLLFILGFWTHWLVKKRKLAKTKQRYFMQNGGLLLKQQMFSERAPLHIFTSSELDKATSNFSDDNIIGRGGFGTVYKGILSNQVVVAIKKAQRVDQTQMEQFVNELIILSQANHKHVVQLLGCCLETEVPLLVYEFITNGALFHHLHNTSSPMSWENRLS

SEQ ID NO: 59790 - protein, 109 aa, Sorghum bicolor
  Clone ID: 7536057.pep
MVDAMAASGVEDERVGGEVRGEEEDDDVPQLSAAAMEALREFLAEQQRPEEQDETGGGEGGVKLVPEDWRLSQFWYDERTARSLVEEVVRLVSPSGSGSASGAVACITC

SEQ ID NO: 59791 - protein, 149 aa, Sorghum bicolor
  Clone ID: 7536059.pep
MGSVAMDSDYGAPRELSPLQKARALYRPEPPPCLQGTTVTVEYGDAAIAADNDAHVISHAFPHTYGQPLAHFLGKTANVPDASIITEHPVVRVGIVFSGRQSPGGHNVIWGLYDAIKAHNSNSKIIGFLGGTDGLFAQKTMEITDEALS

SEQ ID NO: 59792 - protein, 178 aa, Sorghum bicolor
  Clone ID: 7536064.pep
MQDGGEVLFLDGVGDVAVTVGRNGLSVQPLHPELVSSCWSSITLQPKLDSQIKFSDLYAIEMLDKGPICGPWSTRTTIQGKKNIEMHRFVVHGITRRRKHPSPWVPCEYIFGHKDLKICTDWFERLISCINNEGGRPKNLMVFVHPLCGKGRGVRNWETVSPLFIRAKIKTKVIVTQR

SEQ ID NO: 59793 - protein, 170 aa, Sorghum bicolor
  Clone ID: 7536067.pep
MKVLAVLFAFTAFLAHASASLTPLFERHTVPQGWVKAARAEPSAKVHFHVAIQQQNLDVLEKIFWEVSDPEHDNYLNFMTKDEILSLVAPKPEHRQTVISWLHEHGVKEFSDFVDSIEGWTIAATAEKMFGTEFFEFRNMETGKKVIKAFGQVAIDSEVHDAIDSVMSIS

SEQ ID NO: 59794 - protein, 54 aa, Sorghum bicolor
  Clone ID: 7536082.pep
VSSFNLHGISWVKMSQQWVSSPFQRQKSWPILKIIFWFIQPAWDIPNVRPLLLG

SEQ ID NO: 59795 - protein, 110 aa, Sorghum bicolor
  Clone ID: 7536085.pep
PRAATFPFAPNRSPSSEPPGRWLALCSSLRMFTHAAHPASAWFLPWCRWSALPQRAAAAADGSALRTARPTQRARASRAHRLGVGGGGSSFPCDRTPPAREGRAGVSERA

SEQ ID NO: 59796 - protein, 110 aa, Sorghum bicolor
  Clone ID: 7536090.pep
TFYDYNRPEELPPAMKHAYRVVVADPPYLSKECLEKVAKTVSFLAQPEGSFLLLLTGEVQKDRALELLNVRPCGFRPRHSNKLGNEFRLFTNYDPADRLGGWDQSDGASI

SEQ ID NO: 59797 - protein, 149 aa, Sorghum bicolor
  Clone ID: 7536106.pep
STCPRNTYSNGDNCSPCPAGSTSNPGSSSCGPQPSRRAQPVLTSCAVPGEVRCPVWSGMGGSECVNTMSTKDSCGGCVAPEGLESAEFTGRDCTAIPNVDKVDCHAGSCKIHTCRSGYELLGESCVPKPGAKNTTSHSKRSMISRHDSF

SEQ ID NO: 59798 - protein, 99 aa, Sorghum bicolor
  Clone ID: 7536108.pep
IFVHKSGHQRSSNCKQQSKPSRRWHVRACSPGGAGHNRRLRLYLADRWRRRGRGFRRWSCRRRFRLRRCRRHWCCPVSRKPPCTHSSVTFLEIKEKTLT

SEQ ID NO: 59799 - protein, 167 aa, Sorghum bicolor
  Clone ID: 7536110.pep
CHRDAIRNQELILTYLIPLSLLNGIPPSSTLLTTFPRLGEVYTPFVNALRQGDVKAYDNALEWAEVRLAESGVTMCMEKSREGCLRGLVRKIWLALSKPTRLPVASALKAFHLSGLTSYTMEEAECILAILIYKGYMKGYISHEKQIVVLAKVDPFPKLGTKGVGQG

SEQ ID NO: 59800 - protein, 129 aa, Sorghum bicolor
  Clone ID: 7536112.pep
PSSPTKCSGYYCPIPPPGKPSISTSSPFPSKSSPFTPKPSSPTKCSGYYCVAPTTFPPPTPPSPWPPEIPPCEGIFCWPPPNNPSPSCWLGLICAPATPPSSLKPASSTKNPTTTSAQGYPPVPNPSPY

SEQ ID NO: 59801 - protein, 109 aa, Sorghum bicolor
  Clone ID: 7536114.pep
LSRMSFSFPPQLSMYILISITVDRMHVRRVWHRLMELTKRVSRSFIRNFESRELLVDDVTALQYYPVLDRDLGKDATFTFDRHAFHLQVVFRLCGGRWSLLRTFSLRRR

SEQ ID NO: 59802 - protein, 113 aa, Sorghum bicolor
  Clone ID: 7536117.pep
VLEIVTGKKHNVCRDDDAWRSRDEDDLLSLVWDHWTAGVVPEAIVDPCLGRSCFCRSDVLRCIQIGLLCVQEDPADRPVMSSVVMMLGSDTVSLWNPSNPAFYGRNRAPATSS

SEQ ID NO: 59803 - protein, 37 aa, Sorghum bicolor
  Clone ID: 7536121.pep
WKYSMPLDTRTSQSNCASLLLASTFTCKSELKAMLVF

SEQ ID NO: 59804 - protein, 221 aa, Sorghum bicolor
  Clone ID: 7536122.pep
SLSEHKRSLPPEKHTSDRLNKETGNVSRDASRDSSPGMKGRPSAPGNLQRIDQSPNLPVPTMHSEKTKENTVKSSSKKKSDKMQKPWHGMDGDFGPGYSHGVDHHANFDGSDDSSTRKRSRHGNPLIDDKMLKRSKDVNVNVNSMNLTKVSREIVVPDEITAFPESNESNGEPSNSQRDNVERSPYGKKKLQRELSDLELGELRETSLENDDGRIRKQFER

SEQ ID NO: 59805 - protein, 139 aa, Sorghum bicolor
  unsure (1)..(139): unsure at all Xaa locations
  Clone ID: 7536126.pep
TRLLLALAAGAAGAAGGGTDSDADADALLAAKAALSDPTGALAXWGVASSDHCAWAGVTCAPRGSGGVVVGLDVSGLNLSGALPPALSRLRGLQRLSVDANGFYGPIPPSLARLQLLVHLNLSNNAFNGSFPPALARLR

SEQ ID NO: 59806 - protein, 160 aa, Sorghum bicolor
  Clone ID: 7536127.pep
TRDISTEDPEAVFELQEKLGKGSYGMVYKGRNRTTNETLAVKILALDDEATLKAVRGEIKILATCNHANIVRYGGSYFKDEKLWICMEYCGGGSVSDLCVILDSGLQEDQIAIICREALKGLNYLHNGTKIHRDIKGGNILLTESGDVKLADFGVSATLF

SEQ ID NO: 59807 - protein, 91 aa, Sorghum bicolor
  unsure (1)..(91): unsure at all Xaa locations
  Clone ID: 7536133.pep
NRYKTECGQRLEPIEEVTVEVDEEHVGFVLETITHRKGEVVDMGPVPXTTGRTRIFMTCPSXGLVGVKGIFSSFTRGTGFMHRAFQAYAKY

SEQ ID NO: 59808 - protein, 200 aa, Sorghum bicolor
  Clone ID: 7536135.pep
HEGSLEGRHKLKLFICTEKNVKLFFNCVHCLVGAEFFGGPYTLTDKFSSAQRELVDQLIEDAYAEVDKLPEDHVITEHSPNPIHVDKYTSIGAGPSYMPTEQQNCSVRLASVHGMAAAERLSHDRIESSCLNAYNDPVPSSSIPDHPSMHNYQGGSIPVVPLEGLSHDQYNELSCANANNNDPGPSSSNADHLCTYDSRD

SEQ ID NO: 59809 - protein, 143 aa, Sorghum bicolor
  Clone ID: 7536139.pep
MAEMVRYAVAEEIAKQIVSGILDKHGRKPPNDKEQLERLEMAHIKLEAALETSDRWQIRDASLLRWRKKLKRAAQECDDTLRRCKQRAVAVDEDEDGQEKHQRVPVIRRSSSSLPTRLVHATTSFVSSILLSARNRTDAAADA

SEQ ID NO: 59810 - protein, 221 aa, Sorghum bicolor
  Clone ID: 7536141.pep
ARGPSTREDAADIRQSGRNEDDSDQIDLSGFSGNLRRDDRDNSRDCWRISDGNNFRVRSKNFVYDKSKVPAGKPLMELVAVDWFKDAKRMDHVARRKGCAVQVAAEKGLFALAINLQVPGTTNYSMVFYFVTKKLIPNSLLQRFVDGDDEYRNSRFKLIPSVPKGSWIVRQSVGSTPCLLGKAVDITYIRGSNYLEIDVDIGSSTVANGVLGLVCGVITTL

SEQ ID NO: 59811 - protein, 196 aa, Sorghum bicolor
  Clone ID: 7536157.pep
ARGSKRKQLYAVKEFKQRPGESAKRYQKRLTSEFCISSSMQHPNVITTLDLLQDEKGTYCEVMEYCSGGDLYTLVLAAGQLEVVEADCFFKQLMRGVEYMHEMGVAHRDLKPENLLLTAHGSIKITDFGNGECFRMAWEKEAHMTAGLCGSAPYIAPEEYVDKEFDPRAVDVWACGIIYMAMRTGRHLWRVAQKAR

SEQ ID NO: 59812 - protein, 203 aa, Sorghum bicolor
  Clone ID: 7536164.pep
HEVTDNMLTGDLPAWMLKNKASNKVNMDISYNDFTGNPPSECQQANVNMVSSFSSSNNNSLQPCLRKNLPCTTRPRHSSLFINCGGKSVVVDGNTYEDDSSQIGTSMFSVSDDKKWAYSSTGDFVGNENADYIARNTSKLNLAYPELYTEARLSPLSLKYYGLCMENGEYTVKLHFAEIVFTEDHTYSSNGKRVFDVFIQGVK

SEQ ID NO: 59813 - protein, 168 aa, Sorghum bicolor
  Clone ID: 7536167.pep
MDAAVSSPSSKRIALVTGGNKGIGLETCRQLASKGLRVVLTARNEARGLEAVERIRWASGDAEVFFHQLDVTDPSSAARLAEFVRDQFGRLDILINNAGISGVDRDPVLFAAVKDKVDGMDVDQRVEWMRENSKETYDEAIQCMRTNYYGAKLVTEALLPLLQLSSSG

SEQ ID NO: 59814 - protein, 183 aa, Sorghum bicolor
  Clone ID: 7536169.pep
MGLAFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDGLYEGLEWLANTLRKAGHQ

SEQ ID NO: 59815 - protein, 105 aa, Sorghum bicolor
  Clone ID: 7536175.pep
RMQGNWNGAAKQCRRVTLLVDPTVFTVGLSRVSPHQTLAQMVQYLSRGRPCGMRAMSASWAATCSCFLVLGRRPGGWTCLRPGVATGNGHVWGFGFVGQVRRVVR

SEQ ID NO: 59816 - protein, 107 aa, Sorghum bicolor
  Clone ID: 7536178.pep
LVGMVTHHCLAIHSISIAWMELSTLNQLADSWAKMRIQLMHVFHFSALDMKCAIEAMQISCRRGSETVEYRQKLRWTNITRVFMRALVPIGSVHFSEHDSALIKTGQ

SEQ ID NO: 59817 - protein, 205 aa, Sorghum bicolor
  Clone ID: 7536182.pep
HEGAMEELGPFRVKSDGKTLYRNPYAWNNAANVLFLESPAGVGFSYSNTTADYGRFGDNKTAEDALQFLLNWMDKFPEYKGRDFYLAGESYAGHYVPQLAHAILRHAAATVGGGKPSSSSPINLKGIMIGNAVINDWTDSKGMYDFFWTHALISDTTADAIGRYCNFSAAAAGSDKCDEATSEADEALEDIDIYNIYAPNCQSDD

SEQ ID NO: 59818 - protein, 171 aa, Sorghum bicolor
  unsure (1)..(171): unsure at all Xaa locations
  Clone ID: 7536191.pep
QICSTATSSPSPQPPPMASPSGNPNPNPNPPFEIGKLFRPPNPMPTPTPNTIFPGVAGGPAGPPPPSGPYSYPPVTPXSTADPTSTTRRTPTPCPAPLSPSPCQTQTSTPTRTLTPTPPPRAPTPARASCSYSGTPGRPNSRPPSPCPRPRRSSRSRSRSQRCHPRRRPGC

SEQ ID NO: 59819 - protein, 176 aa, Sorghum bicolor
  unsure (1)..(176): unsure at all Xaa locations
  Clone ID: 7536194.pep
ARGPHWIPDSGTKTSLLFETYRAAPRPLGNAVSYVNCAFLGHASVDEQSDTLVLSNLRLAFGAYGTEHAIRAKKVEDFLTGKSLTASVVLGAIQLLRETVVPMEGTSHPEYRVSAAIGFLFSFLSPLSKGIPEPGKSLTSSSADSAVTDDVCNMPLXTRRETVXSDEYKPVGEPIK

SEQ ID NO: 59820 - protein, 182 aa, Sorghum bicolor
  Clone ID: 7536197.pep
MATGTFTQLFPPAPTFTEKTLGDLAGKVYVITGAASGVGLELAKILYSKNGTVYVAARSQKRAEGGIAAIKKAVGKTQGSLKAMVVDLADLTTIKPAVDAFSAHESRLDVLFLNAGVMTPPAGSKTVQGYDLELGVHCMAGFLLARLLEPIQSATVALPDTPSGSVRVVWVSSLLNLAPPGG

SEQ ID NO: 59821 - protein, 127 aa, Sorghum bicolor
  Clone ID: 7536205.pep
MDCCICSPMAAVYRLPRNAICAPCHEGAKAIIGFLNKDDEHQHEEEGSLSHGSVLKSRGSVKPNSPTKGMRDAWEQVKEMRGREEEAHQRAAFLAMAWKEGVHTDIVVKPGTGPPIPAHKAILAAKS

SEQ ID NO: 59822 - protein, 157 aa, Sorghum bicolor
  Clone ID: 7536206.pep
DGAFSTYVVRDKERPRKEGAPAGTVRTYSTLRRKVADDPTRGFGLSDKLQNIYGRGCTIQIPFLNLNYISPEWLLRQDDANGEAVADTMHELALAGSAVTASPLVLVPSSPTLGNLVKTLGYHKQCQKYVPMTPKESEQNARIVNELSSTLKTIFKV

SEQ ID NO: 59823 - protein, 55 aa, Sorghum bicolor
  Clone ID: 7536210.pep
FKASSLPQTSLPPRVMNQGCLPHALHRRCPATSLIFELSLPPLHRDDYQIQHGDP

SEQ ID NO: 59824 - protein, 66 aa, Sorghum bicolor
  Clone ID: 7536215.pep
KTEAMAYQMLWKSKHGAGYLQVRKTTPRKNWKGDNKNKRLLMQRYHQDPKLERWTHVLTNFLNLWV

SEQ ID NO: 59825 - protein, 91 aa, Sorghum bicolor
  Clone ID: 7536220.pep
PGLMKTELQRYGPPPMRLIMGTIFKGPKYGAYTELYAGLSPDAKNGGYYIPWGRRGFAPPHVEASCKSDGGKPSIACRFYDWCERETARFA

SEQ ID NO: 59826 - protein, 50 aa, Sorghum bicolor
  Clone ID: 7536225.pep
YWVPNEGTQNFPTQNWVSGQTFSKFPFFRVPSHAKNKFFPGSHFFGFHYM

SEQ ID NO: 59827 - protein, 77 aa, Sorghum bicolor
  Clone ID: 7536235.pep
CWNSVAEAIRTIGELMQTNKADGPFVLGAQFSYTDCFIAGYIQNAKMVDEGLFQRLMKDPGHRAIYEACLPYTERKD

SEQ ID NO: 59828 - protein, 97 aa, Sorghum bicolor
  Clone ID: 7536237.pep
VGQQVGSSKQNVNAHMAVNTMPVPFVYWTLNRNKQRLVMKKCAGSTSHHIAGGRERFSFSLAGPLARDDTKGPCRRVTSSVVSVVGRGIATADVSRA

SEQ ID NO: 59829 - protein, 156 aa, Sorghum bicolor
  Clone ID: 7536238.pep
LVTEALLPLLQLSSSGRIVNVSSGFGLLRNFNSEDLKKEFDDIDNLTENKLEELLNKFLEDFKANLVEAHGWPTGGSSAYKVAKAALNAYTRILAKKYPTLHINCLTPGYVKTDICMHMGVLTLEEGARNPVKVALLPDDGPTGAYFDLNGEASFV

SEQ ID NO: 59830 - protein, 60 aa, Sorghum bicolor
  Clone ID: 7536240.pep
MASRVTTFDGPFAIPDLVFGLKGAGVYFGTSPCFLGQICCSSILMEKIKLGIVKRISWKA

SEQ ID NO: 59831 - protein, 63 aa, Sorghum bicolor
  Clone ID: 7536241.pep
IQHLQTYRPKNTIYLIAKIVNFNIHHPSIKQRGIYLSCIKIQNVSIKHFGHYNGSTKREKNHG

SEQ ID NO: 59832 - protein, 76 aa, Sorghum bicolor
  Clone ID: 7536248.pep
RFLPLSMVLHCQCFGQQYLLAIASVSSLPEDYRTYFFFFFWRKSRVMMGGVLWGSPGYLYSRQSGVVCSLKRMHPR

SEQ ID NO: 59833 - protein, 172 aa, Sorghum bicolor
  Clone ID: 7536252.pep
HEGGYGGGGGGGGGYGRDDPYRYRGYDRNYERRYEDRGGGYGGSSGGGGGGGRDYDRSYRDERRYEDRGGYGGRDYDRGYERRDRDEGYGRDRYGGGGGGGGREERDRYGPRGGPGGSGYERGGDRYERGGDRDAARTRDPAASAGGAGYGESASRSETRDAYGGAPDRNIQ

SEQ ID NO: 59834 - protein, 140 aa, Sorghum bicolor
  Clone ID: 7536254.pep
MADEEKHVVDATPQVAPVDEYASAQNEFVDRPNGWIYKGYKIFGREVYYASPRVQLLLVALVCFLCPGMYNSLSGLGGGGQVDPKAQDHSSVALYSTFAVVGFFSGTFANRLGLRLTIGIGGLGYCIYSASFLSYNHNKN

SEQ ID NO: 59835 - protein, 131 aa, Sorghum bicolor
  Clone ID: 7536262.pep
MSTPYKLSATLTAHSADVRALCAPTPDLVISGSRDTTAIAWRRTGAADSKIWDPATVFRASGGYIGSVTYINPTPDAPQGYAVVGGQDAVINVYNIATGSSEPERTLLGHTGNVCALNTSTEGTIISGSWD

SEQ ID NO: 59836 - protein, 151 aa, Sorghum bicolor
  Clone ID: 7536272.pep
ARGPRIGINGFGRIGRLCLRAALKSKKVEVVAVNDPFLDPTYMVYLFTHDSVHGRWPGTAEVKPAAEGQAPSIVIDGHEIKVFTDRDPAHIPWGSVGADYVIESSGVFANKEGASKHLQGGCKLVVISAPADVPMYVFGVNHEKYTNDQKV

SEQ ID NO: 59837 - protein, 137 aa, Sorghum bicolor
  Clone ID: 7536274.pep
MQWYLVAALLTVLTSSQGILTTLSQSNGKYKYDYATIPFLDELFKLSVSGFFLWKECHSSSPPRMTKEWRSVRLYLVPSVIYLIHNNVQFATLTYVDPSTYQIMGNLKIVTTGILFRLVLKRKLSNLQWMAIVLLAV

SEQ ID NO: 59838 - protein, 201 aa, Sorghum bicolor
  Clone ID: 7536285.pep
MRAVTLLAVFAALFVASTLAATHDPLTGVFAKWMRENTKSYSNEEFIYRWNVWRDNFRFVEEHNRQNKSYFLAMNQFGDLTNAEFNRLFKGLAFDYSKHAKIRTAAPETPATGIPSEFDWRQKGAVTHVKNQGQCGSCWSFSTTGSTEGANFLKTGQLVSLSEQNLIDCSVSYGNNGCNGGLMDYAFEYIINNRGIDTEAS

SEQ ID NO: 59839 - protein, 157 aa, Sorghum bicolor
  Clone ID: 7536294.pep
MGLDVPPEESNRCVRGCCRSATIPLHLAPASFSLLSPIARGSESTVYEALLGGERAAAKKPVLSTAEDLDKFHYQLQLLCELEHPGLAKLIAAHARPPNYLMFFDFFEPPNLAEKIHVEEWIPSTQQVVAIASDLAKALQYLQILGVVHRDIKPANI

SEQ ID NO: 59840 - protein, 121 aa, Sorghum bicolor
  Clone ID: 7536301.pep
MRFTSIFVAGAFATMAAAQSKTASVSPAQQSQLDCLDACDAGDVKCQSYCITVPSPDEKNINATTECVAACPKGKGSASDTEKYSVCLQDCIADNYWKTVSGTPRETGAAGSKDEASSAAE

SEQ ID NO: 59841 - protein, 184 aa, Sorghum bicolor
  Clone ID: 7536302.pep
MYEHACEASALLSGFKHVSQDRTALTSECGSLLEEVLAIADGLHDVYTLGKEAAAVHSSLMTNLSKANTILFPLEACLCADVTVMSEAISKEREKNNASMPLIHGKALHQSYNIKVREACKTMEPLVGPLTENAKELHSMVMKLGHISSLHAGNLHKALEVPGERESVRSQDMLSTHPDLLQSD

SEQ ID NO: 59842 - protein, 179 aa, Sorghum bicolor
  Clone ID: 7536310.pep
HEELDELLRSSAYVLGKGGKGIVYKVVVDNGTTPVAVRRLGGGAAAPERYREFAAEAGAIGRVRHPNVVRLRAYYWSADEKLVVTDFINNGNLATALRGRSGQPTLSWTLRLRIAKGAARGLAHLHECSPRRFVHGEVKPSNILLDADYNALVADFGLTRLLTIAGCTDVYSVAGSGGI

SEQ ID NO: 59843 - protein, 195 aa, Sorghum bicolor
  Clone ID: 7536313.pep
TRRYFRTQYAALRDLPRTMRTRFWFTIRELERMEDASWTRKRRTAAQEVSHVLSEIRTLPKFERFLLPPLLEEITRELRIRDGFAVVIIPSGTQCDVVMIGGPNGPSHIQIETLNTTRVRDLARRLTSTCLNARNIAKMKTRGMQKVEVTSSESSHPHSSNEELDVLSELWQSLVHPILQYMNLLSTPPTNSYSR

SEQ ID NO: 59844 - protein, 171 aa, Sorghum bicolor
  Clone ID: 7536316.pep
MKEALVVLLMLIISPVKAAALSSATPSEPALSLPGCPDKCGDVTIPYPFGIGDGCAATSRNPSFAVTCNNTFQPPRPMIYAPASNTSTPMEVIDISLERGEVSIYAPVGYSCFEPNTNTLDNYTGEFSLEGTPLILSSTRNRFMAIGCSALGLIGASDPEPSVAGCFSYCE

SEQ ID NO: 59845 - protein, 92 aa, Sorghum bicolor
  Clone ID: 7536317.pep
TRLAGRRRKVLSIYGFGGLGKTTLANEVRRKIGKQFDCEAVVPVSQKPDDKKILWNILTRVDKNRTLVHEREIWDEQRIIEEIRDLLEHKSR

SEQ ID NO: 59846 - protein, 200 aa, Sorghum bicolor
  unsure (1)..(200): unsure at all Xaa locations
  Clone ID: 7536319.pep
FPSMAFNAMMLPNVAATTTELWPSITNIAMAPWRHMTSVTHSRSVPSINGMEQTKVTEAQRVTEFRIPEFLQQVDFGSLSRSRFSPMTPMTAQTTLSNMGRIGLRAANPILRHPQFQPRVSTQSSFLRSFSQSSSGILSSPLGISTLGAFSVQRRAFGSSNGISRNQLATLEESANRNPGNANAQNAXYQLLLRATCLLF

SEQ ID NO: 59847 - protein, 160 aa, Sorghum bicolor
  Clone ID: 7536335.pep
TRKGRTLGGSSAINLGLMVYPSRSGLNAWEALGNPGWNWDGLAPYIQKFQRSTPPSESNRDFFKGMKYDEKSQGIDGPVHASFGDQYMPFHSAWLETFKGLGYPQVEDPINGAGTGPFVPPATIDPVTHTRSHSGAAYLGPDVQSRANLRIVTGALVEKV

SEQ ID NO: 59848 - protein, 179 aa, Sorghum bicolor
  Clone ID: 7536336.pep
HEAGKSNLLEHALDSILERGEIPDVQLITELICQSIAHRDYRRTLQLLNIMTEASIKMKEVEWVYLLQKNVYQFNIDALEGFIKYLSTSGTINADPALGLVRALESQCGITLVKGPYLLTDDTTTQQCGLSLLESEDKYASSSLAKQDQLTCENLCTDIILDVPDSDREIPQFGVSVVM

SEQ ID NO: 59849 - protein, 159 aa, Sorghum bicolor
  Clone ID: 7536361.pep
TPQRNTIVGLVLRAAANALIGASASEAAEILAVVDAAPYVALNKASRVAYAAMLVNFSITGLTSPIEGSSRSKHLYLINNILQQEPSRKPEDAADRVPDPEVIYRALVSLGNVVQAVKTYGQPLTSMEAQQARIGLREAGGMSDPRIATVISDTRLLMQ

SEQ ID NO: 59850 - protein, 100 aa, Sorghum bicolor
  Clone ID: 7536366.pep
CKIGGTRGMSSFALFEKFCICMDFFSLNNKTNQPPFFTWIKIGKTGHINFQLVALALHAHFTTDSPFLQHETNHSSIAVEITTINFQTDDSNKAGLQTVN

SEQ ID NO: 59851 - protein, 139 aa, Sorghum bicolor
  Clone ID: 7536368.pep
RGGRAAAINIIPSSTGAAKAVGQVIPEMNGKLPGMSFRVPTVDVSCVDLTARLKSPASFDDIKKTIKEAAAGPMKGILSYTDQEVVSSDFIGDTHSSIFDAGASIILNPTFVKLVSWYDNEMGYSNRVIDLIAYVATKQ

SEQ ID NO: 59852 - protein, 71 aa, Sorghum bicolor
  Clone ID: 7536370.pep
GNKNTLFGFSMNRVGSYNSLGQISQIHISFLQYSIWLNKNKVKGISIQILKTSFQKVLKRKGGIWDHMLLK

SEQ ID NO: 59853 - protein, 116 aa, Sorghum bicolor
  Clone ID: 7536371.pep
AFVSHHLTDKSDVYSFGVVLLELITRKRAIYIDNHNEKKSLSHTFILRFHQNELQDILDSEIVDNEVMVVLEKLADLIMQCLSSTGDERPTMKEVAERLQMLRRLQMQLVTKTNPI

SEQ ID NO: 59854 - protein, 36 aa, Sorghum bicolor
  Clone ID: 7536372.pep
FVGMDKGHPNKGFNLAGAMVFAGFKSVIAILWPMDA

SEQ ID NO: 59855 - protein, 60 aa, Sorghum bicolor
  Clone ID: 7536379.pep
PEGCFFAPSDQWCRCSRFVGCPAIMQISLLSFCPTEVFARAFKFAGRKNRIPRTGWISEF

SEQ ID NO: 59856 - protein, 67 aa, Sorghum bicolor
  Clone ID: 7536380.pep
KKNIYSGFCFYSQKKNVAKNRQKKLQKRLLSGYYFFFRTVYKHKNEWISSFLLDRCKSNKKNCELTA

SEQ ID NO: 59857 - protein, 126 aa, Sorghum bicolor
  Clone ID: 7536384.pep
KVDPARKSLRHDAQHVSHLESNSNHYRPRAIPFKSSYSINQMSKRGDPIYRAKTAATRPRRETPPTRAVAALPVSVDEAAEPEAVPEADPEVSKASVAVASNSPAEAVAVLSSSEAVPVALEAADS

SEQ ID NO: 59858 - protein, 131 aa, Sorghum bicolor
  Clone ID: 7536386.pep
TRTVWRKSLLFNGRGFTVFDARGDLVYRVDSYASDSRAEVVLMDAAGCPVLTLRRRKLIGLGLGSDQWLVYPGEETRRLPPLYAVKRAAPQYMRGGFGGGAKSMAHVAACSGGGAAAKTTGAGGYEVEGSY

SEQ ID NO: 59859 - protein, 139 aa, Sorghum bicolor
  Clone ID: 7536398.pep
MSAEPDHTKPKPDLSKNPDGAEPKENDETATAILKKKKKPNSLIVTDAVNDDNSIIALSNNTMETLQLFRGDTVLVKGKKRKDTVLIVLADDDLDDGSARINRVVRHNLRVKHGDVITIHPCPDIKYAKRIAVLPIADT

SEQ ID NO: 59860 - protein, 214 aa, Sorghum bicolor
  Clone ID: 7536407.pep
HEAGTENHFLAPKMPNPLKASYHFLTWILDHDQVPNDIRRSLELVRTCDSDLRHLIELRNDCLPLLQRRPKVLQRVHTIIESAQKGLQEVCEIVERCRPENDRGTRTTFSKRMAWVLVESSEFKSQEPIVSRHHAAVLAELNFLRQIALMAPVSEPEKREEKKGIVKEAAVFDNVALLGDLLGDMKVATEKQPSVTQTIVSPPPIIVFNANTEP

SEQ ID NO: 59861 - protein, 142 aa, Sorghum bicolor
  unsure (1)..(142): unsure at all Xaa locations
  Clone ID: 7536412.pep
HEAAWXKALLIAPNSWNIHARIGELLFVCSSSASSEGDSAGLAGKSVQHFCRSIELCDDYLRGLYGLILATSRVLDHKYAPESPSDPAVASQKTIQQLREFALQRLGHIVQSRSVDDQRWASSRGELVAAKELLNRFAPPQK

SEQ ID NO: 59862 - protein, 154 aa, Sorghum bicolor
  Clone ID: 7536415.pep
TRGLGIPTALMFLACVLFFMGTRLYVRVTPEGSPFTSVVQVLSAALKKRSLKQPKDPKQDLFDPPHTSAIVTKLAHTDQFRCLDKAAIVASQDEVRPGGAAPADPWRLCSVQQVEEVKCLIRIVPVWSTGIIYYVAVVQQSTYVVLSALQSDRH

SEQ ID NO: 59863 - protein, 198 aa, Sorghum bicolor
  Clone ID: 7536416.pep
TRAISVFSAVSGLELSLSKDQHEYAVIPITCAILVFLFALQHYGTHRVGFLFAPIILAWLLCMSTIGLYNIIRWNPQIYTALNPSYMIRFLRKTKKSGWMSLGGILLCMTGSEAMFADLGHFSYSSIQLAFTSLVYPSLILGYMGQAAYLSQHHNLDASYQIGFYIAVPGTLHCYLLCLFSRRTTLSDFQTFTWALPM

SEQ ID NO: 59864 - protein, 157 aa, Sorghum bicolor
  Clone ID: 7536425.pep
HEDPPAGCRPIGLKWVYKVKRDERGAIVKYKARLVARGFVQHEGIDFEEVFALVARMESVHLLLAMAAAKDWRVHHLDVKSAFLNGELAETVFVKQAPGFTVKGADHKVLKLHKALYRLRQARRVWNAKLDATLCELGFTRCVTEHVLYTQRWGRKS

SEQ ID NO: 59865 - protein, 182 aa, Sorghum bicolor
  unsure (1)..(182): unsure at all Xaa locations
  Clone ID: 7536430.pep
HEGDISESFDNFPYYLSENTKNVLLSSAYVNLCCKESTKWTKDISSLCKRVLLSGPAGSEIYQELLVKALTKSFGAKLLVIDYSLLSGGQPSKSKESEPYKKGDRVRYIGPPRSSGFMLEGPRAPDYGSQGEVRLSFAENGSSKVGVRFDKQIPXGIDLGGNCELDHGLFCSVDSLCLDGPG

SEQ ID NO: 59866 - protein, 189 aa, Sorghum bicolor
  Clone ID: 7536439.pep
MLTKSVATPLLALLSLASQATAVSKKHWSKRSDAVYLPKEVHDYKTATAPNNVTIRYKNPGICETTPGVDSYSGYVDLAPNVHVFFWFFESRNNPASDPFTLWLNGGPGSDSLIGLFEENGPCMISDNLTAEYNPYSWNNVSNMLYISQPVGTGFSYQEQGVGSLNPVTGEFRYNSSELPADGRYPLLD

SEQ ID NO: 59867 - protein, 94 aa, Sorghum bicolor
  Clone ID: 7536442.pep
NESQQLSTLGPLRKRKWCMVGQAGAQMTMTLSQVSKLVHQTPPKQIHERARDNYLPACCISATCLCSSRDPGSMRLPDHKCEIYDNKILLPRRL

SEQ ID NO: 59868 - protein, 192 aa, Sorghum bicolor
  Clone ID: 7536444.pep
TRPIKYPSTPSSPSHSFGPLPDSYFACNVFDRRTVKRYLTTNDYTRYIDTITNNKPIDASTADAIASALLRWATERGATHFTHWFQPLIGLTGTAEKHDTFIDTLRDGETPLIRFTGKQLIMGEPDGSSFPSGGLRATHIARGYTAWDPNSPPFLLDNNNGSTLYIPSCFFSWDHGKALDEKIPLLRSELAL

SEQ ID NO: 59869 - protein, 177 aa, Sorghum bicolor
  Clone ID: 7536447.pep
HEALPYQLTAPALALLLVFRTEASYARFDEGRKAWMRVLAGAADLAGMLMHHPNNLHTRTGGRQAQADDDPLRRALINYILAFPVALKCHIIFDSDVKGDLQGLLAEDDLNVVLASKHRPRCIIEFISQSLQMLDLDEQKRSIMESKLSCFLEGIGVCEQLMGIPIPLSYTRLTSRF

SEQ ID NO: 59870 - protein, 139 aa, Sorghum bicolor
  Clone ID: 7536449.pep
MANIENEEQQYQQEVEDVKKWWSDSRWRHTRRPFTAEQIVQKRGTLKLQYPSNAQSKKLWDIVEGRFKNNDVSFTYGCLDPVMVTQMAKYLDTVYVSGWQCSSTASTTDEPGPDLADYPMTTVPNKVGHLFMAQLFHDR

SEQ ID NO: 59871 - protein, 202 aa, Sorghum bicolor
  Clone ID: 7536450.pep
TRFEIRAGRAVFGDSPSASIRLKSRSKRGSLYPDQASQQPGSGPQAFSTRYDFGASLSAALSNAQNALGDRSGIKTNASAKGSDGRFDNEAGAPGSNSVSGSTPASAAPLVPGTRPDGTSSAKPGLQSAEYNELIQKFCFYGTPSRGSPKATTPATKNSHTGGVVEYVLGERSGKHQSSASNSPPSPQLPTQVDGANDVTSA

SEQ ID NO: 59872 - protein, 57 aa, Sorghum bicolor
  Clone ID: 7536455.pep
EHRTTRPERGAELPRRWVVQSLLASTEEDQTVERWEHYMAAAAGPTATGITSGRRRA

SEQ ID NO: 59873 - protein, 52 aa, Sorghum bicolor
  Clone ID: 7536461.pep
MLLTEGCMQNRHYREGKDGRMVEIFIGISQESVQFHRKNAGTGKQYCVPNRP

SEQ ID NO: 59874 - protein, 97 aa, Sorghum bicolor
  Clone ID: 7536462.pep
KYLPTKQNKSGTLPSIDRKIFCKDMPSSEPCLCQSIFSFLFPFEMLDKKNDTKRNYGPMGWQREASSDWDKIEVSFTSNPFFLIKYQSVVLACFRCV

SEQ ID NO: 59875 - protein, 80 aa, Sorghum bicolor
  unsure (1)..(80): unsure at all Xaa locations
  Clone ID: 7536469.pep
MKRFVYINDESYQNDYCDNRISNTKYTLLNFLPKNLWEQFRRFMNQYFLLIACLQLWSLITPXNPASTWGPLIXIFAVSA

SEQ ID NO: 59876 - protein, 148 aa, Sorghum bicolor
  Clone ID: 7536475.pep
MSRFSIPIDALTSRMNLSGRFDGLRSTSVSSRFANLRPISEFLDVKRISKPANFGEVQSRVNYNLGYFSSNYAAVFVMLSIYSLLTNLLLLFVICFIVGGMFGIGKLEGNDLQLGSVRATTSQLYTGLFIIAIPLGLWASPFTTVLWL

SEQ ID NO: 59877 - protein, 192 aa, Sorghum bicolor
  Clone ID: 7536477.pep
HEGIAFLYSGLARRKSALSMLWVVMMSFSVIVFQWYFWGFSLAFSTTSNNPFIGDLKHFGLMKVWGAPSVGSPLIPALLYSFYQMMFCAVTGALTVGAVAERGRVVPSMVFVFFWATLVYCPLAYWVWNPNGWGFVNGVLDYAGGVPVEIGSGMSAFAYSWVLGRRNEKMMMNFRPHNISLITLGTMFLWFG

SEQ ID NO: 59878 - protein, 85 aa, Sorghum bicolor
  Clone ID: 7536478.pep
ELLGMDDDQHGEFSYDYVEVRRDFLAWSPHRGEPAEDGDVLEPTHGIQEHQSMMNPSESDDVRKTPSLNAPDAVAPDAVINEKNT

SEQ ID NO: 59879 - protein, 184 aa, Sorghum bicolor
  Clone ID: 7536480.pep
AYYGSNEPLRSGASSQFLRDVPGAFPSAWGMPSHGYYYEGYPSQSRVVSTEHQQEPKDPTPPPEPPKLVPFPVEPYQYQSFSPTDSSSSQASPQLQYIRRPSAPPSEVSYTAMPRRVPVPVQRTIPTTTDHVGFSDPITATAQPSDAQSVVDVTPQPVAVAAGAAVGNGKDGERRRKAGKKKKV

SEQ ID NO: 59880 - protein, 182 aa, Sorghum bicolor
  Clone ID: 7536487.pep
GYSEEWQVEAARRGLPNFKSTPKALDTLNSAKNVELFESLKVLDRTELEARQTILFEDYVKRLCVEVKVLIQMCQQSIVPVVVQYVREVREVVEVGKGKGSEKLLKGLVKELEKMLEGVEELKARLHEVHGKATVKESAHYCEDQLIPLMEKTRAAADELEQMLPAEKWPLPTYHMMLFHQD

SEQ ID NO: 59881 - protein, 125 aa, Sorghum bicolor
  Clone ID: 7536488.pep
KYLSYLLKGYDPSTQQESGSGYVVGGAGYMNPPSNLNTPGGTNFKFETTPTPPATGATWSPGQMPQQSPMTVGMDQGYGMVNGANQYGLTPTSASRASFPTSISQSSQGRMDGQSPPEKRQRTYT

SEQ ID NO: 59882 - protein, 111 aa, Sorghum bicolor
  Clone ID: 7536492.pep
TQRAVKLAIKQSIAIDIERRKAREAAGEDVDMEVDEEDPVPVLTKAHFEEAMRSARRSVTDVEIRRYEAFAQSMKNSGGSSFFRFPDAENAAAGGDQNTFGAGGEDEDLYN

SEQ ID NO: 59883 - protein, 89 aa, Sorghum bicolor
  Clone ID: 7536498.pep
MFSLIVTLLSIWLDPYLSEANTTSVTYAVVAVQATDGQTLSRIADEELRTPIHRKDVLFWSRRLYQVTSAWVGLSFFQLASSVELVGTV

SEQ ID NO: 59884 - protein, 96 aa, Sorghum bicolor
  Clone ID: 7536502.pep
TSPYQRVPLSGPLSFNNSWSGQKLAVQVNTAPVELSAEEKPTSKPSLRRQAMRIGSSRSGRAFSEPFQQHKRRPPEAVTRSTETGTFMMQSQNSTW

SEQ ID NO: 59885 - protein, 145 aa, Sorghum bicolor
  Clone ID: 7550349.pep
VSFLLPFRSTPWYSKLRNLLHQQNGTNTFLPLAFRVSHPNGKKRNFGVLFLRKENLVVLCICYRVLYMQREKNWWLLRKKSVLLNLLASIWLYSCRVSHSLLLSAFAPPIAALRRTGLEVGPPLLGCTERTSAGSCCSPQDCQSV

SEQ ID NO: 59886 - protein, 75 aa, Sorghum bicolor
  Clone ID: 7550350.pep
HKGPVELVTPPADPKAGARVWFQGWEGHPEGVFNPKKKVWETFQPGFTPTDGFEVALDAAAVEQLGKNGTGPLVT

SEQ ID NO: 59887 - protein, 178 aa, Sorghum bicolor
  Clone ID: 7550356.pep
LLESIKPSVSMVGGSSMELRYANVILTAETLLAALRPPAAGDSEEVQEGMIDLSTRDALYKMLPVSIREAMNTKLRERWGKGQPVDEVAAAESRDAVERLLRWLSPMAHDTLRWNDERSMERAQRFGMQPRALMVQTLHFADRQKTDAAIVDVLIDLSCICWYDDERRRLESHDWDAE

SEQ ID NO: 59888 - protein, 108 aa, Sorghum bicolor
  Clone ID: 7550360.pep
ALLKAPKVLLMDEATASIDYATDARIQETIRQIKNTTITIAHRLQTIIDYDKVLVLDKGEVIEYGHPYDLVRKDGGSFRSMCQTSGELDSLISTAKAAYEAKTNTAAQ

SEQ ID NO: 59889 - protein, 143 aa, Sorghum bicolor
  Clone ID: 7550369.pep
RRSARERDARGSKTAQSTPRCASHDSSPARSVEHSLAGTPRRRGGTQRDRDALVSPRYMAGTASSAARTRCHSAPRQRQTTDAEQAPRTSVASRDGASRRSSCSHAHGGGFCFQCSDVTRTTGFSGISVSDEVARDYYLDSFW

SEQ ID NO: 59890 - protein, 154 aa, Sorghum bicolor
  Clone ID: 7550371.pep
AVIQYDYEKAEDNEIDLIEGDVVTNIDMVDEDWWMGTNSRGESGLFPSNYVELVGDDDSEQPAAAAVPPPPPPVAEPEPEPEPETQAPAAAAAPAEAGHTAVALYDYEAAEDNELSFPEDATITNLEFPDEDWWFGHYAGQAGLFPANYVQLNQ

SEQ ID NO: 59891 - protein, 103 aa, Sorghum bicolor
  Clone ID: 7550377.pep
QLDNEIVFNEAIIEEREQAIQDIQQQIGEVNEVFKDLATLVHSQGIIIEEINMNIEKSEVLTKEAKKEVTKAAKTQKSNSSLICLLMVIFGVVLLVVIIVLAA

SEQ ID NO: 59892 - protein, 62 aa, Sorghum bicolor
  Clone ID: 7550379.pep
PRRNQKTGRHAPAPVDLDTYETSNQPTIILLAAGPAQVKAARGRANGSDTRPDTINWQQKLN

SEQ ID NO: 59893 - protein, 160 aa, Sorghum bicolor
  Clone ID: 7550384.pep
VVFVSSIFLLQALWDASSTCFLGDETPTPAPINPRNMHLAAQLKEPFIEQWTWLEEKIAAYWIDKDWDLEASPLMRNGHTYPVYGTLPVKSGNNRQTKRRMVRLTLIAIVSMFFLSVAQWLFWLGFIGLPADDYCTPMLGLLTVTWTLSSVAAVVGVSKS

SEQ ID NO: 59894 - protein, 73 aa, Sorghum bicolor
  Clone ID: 7550387.pep
PTVLVQAKAHMQRKHITKRSSRTIRKDDKPSFASVRRQQQFCSLRLCLKSEYCGVYEINIFSTCNSKAVHYLV

SEQ ID NO: 59895 - protein, 169 aa, Sorghum bicolor
  Clone ID: 7550393.pep
PSRVPLQPRRQHAPWRQRQERGRGRGRRRRQQPRREEHPAGPVRAVAVVPGADVLHEASRVGVAVDAQGRRDGRVQQGRQGGRRRRRREVSGTGRPGGRARTTCLTASPCPGQTVAARKLLVLSSPSRRKFFWQLNLGENVLDRAAPSVLLLESGRVLYSFFFVKKTCT

SEQ ID NO: 59896 - protein, 57 aa, Sorghum bicolor
  Clone ID: 7550395.pep
TFTYMAELVYTIHQDRKKWGIHYVGYIDTSRKRKGNITNKYSIPMSHCERTIKPTGA

SEQ ID NO: 59897 - protein, 142 aa, Sorghum bicolor
  Clone ID: 7550471.pep
MIFVCPVNTMAEPIRNKRSDVSTAPTPQNTPATNAPISSRAQQPGVASIKEDDMERAAAASLLAQNPKLVQMIQGRLGSLIGQSSGYIESLPAPVRRRVSGLRAIQKDHAKLEAEFQEEVLQLEKKYFAKFTPLYEKRSAIV

SEQ ID NO: 59898 - protein, 141 aa, Sorghum bicolor
  Clone ID: 7550482.pep
ARGYRLAHDADVEAIISNLRSSLHKALAAFYPLAGRVRLTPGTSDRYELHYRPGDAVTFTVAECDDDVDGDAHFDALATDEPREVAKIAALVPTLPRGGRLLAVRATLLPARRGLAIGVTLHHAACDGSGSTHFLHTWAAT

SEQ ID NO: 59899 - protein, 146 aa, Sorghum bicolor
  Clone ID: 7550498.pep
TRSKSTEGFQSVPYVVALFSAMLWIFYALIKSNETFLITINAAGCVIETIYIVMYFVYAPKKAKLFTAKIMLLLNVGVFGVILLVTLLLFKGDKRVVMLGWICVGFSVSVFVAPLSIMRRVIQTKSVEYMPFSLSLSLTLSAVVWF

SEQ ID NO: 59900 - protein, 124 aa, Sorghum bicolor
  Clone ID: 7550522.pep
RYHHQSSFWTSYLPTLTMAAKLVRSSSSLLLLLAVALWTSSCLLLILPAAMADHTVPQPASSSSAQPSIPATEPTTTGTLPTAPSTSSSSATAEPAGIPPATPAAAAAAASEPATTGAAATTTA

SEQ ID NO: 59901 - protein, 77 aa, Sorghum bicolor
  Clone ID: 7550523.pep
NKQLCGSGFLPVVWCSLRFCKIEITKYVFCTTIQPHLLINCTFTLWLEAVCLQSLVDTLMVTQIILNFKILFNFKTQ

SEQ ID NO: 59902 - protein, 65 aa, Sorghum bicolor
  Clone ID: 7550527.pep
GPSLFVPTPRGGTPPPSPHGKEPAPPQRTVAAAMRLGLGLRSATNSAGGRISGREREEKRRRRRN

SEQ ID NO: 59903 - protein, 163 aa, Sorghum bicolor
  Clone ID: 7550535.pep
MYAGGGGVRRAATALIWVLVLAAAGGGSVVCEAQLRRGYYAGVCPNVESIVRGVVAKKIQQTPATVGATVRLFFHDCFVEGCDASVMVASTANNTAEKDHPINLSLAGDGFDTVIRARAAVDAAPGCRGKVSCADILAMATRDAIALSGGPSYAVELGRLDGL

SEQ ID NO: 59904 - protein, 151 aa, Sorghum bicolor
  Clone ID: 7550537.pep
ARGCQGVQFDRIFGVWLGGAELLRSCTAEPRPNGIVWSVSKDITKYASLLAAGNSTLAVYLGNLVNSQYTGVYYANVTLHLYFRRAPATRTPPPPATAPADLIVPMSRGLPLNDGLWYQIQNATDVQSTSVTLPPNTYRAVLEVYASSHGD

SEQ ID NO: 59905 - protein, 131 aa, Sorghum bicolor
  Clone ID: 7550539.pep
HEAKDGQTREHALLAYTLGVKQLIVAINKMDTANWAEARYQEIIKETSNFIKKVGFNPKAVAFVPISGFNGDNMLQPSTNCPWYKGWEKETKAGKFTGKTLLEAIDSIEPPKRPTDKPLRLPLQDVYKIGG

SEQ ID NO: 59906 - protein, 116 aa, Sorghum bicolor
  Clone ID: 7550541.pep
SLGPPRLIRRVFPSAEIDKDAAQMTRPQATRSSRTRASGPCALYTNGQALVRRGQPACFAACHGPANRFRIHSARQRDHGTGCPSLGGKAPSAPCSLADSSSCSGTPCLISEEPSC

SEQ ID NO: 59907 - protein, 77 aa, Sorghum bicolor
  Clone ID: 7550572.pep
AASMDGGWTVIAFWMEETTTPLDLHRAPWIHHREATAPWIYHRKATHDRSRGWETAHLGVGGTSGTSTPRWMDGAAV

SEQ ID NO: 59908 - protein, 121 aa, Sorghum bicolor
  Clone ID: 7550573.pep
MPAFTLYGALGSTNTDRIRLTLAESGFTDYELVHVNLQKGEQKSEENLKRHPWGKIPAITFSDGFTLYESRPICKYLARKYAFPLLSPDSDLEATALFDQAQSVEMLYFTEPAGRIGFEKF

SEQ ID NO: 59909 - protein, 46 aa, Sorghum bicolor
  Clone ID: 7550576.pep
SSPPPQAEVAESTSQSLISEAASSMAVAALCRLPVSSGKEKASWGK

SEQ ID NO: 59910 - protein, 123 aa, Sorghum bicolor
  Clone ID: 7550582.pep
ARGFDERELELLIGGIAEIDVDDWKKHTDYRGYTESDEVVQNFWATVRSWDGEQKSRLLQFTTGTSRIPVNGFKDLQGSDGPRRFTIEKAGEITNLPKAHTCFNRLDLPPYKSLEMLQQKLTI

SEQ ID NO: 59911 - protein, 151 aa, Sorghum bicolor
  Clone ID: 7550586.pep
MSAPAHKFKVADISLAAFGRREIELAENEMPGLMETRRKYAEDQPLKGARIAGCLHMTIQTAVLIETLKFLGAELTWTSCNIFSTQDHAAAAIAAAGVPVFAWKGETEEEYEWCLEQQLTAFKDGKSLNLILDDGGDLTALVHKKYPEMLK

SEQ ID NO: 59912 - protein, 99 aa, Sorghum bicolor
  Clone ID: 7550593.pep
MSSSSELYNLVPAPQTLNPPAPAAADLSSSTAVAAAAAAAPGDGALRGRVRRPVGSSSVDRHAKVAGRGRRVRIPAMVAARVFQLTRELGHRSDGETIE

SEQ ID NO: 59913 - protein, 140 aa, Sorghum bicolor
  Clone ID: 7550600.pep
ARGYVSCGGCPDTWHGFSLEAFAGMWEFVKLSSASGVMLCLENWYYRILVLLTGNLKDAAIAVDALSICMTINGWEMMIPLAFFAGTGVRVANELGAGNGKGARFATIVSSITSLVIGLFFWVLIMGLHDKFALIFTSSS

SEQ ID NO: 59914 - protein, 151 aa, Sorghum bicolor
  Clone ID: 7550601.pep
ATKAVRRPRRREKSIEPYHLEEEEAEQEEVVVDFVFVDPAEIDYHMVKNLATDLIDDPTFNNRELAELVVSENNPVGSIIKIEGEDDGVGYITALPVHKYRDQQCIQQILSFVKQNAQQHGVLTDSKQGALWQKVLSSERVGLVLNQRLLN

SEQ ID NO: 59915 - protein, 118 aa, Sorghum bicolor
  Clone ID: 7550612.pep
AVGVLAETRRLPGGAAAVVLRGGAEGALDGGEPRRAALLAHDGRRRRRGASTSWDTSCGESGAERAWALGGGRWQHSQRQRATGVVGGVGGGIIAGAGGSRGPPPWLNKALVLSSLLV

SEQ ID NO: 59916 - protein, 144 aa, Sorghum bicolor
  unsure (1)..(144): unsure at all Xaa locations
  Clone ID: 7550620.pep
KYCEKHMHRGKNRSRKPVEMSLATPAPASAVSSATSATAAAAAATTTTSSPAPSYRPAPTSHDASPYHALYGGGSPYSASARPAGGPGPYHHPAQVSPFHLHLETTHPHPPXSYYSVDQRDYAYGHATKEVVGEHAFFSDGAAE

SEQ ID NO: 59917 - protein, 123 aa, Sorghum bicolor
  Clone ID: 7550622.pep
TRLSSSSQTGHETLGRPASLRNPPFRSAMQASARFSSSAAFRKVIAGVSSATTRSCYRTSRWKAHAAPLPAQEPPLKGQKRATKQERKVRIMEFVESYRASNEGKFPTIKNIRQQIGGGHYTV

SEQ ID NO: 59918 - protein, 125 aa, Sorghum bicolor
  Clone ID: 7550627.pep
MEKAAHVAAGATQDWCPHRLDTVRHNDSAELIPERLAVVTGGNKGVGLEVCRQLAHKGVTVILTARDEKRGKYAAETLRRESELPNIIFHQLDVRDDDSVTTLARYVERRYGKLDILVNNAAISG

SEQ ID NO: 59919 - protein, 120 aa, Sorghum bicolor
  Clone ID: 7550634.pep
GTGGGGGFEEGAGELGRGDGGGVVVILHAVGVGHALDAVQLHAPQQIERNLDQLVARLRFGSLSLSLSLSLSPTLPRAAGGPGSLDEVLRAPRTRSKNSTGAVGCEGGEGERSRGDDPRA

SEQ ID NO: 59920 - protein, 87 aa, Sorghum bicolor
  Clone ID: 7550661.pep
MGGKLLLGANQSHAAAAASPAPLSKVATSGLHGEDSPYFAGWKAYDENPYDAATNPGGVIQMGLAENQVSFDLLEGYLRDHPEAASW

SEQ ID NO: 59921 - protein, 65 aa, Sorghum bicolor
  unsure (1)..(65): unsure at all Xaa locations
  Clone ID: 7550665.pep
MFVLPPPPRYPAGAYGVGLGGVVPLIETNNTLSNPSGPEYRXLVGEGTYVLKEDLNLGTPPPHPS

SEQ ID NO: 59922 - protein, 93 aa, Sorghum bicolor
  Clone ID: 7550687.pep
TLAACLTHASRTGSGVSSGEQDLKEIAAAPDIHLLFQTHPFACVCVCVCVCGSAQCVGWTISRQSQQQNLFEGFKKFAHRVCQSSEVLSFSNV

SEQ ID NO: 59923 - protein, 144 aa, Sorghum bicolor
  Clone ID: 7550690.pep
MWHSKWLLTLLAAGVQAAPASTAKDTVSSVVKDGVTYTVFEHAATGAKIEFVKNSGICETTPGVNQYSGYLSVGSNMNMWFWFFEARNNPQQAPLAAWFNGGPGCSSMIGLFQENGPCHFVNGDSTPSLNENSWNNYANMIYID

SEQ ID NO: 59924 - protein, 135 aa, Sorghum bicolor
  Clone ID: 7550692.pep
HEAAADLLLQCPHTATHPLLARGQMAPAAAVLKRAHLAGVHSLALRRRQPGPPDRVSVPSLAIPSPRVSWQQGSGVVAKRRFWASASGSLAKDNTGEDAASPSQLQGVEESKVDLLKILKSANSIIPHIVLGSTI

SEQ ID NO: 59925 - protein, 116 aa, Sorghum bicolor
  Clone ID: 7550713.pep
MESDAEEEAAATPAAAGAPGAGRLKGSPELTVDADMREMAKTAAWSVSSCKAGNGVAALRDDNLDTYWQSDGAQPHLVNIQFQKKVQLQLVALYVDFKLDESYTPSKISIRAGDGF

SEQ ID NO: 59926 - protein, 49 aa, Sorghum bicolor
  Clone ID: 7550723.pep
MDPWISSQPSLSLDLHVGLPPLSLHQAPVAAVALARPKVLVEENFLPPK

SEQ ID NO: 59927 - protein, 80 aa, Sorghum bicolor
  Clone ID: 7550730.pep
RAPNGYSSRILSPALAPQFSPGVTVTPARRCGRRASPHLFNCGDAGRATERFARSSLSPSPARTRTSVHALSYTGTATAD

SEQ ID NO: 59928 - protein, 112 aa, Sorghum bicolor
  Clone ID: 7550736.pep
YARIGVTCTMDMVYNIQSRMIISSHALHNGLQNTSPNAPSRRRCSVQMAQSHGKNPCLPHRPIEKEKTPKDCSETSEAHGHYSKPNWARKEQRRANQMREESNIAALDAASC

SEQ ID NO: 59929 - protein, 108 aa, Sorghum bicolor
  Clone ID: 7550756.pep
TRVETATGGFSSKVVGRGGFSTVYLASLSSSRLGAVKVHCSSERLHRAFRRELDVLLSLRHPHIVRLLGYCDERDEGVLVFEYAPNGDLHDALHGHGGVLPWARRVAV

SEQ ID NO: 59930 - protein, 58 aa, Sorghum bicolor
  Clone ID: 7550781.pep
VCIYVARCLSVHQLLIRGQKWCEKKASVVTSAGMQIKKVRRDFPSYILLEFLIVISPL

SEQ ID NO: 59931 - protein, 128 aa, Sorghum bicolor
  unsure (1)..(128): unsure at all Xaa locations
  Clone ID: 7550785.pep
PPAARAXGHKPPRRPSRATHVGPVAAVAPSAPPGAAGCCCASCPAPGVHAAERHAWGRAGCRRARAHAAAPSRRSHHRASAQGHSCARPPRRTRRAPCTREQASLPAGRLALPPPIFSLFSMFCKPRA

SEQ ID NO: 59932 - protein, 140 aa, Sorghum bicolor
  Clone ID: 7550787.pep
MSTIMASYTTPVRPSPALRPQACSLLLARGSWKPSVALRPSATVKCRRRALTVTCALPEKERPPAFSIPPTAMLCPVPPPDGKERWDIKDEDDRVTLWLQVPGLSESDIEVTTSEDVLEIKRRVTATQQPAAPVDAHGVG

SEQ ID NO: 59933 - protein, 85 aa, Sorghum bicolor
  Clone ID: 7550807.pep
GGGGGAATPTRHVRSKSEGSVVAAAAITITDRQLGGAESPPEKEAAKKKQQQHKRAAAQQHRRRMSTGSHAAPWQPHLACIAEDL

SEQ ID NO: 59934 - protein, 169 aa, Sorghum bicolor
  Clone ID: 7550827.pep
HEGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTL

SEQ ID NO: 59935 - protein, 150 aa, Sorghum bicolor
  Clone ID: 7550828.pep
ARGSNSSALSVVHRHGPCSPLQARGGEPSHAEILDRDQDRVDSIHRLAAARPSSTADDPSSASKGVSLPARRGVPLGTANYIVSVGLGTPKRDLLVVFDTGSDLSWVQCKPCDSCYQQHDPLFDPSQSTTYSDVPCGAHECRRLDSGSCS

SEQ ID NO: 59936 - protein, 160 aa, Sorghum bicolor
  Clone ID: 7550835.pep
TRVDHTEKQAYVVLRVQTPRHIVEDLFLRWNKAKKNDDSSDEEGEEEEEDPVILHCAYIDFDGKQFGPVSKKFKIPQFGELKDVRSLPVYPFRYAKKIKLEEDLIDRGKMLLDVSRFKPMYYMGYTLDTRDEIDSQVVVDFNEALADETRRKKWEPTIAP

SEQ ID NO: 59937 - protein, 126 aa, Sorghum bicolor
  Clone ID: 7550838.pep
GELVYGLTPASQLLAGGSSSLTPFMSLALHGIFVSPFLGLGTWFQQEHSDPSLFEMTHGQTAWDLNDHNPAFGKLFNQGMVCDSSFIMDIVVKDCGDVFRGLSSVVDVAGGLGGAAMAISIAFPDV

SEQ ID NO: 59938 - protein, 160 aa, Sorghum bicolor
  Clone ID: 7550839.pep
FHLWECQEAVDKEVATSVTTLLKSSYTYVFQVPTQASIDSEPQSYTERVLQQWKSSHSPASHWSNTTPRRSLSPTSPPRRRGSSSPAAASSTRPCTSTITGGASRPWSSKQTPAATTTTATATARLGSPWRTRWTCCGRTSTRSSPGPRSRARSPRGRRR

SEQ ID NO: 59939 - protein, 132 aa, Sorghum bicolor
  Clone ID: 7550846.pep
PGVMGWWPSRSVTFIENHDTGSTQGHWPFPSDHIMEGYAYILTHPGIPTVFYDHFYDQGVPLHDEIAKLMQIRKCQDIHSRSSIKILEVRSDLYSAIIDDKLCMKIGDGSWCPSDPEWMLAVSGDRYAVWHK

SEQ ID NO: 59940 - protein, 105 aa, Sorghum bicolor
  unsure (1)..(105): unsure at all Xaa locations
  Clone ID: 7550868.pep
HEARHTATAAAPPPPPRHHPTQSPSPPPGGAXLPWRTSTTSSSSTSGTTGSETSPTSPSPSPSSWISTAHVTSSPRASIPKPXPPPRGLPSPSTPTPTSAASPPR

SEQ ID NO: 59941 - protein, 44 aa, Sorghum bicolor
  Clone ID: 7550882.pep
CLPVLAPGRICLWPRRGQWPRPRKKSSNPAWGHAPVGINCLCSF

SEQ ID NO: 59942 - protein, 110 aa, Sorghum bicolor
  Clone ID: 7550896.pep
ALRSSFAGLMRRYSYKRAPALSILDTCYDFTGRNKVQIPSVALLFDGGATLNLGFGEVLYVANKSQACLAFASNGDDTSIAILGNMQQKTFAVVYDVANQKIGFGAKGCS

SEQ ID NO: 59943 - protein, 49 aa, Sorghum bicolor
  Clone ID: 7550900.pep
GSLVSHTNSRDILTSFPTFDPHYTYFIHRNSKHLIVSSSWSTQVQRKSN

SEQ ID NO: 59944 - protein, 100 aa, Sorghum bicolor
  Clone ID: 7550902.pep
PQPYNAYAPQQPLQPLQNHYQQQQPVLPMDNPAHNMPPGLGYPGQGQSDPHMMQSQQSTTQHTHYQQGSQGPLQNMNVNSQGSPIPHNSFQGQLQAQRML

SEQ ID NO: 59945 - protein, 41 aa, Sorghum bicolor
  Clone ID: 7550904.pep
DLFIMFVNGVERSEQKWKKIIFEAGFIDYKITPVFGVRSIN

SEQ ID NO: 59946 - protein, 103 aa, Sorghum bicolor
  Clone ID: 7550905.pep
QNPRLSTTTQLHKEKLLKHNSSSAKAKRSLPLTTALNQVLGPVLPREACIVDQLTTSVYTRDDRLIHHDALIKDSIFFSAASDRRRLPRRGGAGLVRQEELLE

SEQ ID NO: 59947 - protein, 53 aa, Sorghum bicolor
  Clone ID: 7550908.pep
FFLKGFANPRRAISVDPCMRNCAFCKRPICHQLCRLHPLLFDMNSKVPNSARS

SEQ ID NO: 59948 - protein, 184 aa, Sorghum bicolor
  Clone ID: 7550919.pep
RAPPRKGYLPQNLYCLDSCYGSLHELKSLLHKMSEHNVRAMADVVLNHRIGTTQGSNGMYNRYDGIPISWDEHAVTSCSGGKGNKSTGDNFDGVPNIDHTQPFVRKDIIEWLIWLRKSVGFQDFRFDFTKGYAAKFVKEYIEESKPLFAVGEYWDSCEYSPPDYRLNYNQDSHRQKIINWIDNT

SEQ ID NO: 59949 - protein, 45 aa, Sorghum bicolor
  Clone ID: 7550922.pep
VPSGCQSGGEVWVSSVLVGGWGGVFQLGLSFSFLSGFHFFDWVKM

SEQ ID NO: 59950 - protein, 104 aa, Sorghum bicolor
  Clone ID: 7550970.pep
MAAQSIALWLLTTTMALQAGTSWAQLSTGFYSSSCPGLYSAVKPVVQSAIDSEKRVGASIVRLFFHDCFVQGCDASLLLDDTATFQGEKMATPNNGSVRGFEVI

SEQ ID NO: 59951 - protein, 165 aa, Sorghum bicolor
  Clone ID: 7550999.pep
TFRVVAVIMGLILLPAVAFAIFVVYYVLVPKKKTGLPLPPGPKPLPIIGNLLDLPPTGTAEYKHWAKHKELYGPISSLNVMGQPMIILNSPDAMHELLEKRSTKTSSRPSAKFGGELCGFSVMLPLIPYGDKFRYYRKLVHQQMGTKLICSEFRDTQDLESLRFL

SEQ ID NO: 59952 - protein, 137 aa, Sorghum bicolor
  Clone ID: 7551000.pep
TREREKWLEEYNMDENRFSTGRIARLNLKRAEKARLIITKIPAVVDNLIIRTLAWESERKKPFLYDGARLVAVLEEHKQARIRQEEERRRLREQKKLRTLLSEKEAMPHLKRPGSSFGRATEPCNVNRKRVDAAGRF

SEQ ID NO: 59953 - protein, 163 aa, Sorghum bicolor
  Clone ID: 7551002.pep
ARGFFDPSWYHLQVVYEFLLRFVTSPLVDAKVARKYVDSPFVSKLLDLFDSDDPRERDCLKTILHRIYGKFMGNRPFIRKAVSNIFYRFVFETDHHNGIAELLEVFGSVISGFAKPLKEEHKLFLWKALIPLHKPKSVGVYLPQLTYCITQFIEKEPKLAGTV

SEQ ID NO: 59954 - protein, 162 aa, Sorghum bicolor
  Clone ID: 7551003.pep
QYKVSLDRIEKFLLEDEIREEDVKRVPSDNSDVRVQVQDGNFSWKATGADLSLRNVNLRINRGEKVAVCGPVGSGKSSLLYALLGEIPRISGSVAVFGSVAYVSQSSWIQSGTVRDNILFGKPFHKELYDKAIKSCALDKDIENFDHGDLTEIGQRGLNMSG

SEQ ID NO: 59955 - protein, 120 aa, Sorghum bicolor
  Clone ID: 7551018.pep
LDSGLDILVISVPLTDKTKGLISKPEFEILGKKGTFLINIARGPIVDTDDLIEALDVTDPEPLPDQHPLWSAKNVTITPHISAASSFYYTRLLDIFRLNLERLSQGRTDFINKVNRKEGY

SEQ ID NO: 59956 - protein, 105 aa, Sorghum bicolor
  Clone ID: 7551026.pep
RPGSSFGRATEPCNVNRKRVDAAGRFASSAAPSVRSGASSSSSSSSGSGGGGASATELIRPRSSAAGAGQCGEFFKGARRLSAPAPFNYVAVSKGGSMSSSLALS

SEQ ID NO: 59957 - protein, 153 aa, Sorghum bicolor
  Clone ID: 7551053.pep
TTEELEYNGYHIPKGTYLIPSTWALLHDPETYPNPSAFEPERYIAPRNEPDPSDFAFGYGRRICPGRYLAEDSVFMTCARLLAVFNMRKAVDENGKEIDVVVDGTPGLISHPVDYAYSITPRSDKHVEMVRAAERMNPWEESDAPLLPKDSLV

SEQ ID NO: 59958 - protein, 56 aa, Sorghum bicolor
  Clone ID: 7551057.pep
LETSFDSHYSSNSTGRQLTFLYSNAQFLAQFNEPTRKWIILSLASPKTIVFALPMP

SEQ ID NO: 59959 - protein, 123 aa, Sorghum bicolor
  Clone ID: 7551064.pep
MPFILQNKPFFFLSLEGLLTHLVYVRLRNTYMYTCTVVHAERCLSYHRSNLLPITSRSTNLSHDGLIPAHVPYWWVNNPTLGEFCFTMIGRADIEGSKSNVAMNAWLPQASYPCGNFSDTSSF

SEQ ID NO: 59960 - protein, 65 aa, Sorghum bicolor
  Clone ID: 7551075.pep
HIRVTQHLTKGIFIGRQSRHKSRRRMHGTRCRVIGTLCHITHSCCCYLPCCLALILLVITPFHFI

SEQ ID NO: 59961 - protein, 74 aa, Sorghum bicolor
  Clone ID: 7551080.pep
FENDYYKNLVSNMGLLHSDQELFNGGATDALVQSYVSSQSAFFADFVTGMIKMGDITPLTGSAGEIRKNCRRIN

SEQ ID NO: 59962 - protein, 177 aa, Sorghum bicolor
  unsure (1)..(177): unsure at all Xaa locations
  Clone ID: 7551098.pep
VRGKELSDVCREKLAPSGFRSSEFTPKVSRNVNKDSISMNFISMNFVDMNKQGMRHENYIPSSDAFKDIELRIFGKLVATATRSPKCDCIDKSDVEDHIHVYLVPNADLSDLTQGNLLLXTITGLATTGEEGSCCVYDGHGIKTHVIMKHRTLMVKHMHWYQVGDKVSPCECRCSRA

SEQ ID NO: 59963 - protein, 178 aa, Sorghum bicolor
  Clone ID: 7551101.pep
TRSERSAASPRGSEARARMQGGSSGIVYGGLKYQARCIADVRADAGSTTFLAGTLSLKEENEVHLIRLSPAEGELVCDGLFYHPDEIWDLKSCPFDHRIFSTVYTSGEGYGASVWKMPEVNGQSNSPQLDQLFELSGHRGKIRRVIWWPLGKHDKLISIDDRNIFLWSIDTSNKSAKV

SEQ ID NO: 59964 - protein, 107 aa, Sorghum bicolor
  Clone ID: 7551105.pep
RERSKRMEGLIPFVIDVIRRSNGRSGYRSVSSDGGSSRGGGSRRHLIDYSELPDAPAAAANVGVDWTSGTLHRRARPEYADTMAGRRNEEYARPASAVAAGPAYRRK

SEQ ID NO: 59965 - protein, 128 aa, Sorghum bicolor
  Clone ID: 7551107.pep
MDPDGDPAFHRNEAISAVQDVDQYYGDDDDFDDLYNDVNVGDGFLHASHQAPPPPTQQAPPPQQHQHQQQQLPPPPQQPQPQQQLHPPAHTLPPPPPQVPPPQQQVRIPGVAVPGPGIPPGQTSLPPP

SEQ ID NO: 59966 - protein, 125 aa, Sorghum bicolor
  Clone ID: 7551126.pep
MGSEGSTSPGGGGGAACAVCGGAAAVYCAADAAALCGPCDAAVHAANLLASRHERVPLSMAAVAAASGVYDDLFAPDDIDAASSWAAAAHASPQNGSSSTSFTTSDGGAEGRMSLFDLLSDVDLA

SEQ ID NO: 59967 - protein, 164 aa, Sorghum bicolor
  Clone ID: 7551133.pep
VDCTGEGVWFIEASASCTLEDVDYLEYPLMVPKDELLPHPTYPPESDPLPEDSLILLVQVTQFACGGFVVGFRFSHAVADGPGAAQFMTAVGDMARGHAAPLVAPAWGREAIPNPPGAAVGALPVPTELRLQYLAMDISTDYIEHFKSRFLEQTGGQQRCSAFE

SEQ ID NO: 59968 - protein, 189 aa, Sorghum bicolor
  Clone ID: 7551134.pep
ATSAQTLGNVVVSIVGTGVLGLPYAFRAAGWVAGSLGVAAAGSATLYCMLLLVDCRDKLAEEETEECCHGHYTYGDLGDRCFGTIGRCLTEILVLVSQAGGSVAYLIFIGQNLHSTFSQLMSPAGFIFAILLPLQIALSFIRSLSSLSPFSIFADVCNVLAMAIVIKEDLQLFDHPFSHRSAFNGLWAV

SEQ ID NO: 59969 - protein, 88 aa, Sorghum bicolor
  Clone ID: 7551139.pep
SPLPAFFMLPLALEFILRTTDFLQISVCSFAFETAEVGFSPAGHAPAARKTPPPPARLPSPSVWPACSPLPRSLVSRRVDRTLRRLRP

SEQ ID NO: 59970 - protein, 87 aa, Sorghum bicolor
  Clone ID: 7551143.pep
PSTRQRGGGDDDGSCDIFRGEWVPDPDAPYYTNDTCKVIHEHYDCIRYSKPDLGFVNWRWRPDGCDLPRFNPWRFLHMMRGKSLAFV

SEQ ID NO: 59971 - protein, 162 aa, Sorghum bicolor
  Clone ID: 7551153.pep
TIPVIDLAAFSAANNNTNDAAGANHHQQLVAQVKAAAETVGFFQVVNHGVPAELLARMLASVRSFNEEPAEARRRYYTRDPARRVRYQSNFDLFYSPAASWRDTVFIESAAETETEEMPAAFRDVVPEYTQQVRALGAHLLALLSEALGLPRADYLQRDAGC

SEQ ID NO: 59972 - protein, 67 aa, Sorghum bicolor
  Clone ID: 7551154.pep
TAPYLTSSSRRRHRGTGVSPPQSSSATIGRKVSTDDLRLTTSGCCFEPLNPIIPFHHYYMSLCQSIL

SEQ ID NO: 59973 - protein, 127 aa, Sorghum bicolor
  Clone ID: 7551165.pep
FFRGTALLRTVDPSQYEGGEWNGDGDCVRTAPYGRGEKSVEGFERDFRALQVEELASAAKAATDSGGKVRMLLMHTTEAMVLRADAHPSKYRGWTPEKHFTLHNDCVHWCLPGAIDTWNDMLLHMLK

SEQ ID NO: 59974 - protein, 104 aa, Sorghum bicolor
  Clone ID: 7551166.pep
IAVSPRRNAFVINLGDQLQALSNGAYKSVWHRAVVNAAQERMSVASFLCPCNSAVISPAAALVGEGDAPVYRSYTYEEYYKKFWSRSLDQEHCLELFRSTQQLQ

SEQ ID NO: 59975 - protein, 59 aa, Sorghum bicolor
  Clone ID: 7551172.pep
GYSYSTANKSMAVIWEENTLYDYLLNPKKYIPGTKMVFPGLKKPQERADLIAYLKNATA

SEQ ID NO: 59976 - protein, 152 aa, Sorghum bicolor
  Clone ID: 7551183.pep
DEDDPAEAHSKVSFFSYFYLALNLGSLFSNTFLSYLEDKGSWALGFWASTAAAATALLLFLSGTLRYRYFQPGGNPIGRICQVAIAASRKWKAGASTTGVVSLYEGDEKADAAGGRKLLHTQGFSFLDRAAHADTDSKLGARDPWKLCTVTQ

SEQ ID NO: 59977 - protein, 126 aa, Sorghum bicolor
  Clone ID: 7551197.pep
MAVPTPPIPPVSPDSGPTDPTLPKLPAGWIAQWDNSSRKYYYVQISTGVSQWELPTSEAPVGGSSNHSTPAQSTNPYNVPGTSGPDGAGDGTRGMGDGPTGDRAGGLGGFAMNALMGNKQSGSGGH

SEQ ID NO: 59978 - protein, 139 aa, Sorghum bicolor
  Clone ID: 7551204.pep
ARGHPPPAVTAHRTETKQTNMASAAPARHVHIEALQTALPTRAVEPGRARPVSVAAAAAPLPAAALQRRARVVLYYRAAADAPAPWSQEEALLVKESLSEAVADHPEMAGRLRRSGSGSGSGSSWEVKLNDTGVRLVLA

SEQ ID NO: 59979 - protein, 174 aa, Sorghum bicolor
  Clone ID: 7551235.pep
HEGNDTLVSSGAGSFVLGFFSPLGSNNTYVGIWYAKVPIRTVVWVANRAAPVRGAATDNAGATLSVSSQECALAVADANATVVWSSASSPRPAGSSAASGGGCTARIRDDGNLVVTDQRGRVVWQGFDHPTDTLLPGMRLGVDFAAGTNMTLTAWASPSDPSPSPVVAAMDTSG

SEQ ID NO: 59980 - protein, 159 aa, Sorghum bicolor
  Clone ID: 7551242.pep
ARGNGDWALCTVLTTSGDESVLKVSEGKVLRLKTDSLQPANPEILDGVDDLMQLSYLSEASVLYNLQYRYSQDMIYTKAGPVLVAVNPFKKVSLYGNEYIDAYRNKSMDSPHVYAIADAALREMKRDEVNQSIIISGESGAGKTETAKIAMQYLASLGG

SEQ ID NO: 59981 - protein, 139 aa, Sorghum bicolor
  Clone ID: 7551247.pep
MAAPRKVLMLCGDYMEDFEAAVPLYALSALGITVDCAAPGKRPGDSCLTAVHDFLGFELYTELTGHRFTITADFAAAAADPSRYDALVIPGGRFTEQLSADAAVVDLVAAFAALRRPLVLTCHSQLLLAAAGGLSGGTR

SEQ ID NO: 59982 - protein, 173 aa, Sorghum bicolor
  Clone ID: 7551251.pep
ARGFTLDTSKVFTIITQFNTDNGLPSGNLVSITRKYRQNGVDVPSAQSGGDTISSCPSASAYGGLTTMGKALANGMVLVFSIWNDNGGNMNWLDSGNAGPCSSTEGNPSTIVANNPGTHVIFSNIRWGDIGSTTGATGGNPPPSTSRTSTTPPPSTTLRTSTSSRTTTSTAAG

SEQ ID NO: 59983 - protein, 61 aa, Sorghum bicolor
  Clone ID: 7551274.pep
RFILYKSNAFFFQSCSMHCKIWLVFFVSPLVEFEYHSQYIAKKTLVPIPMAGRVFPLFCLS

SEQ ID NO: 59984 - protein, 104 aa, Sorghum bicolor
  Clone ID: 7551288.pep
GGRAPELLVTHDRAVALVKEFADKGKVVASIGHGHLLLAAAGLLRGRKCASGVPMRVVSRLAGAEAVEAAAAVVDGRLVTAASWTDLAQFVARVIDLLGISVSF

SEQ ID NO: 59985 - protein, 85 aa, Sorghum bicolor
  Clone ID: 7551310.pep
PPHGGPPGGYGQQAGYGGPAYGAPSGPYGGPGNYDQHQHNQYGGAPTHANQYGGGGQQYPPPPGQHQAGYGGPPGGHHTPQPGWQ

SEQ ID NO: 59986 - protein, 35 aa, Sorghum bicolor
  Clone ID: 7551325.pep
TGSQPKAPNNKGVSINSHYMCRTKQQHRASPNREK

SEQ ID NO: 59987 - protein, 106 aa, Sorghum bicolor
  Clone ID: 7551326.pep
SCFSAYSLVISSPCPPLWLCYRHQWKNSVNQWPSRFAACQPPPQEDKNGIRTTPGGRPVMVMRKPAGMSPDRPLPPPRRRCSSRPPCRSRSGSRTRGTPRSPRRPA

SEQ ID NO: 59988 - protein, 189 aa, Sorghum bicolor
  Clone ID: 7551369.pep
MEVEEAGELETAGKDVAEAEYHSHDFEWEELKEEVESGPAFSYHLSPFPEPAASTTSPPQLSSEAWRSFHRRHASGKFFKERRYLLKEFPELCSSKDHAKVLEVGCGNGSTAVSILRSSERITVFACDCSKDTLERANEIISNTKGIDIKDRFHPFLMDVSKETFPDWLFCKACQCSLGKDAALLLGYT

SEQ ID NO: 59989 - protein, 68 aa, Sorghum bicolor
  Clone ID: 7551389.pep
YLWGKTLKNLIHIIQIFATYNQQKLALTCPKVMVKVETKKKSCPGKTSISPFPQVNAGFNTILNKRTG

SEQ ID NO: 59990 - protein, 146 aa, Sorghum bicolor
  Clone ID: 7551420.pep
SDPSHHGIRKEHPVFLRENQCCAGGMDFITMIFTLSAIPFDIMPTTIEQCVSVLKPGGLLLFRDYGLYDMTMLRFLPHQRVGFREYMRSDGTFSYFFSLDTVRELFHAAGLVELELEYCCVKSVNRKKGKTMQRVWVHGKFQKPPT

SEQ ID NO: 59991 - protein, 141 aa, Sorghum bicolor
  Clone ID: 7551441.pep
TRQTCIHHRRTTLLYSQKHTGSARVKKKAQKGKEENGPGHRHTHTPGRRRRAAERRSPVSVSHTPRRRRRRRRRLLAGYTEASAQNSSGTTHRIATMIHDRFRSRSKPEEPRGLLRLALAEPPLGLPLRSGSTGAGGLARR

SEQ ID NO: 59992 - protein, 64 aa, Sorghum bicolor
  Clone ID: 7551456.pep
GSGRLFYNPYFLYQSVVFFFPNKSATNTTSTYGNPQMAKCIASLGSSGPMPSCTLLNRYFYMYC

SEQ ID NO: 59993 - protein, 131 aa, Sorghum bicolor
  Clone ID: 7551539.pep
VRKCVVIMEGNPHPGAIKGRMSFQNFNPSIDKLNEEARGDRQTESASPSNSSRGDEVPASRSRDFDIPSSESISMNELKRKEPELDMETPASYKEPKTNVDSRSSSQSNGRGSHKSNKREKLDFNHLRPKK

SEQ ID NO: 59994 - protein, 86 aa, Sorghum bicolor
  Clone ID: 7551551.pep
TVASPAAASLPRMQLLAADSMRLLKHARRAPASWRHTQAGADEAGKAARAVLSYAGCRLSLFPSQLRRHAPPVAREIHCSRLPSVR

SEQ ID NO: 59995 - protein, 101 aa, Sorghum bicolor
  Clone ID: 7551559.pep
LSSFTEASSQIPLLGNEMQSQVASLASNGLPMPFTQEAAPFAYGSSTNSREMLNNNLALSNSGINSSLPNLRIDGSVVPRQTLDGGNSGGVPFIDGDWELV

SEQ ID NO: 59996 - protein, 118 aa, Sorghum bicolor
  Clone ID: 7551600.pep
REPTAFDILSFSPGSDLSALFLGAGKERVFVGEPVAAVVARVEAAGRKGGYRVRRDGKRATAVYVEEEESGVVVAKVSVFRIADAVSVVEVVKGDGPDAVVFWSELLEPAVKPPALSC

SEQ ID NO: 59997 - protein, 194 aa, Sorghum bicolor
  Clone ID: 7551635.pep
LAIAERLGLEGAAVVISSRKQKNVDEAVEGLRAKGITAVGSVCHVSDAQQRKSLIETAVKSFGHIDILVSNAAANPTVDGILEMKEAVLDKLWDINVKASILLLQDAAPHLRKGSSVIIISSIAGYNPEQGLTMYGVTKTALFGLTKALAGEMGPNTRVNCIAPGFVPTRFASFLTENESIMKELNERSKLKRL

SEQ ID NO: 59998 - protein, 172 aa, Sorghum bicolor
  Clone ID: 7551639.pep
MASKSTMHSLVLLMGLLLLSCSGTSSAARLLEEVAAPKEEYPHPEVPELPKPELPPHPTVPEFPKPELPPHPVLPELPKPEVPVHPAVPEKLPKPELPKPEVPEHPAAVPELPKPELPPHPTPTVPELPKPEVPEHPAAVPELPKPELPPHPTVPELPKPEVPEHPAAVPEL

SEQ ID NO: 59999 - protein, 45 aa, Sorghum bicolor
  Clone ID: 7551662.pep
VLKVINVNDLRSSHNPKSTQILIWKLSNSLFKKRLAKNKQLYLHT

SEQ ID NO: 60000 - protein, 162 aa, Sorghum bicolor
  Clone ID: 7551679.pep
KELNLQNMGKSRSGALTTPIDQVAVIELLVPSIFRAVVSLHPAGSTDPDAVAFFSPTEGGSYLHARGTSVHHVFKHVKEHADKALQYFISVEPNKALSLLLRWIASYQTLFTKVCSKCGRLLMMDKSLALLLPPVHRPYHQTSSIGPDLQEAYHIGCSSYDG

SEQ ID NO: 60001 - protein, 86 aa, Sorghum bicolor
  Clone ID: 7551688.pep
QSRGEGGAAGGYEAGGGGYGAPRKGGGYEEGGGGYGGPRKEEGGYEAGGYGGGGGGYGGPRKGGGGYGGGGGYGGNRGDSGGNWRN

SEQ ID NO: 60002 - protein, 96 aa, Sorghum bicolor
  Clone ID: 7551694.pep
VVEALATSASRSGKDHCVALLVSLCRHGGDKVVALLGRMPGLMSSLYTMVADGGSPHTCKRARALLNLIHRHYEMDGQPASASAASEAGERVVRVL

SEQ ID NO: 60003 - protein, 65 aa, Sorghum bicolor
  Clone ID: 7551699.pep
NRCVSDDVAVFVLDLSWRAARGDQRERYRQRAQARRPAAKGRDDGLTPEQRRERDAKALQEKAAT

SEQ ID NO: 60004 - protein, 43 aa, Sorghum bicolor
  Clone ID: 7551723.pep
AQTVAGPERGVHGPGPVNGPQLGHRFRRVVLLLPLVGMPGLHR

SEQ ID NO: 60005 - protein, 77 aa, Sorghum bicolor
  Clone ID: 7551729.pep
TSKCKPYVRTHIIHQMFINAYIGRPITGWSLAPGSGSRPLGALATQVQPKGATPARGGAQSFQASAAPARKQGAPAP

SEQ ID NO: 60006 - protein, 135 aa, Sorghum bicolor
  Clone ID: 7551731.pep
KASTKKEYSKEEDPGVQSVKTIFNYYKKYGYNTIVMGASFRNTGEITELAGCDYLTISPNLLEDLLNSNEPVPKKLDASQASSLDIEKKSYINDEALFRFDFNEDQMAVEKLREGISKFAADAVTLKSILKEKLA

SEQ ID NO: 60007 - protein, 40 aa, Sorghum bicolor
  Clone ID: 7551737.pep
TFPKCLPKQHAQHIKCEPQKIPFKINPLFTGTPDPLLTRN

SEQ ID NO: 60008 - protein, 83 aa, Sorghum bicolor
  Clone ID: 7551748.pep
TSTMVAKKKNNQNQSGERFTLPQQTNGQSFKPKNLIKNVYFAPEIKFGAIASPITIRGRRSSTGWPFQIHFCHNSSPPWPAGS

SEQ ID NO: 60009 - protein, 71 aa, Sorghum bicolor
  Clone ID: 7551757.pep
RESRDLDPSLGSSSCFTPSHTVHSSSLCTDATPKTNTCDAGRRNLGRSNQINRGWQHRELIQSNHTKTQSQ

SEQ ID NO: 60010 - protein, 160 aa, Sorghum bicolor
  Clone ID: 7551766.pep
VDQDQLASSTGRTVKTEGPPWYPCRLKALKSTPVFFFFDLAASATEEALEELGSPKAFQPFPFPASSSESELKSSSEDTLWDSLRSTTLFVSSPAAAGLEALPPFSFPPNWSESEPEESPEDTSSGSTDGAALFISDTRKRGQRHSIRSPQRSRGFGASC

SEQ ID NO: 60011 - protein, 167 aa, Sorghum bicolor
  Clone ID: 7551772.pep
TRLKTYLDSKPWDLTGFVDLILAQTTVGTVVKLADDDDEEGEGNGAEKANSSNNTDDDDLFGLISVLNLGRHAEQKCIKDLKEYLLAVCADKGTKKQLRSLLEDKASSVGLLVCRRFVNFPYELVPKLYDALFDEVSWATEDEPTKELRDSFRFKQYLLVVRMLERK

SEQ ID NO: 60012 - protein, 209 aa, Sorghum bicolor
  Clone ID: 7551800.pep
SISGVELRAAASALKRLGDGPRAHSLLLSAHDQRLQLNMQTIQPSSTSYGGEYTASLAQQIFPVIAQALNDSAEVFGDEPAYTSELVTWATKQAMSFSLLVKRHALASCAAGGGLRAAAECVKIAIGYSDLLEARGLSLASVLMKQFRPSVEQALDSNLRRIEESTAALAAADDWVLTYPTGIRPLARSSAGNLSLQPKLSSSAHRFNS

SEQ ID NO: 60013 - protein, 167 aa, Sorghum bicolor
  Clone ID: 7551818.pep
ARGLLTRCLDDVDDEVRDRAALNLKLMNEEDDEMAARFVKNENMFSLPYFEQQLVLYVTSDDKSAFDSPFDIAKIPVVTREQADAEDRSKKLIATAPTLKAPKVGPTKPTGAEAVASASAQAQRYAQELLEIPEMKEFGSVLKSSPVIELTEAETEYVVSLVKHIFK

SEQ ID NO: 60014 - protein, 123 aa, Sorghum bicolor
  Clone ID: 7551833.pep
MATPTSSGDGSPPGSSDLVPPSYPEMIVAAIAALAEENGSSQAAIARRIEAEARGDLPASHPALVAAHLSRMSAAGELVAVAGGKYALPPPPPPPPAPPALESPADDEEEEDDCADDEEEEEE

SEQ ID NO: 60015 - protein, 121 aa, Sorghum bicolor
  Clone ID: 7551849.pep
GLWQLANAAGHDIQNMAGYYLTAIHIAIYPKPKLNTTLTISKVHTHRPRVNLPATQQKPKHTMKANPQYAYMLEIVLYLYLVLLSIKARVHATPPQEPLLLLNIVLPPAGLPPVPLPLLLL

SEQ ID NO: 60016 - protein, 138 aa, Sorghum bicolor
  Clone ID: 7551880.pep
LAYSLQHADCAGAVFYSVMKSALVAAQSTNDTLLKTTADALGKWKDLLRNYTKTVDEEMEILLKFEEMCQETTKEFSPLFPTILPYLYDREVVSEDAILRWAEEKEHADESDKVFVKQSEAFIKWLKEAEEEDDEEEE

SEQ ID NO: 60017 - protein, 79 aa, Sorghum bicolor
  Clone ID: 7551886.pep
HQVILAIIDKAMRAFFATGMAPDRVLPSDDWFIDVAQESISRISGNPRFPNGARDREVNSPPPSVSAQSVSSVRFFGSS

SEQ ID NO: 60018 - protein, 153 aa, Sorghum bicolor
  unsure (1)..(153): unsure at all Xaa locations
  Clone ID: 7551899.pep
VPLDGDEAAGGKGLVDVDVLSLGPRERRALLERLVRVADEDNERFLLKLKDRIDRXGDPSPAPRRAARGCTRIRCLTISGRCRVGIDMPTIEVRFQNLEAEAEVRVGSSGLPTVLNSVVNTVEEAANALHILPSRKRIMPILHDVSGIIKPRR

SEQ ID NO: 60019 - protein, 46 aa, Sorghum bicolor
  Clone ID: 7551902.pep
LGKTVGGGRVVANVRMAYSSKTGVTTKITVRSEEENVAALVIASVA

SEQ ID NO: 60020 - protein, 88 aa, Sorghum bicolor
  Clone ID: 7551915.pep
PRPAGFPAGVPGAAPIGAPGAAASPAAAPRRRGRPPKPRDPHAPPKIPRPRGRPRKNPLPEGMVPRPRPGAPTSAKAARPQFAEVGFV

SEQ ID NO: 60021 - protein, 136 aa, Sorghum bicolor
  Clone ID: 7551979.pep
MVQIKEFRIVMPMSMEEYEIGLSYTIMKMEQQNTNSKEGVEVLRQVPFEDEKLGKGQFTSKVYHLQSKIPSWMKGFAPSSALTVHEDSWCAFPKSRTVIKCPLFSKCSLTIDTVTRPDNGCSENVHNLTSEQLAAR

SEQ ID NO: 60022 - protein, 46 aa, Sorghum bicolor
  Clone ID: 7552010.pep
MGTHYTCLIYDILLSTDIPCTARRAFAANTPPPTGIGCQRNQWAVT

SEQ ID NO: 60023 - protein, 127 aa, Sorghum bicolor
  unsure (1)..(127): unsure at all Xaa locations
  Clone ID: 7552013.pep
SDPTKVLFKTLRGQIPADAEEILFQAAHLESHQLQYQKAARCLADRTAQTQLSEEMRKEKLLTDEKHKNIGALKSSEDALEQKISDLSAKREALLAELKQVEDALSQAQQEKNQLPETIKLSEGGXR

SEQ ID NO: 60024 - protein, 62 aa, Sorghum bicolor
  Clone ID: 7552022.pep
VIKSIGFLVPGLSLILEPLVSFAVKNLSCHLKNLEHQISFVMLEDLVNLFILRAFGTNYPRK

SEQ ID NO: 60025 - protein, 49 aa, Sorghum bicolor
  Clone ID: 7552088.pep
CIFPPFCVHSKNIKQLKHGSQRGTFLKLQHSAFEKGLGFPDFLHWAKEK

SEQ ID NO: 60026 - protein, 76 aa, Sorghum bicolor
  Clone ID: 7552107.pep
SRGFFFFFFFFFFFFFFWRRRFHFIPSTVTHPRAHLHHQISTNVNKRAPHPTCHATTYDSTATLLHCQRRPTSRRW

SEQ ID NO: 60027 - protein, 89 aa, Sorghum bicolor
  unsure (1)..(89): unsure at all Xaa locations
  Clone ID: 7552123.pep
VFTSFPHGTCXLSDSPQYLALDGIYHPFGAAFPNNSTHRKCITKHWKACHXTGFSPSMTLYSNRLIHGPARKTXSRDYNSNSEAAKFQS

SEQ ID NO: 60028 - protein, 115 aa, Sorghum bicolor
  Clone ID: 7552149.pep
MVLIGIIMSFRFTPHYSIPQYVISALITFVFAEVLEGVNLSLLSRVMSSRLSRGTYNGGLLSTEAGTLARVVADATITAAGYLGTDLLLNITLVPSLVICIVSIAATLYTYNNLY

SEQ ID NO: 60029 - protein, 81 aa, Sorghum bicolor
  Clone ID: 7552153.pep
SAYDEVEIEDMEWNAELKAYTYPCPCGDLFQITLDDLRLGEEIARCPSCSLFLTVVYNAEDFPDAKEPTTQKPSPSPVAVA

SEQ ID NO: 60030 - protein, 37 aa, Sorghum bicolor
  Clone ID: 7552164.pep
SMQLILSSDQDWEPSELTRNLVHGDLKASSPICSSHL

SEQ ID NO: 60031 - protein, 83 aa, Sorghum bicolor
  Clone ID: 7552167.pep
FLLLLLPIARSSLYSDKLFTTHHDPPANSRTPRELYSSSAGMLYVELVANTLQLVHVILLVRGGVRPGRLLVHLLDDRAAHLL

SEQ ID NO: 60032 - protein, 77 aa, Sorghum bicolor
  Clone ID: 7552185.pep
MAHWVSDGDGSDSFEWDSDGNGEEAGSFNTAGARSSAMASTNTDAPGPSRRVSQVANGNGKAGPSASLVQRYIDMGF

SEQ ID NO: 60033 - protein, 94 aa, Sorghum bicolor
  Clone ID: 7552186.pep
ASRKRSRRMSASASAASYRSASASASAASLRSASPSPPLSPATAASASSASISISISMSMSRFGSGSMAQRRAELPRAAASQQWRPERGVCPRA

SEQ ID NO: 60034 - protein, 92 aa, Sorghum bicolor
  Clone ID: 7552196.pep
MTKRTKKVGVTGKYGTRYGASLRKQVKKMEVTQHAKYTCTFCGKVTVKRQATGIWDCKSCKRTIAGGAYTVATPAAAAMRSTLRRLREIAEV

SEQ ID NO: 60035 - protein, 164 aa, Sorghum bicolor
  Clone ID: 7552256.pep
PASSHVGGSWRPAQAAAGAPAGVQGSPALEQQSPRASSRSLLRRAREPPVSPGSRAQRPLLQLVVVPRSAALQAAEDALGQALVALVLGTRPALAPADIVHHLRSHYGIPEERVTVRRTRPNDFLVRFADNDDLLRVLANQRPVGARFLLRWRRWSRLISGSAG

SEQ ID NO: 60036 - protein, 62 aa, Sorghum bicolor
  Clone ID: 7552279.pep
ARGRPPARISSRLLPAGPPTSFRATWRLPPRSHSRCRTRTMKSLRACPRDWTPALYSFECDY

SEQ ID NO: 60037 - protein, 42 aa, Sorghum bicolor
  Clone ID: 7552313.pep
CLKNPARGISGLNAGNAASIPSKWGVRVPYTISPSPDCSRVN

SEQ ID NO: 60038 - protein, 39 aa, Sorghum bicolor
  Clone ID: 7552319.pep
FAQGGLPIGLAPGEEGNPGLFHVFLLANPSLEGAPLPCA

SEQ ID NO: 60039 - protein, 107 aa, Sorghum bicolor
  unsure (1)..(107): unsure at all Xaa locations
  Clone ID: 7552336.pep
DRFRLAVISIATAEGKKAGMTVADPVVACVADLAFKSAEQLAKDAELFAQHAGRKSVRMDDVILTAHRNEHLMGLLRTFFQELKGKEPASXRKRKNPSKKDERVIDV

SEQ ID NO: 60040 - protein, 79 aa, Sorghum bicolor
  Clone ID: 7552530.pep
IRGLLVKEPECRLGLSRGAAEIKRHPFFEGLNWALIRWTAPPETPKNIDTAAALATRKKKEGKCLEFRLNGDDIEFELF

SEQ ID NO: 60041 - protein, 224 aa, Sorghum bicolor
  Clone ID: 7552547.pep
QSITFFTKQASTLDRRIGSIVVPAASLQNLISASVMVSLPIYDRILLPMARKYTKNPSGITMLQRIGVGLAISTAMAVIAALVETRRLKVASDYGLLDNPQDVIPMSFMWIAPQYIMVGFSDAFAIVGLQELFYDQVPHSIRSLGLGLYFSIVGTGNFISSFLVYTIDKVTSSTGGSWFSNNLNRAHLDYFYWFLAVLSAFGLAAYMYFAQMYVHKKKASISAQ

SEQ ID NO: 60042 - protein, 123 aa, Sorghum bicolor
  Clone ID: 7552552.pep
PAHFHPIFFPIGNFATGFFVLFSLLAGVVGIASAIVGFNHLRFWNYHSLQPAAALGLGAWALTVLAMGLACQEISFDRRNAKLGTMETFTIILTVTQFFYVLAIHGGSHGPAVPVERRRNFAG

SEQ ID NO: 60043 - protein, 115 aa, Sorghum bicolor
  unsure (1)..(115): unsure at all Xaa locations
  Clone ID: 7552557.pep
SHPDTXKIYEELRYLLAHMKEAGYIADTRFVLHDVDQETKEDALLAHSERLAISYGLITSAPRSPIRVIKNLRSCGDCHTAFKIISKLVGRQIIARDAKRFHHFENGVCSCKDYW

SEQ ID NO: 60044 - protein, 102 aa, Sorghum bicolor
  Clone ID: 7552566.pep
ENLKTMARFCAFQIAKILEDNKFSWDSITMLRFYYSVDLSMAADALRGAFSEAFAELAEDNSSMRTDKIPFYNIVPVAGSGRSACTNDIMTCELLASNISSA

SEQ ID NO: 60045 - protein, 86 aa, Sorghum bicolor
  unsure (1)..(86): unsure at all Xaa locations
  Clone ID: 7552586.pep
TFQELMKDQXGNYVVQRVLQTCDDKYLEMILSSIKLHLNELKNYTYGKHIVARVEKLIVTGEKRARMASLSGQHQQPPNCTAVDAH

SEQ ID NO: 60046 - protein, 54 aa, Sorghum bicolor
  Clone ID: 7552624.pep
HEAQEVQQMSLDGDLGNNILPNQACSSSDGGNAWRARCDQNSVNPSTGSYDQFE

SEQ ID NO: 60047 - protein, 71 aa, Sorghum bicolor
  unsure (1)..(71): unsure at all Xaa locations
  Clone ID: 7552625.pep
ARGSLPLLIQLSSSLPFPIPTQKHKLKHKKHNRKKLKKLRQAASPRRRRRRKPRRREREMGSEGSTSPGGX

SEQ ID NO: 60048 - protein, 72 aa, Sorghum bicolor
  Clone ID: 7552678.pep
PPHTLSYRSSQSYSLFLCVCFCKVCVPHIDVSQHLGLCRMQSNSAFARKLPTVYKWGVTDMGPQVIRSGPRA

SEQ ID NO: 60049 - protein, 78 aa, Sorghum bicolor
  Clone ID: 7552681.pep
ARGYDAISHLKTLQKKKPKPSKGKDDGQGEQAYVVVEASKFKRVGRKTTLRQDLANALDIRAFERMTKLGHCDVELLT

SEQ ID NO: 60050 - protein, 86 aa, Sorghum bicolor
  unsure (1)..(86): unsure at all Xaa locations
  Clone ID: 7552697.pep
TRAEALLLRLLRAKADEFMRQSDGVSWMADDPPPGGNEYANEVIIYLETLTSTAQQILPLPVLRRVLVAXLAHISERMIELFLNDS

SEQ ID NO: 60051 - protein, 62 aa, Sorghum bicolor
  Clone ID: 7552705.pep
RPPPSASTIPALTLPSTPRTESAVRPSRVSLGSKFHEAGTDVATPLPALFSIARGAVVAPSC

SEQ ID NO: 60052 - protein, 51 aa, Sorghum bicolor
  Clone ID: 7552726.pep
RSDWWRMQIQRILYVLDMTRGRIHWRSRVAWLLINFFLRRICLPGAFCYAR

SEQ ID NO: 60053 - protein, 102 aa, Sorghum bicolor
  Clone ID: 7552753.pep
WTKDSNSVTVRFMYTSIIGVANAGAEVLYCATAYRRVVSTFIPKLQATQQPQKQNLVSRNDGSILQLRNLRFRSPRRLFHHKSSIVMVNGALSFFLGPKLIS

SEQ ID NO: 60054 - protein, 81 aa, Sorghum bicolor
  Clone ID: 7552804.pep
THELPSRRRLPQRPPTRKGIGRKNHLAVGTARLSLPPPYIKQPPHRSELQIRPSEFLRSANQSIHQILTSASEHETRRGPD

SEQ ID NO: 60055 - protein, 64 aa, Sorghum bicolor
  Clone ID: 7552871.pep
SEKSSARSVDGRTVDQPVASPTWCTDHRVSVRTARGVEFEFKFFAPVDPSMDRVVCTARYCLIV

SEQ ID NO: 60056 - protein, 59 aa, Sorghum bicolor
  Clone ID: 7552874.pep
GSPGLQGPRPGPGGCAAPALGARPAWCAGCPVRPDCSHLQRRASHLYLVKLSDGCKLVL

SEQ ID NO: 60057 - protein, 73 aa, Sorghum bicolor
  Clone ID: 7552948.pep
STCPWRSSPRPGADAGARRAPRTSTGCAPSELAVRAAAAAAPPPPPPSSAARRKDDDDAVVGCKSACLAFASC

SEQ ID NO: 60058 - protein, 86 aa, Sorghum bicolor
  Clone ID: 7552959.pep
LIAKKLREFHDLDMPGPRDVSLWQRLRRWLEEARGRCSEQEFNQFQLDKLGDEIAVLEKTLSGVEQSVGFCHNDLQYGNIMIDEET

SEQ ID NO: 60059 - protein, 101 aa, Sorghum bicolor
  Clone ID: 7552968.pep
TRLGLNTGGNTVPWIHPLPLTTIPLSMLCFAGFLWWEGKAKQPIIPVALLRDRTVLSACSASLFISMLLMATTFYVPLYLQVLGDSTTTAGLKFLPSPLGG

SEQ ID NO: 60060 - protein, 59 aa, Sorghum bicolor
  Clone ID: 7553003.pep
VSGTARRRQEQGQGPPRLRVRTGRGPGGGASDGGRAPPCPRRGPPPLPWRRKPGSKPRA

SEQ ID NO: 60061 - protein, 150 aa, Sorghum bicolor
  unsure (1)..(150): unsure at all Xaa locations
  Clone ID: 7553023.pep
MTMTHAGATGVKFTFRNNCPETVWPETLTSSGXPPGASLSFSGVGATWSGRMWGRYRCTATTSPVGGARFSCESGDCGXAPPATLAEFTLGGGGGGNKDFYDVSNVDGFNLPVEIEPAAGGRCRSTSCPAVRAAAAAAPPPPPPSAARRK

SEQ ID NO: 60062 - protein, 64 aa, Sorghum bicolor
  Clone ID: 7553027.pep
PGIVPGSDQGQEVVGELLPQDGGGDPSRRHATWQRPMSWWDGVPTPEVTFRSSCAMLGSMSLRK

SEQ ID NO: 60063 - protein, 76 aa, Sorghum bicolor
  Clone ID: 7553044.pep
SAAYQSNLKEMLWDIFGDRVGGPEEIQRILDGLDELKHLPEGWWHGVMATFNGLLGCSGPFQHLIGQTTHAALKDG

SEQ ID NO: 60064 - protein, 75 aa, Sorghum bicolor
  unsure (1)..(75): unsure at all Xaa locations
  Clone ID: 7553047.pep
QPEVYEGNFKGTYIRPGNSWDLSKCKXKSGETLREYARRFSKQRTDHPXFVSGTTSRDLVSELGRNRPQNVDELS

SEQ ID NO: 60065 - protein, 122 aa, Sorghum bicolor
  Clone ID: 7553072.pep
APPVQKHIRDIAQYFHLPLRDASKTLKIGVSILKRKCRQYGIARWPHRKIKSLDSLIHDLEYVHQLQKERLAAAITALAKRKSMLESEKETIQQKPTMDLMAETKLFREDSSVMDDMDFGMV

SEQ ID NO: 60066 - protein, 72 aa, Sorghum bicolor
  Clone ID: 7553075.pep
ALDASLQYGEGVLKYEHIFEWLPPQKTKYYFCFPEKYVACNLLGLVMFTCLKKMLASRVVTWTPIWLTVWPK

SEQ ID NO: 60067 - protein, 161 aa, Sorghum bicolor
  unsure (1)..(161): unsure at all Xaa locations
  Clone ID: 7553085.pep
HSGEVALPGGKAEEGDADDAATALRESKXVTSLEHVLSKHLLVVVPIVGILSDINTFKPVPNAAEVDKIFDVPLEMFLKDEXGQEFTIHHFSYAKENEKYMIWGLTAGILIHAASVVYQRPPDFAEKRECHGQSLSTNLDSTSSAISIVTYILHTTDYTLN

SEQ ID NO: 60068 - protein, 73 aa, Sorghum bicolor
  Clone ID: 7553112.pep
DDDAHGLQRPAASEKRAPEHGPKLPPTSTRVPARSGRRRRRRVRIGGEKSEKYFFSPFFFARRNWSFSANPRA

SEQ ID NO: 60069 - protein, 49 aa, Sorghum bicolor
  Clone ID: 7553128.pep
WPPRPPRPPRPPPGAVAAAEAPRGRRGSSTARLPPLLILLELKLGSHED

SEQ ID NO: 60070 - protein, 87 aa, Sorghum bicolor
  Clone ID: 7553134.pep
ARGFLARLKPSHPAPGRRGPPIAIKKFKQSKEGDGVSPTAIREIMLLREINHENVVKLVNVHINHADMSLYLAFDYAEHDLYEIIRH

SEQ ID NO: 60071 - protein, 62 aa, Sorghum bicolor
  Clone ID: 7553139.pep
RDHGVKYVYVWHAMAGYWGGVKPAAEGMEHYESALAYPVQSPGVMGNQPDIVMDSLSVLGLG

SEQ ID NO: 60072 - protein, 72 aa, Sorghum bicolor
  Clone ID: 7553144.pep
HEETAIYPIDLVKTRLQTYSGEGGKVPRIGQLSRDILVHEGPRAFYRGLVPSLLGIVPYAGIDLAVYETLKD

SEQ ID NO: 60073 - protein, 96 aa, Sorghum bicolor
  Clone ID: 7553190.pep
RRRSRCRGRQTTALSASDRSQRGKTGVHGEPPHQGRRAVQDRRQEFRVPEDLPGTVRRQGLASRRRCRRPLCEQHDVTETKLCSKFRAFSLNGLHV

SEQ ID NO: 60074 - protein, 34 aa, Sorghum bicolor
  Clone ID: 7553208.pep
GFYKGILPNLLKVVPAASITYIVYEAMKKNLSLD

SEQ ID NO: 60075 - protein, 45 aa, Sorghum bicolor
  Clone ID: 7553239.pep
FKKPRPGWFGFLSFSFLVCSVEGKRLMYYPFIPFELIISTSNLFN

SEQ ID NO: 60076 - protein, 143 aa, Sorghum bicolor
  Clone ID: 7553242.pep
SKMLEYDPRKRITAAQALEHEYFRMEPLPGRNALLPSPVDTTTDFEGTTSLQPTQPPSGNAPPGGQSVARPMPRQMPQQPMVGGMPRVAAAQAGMAGLNPGNIPMQRGAGGQSHPHQLRRKADQGMGMQNPGYPQQKSHLASD

SEQ ID NO: 60077 - protein, 171 aa, Sorghum bicolor
  Clone ID: 7553269.pep
GLQFTTIPQQICQCQCKLPKPLTSIVSSPLHSLFVFFPALQHQVEKGKNFITYPNNSSTRAQVFLCTNYTFSEYWQGTQGPEGVQWYEAFPCASTKPSSDLRAPLAVDAAAAAAAAAAIAGGIQHRAATLTRSSSRSRHRQEVAAVALFAMASAVAALAVSPTSLLRWREN

SEQ ID NO: 60078 - protein, 137 aa, Sorghum bicolor
  Clone ID: 7553270.pep
LQFVCEYAGEFLTTEEARRRQKLYDELASGGNLSPALIVIREHLPSGKACLRVNIDATKVGNVARFINHSCDGGNLHPVLVRSSGSLLPRLCFFASRDIVEGEELTFSYGDARVRPKGLPCFCGSSGCSGVLPSEET

SEQ ID NO: 60079 - protein, 78 aa, Sorghum bicolor
  Clone ID: 7553305.pep
ATHLIRSVARHQERRGPPATAAGGAPELGVGQVVAAELGDGQEGQHDGARRRRPRHQRRRRVQERRRRPRHLLAPATS

SEQ ID NO: 60080 - protein, 110 aa, Sorghum bicolor
  unsure (1)..(110): unsure at all Xaa locations
  Clone ID: 7553362.pep
GNQNKLAQLTECNSNYASHLSVDQQQVAHIYISRLDGGRKCYERRMEYEINQRTDTRFTWKTPPMRRGKTTGTSQQRSHYLKSFFWVTRLRRLTRESSLHETLARVYTXT

SEQ ID NO: 60081 - protein, 89 aa, Sorghum bicolor
  unsure (1)..(89): unsure at all Xaa locations
  Clone ID: 7553425.pep
MRKPNKXILEHDRXKRQVELRLLVLRDALEEQGYTEAEIEARVDEARKAAEAEAAAEERQGFTDTQSHHAAEQKERQLQTMRTAFGLES

SEQ ID NO: 60082 - protein, 47 aa, Sorghum bicolor
  Clone ID: 7553427.pep
QPEKKSKIYFSMRMMQRMPFPLTIRAKALLISGNGPLWGMNFSTSSS

SEQ ID NO: 60083 - protein, 81 aa, Sorghum bicolor
  Clone ID: 7553440.pep
MDDETVSQFTRVHTLFRGHGHMLDQNSVHFCHFQNLLETAMGLGLGRAGAASLGTTTGNTPFSTGALIPSTRTFSGSATAR

SEQ ID NO: 60084 - protein, 67 aa, Sorghum bicolor
  Clone ID: 7553457.pep
MNIEMGANLVSLMATHCQHRKRGKGVENTKKIIDLLAIFAPSMQASVVYVQNQLYSVIMILTFAEVA

SEQ ID NO: 60085 - protein, 37 aa, Sorghum bicolor
  Clone ID: 7553458.pep
FVHGRKIAGPVLLSLLTPPLKAAGAFPPSMKVAPAGN

SEQ ID NO: 60086 - protein, 60 aa, Sorghum bicolor
  Clone ID: 7553482.pep
NKLGGSATQHCVYNTTMHACSVQSNQIRVPGKQLVNGEPWSGGADQPPRASLLVGSWRMS

SEQ ID NO: 60087 - protein, 51 aa, Sorghum bicolor
  Clone ID: 7553488.pep
GPGNKMDGKVPVYKARSGGGSMALEVCVAPNALAKFVADEEFMDAVSAPPA

SEQ ID NO: 60088 - protein, 57 aa, Sorghum bicolor
  Clone ID: 7553497.pep
VDPFYPGGSFDPLGLAEDPEAFAEFKVKEFKNGPLAMFSMLGFFVQAIVTGKGPFKN

SEQ ID NO: 60089 - protein, 85 aa, Sorghum bicolor
  Clone ID: 7553508.pep
PSAVSFTSTTDRGSEVTPINCTDPMTQDLYEMNSSRLSDWTHEFTVYRRAHDGFSLLTQQRDAHSTADGGSSGGTGISPSVGQAT

SEQ ID NO: 60090 - protein, 140 aa, Sorghum bicolor
  Clone ID: 7553554.pep
RNPRRDKMGPGPPGRGRGRPEGKERNMAIACPTCQLQPVECRGRATARRSARRWTGNHTHTQWRGLLHGGPYRPLVTDRDVELPHKQRPGLTHLGLFFAGCLYVLSTLELAEGWRVRSAGEKLHSPNMMRRQRPMHSFGF

SEQ ID NO: 60091 - protein, 113 aa, Sorghum bicolor
  Clone ID: 7553563.pep
MGVALLRELVRLWPVVCPGTSGCDGDPLINPMAEGAPNLSTLGCRRVLVCVGGKDPMRGRGRLYCEKLKGSGWRGEVEDWEADGQGHGFHLSCAMSAEAEAQVRVIAEFLSYG

SEQ ID NO: 60092 - protein, 31 aa, Sorghum bicolor
  unsure (1)..(31): unsure at all Xaa locations
  Clone ID: 7553585.pep
RHPFSGLIDSAGELLHTPXRISTSMTTVLLF

SEQ ID NO: 60093 - protein, 125 aa, Sorghum bicolor
  Clone ID: 7553592.pep
DTVLPHPWFRAICLESGSGRPVGAVSVSPTGDPCRAELGYVLARAHWGRGVATAAVKRAVATVFAEVQGLERVEALVDVANPASQRVLEKAGFRREGVLRRHYWHKGRARDMVMYSFLSDDTLPE

SEQ ID NO: 60094 - protein, 54 aa, Sorghum bicolor
  Clone ID: 7553599.pep
AVSKLMDEGEAAEEMRMRAKEFGAKARKALEEGGSSYNSINLLIHEMGNLGKGI

SEQ ID NO: 60095 - protein, 103 aa, Sorghum bicolor
  Clone ID: 7553604.pep
REMLARQMQKRLTAEEREHLYTKWGISLDSKKRKLQVARRLWTNTEDLEHVRDSASLVAKLIGLQEPGQVLREMFGLSFAPQQQPPPRRRSSNGWRYGIPSFG

SEQ ID NO: 60096 - protein, 58 aa, Sorghum bicolor
  Clone ID: 7553608.pep
GQKARGEKHPDFRLKTHGGGESSRRRISGFSFSYATCVCVCVSVRGYFELQYVLGVNK

SEQ ID NO: 60097 - protein, 42 aa, Sorghum bicolor
  Clone ID: 7553618.pep
TVVQDPKFGQVIQFQGDQRKNVFNFFVQAGIVKKEPIKIHGF

SEQ ID NO: 60098 - protein, 132 aa, Sorghum bicolor
  Clone ID: 7553621.pep
IDRSNPAAAIHSMKQVARAVVKNNLSLILFPEGTRSKNGRLLPFKKGFVHAALQTGLPVVPIVVTGTHLAWRNNSVRVRPAPLTVKVLPPIGTGGWEEARVDEHVEAVRSLYACNLPDSQKPLDALAARKSD

SEQ ID NO: 60099 - protein, 59 aa, Sorghum bicolor
  Clone ID: 7553641.pep
KRFNKKRGVKKRHNLYFCSSFPTGLYPCICMDPGKQKALSGAFPSFVGFKGLGHIPYYP

SEQ ID NO: 60100 - protein, 180 aa, Sorghum bicolor
  Clone ID: 7553649.pep
KRARDYNSDDEEEDDDDQRQEHPPNPRRRRDDGDDDEALSHSEPEEDEDEDGEDEEEGASSSAVTRFEQGCRAFRVAFLKIMAKKLPDNPLGPIMSAHKTLVAAKLAEEVEQHKPKGEARKEKRVAAEKGHVIPKDHLDSKEKELIKVATKGVVRLFNAVNKAQKPRKDLNPSRTKDAKV

SEQ ID NO: 60101 - protein, 54 aa, Sorghum bicolor
  Clone ID: 7553670.pep
MMTSTNEANHPSSLVTLDSCKKREIKTAIIMGTTVHFLAIETTKLGHTFTNFFF

SEQ ID NO: 60102 - protein, 120 aa, Sorghum bicolor
  Clone ID: 7553716.pep
ALSKVAHMEADNAAAARASIERAGRGGGDMALTVWAEHRAPSRPQLGHLLRLGEADREAMVVSGGGREVAAPARRKVQKQKPIVPLVVPLINGVIFSKKRRMKDKESVYMKELYSLLRLS

SEQ ID NO: 60103 - protein, 39 aa, Sorghum bicolor
  Clone ID: 7553724.pep
KEKIAEKPVTLSEKIWHIISTYLHIGNHQFQKIWFRKIG

SEQ ID NO: 60104 - protein, 54 aa, Sorghum bicolor
  Clone ID: 7553752.pep
APGLGLADAGSGGGGKELLPDPSHFEWPSGCDLGSYWGTSVFADTDPALFLNLP

SEQ ID NO: 60105 - protein, 85 aa, Sorghum bicolor
  Clone ID: 7553778.pep
LSVYSCIMPTNFDCFSKLVGCSLLDPPLLSPIDLGKFLFLVVEGVPSFYFYGKITASLAVSRSYCCAFKLELHLPAHFIKIIRFS

SEQ ID NO: 60106 - protein, 85 aa, Sorghum bicolor
  Clone ID: 7553781.pep
KEEEVARKQGEGAPAATTEVKIRITRKQLEELLRRVEGGKHAGAGGAPVQEVISELLSVVNTSSSFRHREEGQWRPSLQTIPESE

SEQ ID NO: 60107 - protein, 166 aa, Sorghum bicolor
  Clone ID: 7553790.pep
AHGTEAVSVSGWARARALKENPEMAARRQRHHVQSAIRFVLIFLVSLVRRRSPSNRSAAVESSRRGEGKESGGEEERTPWRPLQVSRASRNPNPKFPWVRFSQNRVNRSVALGGYLISLSVLFILDSMWIRVCSGAVYLVFCLIWGSALLWVLVPREFLGIFTAVF

SEQ ID NO: 60108 - protein, 73 aa, Sorghum bicolor
  Clone ID: 7553813.pep
SIKATPGVQNCLHWGLPGVPETWNEILAAQLKPVVECAISYIKQVRGKVFIYSNYPGVHFVRLPGKGFMLLIG

SEQ ID NO: 60109 - protein, 59 aa, Sorghum bicolor
  Clone ID: 7553908.pep
MGFLKSTFSLLIGTGCGIYIAQNYEVPNIKKLMWTVMGKAKEFEESYKKKGNGKNKDNE

SEQ ID NO: 60110 - protein, 64 aa, Sorghum bicolor
  Clone ID: 7553912.pep
LHWACLNGHIEVIKALISAGASVSALNSHEKTPMDEAVSKGKMDVIDAIGAAVAQAELDGVTVS

SEQ ID NO: 60111 - protein, 169 aa, Sorghum bicolor
  Clone ID: 7554034.pep
STTTEGPATQSDKAADRIRIIGAHLGALPQPCANKAPEITGSSNRSRPPITTHVLDTARGSPASGIEVHLEMWKDSSAPPSFSNKDFSGWATLGYSVTNNDGRSGQLMDIVDNIAPGFYRISFNTSKYSPAGFFPYVSIIFEIKENQTAEHFHVPLLHSPFSFTTYRGS

SEQ ID NO: 60112 - protein, 141 aa, Sorghum bicolor
  Clone ID: 7554048.pep
ATVAKNVKNKVFSIDFVSDDPSVIACDMAHTPLEPFFIDVAIFCLSLMGINYPSYLEEANRVFKPSGWLVIAEVRSRLDPNNGGADPEKFFKAIIELGFSLVSKDVKNKMFILFYFRKKEKSKLAKSIDWPQLKPCLYKRR

SEQ ID NO: 60113 - protein, 69 aa, Sorghum bicolor
  Clone ID: 7554056.pep
LFVSHKTDDASARLINLIQRKISFGLFESWKLFPSTFLFTFFVALLPFASLRIRDLHLRTWENRLKKKI

SEQ ID NO: 60114 - protein, 146 aa, Sorghum bicolor
  Clone ID: 7554061.pep
RPYSLACSQKAANLLSSHTANSTLGQSPCEGSFVYVGDLASSARFVRLSHYRPRWALLLFIADIPYILENGLSSLLHASAALAVINCLPVYFLDGEAILETTLSYVAWFTPRLQRRILKVCRFVWTVLSVITFSSICYSTVLHGVV

SEQ ID NO: 60115 - protein, 96 aa, Sorghum bicolor
  unsure (1)..(96): unsure at all Xaa locations
  Clone ID: 7554068.pep
SGAPSFSLILPYGTRLALQWILVKXLDCTHSNYQTLTRPXIVIYCHYLPVSGLGNLRACCLXLDVVAVSQAPSPESNPNSPSPVTTMVGPYPTIES

SEQ ID NO: 60116 - protein, 67 aa, Sorghum bicolor
  Clone ID: 7554071.pep
KERNILSSLWVEENRFKQRVWVQGARPEEEEIFQFTMVQRVGGSWDGYWLTESLINDGDAFSGGIAY

SEQ ID NO: 60117 - protein, 98 aa, Sorghum bicolor
  Clone ID: 7554088.pep
MNNNSNKNSNPAGNVGETVGGGFNFLTSTVGNTVGGLGRTVGGVTGAATCGLGDTVTSATGDAGRPIGDGIGNLGTGVQGGLDSISKGVENVGQWKKQ

SEQ ID NO: 60118 - protein, 47 aa, Sorghum bicolor
  Clone ID: 7554109.pep
GAPGPASSATAGRRARGPVASHCSDPSPTKNKFNIEVGTWPTYQILN

SEQ ID NO: 60119 - protein, 40 aa, Sorghum bicolor
  Clone ID: 7554112.pep
FKGNLLGTRGGRSGFFMTTGNSFFLGKSTLLAGTSFHSYF

SEQ ID NO: 60120 - protein, 54 aa, Sorghum bicolor
  unsure (1)..(54): unsure at all Xaa locations
  Clone ID: 7554114.pep
AASLFTFLWCNRGPSPNLFHLPLVTTAVICCWIMXAIVSLAQMKPLINPILSGE

SEQ ID NO: 60121 - protein, 101 aa, Sorghum bicolor
  unsure (1)..(101): unsure at all Xaa locations
  Clone ID: 7554120.pep
FSLRCRKLLGERLEECSIEELHSLEVKLEKSIXHEQLTALHLIFTWQTLLLEEQVNKLKEKVSQFLPASCPTATQKHQNAQLGVVPDLCFVLFAASTSNRR

SEQ ID NO: 60122 - protein, 86 aa, Sorghum bicolor
  Clone ID: 7554124.pep
AAQLWILQLFLSSVTNNLLQLCTDLAVSLLSLSLEVTTPIICSSSRTLSMSPFAVGRDGSQGPDVGDEIGVVGAARGEPDGACGAA

SEQ ID NO: 60123 - protein, 133 aa, Sorghum bicolor
  Clone ID: 7554127.pep
YYPAYVAEKKKCRFNPRKHVVKIDGKRMMRDTTEAKLKCRVYKQPVAILIEANHAFSRYSKGVFTGPCGTRLNHVVVVVGYGTTTNGIDYWIVKNSWGKGWGENGYIRMKRNVRSKAGLCGMYMRPMYPIKNK

SEQ ID NO: 60124 - protein, 114 aa, Sorghum bicolor
  Clone ID: 7554175.pep
AYGPRGSVYRDHDVNSYLRSVRGVVRKEARRAREEAEREQRGRWRLLLWWPFGVHGVSSSSSSGSGSSGRRGGGGGGLVDAVSEAARRAHLLVVVLLPAELLALGALLAVIRFR

SEQ ID NO: 60125 - protein, 48 aa, Sorghum bicolor
  unsure (1)..(48): unsure at all Xaa locations
  Clone ID: 7554176.pep
PGESRFPVQVRVATRKICDPLEEDAFRPILPHXEGPKFRLELSVPEAL

SEQ ID NO: 60126 - protein, 111 aa, Sorghum bicolor
  Clone ID: 7554221.pep
MNTTDIYEFMSARDAVGHGTHTASTGAGALVADANFKGLASGVARGGAPRARIAVYKVCWATGDCTSAHILAAFDDAIHDGVDVLSVSLGQAPPLPAYVDDVLSIGSFHAV

SEQ ID NO: 60127 - protein, 150 aa, Sorghum bicolor
  Clone ID: 7554274.pep
MATIAPRSHLLLLGLTRPQQPTALRACAAFSRSRGAPVPPRAAQPRRVFLGLGATFIDQVTRMASGGTSSRSFVAGARPRQGVSPVEQILKNVEWPDEFPFKPEDFSRFDESSDTLFYSVPRFVTHIDDQAIRALTEYYSEVLPPINTPG

SEQ ID NO: 60128 - protein, 178 aa, Sorghum bicolor
  unsure (1)..(178): unsure at all Xaa locations
  Clone ID: 7554302.pep
MATGGGASETAVGAGEENASASRIPTRRFFVALHVGAGFHAPANEKAYRRAMKRACLAAAAILREGSGTSLDAVAAGIQVLEDDPVTNAGRGSNLTESGHVECDASIMDGSTGSFGAVGAIRDQXVKNPIKVALHLAKEQMAGSSLLGRIPPMFLVGEGAYQWAKSKGMDLVESAPGA

SEQ ID NO: 60129 - protein, 136 aa, Sorghum bicolor
  Clone ID: 7554305.pep
REQFRKGAQWFELDRELAVDVVADERYYPKFREHCRPPCYVNEHYLPSALSIEAPARIANRSVTWVDWSRGGAHPATFAGKDVDEAFLKRLTAAPAKQNCTYNGQPSEVCFLFARKFAPSTLRPLLRLAPKLLGYG

SEQ ID NO: 60130 - protein, 101 aa, Sorghum bicolor
  Clone ID: 7554367.pep
TFDVITNVVSVDYLTKPIDVFKEMRRILKPSGLAIMSFSNRCFWTKAISIWTSTGDVDHAWIVGAYFHYAGGFEPPQAVDISPNPGRTDPMYAVCSRKKIG

SEQ ID NO: 60131 - protein, 44 aa, Sorghum bicolor
  Clone ID: 7554368.pep
TRSVWKQFLFCKVLGAEKPVNSLKLVTYGVKVLGSPGVGEAFTF

SEQ ID NO: 60132 - protein, 77 aa, Sorghum bicolor
  Clone ID: 7554373.pep
ARDPHPAIWANAMPSNARLSWATAVVDCLAMFSQQKVHACLVLPYVFQLKTLYVVIGLHGSPGLYSDASLLDFLYPL

SEQ ID NO: 60133 - protein, 182 aa, Sorghum bicolor
  unsure (1)..(182): unsure at all Xaa locations
  Clone ID: 7554381.pep
HEGFPFLMTRACCEACGNLKAAFLVAVVFLLFCMSVTLYFAEEIPLEPKDAQGLSDSAPLLNGSREDAHALNEPNNERFPNGHVDGNNVSANNNTEEFPNANSNTDNGGVFNDGPGAVLVNILTSMRHLPPXMHSVLVVMALTWLSWFPFFLFDTDWMGREVYHGDPNGDLSEKKAYDNGVR

SEQ ID NO: 60134 - protein, 91 aa, Sorghum bicolor
  Clone ID: 7554431.pep
MGGYELVRSDDAPAAAIAVDLEAGGTTAPCGDDYPKRRRGSSTPSPPAPASTRPQRLVSLDVFRGITVLLMIIVDDAGAFIPAMNHSPWDG

SEQ ID NO: 60135 - protein, 84 aa, Sorghum bicolor
  Clone ID: 7554437.pep
VSPSSKNQCLPMFFSMKFITLKQKICLMFFSIRQASPLKLANPNQLKLASLILNFTMQSVAKMGSSSGARLINEHLHNKTSSPH

SEQ ID NO: 60136 - protein, 182 aa, Sorghum bicolor
  Clone ID: 7554458.pep
HEAIVAFTVLHNVNCCRGLIYVTSQGFLKICQLPSAYNYDNYWPVQKVPLHGTPHQVTYYAEQSLYPLIVSVPQVRPLNQVLSSMADQELGLHIENDVTSGDDLQKVYTVDEFEVRIMELGKPSGHWETRFTIPMQSFENALTVRIVTLQNTSTKENETLMAIGTAYVQGEDVAARRRVLLY

SEQ ID NO: 60137 - protein, 99 aa, Sorghum bicolor
  unsure (1)..(99): unsure at all Xaa locations
  Clone ID: 7554462.pep
MRLLACCYNDPEMQIDPDTVYPIRPDCRDDAPKTRFKPRPGLTLSPRRWKLLHNEEGVLDIAGMIKRVQXXGVHPTIKGEVWEFLLGCYDPKSTTEQRS

SEQ ID NO: 60138 - protein, 155 aa, Sorghum bicolor
  Clone ID: 7554495.pep
DPKLHEHLENLDGGEYLFAFRMLMVLFRREFSFVDTMYLWELMWSMEYNPNLFSMLESGTGTSSANTKDESVLGQCGKFERKILQAAKKDDQIPLSVFVVASVIEARNKQLLGEAKGLDDVVKILNEITGSLDAKKACRGALQIHEKYLNTVKAS

SEQ ID NO: 60139 - protein, 43 aa, Sorghum bicolor
  Clone ID: 7554506.pep
FCCPKGSKIIGPNVKGLLQLQGYLFHQTGNQLSLVGGNFFPAC

SEQ ID NO: 60140 - protein, 47 aa, Sorghum bicolor
  Clone ID: 7554526.pep
ILLTYKETLPFLSKKITPAGQLTQDKMQQPKSSNPRGFKKNPGPDPN

SEQ ID NO: 60141 - protein, 60 aa, Sorghum bicolor
  Clone ID: 7554546.pep
ETGPGLIMAWRDGPGLWAGNSNDFVRRIDYAPGPCLVHTKKPKTFQNFSKKKKKKNSPRA

SEQ ID NO: 60142 - protein, 91 aa, Sorghum bicolor
  Clone ID: 7554549.pep
MASIVLLLSELLGGESASVLAAERYMGGHRSLGEFRPAVTEAPARHGQRLVDDQHAAAAGTERARRMPEDKKRKEESFEDLAMPRIAVDIM

SEQ ID NO: 60143 - protein, 71 aa, Sorghum bicolor
  Clone ID: 7554552.pep
TRDESARMIGLMRERGVNKTPGCSWVEVHGKVLEFYASTEPQHGAEDMYQLMGILVNEMRLEGYVPNLDLV

SEQ ID NO: 60144 - protein, 152 aa, Sorghum bicolor
  Clone ID: 7554590.pep
TGAGRESFPGRNELGRGQNWNSLAETRPDRLLLCLFWASVARWDPRSSVVTPDEEVFYLVAFLRSALPGAPESLEALVRQNQRILDFCAEAGISAKQYLPNHKAQHEWAEHFGAARWERFQRLKAEFDPRAILATGQGIFRPPGSTPLVADS

SEQ ID NO: 60145 - protein, 144 aa, Sorghum bicolor
  Clone ID: 7554595.pep
AGAAGVGGRRRSGCGGAGQAAQQNSPLQQKLLAVAVAARFAEAGPPPSTEASGAGAGGCCVELLDCLLGALNVSVATVTPAPAQYGWAVREIRPRGEGSAEDRHADAPSGRIAGNGASANAAASLYTMQGRKGVNQDAMVVWPR

SEQ ID NO: 60146 - protein, 134 aa, Sorghum bicolor
  Clone ID: 7554630.pep
VHHLSGPDRRAPTRTLHRRSGSASGAAREGLPLVSFLAHPRFQNPSTRTHVRRSGSTGRRWAASGGRRPPGTTPACCYPTTRAPTGSPPRSRTACCTSPCRAPGSAGGTSPRSRSSDDDACRVTRVRASCLVSS

SEQ ID NO: 60147 - protein, 50 aa, Sorghum bicolor
  Clone ID: 7554651.pep
HFTLIWKDFYVKAWGPVRKKNIEATPDPSEFNCLLRDQQRVSLGEFVDGP

SEQ ID NO: 60148 - protein, 55 aa, Sorghum bicolor
  Clone ID: 7554667.pep
LTHHHPLSQDPSRGHDLIIRLQGGVPRRSRLQGATAASSLAMVTVAAGRRAGAAG

SEQ ID NO: 60149 - protein, 61 aa, Sorghum bicolor
  Clone ID: 7554669.pep
HRHCHRMFSTQVERGYSSRAPQIMYCFHQKLLFRGKTNLRKTEVDLGAVLSVAAGVTSLQC

SEQ ID NO: 60150 - protein, 39 aa, Sorghum bicolor
  unsure (1)..(39): unsure at all Xaa locations
  Clone ID: 7554807.pep
GRQHALDPLTTVKARFNKYGMASAVIQHEXRPKSLVTIS

SEQ ID NO: 60151 - protein, 96 aa, Sorghum bicolor
  Clone ID: 7554993.pep
LVHFICSKTNFLKLSKTGFYKQPTEAQLLKSKGLKKQVVNPFYNQLSRWLNASSTVYSTNAMPHRLILQACSNLPSRFIRGKETSIIATTACRIFI

SEQ ID NO: 60152 - protein, 144 aa, Sorghum bicolor
  Clone ID: 7658510.pep
MKFATALAFAAGVAAHAKNVTYTTEVVTAYTTYCPGPTEIVHGDKTYTVTKATTLTITDCPCTVTKPVITTSAVVCHDCPAPPPHHGNNSTIVPVYPTGKPGKPGSPAGPGATPTAGAPSEVPTAGAGKVAALSGAGLAAVVGL

SEQ ID NO: 60153 - protein, 139 aa, Sorghum bicolor
  Clone ID: 7658515.pep
MHNIYSKFLTKNTKMNASPPKSAEDLLGESWIELGNNSSGPRTPERVTPLPFQSGEEYLRLLREAQRESNQSSRVVSLASSRRDTPHDSPKSPPNSPNTELCNEDELKGVYINYWNKDGELVNPKETGDWIWEWSSRPD

SEQ ID NO: 60154 - protein, 174 aa, Sorghum bicolor
  Clone ID: 7658516.pep
MGRQFFVGGNFKMNGTIKSIKDIISNLNEAKLDPNTEVVIAPPSLYLLLAREHLRKGLEVAAQNVFDKPNGAFTGEISVEQLKESGITWTILGHSERRVILQEDDKFVANKTKAAVDGGLNVILCCGESLEQREANKTIEVVTTQLKAVADKIKDWSKIVIAYEPIWAIGTGKV

SEQ ID NO: 60155 - protein, 175 aa, Sorghum bicolor
  Clone ID: 7658523.pep
MVNFTVDQIRGIMEKPTNIRNLSVIAHVDHGKSTLTDSLIAKAGIIAQAKAGDARYTDTREDEKERGITIKSTGVSLYYEYDLYGTGESAPYLINLIDSPGHVDFSSEVTAALRVTDGALVVVDCVEGVCVQTETVLRQAMGEKIRPVVMVNKIDRAILELQQDGESMYQNFVKV

SEQ ID NO: 60156 - protein, 117 aa, Sorghum bicolor
  Clone ID: 7658528.pep
LSDPVVGAAPRHDLQCPHGGIASRAPVRPRLPRQRASGHGGALLGRVGAGPSVQCRPYPWSFALPTQQQDPAKWSLASYSDPAKWSTVAHVRLRRSAPPAPIHWRAQSRICIDFVSK

SEQ ID NO: 60157 - protein, 188 aa, Sorghum bicolor
  Clone ID: 7658529.pep
FFAKDAMAEDEFEEYEVKIQGKKRFVSFDTSLHDAMVVKDGSGDVLDTFPLAHMKRWGVKENLLCIDYWYPGAEKGTLLPLESKDPKMLQDKLLQAAKAIAERKKAGGHSPVPSSPMSSESPSPPVTPTYITPSAPPQSPPLSPATNGSSPHSKKSKPQCELEVCIREAIGLRFPDTDKVSPYCVLRV

SEQ ID NO: 60158 - protein, 168 aa, Sorghum bicolor
  Clone ID: 7658535.pep
TLFKMFVYQGKMNWWTYAINETFVVVLPNGPVRVGDSVYLFWKWTVDAKGVKNGNVFQTISVDSVTQTSATDVTFVLKGSWYSFTVTTKGGYENISIVMRNPQGGVSDPMPLKREWKSDKELTGTTRIWTGKFKWMSFARDEHAIFIVPDGFGEGKPVISTWQWTKAS

SEQ ID NO: 60159 - protein, 174 aa, Sorghum bicolor
  Clone ID: 7658542.pep
TRAVVTGGNRGIGLEICRQLASKGVTVVLTARDEKRGAEAVKNLVAQGLSNILFHQLVVGDLSSTARLADFIREKFGKLDILVNNAAVVGSITEISDPDAFKLELASMNAQERLERIRRYTTDPYDQAEEVLRTNYHGTKIVTEALLPLLEFSSHGRVVNVTSIVGLLRFFSGE

SEQ ID NO: 60160 - protein, 188 aa, Sorghum bicolor
  unsure (1)..(188): unsure at all Xaa locations
  Clone ID: 7658544.pep
HEDDNDAYIAIRGIVYDLGKFIPVHYPSIIPDASLEKYAGKDATNLFPVDVSSLCNGIDGSVHPGLKLDFRSTNYTQQTNLVSTNDLNARFHDFRAFWNDSRPDWWFEQQVFLKSNYMKGRVGYSPQYLKTLTKSGKSIGYMYGRVYDFTDYIVGGRSIQPRADGKSWPKNLNTNTNFMDDSXVDIFR

SEQ ID NO: 60161 - protein, 142 aa, Sorghum bicolor
  Clone ID: 7658551.pep
MGEEEKAKEAAAPADKAKEAEEKKDEAAGGEEKKEEVPPLPPPPPPEEMVMRVFMHCEGCARKVKKILKGFDGVEDVIADTKAHKVVVKGKKAAADPMKVVERVQKKTGRKVELLSPMPPPKEEKKEEEKKEEPEPPKPEKK

SEQ ID NO: 60162 - protein, 172 aa, Sorghum bicolor
  Clone ID: 7658589.pep
MSGWSWSPRQAMLQMSQPEMNGQPRPSIPPQSLPSMPALNLPHPPAPNPALPMYNHKPICNKPDPTPVSNNLAPPLVPGPVPNNSTSPAYYNPPPPFVPHTTGAQTPGGLPSLMNTSPMARGLSSAALQIPAPAPAPAATTTSSRKRKSGVGPDNAQENLFPDNVPDIDSED

SEQ ID NO: 60163 - protein, 91 aa, Sorghum bicolor
  Clone ID: 7658595.pep
RLAKCLLKLLMGAENKDEPRVKLDKIVLFCSRQKTHIIFPASKEDLTHREYASSFRTPRQNSYTRMSQLLQSVAIIRQDSIERCKGIPVLP

SEQ ID NO: 60164 - protein, 75 aa, Sorghum bicolor
  Clone ID: 7658597.pep
VVTPEQAQEVHAAIREWLKKEVFAEAADKTRILYGGSVSEKNCADLAKQPDIDGFLVGGASLKPAFVDIINANQA

SEQ ID NO: 60165 - protein, 46 aa, Sorghum bicolor
  Clone ID: 7658598.pep
MTRVNIEREKKENLKNEVKVCKGIFVLFKKWIDDRVGMEINFYCLI

SEQ ID NO: 60166 - protein, 102 aa, Sorghum bicolor
  Clone ID: 7658619.pep
ISSNTIVSDNTSRFETLLLGFLFFFSQAHVSFSPPPPCHNKVDLAKLIHYRLFTSKTSVLVVGPMLNIKPFVAPCLLHLLAELRFGLASLNTLLFEENISRV

SEQ ID NO: 60167 - protein, 131 aa, Sorghum bicolor
  Clone ID: 7658632.pep
VYYAAEMTAHPRLQEPMFLAEITAPMDAMGGVYQCLNQRRGIIIEEEQVQGTPLNQVKSHLPVAESFGFTAHLRALTAGQAFPQCVFSHWAEVNGDPLDVTSKCHEIVNAIRKRKGFKEGIPALDNYMDKL

SEQ ID NO: 60168 - protein, 48 aa, Sorghum bicolor
  Clone ID: 7658647.pep
ERGVVHACHAGGVVHFLEGYTPHEVGAIDVPRIDVVWEAALKHGLRPA

SEQ ID NO: 60169 - protein, 94 aa, Sorghum bicolor
  Clone ID: 7658650.pep
PLDLPRYGNGSRMSLAPSGYGGYDNNMEMGNLLGMPSDDAVLAEIRDILASSDLMPVTKKQIKSELEKRFGMDPTPKKAFISSAVESLLVGQTQ

SEQ ID NO: 60170 - protein, 68 aa, Sorghum bicolor
  Clone ID: 7658652.pep
AYSRIIAKKHPTLCINCVHPGYVDTDMNFHTGVLTVEEGARGALILALLPKGGMTGAYLDCTEVASFV

SEQ ID NO: 60171 - protein, 133 aa, Sorghum bicolor
  Clone ID: 7658659.pep
LPSPSFVLRLQSRPTRTRSSPRPTSPSRDRRGISRAPSRPSKMSLLAPRLGSRNSRPLLRATRPRTRRSAMLRLVLILRLPNQRRRLPRHWLRLRSTSSGLLTTRSRLISPATEARGSCHCPWCQWEFRAIEC

SEQ ID NO: 60172 - protein, 79 aa, Sorghum bicolor
  Clone ID: 7658664.pep
KEVKNENEPRWFETFRMQTHEEDQELVIELKDKKSSLPFGKVKIPLNTMSNTNPDHVYCKWLRVSHYAQLSVSIKVKKL

SEQ ID NO: 60173 - protein, 58 aa, Sorghum bicolor
  Clone ID: 7658665.pep
HMLYLYLYLYLYLYLYLYLYLYLYLYLYLYLYLYLYLYLYLIINCENFSLPIFLSALF

SEQ ID NO: 60174 - protein, 125 aa, Sorghum bicolor
  Clone ID: 7658687.pep
MNSQGNNDVSPEAMQSRIQQARREAETLKDRIKRKKDDLADTTLRAVAQQAHEPIPKNQLMKAKRTLKGHLAKIYAMHWSTDRRHLVSASQDGKLIIWDAYTTNKVHAIPLRSSWVMTCAYAPSG

SEQ ID NO: 60175 - protein, 62 aa, Sorghum bicolor
  Clone ID: 7658688.pep
RLLRIIFFSPRSCCPISFWLQPTIWNWIPVKESNDRNDIYSDSLIQEEQKGNTAKTACKPSE

SEQ ID NO: 60176 - protein, 97 aa, Sorghum bicolor
  Clone ID: 7658710.pep
DSSAVTNLPGMDLFTKQQTCPCGLYPFKSNSEGRGDIVQLQHTPGQLALHLALRSDEEIPSSSSKRPDRSIFVIKATNRASIGLSCLEIYRKILLQY

SEQ ID NO: 60177 - protein, 86 aa, Sorghum bicolor
  Clone ID: 7658738.pep
PVYRICMVKGFQWGCGKFCHRYIDDPCRYRYCYFVTVASASYNQWAGFGKESLVEPDPPKGSQASQWYSVFAVKRVLSNAATIDDT

SEQ ID NO: 60178 - protein, 98 aa, Sorghum bicolor
  Clone ID: 7658772.pep
RAVTIGLQGRNEEATRLFRSALGKARYCLGFQHHEVCHIQELLVLCIAAGGHYKLAMTELLELEKNLNAISGGSIQLQIPRVSHYRKSLEISRIGRGI

SEQ ID NO: 60179 - protein, 143 aa, Sorghum bicolor
  Clone ID: 7658778.pep
IYIRNVTNNYAVSKKNRTRRSARLYHLLALEGCPQKKGICLKIRTTKPKKPNSAIRKIVRVRLSNNKQITAYIPGQGYSIQKFSVVLVRGGRVKDIPGIKYKLIRGKFDFGISESFLRVKRRSKYGITKEEGNKRILSLKSKS

SEQ ID NO: 60180 - protein, 178 aa, Sorghum bicolor
  Clone ID: 7658783.pep
ARGDQAHPIISRLARLIYKAQDSHYDISTTIVTLKNHALALEERAKAAIVQSAEFGQLAAESFPKNLHCLTVKLTEEWLRNPKHRSRSEENRNSTRLVDNNLYHFCIFSDNVLATSVVVNSTVSNANHPQQLVFHVVTDRIHFGAMSTWFLLNDFKGCTVEVRCIDEFSWLNSSSSPL

SEQ ID NO: 60181 - protein, 184 aa, Sorghum bicolor
  Clone ID: 7658788.pep
ARGTDWHMAHLGGIASRGPGFVMVEATAVQPEGRITPQDHGLWKDSQIEPLRRVVEFVHSQSQIIGIQLAHAGRKASTVAPWLSMAATATEKVGGWPNNVKGPSNTPFQDSFPTPQAMTTADIEQFKKDWVAAVKRAVQAGVDFVEIHNAHGYLLMSFLSPATNDRTDEYGGSFENRIRLSLEI

SEQ ID NO: 60182 - protein, 180 aa, Sorghum bicolor
  Clone ID: 7658791.pep
SEIGFFQSLCFFITNNLSTHHLNNYKMFQVQGSEILFIILWCLQFLLCIACTIVLVLFTNTQSIRARAPVLSSLSSLGASVYLGAYTLSYSIPETPCSLIVLVANVSFYILWAPLLLRAWRIYFIYHWNSKMILEQKKQEEIAKERRNARNLNKKLQNRAKQIEISDDEGPPPAQPQKPS

SEQ ID NO: 60183 - protein, 176 aa, Sorghum bicolor
  Clone ID: 7658800.pep
KIPKLRTLKLEGCKFMVDGLKAIGTSCVSLKELNLSKCSGMTDTEFSFAMSRLKNLLKLDITCCRNITDVSLAAMTSSCTSLISLRMESCSRVSSGALQLIGKHCSHLEQLDLTDSDLDDEGLKALSRCGKLSSLKIGICLKISDEGLTHIGRSCPNLRDIDLYRCGGLSDDGIIP

SEQ ID NO: 60184 - protein, 128 aa, Sorghum bicolor
  Clone ID: 7658808.pep
SSTALDGITPPPPPSPQRKYSSRCMLPASTASYPSTASLSLFASSLRLLTPTPSHTTPIGSNHHSGPTPRRNLRCVPWHRNVTASFLTFSIPENFGRRAKPDRHLSVLLTAPSLIASNIDPKASQQAS

SEQ ID NO: 60185 - protein, 180 aa, Sorghum bicolor
  Clone ID: 7658813.pep
ARGRAIVFEMADLSLDAVAQLGTSLASKLNLHSEGCRKSRQRLPKLVSLVNSTASTIRQIHELMQQNDKIFTEACVKDINLFAAKCRAIYVGVLTLIAKKTQSVNGDKDAKTLSAEQIKELLACLANMSVWRTEAWNWLEPRFKICQQELKQVKFELVLRYLLGSIARLQMETMIRSPGA

SEQ ID NO: 60186 - protein, 186 aa, Sorghum bicolor
  Clone ID: 7658824.pep
HEALLPRLVSGCQLAWGRGGSGALRPAMAAAASTPHCHRPWQLLVPAKACASRRTGWPAVAAGVGAGGAPNAWTGRLLPPPAARRAVRTKAGAAEARPSSPPDAVTYSASISTDTPLHEPPGVSFDEYLQDSARVFRAMFPDESRSQRVGDGEWRVQMLPLQFLLLTVRPVVVMQLRHRHRAGGLD

SEQ ID NO: 60187 - protein, 191 aa, Sorghum bicolor
  Clone ID: 7658827.pep
MAEAAKKEHLSLVVCGHVDAGKSTTTGHLIFKLGGIGEREMAKLQAEADSKGKSSFAFAYYMDTCKEERERGVTIQCNTKEFYTPNYHYTIVDAPGHKDYIKNMITGSGSADAALILVPAEKGGFEAAIAKADPKLGVDEGQTRQHARLLFLLGIEQIIVGVNKMDSCDWSETRFNEIKDEFVKMITMIGF

SEQ ID NO: 60188 - protein, 94 aa, Sorghum bicolor
  Clone ID: 7658828.pep
TRQTFAGHESDINAIQFFPDGHSFVTGSDDATCRLFDIRADRELNLYGSESILCGITLVATSVSGRLLFAGYDDFECKVRDITRGEKVGSLVGH

SEQ ID NO: 60189 - protein, 63 aa, Sorghum bicolor
  Clone ID: 7658830.pep
AAATPAPDALAPGATPGHPVPAHLPGRRGCQRWPAATGRCWTRSPGRCCRPATPSTPSCRTRR

SEQ ID NO: 60190 - protein, 155 aa, Sorghum bicolor
  unsure (1)..(155): unsure at all Xaa locations
  Clone ID: 7658837.pep
MLSVEAHTYYWIARPRWKLCACRNVLQETALHDAEVNSYRHSERKNRKRDGAYIDKDGVARTFDRKKISRKRGGAIKGRGWKYGSGFVDGVFPVLSPMAHDILEFVQKGTDVTNIWESLDKIPQAHDLWDDIVNVAVQLRLNRXWEPIITVCEWI

SEQ ID NO: 60191 - protein, 122 aa, Sorghum bicolor
  Clone ID: 7658841.pep
MAGGNRSQDEDVRVGVDRFPERQPIGTTAADDLGGRDYSEPPAAPLFESSELSSWSFYRAGIAEFVATFLFLYVTVLTVMGVSKSPSKCGTVGIQGIAWAFGGMIFALVYCTAGVSGGHINP

SEQ ID NO: 60192 - protein, 164 aa, Sorghum bicolor
  Clone ID: 7658847.pep
MALLPAAGAAAPATPSAAKPCGLRRPSAPPAAALRLGPLFWPWEKVKIGPLSVSPMGFGTWAWGNQLLWGYEESMDNELQDCFNLALRNGINLFDTADSYGTGRLNGQSERLLGKFILECEGTIKSPDDVIIATKFAAYPWRLTSGQLVSACKSSLERLQLDRL

SEQ ID NO: 60193 - protein, 132 aa, Sorghum bicolor
  Clone ID: 7658849.pep
RSLVYILDCLHVRHVEASKLRVLPSETTTTMATSTTVAAVREIRRAQRADGPAAVLGIGTATPTFCVLQDDFPDYYFRVTNKEHLTHLKDTFRRLCRITGLERRFFHHTEQMLNAHPSLLHGNGDLDARLDM

SEQ ID NO: 60194 - protein, 70 aa, Sorghum bicolor
  Clone ID: 7658852.pep
KKTLLQDSVVKSPTSTPMASFPPPPHTLPPTPTAPYPGTPPPLHHHHHQQQQGPAPPGAATLLVRHLPDA

SEQ ID NO: 60195 - protein, 184 aa, Sorghum bicolor
  Clone ID: 7658853.pep
HEATIICAASATEQGHVHGSCHSSPYRVAFLGSHGEQIISYVYSSVTGTWGDAISMTSLKPFDPDEFISCNNILVGNFIYWLLNERTISILEFDLDRQSLATIEVPPEMIDINPVVREESEFLIVPAEGCGLGLLMIAGFSARIWKRKYSCDGNAGWVLIDTIRLDHHLRLKPWAHTFPPVLLG

SEQ ID NO: 60196 - protein, 199 aa, Sorghum bicolor
  Clone ID: 7658859.pep
RHEALMNHLQETALNHVKTAGLLGDGFGSTPEMSKRNLFWVVSQMQAIVERYPCWGDTVEVDTWVSANGKNGMRRDWHIRDSITGHTILKATSKWVMMNKLTRKLARIPDEVRTEIEPYFFERSAIVDEDNRKLPKLPDGQSTSAAKYVRTGLTPRWADLDINQHVNNVKYIAWILESAPISILENHELASIVLDYKRE

SEQ ID NO: 60197 - protein, 113 aa, Sorghum bicolor
  Clone ID: 7658873.pep
FYEEVLNYKRATPDERSQLAPNLIDNYIKDDALNEINIAGKVKKRIIHRYNQITYDDEVPIDLFDLAVEKLKLVLNENGTYQNFLESSEFKQYIKKIKNNKKIKELEVAGGVI

SEQ ID NO: 60198 - protein, 86 aa, Sorghum bicolor
  Clone ID: 7658874.pep
SLHSRCSIFHLNLRALFTSQFYLHMQCGPCRIYASNNLSWFLLSNLLLSSLITRLKLLSSVESSPYTILMLSTQALQASRSNLLRG

SEQ ID NO: 60199 - protein, 53 aa, Sorghum bicolor
  Clone ID: 7658875.pep
NSVHLNLFLALFQVWTTPPGTKAPTDLVPHGNLHIEFLGPRPNQTRVFLEPPT

SEQ ID NO: 60200 - protein, 120 aa, Sorghum bicolor
  Clone ID: 7658889.pep
LAVMLGTWDSVRRPGMTLTLKIWPPAVPPGPPRPRMYPPPPMGYVPPVKKYREEMKETYREMVELLGLSDACVPDQETVKSGLGDLLRLWTNAIDPHTEDCSDCASFMMSYSSSSFEYSD

SEQ ID NO: 60201 - protein, 60 aa, Sorghum bicolor
  Clone ID: 7658893.pep
SQHASRTILPHHLKQIKPSKILGMTNTHESATCNCIYSSRRLENHSWRQSHYRKAPRRSN

SEQ ID NO: 60202 - protein, 53 aa, Sorghum bicolor
  Clone ID: 7658895.pep
HRLEKNPATGQPWQNPLTPVGNLSQTGTKGGAFNPGRATPVRKPGQQSLPDRG

SEQ ID NO: 60203 - protein, 44 aa, Sorghum bicolor
  Clone ID: 7658908.pep
KRKLTTHLSKFGYTHYTFGVTVHERPMWEQINPCTPANIKGRDT

SEQ ID NO: 60204 - protein, 75 aa, Sorghum bicolor
  Clone ID: 7658911.pep
PQPDSIIRGGLGEENTVADAIPPFHYSLFIVFPVSCFFSHLQNSLHHSSPFLTQRGLLVLGGCIIGWVSCVQLPF

SEQ ID NO: 60205 - protein, 36 aa, Sorghum bicolor
  Clone ID: 7658912.pep
NGKSLNALSFQHTLGVRSQMGLGWGELLGKRDPLIL

SEQ ID NO: 60206 - protein, 82 aa, Sorghum bicolor
  Clone ID: 7658914.pep
PLEIAITWVLPPPLRLVPKTVLRGVAESVLSRLAEKMRRDVDVGLVADFRRFPREKAAASRATPTLDGTASSKDQAFERQSR

SEQ ID NO: 60207 - protein, 183 aa, Sorghum bicolor
  Clone ID: 7658923.pep
FNNMSGPGQNTVDIDALLDLTEYDNFQSPATTVSPSGTSKATFASPITAAVAAPATTTAQSLSGPSHNYDMYRQQTGFVPGAIANTMAVNQTNNTGYQDFRNIDYLTTFSPEADLFDFNTSPSQATLGASDMDMDFESQTETQQFFTVDPSSIEQENAGLPSPPVLPTQNNGRLWPGAHSQAA

SEQ ID NO: 60208 - protein, 219 aa, Sorghum bicolor
  Clone ID: 7658926.pep
SARGDETTSLTDYITRMPEHQKQMYYITGESLKAVQKSPFLDSLKEKGFEVLFLVDPIDEYAMTQLKEFDGKKLVDITKDFELEETDEEKAQREAEEKEYEGLAKSLKNVLGDKVEKVVVSHKLIGSPCAIRTGQFGWSANMERIMKAQALRDTSMSSYMSSKKTFEISPKSPIIKELKRKVEADGEEDRTVKSITLLLFETSLLVSGFTIDEPVQYAE

SEQ ID NO: 60209 - protein, 192 aa, Sorghum bicolor
  Clone ID: 7658935.pep
TRKKVTKAAELTLRESIWPIALVTVLFFLWGFSYGLLDTLNKHFQKVLHIDRARSAGLQAAYFGAYPLASLGHASWILRHYSYKAVFIWGLCLYAVGALIAIPCIKAKSFAGFCMSIFIIGNGLGSLETAANPFITVCGPPRYSEIRINISQAFNGIGTVIAPVLGSYVFFNNLDDNAALANVQWVYLAIAV

SEQ ID NO: 60210 - protein, 177 aa, Sorghum bicolor
  Clone ID: 7658936.pep
MADLNSNNSFDSGASLMSNFNNGGFSMDQVSAFTAINDPSVAAGSTRTVSPKDIFNDAFGSAPPSTAFTNLTSPDVGDSPFFNDSFECSPMFNGEPNMTDTSDWFSLFPEQETKVPDNAYAPAISMPLERTVSSQSMERSGSSSTGSPIVLDSYTRRKSSVTNSPAINGVSKSRRRK

SEQ ID NO: 60211 - protein, 163 aa, Sorghum bicolor
  Clone ID: 7658943.pep
HEAAVDVLDSSVHNLQGVARPPAVNVAGSSTLSNSAGRRKKTRPVRAFPTDEGTLWKTRPASGRADAWGRLISQSSEYPSIPIYPAHFTIGHGGKCDLKLTETSPGSLICKLKHVKRGAALEIYMNKVVHVNGKALDKAAKVTITGGDEVIFVSVGRHAYIFE

SEQ ID NO: 60212 - protein, 117 aa, Sorghum bicolor
  Clone ID: 7658947.pep
TQRSGSMKQCSVYALDVGVIIDIKSACFIPASLRSAGEFQCQPSKMPSSLLQDAPSAASMQSKTTEATSVDIHVIALTWLSRLSLALSPLCNSNIASAEMNPSTPLSVLFAPDAILR

SEQ ID NO: 60213 - protein, 107 aa, Sorghum bicolor
  Clone ID: 7658953.pep
MSSDYSYDEQGQFFPFFILTLTGIVTVPLTYTLLRPNRDQDALAPRIKTNYKSEHAATVESLKSAQKRSQWRVKRVIFVIIGWALMAGMAYLIMVTQRTVPKLWNPY

SEQ ID NO: 60214 - protein, 187 aa, Sorghum bicolor
  Clone ID: 7658955.pep
MQSLDAIVVGAGFSGISALYQLRQQGLNVKLFEKAPEVGGVWYWNQYQNAATDSPSELYRFSWDKDNLQTYPWPNHVLPQEEIQGYLKHVVDHYDLRQHIHFSRELKSASFDQGVWTVKFSTGDSFKTTYLILAVGTCHKPVWPTLPGQDKFKGEQYHTGLWPEHRDMRGKRVGIIGTGSSGAQLLR

SEQ ID NO: 60215 - protein, 186 aa, Sorghum bicolor
  Clone ID: 7658960.pep
MSHRKFEAPRHGSLGFLPRKRTKHHRGRVRSFPKDDASKPVHLTAFPVFKAGMTHILRDVHKVGSKLHKKETVEAATVLEAPPIIVAGVVGYIETPRGLRALTTVWAQHLSTQFKRRLYKNWMNSKKKAFSKYAAKWADEKNITRELDRIKKYCQVVRVIVHTQLNKLNLRQKRAHVLEIQVNGGT

SEQ ID NO: 60216 - protein, 145 aa, Sorghum bicolor
  Clone ID: 7658966.pep
MASHNNNKDANIYHAPVGGNGYGGTVNMGPTAPAPAKPESPVVTQHAEQYTSSYTAYPAPHRRPPAPYMRPQKPPPPPPAYYGGGWYWGEAVGEYGGGGYYGYRPPQPLPYGGGGYGYCPPSEFGWGAGGGGYSYYDGGYGGGGG

SEQ ID NO: 60217 - protein, 201 aa, Sorghum bicolor
  Clone ID: 7658973.pep
KHEGLGGQRPPAPNALPSIGQHHPMMPGLPTGGYVPQSLANGPQSLASTPQSLTNGSQPPMPNGGGMLKRGREEEEDLHRPVSNGHDPMSNMHAMSNGYPQQPPLANVHQPPLQNGGDMLKRGREEDDEVHRSAHNAHDTMNNMPGGMPGMSNAYAQPLPNVHHQSLANGDGGMLKRGRDEDDDVHRSSPNGHDSAGNFEV

SEQ ID NO: 60218 - protein, 147 aa, Sorghum bicolor
  Clone ID: 7658980.pep
HEDLVKHLIQNNLVSKIAVADKVLPDTAGLSAEELKLYKDENGIVVYKQANLAREATISKVFELDGGNFQYVFNLAAITKYSQPEEVYKENIIDVAKICAAAALKYKVQRFIHVSTGQVYSSGKKASAEDDKIKPWTDIAKASLEAE

SEQ ID NO: 60219 - protein, 155 aa, Sorghum bicolor
  Clone ID: 7658981.pep
ARGCHAATADTLLPSQGLTGGDTLLSSNGRFALGFFQAGSQSNFSADGDSTPKWYLGIWFHTVPKLTPVWVANADNPVVAANLTSCKLVISHDGNLLVILDDDHHHLQPANGSSSSTVWSSKTNATTTNGTTTTTTTTTMAAAAASLLDNGNLVL

SEQ ID NO: 60220 - protein, 174 aa, Sorghum bicolor
  Clone ID: 7658982.pep
VKSEKDLHDDFDNEAHDLDLDIANNIGGMTDNDNQLAGKANQDLDNGSDLALDGGGELPSDVEVVDSRNGGVDHGSVLLDVGQGRDELVADIIDGISAGDEFKVGDRLGDVGDRLDDIGDWLDGTGEGRDGNVERSGCGISGGEESRDGDESEAGEAHFEVGYYITKLGKECSD

SEQ ID NO: 60221 - protein, 65 aa, Sorghum bicolor
  Clone ID: 7659001.pep
GPLPSITVDPNDKVALKRARNTLAARESRQRKFDHVTTLEQRNFELLAEVEKWKSIALAHGYSGQ

SEQ ID NO: 60222 - protein, 164 aa, Sorghum bicolor
  Clone ID: 7659002.pep
RFFGTFLMKFCKPRKVFFVFLTMCIVFIGPPIVHHGTAGVSFLYIVLFFESICFPTIVALGMRGLGRHTKRGSGFIIAGVIGGACVPPLTGAVADMHDVGISMVVPMMFFVAAWSYPIAVNFVPSYKKVVDVFYEADIGLGERTLDEEKNQGTQHEEKDMTARA

SEQ ID NO: 60223 - protein, 51 aa, Sorghum bicolor
  Clone ID: 7659005.pep
SRCHRPGCFPRCLRPHWRCFGTRWRCPQLHLVSNYATTPLIVSGGSRGEDW

SEQ ID NO: 60224 - protein, 130 aa, Sorghum bicolor
  Clone ID: 7659006.pep
GQIFNLADENATDQGKVNDMLEQIYGIKTGFVGQIMSSIAAKMSLKNIAEVANDKHLKPWSDMTKEAGIQDTPLTPYLDEELLKDHSTAIDGSAITKLGFKYDFPKPTIDLLKEVIRDFEAKGYFPKNIV

SEQ ID NO: 60225 - protein, 177 aa, Sorghum bicolor
  Clone ID: 7659011.pep
WRGLHPDLEEEDEHRMQKMKDKGFLVHDGSHSESLAFSIFTRFGGHLVDVGFSDLLIQGDVEMITNTQIAHFEERAVVMTDGRRVECESVVFATGYQPITTLWRSIFGNEIIDRAGPVWGLDHECELRGVFRRTGHPGLYYAGGNFGTSRWATRQLGLLLLARKLGYDKEQDASRSA

SEQ ID NO: 60226 - protein, 72 aa, Sorghum bicolor
  Clone ID: 7659017.pep
AVLASPNVGKSRRRREPMGKALNYELRSYISYFFSSFHMCSRFTVVQKTRAQANVCVFFFFFGSVALLGNEL

SEQ ID NO: 60227 - protein, 131 aa, Sorghum bicolor
  Clone ID: 7659020.pep
ERLQPTAPLGCKRESTVVCVNRLLTSIDIVVKAPKPPNRMPRALLGYAILGRSRGVVVAEKVRVSLVENGCRGNCVGLLHPLVFVFLNGVDNNRLARFLLHLLGLQDELPEELALPHGNRRDAGERRLRAN

SEQ ID NO: 60228 - protein, 75 aa, Sorghum bicolor
  Clone ID: 7659021.pep
VTLVVEEASKAAEMQAEDEISEPEEDSLAGQMHVLKTGQTPKTRRRDSDDSEDESGTDEEEDDTSATNTDTEDES

SEQ ID NO: 60229 - protein, 101 aa, Sorghum bicolor
  Clone ID: 7659070.pep
ERSYRCLLEMGVALGEVVRRQLPDTRSCRRRTSRRAAGRARGGAGAPSVGLAPSMCGGERGWAAARARERAGRGHCLAGGRRCLPGHRLTRREEGARAPLA

SEQ ID NO: 60230 - protein, 181 aa, Sorghum bicolor
  Clone ID: 7659074.pep
RHLLPRPGRLVLQILDGAHDHEVRRLALLLLVVVVGQRRRRRKERRRGGDQVHWHVFCNRRPWHSRLGVATSQLFLGIVGDNTWLGVAFHHAIAPVRRLHIRGGDGDSIHPGVHLLANTTAAMRATIWSELSFPDKDALPEHGDRLLDRPEGAGCVDLSSVRRHAAARACKVGFPAGHPRA

SEQ ID NO: 60231 - protein, 181 aa, Sorghum bicolor
  unsure (1)..(181): unsure at all Xaa locations
  Clone ID: 7659076.pep
ARGAAAANAASKGVPVVIASGFATDSIIKVLKGEKIGTLFHNEANLWECSKEATAREMAVAARDCSRRLQKLSSDERKKILLDIADALEANEGAIRSENEADVEAAQGAGYEKSLVARMTLKPGKITNLARSIRAIADMEDPISHTLKRTEVAKDLVFEKAYCPLXVLLIIFESRPDALVQ

SEQ ID NO: 60232 - protein, 183 aa, Sorghum bicolor
  Clone ID: 7659099.pep
HEDLKLTGPTRSVVVLDPATFEVDLKVKGTTESEDQWLSFLAVTYRHFSRFDSHLLERDYASKLSELQFQLGSIIYSVEATIEVRITSGSWPHGLRAQFTAGTASIPGAELILLDSGDHGVPVAEIGRRIELSRCVASVEVDGELRVRVKAFLGDKIVVNRVKAFKSRTTGVSNESLRVHFDR

SEQ ID NO: 60233 - protein, 45 aa, Sorghum bicolor
  Clone ID: 7659100.pep
TRHPFVAPASSAKVAPLGGLEFQALAASGQIPPQALAALQDELLG

SEQ ID NO: 60234 - protein, 121 aa, Sorghum bicolor
  Clone ID: 7659105.pep
LTTQPRNLLCDRSIGSLRAAQLLSHRSRQDSEGSRQEPSKSKRGIRIQQRGIYTSIILSVSIQELLPTRNYGGRKKKKKKKKKKKKKKKKRADWEEAAPDGRGECSCLAWTDVTSSATASC

SEQ ID NO: 60235 - protein, 186 aa, Sorghum bicolor
  unsure (1)..(186): unsure at all Xaa locations
  Clone ID: 7659125.pep
MALSSHATTTATAAAAAVGTFPQSTRSSSRRLPASSVSPRPPPPPRSLRLDHAAAPSLSAAATVPAPEGLLAAAIEHLEREPASVAADEAPLAALSPRELQLVLVYFAQEGRDAYCALEVFDWLRRANRVDGETMELMAAIACGWIERLVGAGGDVADVAALLGEMDCVXLRPGFSLVEKAVALYW

SEQ ID NO: 60236 - protein, 101 aa, Sorghum bicolor
  Clone ID: 7659134.pep
MAHHFLGSKHHGGEASKVTDWRKEEKHHKHMEQLGQLGAVAAGAYAVHEKHKAKKDPEHAHPHKIKEGVAAAVAVGSAGFAFHEHHQKKDAKKHRRHGHHH

SEQ ID NO: 60237 - protein, 148 aa, Sorghum bicolor
  Clone ID: 7659136.pep
MGEAAADPAPAAAKGRVAPPMSWRTRLSVLAAGYLTDATRRADGTVNRRLLAVLDKPVAASATPRNGVASRDVTIDPALPLRARLFYPCAPAPADAAEAAAVPVVVFFHGGGFAYLSAASLAYDAACRRIARYAGAAVLSVDYRRSPE

SEQ ID NO: 60238 - protein, 46 aa, Sorghum bicolor
  Clone ID: 7659141.pep
TTASSSPPSPPPLRLPRRMRKRRWIVCSAPALLRLIALLRTLVPRA

SEQ ID NO: 60239 - protein, 147 aa, Sorghum bicolor
  Clone ID: 7659146.pep
SVKLLKKLLTRVQNKYQFCVMDLGQVTAALFSPHRIFSIVHFKRANMLKYERHLSFGTVYAIYSYARTLNNMYDGLDVVVFNLFVLSRIRLCAYPYHCRYVVFLENIFIYTLHTGCLDSYYGQCRLEAFAVPMFCFLLQNTTEAKSY

SEQ ID NO: 60240 - protein, 127 aa, Sorghum bicolor
  Clone ID: 7659163.pep
PSDLVPEFQRSGTRQGVKARTLSYDDLVPEFQRADGRREIKASTLSYEDELFRKFKTGSAVPEIQPVNQTPLHTHNQETVSKNTSHAGVNTSHDGVSKNTSHDGVASVQSSREVEIRPRSAPPSQST

SEQ ID NO: 60241 - protein, 142 aa, Sorghum bicolor
  Clone ID: 7659203.pep
MAPRVADKSPLPPATGLGLGVGGVVGGVGMGPHYRGVRKRPWGRFAAEIRDPAKKSRVWLGTYDTAEEAAKAYDAAAREFRGAKAKTNFPFPSQCAVAAGGAGSPCSNSTVDSSGGASGCAVQAPMQAMPLPPALDLDLFHR

SEQ ID NO: 60242 - protein, 196 aa, Sorghum bicolor
  Clone ID: 7659225.pep
LADEEPQVLATAVFAFLRLLSRNRLAPAAGSVECKDCEECNGAKNLQECRGRLVSFCVSVLRDHFQVCALLGRDLVRSLHELALVPEFQLLWRDLILDRAADVCRIGTPRWCTAVAITSEMETQLLFMMNNVKWGDQKRYQLWFARKHLMVPGGEERIPDIVRFICCGYHPTNEVMQSGVIARWAVVGWLLTSCSK

SEQ ID NO: 60243 - protein, 178 aa, Sorghum bicolor
  Clone ID: 7659234.pep
KYLLKSGLQKYLDHLRFNLIGYGCTTCIGNSGELDEDVAKAVTDNDIIAAAVLSGNRNFEGRIHALVRANYLASPPLVVAYALAGTVDIDFETEPIGKGKNGKDVYFKDIWPSNEEIAEVEQSSVLPDMFRSTYEAITQGNPMWNQLSVPKAKRFPWDPSSTYIHDPPFFKDITPTPP

SEQ ID NO: 60244 - protein, 120 aa, Sorghum bicolor
  Clone ID: 7659273.pep
VNIALVIISNATSCQLIQFASAQQLETTRSQKLSEQNTNTARRHPYLGSHSRVAGTMPRLEHGTHIATVIYRSCVRLVSRGSLGALQKKSPGHTRARAQHKGKDGRGSARGHGVSRQRAS

SEQ ID NO: 60245 - protein, 86 aa, Sorghum bicolor
  Clone ID: 7659289.pep
QNLIMLCNFNLKHRKAYQSSQFSIMDGEKFAQRPIFLLYSNYQYFELMGNRVMRSTNFILEINVTIPLDEHTTSEIIPSHTNSTAS

SEQ ID NO: 60246 - protein, 26 aa, Sorghum bicolor
  Clone ID: 7659316.pep
QKFPKHFTPHLFHECFQHYLKLVINW

SEQ ID NO: 60247 - protein, 121 aa, Sorghum bicolor
  Clone ID: 7659343.pep
EIYARLCRSTLFDAGTKEFWILKDKGGLCISLSSKAMTITGIDDRRYWSHLATEESRFHSVAYLQHIWWLEVYGELEFCFPAGAYSLFFHLHLGRPYRRMGRRLCGTEHVHGWDVTPTRFQ

SEQ ID NO: 60248 - protein, 101 aa, Sorghum bicolor
  Clone ID: 7659390.pep
KDVQGWGMNDRGVSYTFGADKVSQFLQKHDLDLICRAHQVVEDGYEFFADRQLVTIFSAPNYCGEFDNAGAMMSVDETLMCSLQILKPAERKNKFMGSNKM

SEQ ID NO: 60249 - protein, 24 aa, Sorghum bicolor
  Clone ID: 7659405.pep
QHFTTHLFPQSIIAQKSSISISDL

SEQ ID NO: 60250 - protein, 50 aa, Sorghum bicolor
  Clone ID: 7659407.pep
FVVSDFDEPIKLKFSMMQIDCTHTKGGLCVDSVFIYPKGYKPEKASIVDT

SEQ ID NO: 60251 - protein, 54 aa, Sorghum bicolor
  Clone ID: 7659416.pep
FLVDLRQIKTRVPGAQNNLLTETSHKPCNICFAKFLNMGWGTKTFETCFKKPQF

SEQ ID NO: 60252 - protein, 61 aa, Sorghum bicolor
  Clone ID: 7659430.pep
IVKLANRNSLMFRIFPGWRRKSPQVNLATSSFHNQYIYSYIIVVTHSNRKGEKNSGTCHEE

SEQ ID NO: 60253 - protein, 162 aa, Sorghum bicolor
  Clone ID: 7659497.pep
MAAASLARLSRRATASASAAAPSLRRLLSATSTAPAAASAPPPPPSAAAAAAVGADRVRWDYRGQRQLVPLGQWMPKVAVDAYVAPEAVLAGQVTVHDGASVWSGAVLRGDLNKITLGFCANVQERCVLHAAWAAPTGLPAETLGDRYVTVGAYCLLRSCTI

SEQ ID NO: 60254 - protein, 91 aa, Sorghum bicolor
  Clone ID: 7659500.pep
MAMRTALTSLPARLRAPAAPSSAAATGGGLRLLSDGKGRVLSEEERAKETVYIQKMEKERQEKLKKQLEQEKPGADKAKPADADKKAEGST

SEQ ID NO: 60255 - protein, 57 aa, Sorghum bicolor
  unsure (1)..(57): unsure at all Xaa locations
  Clone ID: 7659597.pep
QPPPPPHPPPPPPPPPHPPPPWPPPPPHPPSPWPPPPPHPPPXWPPLCPPPPDPPPP

SEQ ID NO: 60256 - protein, 92 aa, Sorghum bicolor
  Clone ID: 7659598.pep
DNCEFRVMQLGPGGEYSLLVHHTKEELQQWGMSPEMIADQQWRASANRRSWAEECSSFIDTFFEEPNDSSETSSSDDEEPVDKENGKTKLLE

SEQ ID NO: 60257 - protein, 36 aa, Sorghum bicolor
  Clone ID: 7659606.pep
KSRLPIPPSMGYGSKRVGQIPQNSTLIFDVELVNVK

SEQ ID NO: 60258 - protein, 56 aa, Sorghum bicolor
  Clone ID: 7659693.pep
TVVNTERASEQACTQSSQSRTRAAGRSISPLPLRQREGRPWPSCAAAAAAAYRGRP

SEQ ID NO: 60259 - protein, 156 aa, Sorghum bicolor
  Clone ID: 7659694.pep
VSTAPQGTPGYVDPEYHQCYQLTDRSDVYSFGVVLVELISSKPAVDVTRDRSEINLAGMAIHKIQQCQLEQLVDLDLGYGSDEATRKAMTMVAELAFRCLQQNGEMRPPIKEVLDALRSIQEDGFGKKGDALIAPRSPDTVHAPWDSMSTTPSISQ

SEQ ID NO: 60260 - protein, 52 aa, Sorghum bicolor
  Clone ID: 7659698.pep
AALPLYQKRRNGGDYCRCQEGRAPGPDPKANRVRVRVKKKSVVVNKGPAHCM

SEQ ID NO: 60261 - protein, 76 aa, Sorghum bicolor
  Clone ID: 7659771.pep
MQRLASSRRLLQAALVPARANSSLSAAAVAAPAPENGADAVPKMPAFDYTPPPYDGPRADEIFRKRAQFLSPSLFH

SEQ ID NO: 60262 - protein, 118 aa, Sorghum bicolor
  Clone ID: 7659778.pep
MAAALGAVVRRLHTAAAQPPRLTKFALHPPKSVEIEFADGSSFHLSAEFLRVYSPAADSKIRSVGGEKVIFGRQHVGIMSAESVGNYGVRILFDDLHKTGIFTWDYLHHLGSNKFGLM

SEQ ID NO: 60263 - protein, 163 aa, Sorghum bicolor
  Clone ID: 7659790.pep
ARGRAGSVVELVVMDCKGIKQYDLLKFGQGWMKLEKFEFQISNCWSSGTPSNSSYYAHHPYKYDLSCENLKDLRLAHIDIAMRMLGHIVAVPHIGLHFLLRKCKALEKLCLHYVTGLEKSDMIALFQNCSTLRSFTLHELPTLRMPLTDESLVVLGRSCPMLE

SEQ ID NO: 60264 - protein, 175 aa, Sorghum bicolor
  Clone ID: 7659792.pep
SVSRPLSAPQVPAAKQSAPVTSTAPNAPLLSRSMSAVGRLGNEPSASAPSFIPRSRTYRNAMMEKSSGGGSSFTHQQGSSEQAVTPLQSIFTSQPSIPSSETLSRKEETSLRPGFTFGTVKPESLNPYQGREDTSQQASSSSSSSSDCMPSNSNIRSEIAKLNLNGRSRSKQLLS

SEQ ID NO: 60265 - protein, 152 aa, Sorghum bicolor
  Clone ID: 7659797.pep
ARGLPEGIRVALVTFAASVWVHDLGFEGCARVVVLNGERELESDKIQELLGVHRSPYKKLAMPRSTEAQRFLLPVSECEFNITSAIEDLGSMSACPRGHRPLRATGAAISTAIALLEGCCSPSTGGRIMVFTSGPATVGPGCVVETDLGKAI

SEQ ID NO: 60266 - protein, 139 aa, Sorghum bicolor
  Clone ID: 7659800.pep
MARPSASAAAAALRACLGVAFAFALLLLLPSSGLPRRALSADESCHDVAPGSDGDRGGGGGYVDYLYLFYCVLGGGRRPFLGYAALAAWLAVLFYLLADTAAVYFCASLEGLARLLGLPPAIAGATLLSLGNGAPDALS

SEQ ID NO: 60267 - protein, 123 aa, Sorghum bicolor
  Clone ID: 7659840.pep
HEGSFGVVLYEILTGRRSLDRNKPAAEQKLLEWVVQFPPDSRNFRKIMDPRLRGEYSVKAAREIAKLADSCLLKNAKERPTMSEVVEVLMRAVQAHAEPDSRTPGGPGAKGKKSSDAATPSRR

SEQ ID NO: 60268 - protein, 173 aa, Sorghum bicolor
  Clone ID: 7659855.pep
TDPSAPPTRFLGAWLAGGFAMSVAWAYVIANEVLSLLVSAGTILSVDSAALGVTVLAWGNSVSDLVANVAVASRGGGAQVAVSGCYGGPVFNVLVGLGLSMLLSCWSGYPRPVEIPREPGLYRTLAFVASGLLWAVVMLPRRGMRVDRTLGFGLLVIYFCFLCINISQLKNAR

SEQ ID NO: 60269 - protein, 73 aa, Sorghum bicolor
  Clone ID: 7659864.pep
QQTEIQVHYIHFLSITSFRQICGSHKNGTFDGTEEYIIILFFPSNISQLNSFQSKFPLPMTQNNFVLHKALIA

SEQ ID NO: 60270 - protein, 64 aa, Sorghum bicolor
  Clone ID: 7659911.pep
HVGIMSAESVGNYGVRILFDDLHKTGIFTWDYLHHLGSNKFGLMRNYIRTLRKHGLSRDPQRRK

SEQ ID NO: 60271 - protein, 72 aa, Sorghum bicolor
  Clone ID: 7659922.pep
ASSITLASKHALLDWGGTIYWLLASCCLLKKTTQQLATCDTQNTLAPLVLQSTAGAVLPSRTWTCCMLKNTA

SEQ ID NO: 60272 - protein, 176 aa, Sorghum bicolor
  Clone ID: 7659936.pep
TRVCQRLEHSLEILGVSAIEDRLQDGVPETIEILRQSGINFWMLTGDKQSTAIQIALLCNLISSEPKGQLLHIDGKTQDEVARSLERVLLTMRITSSEPKELAFVVDGWALEIILSHYTEAFTELAVLSKTALCCRVTPSQKAQLVKLLKSCDYRTLAIGDGGNDVRMIQQADIGV

SEQ ID NO: 60273 - protein, 139 aa, Sorghum bicolor
  Clone ID: 7659983.pep
MDLSPSSPSPSSVPVPCQWSGAAACGLAGRVLCAVATCVFAAVGSLVGAVTGSMVGLATESGMLRGAGIGAISGAVFSIEVAESSRDLWHSADSGVWSLLYMVDIISGLLSGRLVREKVGPAVQSAVQSQISAISSPFE

SEQ ID NO: 60274 - protein, 72 aa, Sorghum bicolor
  Clone ID: 7659986.pep
RRVAAAAALFLATILRLRPRSTRNKYRLPPGPRAWPVIGNLNLIGRLPHRSIHELSKRYGPLMSLRFGLLPR

SEQ ID NO: 60275 - protein, 90 aa, Sorghum bicolor
  Clone ID: 7660001.pep
MRCLVGGGGVQDSPRGAAKRVSPASWRLDTAAAEADAGGAAAAAKGPRLCFRPRDVMETVHEVAIYIHRFHNLDLFQQGWYQMKISAMWE

SEQ ID NO: 60276 - protein, 101 aa, Sorghum bicolor
  Clone ID: 7660017.pep
AVQSQISAISSPFEETSDLFETGSVRGLPEDAVRRLPETVIAADTAVDAAGQALCCSVCLQDFRVGEPARRLPGCRHLFHVPCIDCWLVRHGSCPLCRRDI

SEQ ID NO: 60277 - protein, 130 aa, Sorghum bicolor
  Clone ID: 7660027.pep
TGSLYLPQRSILQFAMANLVCPKSSFGRDHVQPMNRAQKSCMTETERANFDAHCHCSSLSSLSANLAVSFHKDTSISFSTSFCSAHRSAASSSSILSRFLSWRSSWSLLSSCTAETPLYSALPSSSSSSP

SEQ ID NO: 60278 - protein, 98 aa, Sorghum bicolor
  Clone ID: 7660041.pep
ERAAAADGQRQRSMALNSEGLEGLVPRAKLLLSLGGTFFLAFGPLILVTVSLFAGLYVYFGPSFVHDASKTPVSVPPYIDPYELLEDERLSRPSPDVF

SEQ ID NO: 60279 - protein, 89 aa, Sorghum bicolor
  Clone ID: 7660063.pep
PRGINIFQKAERSRGPMYPLMNLEFQLSPDKDNMMIASSPAPAKNKSFVYEPLLFDSPMASRRSLAPFSFDIFHPAHLRTFPPRNIKAN

SEQ ID NO: 60280 - protein, 35 aa, Sorghum bicolor
  Clone ID: 7660081.pep
LPFQILLKVQKSSQFHGYSLKVPHWFLFSAHFISS

SEQ ID NO: 60281 - protein, 89 aa, Sorghum bicolor
  Clone ID: 7660099.pep
LDNYTNRDRIQCVTSNHAGTENRVISRILCINSSYDVVDPHLSTPFDDGRSVEGRIWLYEDGTFGFGFVGSNSIIDLRHVSSAGCILDT

SEQ ID NO: 60282 - protein, 150 aa, Sorghum bicolor
  Clone ID: 7660104.pep
VPHVACNIQIKKPICIIGGGDLPDDTVLTCSRGFDNALEFLSTCKIANLTIRAELGCCLLHRSGKLTIQECLLQCEQNPLDYLSFPIISTAIEYNSFPSLKEQGHGVTVVRTRIEGGAKAVRTNGTLALQRVRAIYSRSSVFFWFEVGEK

SEQ ID NO: 60283 - protein, 123 aa, Sorghum bicolor
  Clone ID: 7660107.pep
ARGPNLPTACKDNSAPLLDMVTACHDKSGNRWPNFIAVDFYKRSDRGGAAEATDKANGGLVCGCGSISACNANGTCTPRHGRTPKGIFNASSDAAAWRSPPPPVLQWQRLILLPCLLALLLGL

SEQ ID NO: 60284 - protein, 81 aa, Sorghum bicolor
  Clone ID: 7660109.pep
GSGDDGAPVVFLKHNVIDEYDEQSEVADRLRIKIVPLFHFYKDGVLVESFATRDKERILAAIQKYTSAEPEPEPEPEEEEQ

SEQ ID NO: 60285 - protein, 45 aa, Sorghum bicolor
  Clone ID: 7660119.pep
HKRTHLGSLFTHPYDYHIFFSPTITITILSEGKKQLKVASTRFGP

SEQ ID NO: 60286 - protein, 42 aa, Sorghum bicolor
  Clone ID: 7660127.pep
VNFLLPPDYKKDNLLQNLGGLSFLNTKTTLSMGETDTDNSTQ

SEQ ID NO: 60287 - protein, 126 aa, Sorghum bicolor
  Clone ID: 7660128.pep
SKACNAVVRNSEWENSPNLAQKSGLISTLISTHFSSAAQKPPPRPADVNINSAVYPGGPPVPVQTPKLLKFVDPTEMMRGPQDSPGYWVVSGAKLNLERGKISLRVKYSLLTAMMSDDESLDDDEF

SEQ ID NO: 60288 - protein, 107 aa, Sorghum bicolor
  Clone ID: 7660181.pep
HEADPSLLSLLSPPYPRRRRRHHPPPPLPVLSSLCSLHTAIARARKWRGLATQGSALRHARSKNTTDRANLIGPHGGHGLRRSRRRWLLPALSSPHSLHAGMSTVVA

SEQ ID NO: 60289 - protein, 52 aa, Sorghum bicolor
  Clone ID: 7660234.pep
RSSKRRASSSPARFETLHVPCTFPCHHLGCFFGVLVMVAMFCYKCSRANVTT

SEQ ID NO: 60290 - protein, 70 aa, Sorghum bicolor
  Clone ID: 7660252.pep
DGIMTHRLCQWAVDFRYGVVDVISVNILHVFCCGTGLTPMRFSMPLLIRDFRMAQDVSISGSIFVYLVFD

SEQ ID NO: 60291 - protein, 84 aa, Sorghum bicolor
  Clone ID: 7660253.pep
ELVRNYIYVCGVNRFLAAVVVVDHGAPLMSTSNILCTAASCTTLLLLRFSNALCVSVVSLSINRYGWEMCPILASWSCLVCQNF

SEQ ID NO: 60292 - protein, 86 aa, Sorghum bicolor
  unsure (1)..(86): unsure at all Xaa locations
  Clone ID: 7660316.pep
VASLAAAVVASVITLASSFCVGLAVPFSFGCQKTDSYIFDDSLVQTMCVRLLXKKKKKKKKKKKKKKKKKKKKKKKKKKKKKPSKL

SEQ ID NO: 60293 - protein, 184 aa, Sorghum bicolor
  unsure (1)..(184): unsure at all Xaa locations
  Clone ID: 7660376.pep
TRASRSPALPWTGEESSRRRRRXQPGKNLIKIPSYQEVFGTGASSSSSKPASYNPPLASSGGTAAAAASSSSSSSGSFSQAFSFLKSSEFYSPPPPPPPQPTTTTPRPPQASPSAPTRQSKNAILVSHRQRGNPLLKHIRNARWTFADVVPDYVLGQSSCALYLSIRYHLLHPDYLYYRIRELQ

SEQ ID NO: 60294 - protein, 55 aa, Sorghum bicolor
  Clone ID: 7660383.pep
GQPLPLLLLSIRRRSAARAPMQQTRPVKVLAAHPWKLTGRETRLPVGVLTVLEKC

SEQ ID NO: 60295 - protein, 31 aa, Sorghum bicolor
  Clone ID: 7660396.pep
SGCFPKTKAKCPQLVSSSKQDRSIHTCGGMN

SEQ ID NO: 60296 - protein, 42 aa, Sorghum bicolor
  Clone ID: 7660404.pep
LKKCSVCLNKKMFSISSRVFLPREDDHFYKHNLGKQLKIESL

SEQ ID NO: 60297 - protein, 48 aa, Sorghum bicolor
  Clone ID: 7660421.pep
LLALLHPLYCTSLFCTCPHAGSAFLRLKLPAPKRPVPLQNSLGINLQQ

SEQ ID NO: 60298 - protein, 92 aa, Sorghum bicolor
  Clone ID: 7660458.pep
TRVPPTPPGATTTAPGASDMPSPPSSSCLSPSLPLSLPCPSDAVAGAASSSCGQAKAARWHLHYSLLHPRCYYLSSALHCIGQCLGQCPVLS

SEQ ID NO: 60299 - protein, 157 aa, Sorghum bicolor
  Clone ID: 7660460.pep
IVLLSLPSDILRIWGNLRTTEASSASEHPRVAFMTSIFAPMELGPTQQTAHKALLNIPVLRGTPSFSAHATLSLTFSGFMDISIGNSKLLEAVRPHCCRNAMLGDLDCTHSNYQTLTRPVLLFIVTTSPCQDWVICAPAAFLGCGSRFSGSLSGIEP

SEQ ID NO: 60300 - protein, 174 aa, Sorghum bicolor
  Clone ID: 7660499.pep
VTAPITFGCGRIQTGSFLGSAAPNGLLGLGMDSISVPSLLASEGVAANSFSMCFGDDGRGRINFGDTGSSDQQETPLNIYKQNPYYNISITGAMVGSKSFNTNFNAIVDSGTSFTALSDPMYSEITSSFNSQVQDKPTQLDSSLPFEFCYSISPKGSVNPPNISLMAKGGSIPR

SEQ ID NO: 60301 - protein, 80 aa, Sorghum bicolor
  Clone ID: 7660581.pep
WSSWRTGGRCRIPWDWQVDQLVYVVSGEVKVIPAGPVHGDDYMHFVAGDLVRYPRWFEADLYFDGPYEERYRFLAYGDDN

SEQ ID NO: 60302 - protein, 112 aa, Sorghum bicolor
  Clone ID: 7660582.pep
TRQRRRADLQPPQSPAAMASSNSGIPIKAEQDSDGSAQSTADMTAFVQNLLVQMQTRFQTMSENIISKIDEMGARIDELEQSINDLKAEMGNEGMATPSKIKEESKPSDSSA

SEQ ID NO: 60303 - protein, 82 aa, Sorghum bicolor
  Clone ID: 7660600.pep
FVTNIKRYIKNLTGKLEPKKADEFKKGIEGAPKFLFSKLKNFQFFVGESMHDDGSLVFAYYKEGAPDPTFLYFAHGLKEIKC

SEQ ID NO: 60304 - protein, 182 aa, Sorghum bicolor
  Clone ID: 7660650.pep
TRVRHNKSTFGDVFKVFFALMLATIGISQTSALASDSTKAKDSAVSIFALLDRKSKIDSSNDEGSTLHEVKGDIDFRHVSFKYPSRPDIQIFSDFTLHIPAGKTVALVGESGSGKSTVISLLERFYNPDSGTISLDGVEIKSLKVTWLRDQMGLVSQEPILFNDTIRANIAYGKHGEVTEEE

SEQ ID NO: 60305 - protein, 153 aa, Sorghum bicolor
  Clone ID: 7660656.pep
ARGLDQLLKLARIEDDDLLIMSDVDEIPSGHTIDLLRWCDDIPDILHLQLRNYLYSFEFFLDDKSWRASIHKYKSGKTRYAHFRQTDELLADSGWHCSFCFRYISDFAFKMQAYSHVDRIRFKYFLNPERIQDVICRGADLFDMLPEEYTFQE

SEQ ID NO: 60306 - protein, 133 aa, Sorghum bicolor
  unsure (1)..(133): unsure at all Xaa locations
  Clone ID: 7660683.pep
MELAIESQLSLLLRVPLASLNFLSMLNLSYNELVGRIPDSPNFLAFTNLSFLGNIGLCGFQVSRACNSTTLPFMKPHHSEKKSLDLVLFLFTGXLGFGVGFAIAIVLTCGIQVRRRSQNRSIFLRCKKVLFFM

SEQ ID NO: 60307 - protein, 180 aa, Sorghum bicolor
  Clone ID: 7660752.pep
LASLNKPEVPILLLGSLAAGVHGVLFPMFGLMISNAIKTFYEPPHQLKKDASFWGLMCVVLGIVSILSIPVEYFLFGIAGGKLIERVRAMSFRSIVHQEVAWFDDPKNSSGALGARLSVDALNVRRLVGDNLALAVQVISTLIAGFVIAFVADWKLTLIILCVMPLSGVQGYAQVKFLKG

SEQ ID NO: 60308 - protein, 89 aa, Sorghum bicolor
  Clone ID: 7660759.pep
SALIVASTLQIIPGLSGLWRNVATYLNALSAAPLVALVGFGLYELRFPSVAKCVEIGLPELILLVIFAMYLPNTDHMLKSIFDRFAVLF

SEQ ID NO: 60309 - protein, 89 aa, Sorghum bicolor
  Clone ID: 7660783.pep
HEELQRQRDWYLMSTAAAAAGPDPSYFHLAAAAAEHEDPAALWSPRLRPSPCPECEAAAAAGMRHPAFHWCVRDAVVSVGFRSHVGPIE

SEQ ID NO: 60310 - protein, 82 aa, Sorghum bicolor
  Clone ID: 7660784.pep
VQSKSLNKDPLESREKVMSLVDPAIVEGWAREEAVRVLRVAVLCTSRTPSMRPSMRSVVQMLEDAAAAREDDDVKVLEVKVV

SEQ ID NO: 60311 - protein, 88 aa, Sorghum bicolor
  Clone ID: 7660794.pep
ARGLLFTVVSQDEKYKAKVCIDVIVQRLGDATAAGIYRWLFSSLEKKTSKVTLFALPLCFVWLVIAFHLGRLQTNLARLQAASAASYS

SEQ ID NO: 60312 - protein, 130 aa, Sorghum bicolor
  Clone ID: 7660853.pep
NKICNKFNFQITHEQKREEEEEKNMYCCLLFCCVITLTLGTRYPSILPSQTKTSKLHGRTNQKKPTIQWLLLNWSPHFVVALLKSEESHLVSLHLQLSYRQSTMSRAAAAAASCSQPTGRINRRLSTVPV

SEQ ID NO: 60313 - protein, 47 aa, Sorghum bicolor
  Clone ID: 7660855.pep
KGGRVGSKEAGENEKLSLSVEVSPVSIKQQSMSMCSVPVRLVLFCLT

SEQ ID NO: 60314 - protein, 170 aa, Sorghum bicolor
  Clone ID: 7660905.pep
HGVEAGNNPAELAAAVGGASSSSSRAAARSRVAAAAGASGSSPVAAARSRGAGAVAAAAGGGGGVGPSCQVERCNADMGVEKRYNRRHKVCDAHRKASVVLLAGLRQRFCQQCSRFHELSHFDDTKRSCRLRLAGHNERRRRNPAEAHDQNGGRGDPGNHHLHIRSDKPI

SEQ ID NO: 60315 - protein, 47 aa, Sorghum bicolor
  Clone ID: 7660906.pep
IQTSPEWSGKTQVVFYNTRVMFFWHNCIVIIKGGRLNNIGIKKKKKK

SEQ ID NO: 60316 - protein, 127 aa, Sorghum bicolor
  Clone ID: 7660909.pep
MDGKNFSNKQQAEQKNPDAVTDSVPSQSQEALNPSDDGNTSPINGHEADVNMEASISTEDVIRAGGFGAKDDIGSLLPTAIDSTDFEASLRDARDFEGEKEAPSHPGLGWKGDKADDGSKLSDVPQQ

SEQ ID NO: 60317 - protein, 169 aa, Sorghum bicolor
  unsure (1)..(169): unsure at all Xaa locations
  Clone ID: 7661010.pep
TRRFATNFIALXSIYKHKTDLQAMVVSNEWTTCAYYKEAKAKKFTKAVLDQKFWKDCAIICQISKPIVRVLRIVDSDERPAMGYLFGAFHASREEIVKRFQRKKELVKPFLKYIDARWDRHFDKNLHAAGFWFNPNNQYDNDLREKYNFTTSRVLDVIEKYAGKDIALR

SEQ ID NO: 60318 - protein, 124 aa, Sorghum bicolor
  Clone ID: 7661044.pep
ASPPPPSVLITGFRAHGKSSLVNTACRALAAEDGPLLLRAEASPPGGGTDGPRRRRRVKAVVAGADGDSVGAAGEGDVVELLDAPPLPEAGRLTREEIDAAISGGDPECVVFVLRCDAPTKEPR

SEQ ID NO: 60319 - protein, 164 aa, Sorghum bicolor
  unsure (1)..(164): unsure at all Xaa locations
  Clone ID: 7661046.pep
HEDQFGRRSSIQHRDCPLQLCCARLKVQFGVSTKFLDNAGRPKMSIVVEIPESLSKVLEFCDDLARKLSQESGSSSEWRPLIKKYGYVNRPTVRLNIPTIANSNATAYSTDICQKEPTGSIQKLDFSKCXTTELDSLCVKGSKVDACFSPELYDYQQNAGIRLV

SEQ ID NO: 60320 - protein, 121 aa, Sorghum bicolor
  Clone ID: 7661049.pep
TGSAPAVWGDGRAPIPLLSPLVVSPTVPVWEADQAGAAARKEGGGDQLAEGRSGAEQQQRGAARHGGSGERQAHDMSPRPPSPAVGAGWRHPALSAPVAEPASLVPLFQSQCALEVRNAQQ

SEQ ID NO: 60321 - protein, 128 aa, Sorghum bicolor
  Clone ID: 7661116.pep
RAERWRVGGRVWRRRGRRGRWGGIGAGVRQFPCNARLLPATVSQRDACGQFLTSGSDRIGIGDRLGICGRRLDLIPSFSLKNPSPVTSLGVGVGFGASPTAFIEVLARQNSAALQIVGIVRLMSDKRY

SEQ ID NO: 60322 - protein, 166 aa, Sorghum bicolor
  Clone ID: 7661120.pep
ECRERIADLPAERGHGVLPAEARRDNDRQRPGSRRRGYLEEEGQPRHAHQDGAGAAGDAEGSFGDRVISRRATKITAIAVGMKQDGNCFWGRDLPCKRPGENKVCLLDEAPCRARMEYDLTGTQDTGHRGPRVAFSVFASRNGLFRCDFFFDFATVVFSFVYDKYC

SEQ ID NO: 60323 - protein, 88 aa, Sorghum bicolor
  Clone ID: 7661126.pep
FFIYFSRLISSSALLFIYQLDVFRKTDSGLDLEADFDSVLVWFLALYLRSFALLSYSDLDLYPIGDRRCESSDSDLYLYYILNMRRRQ

SEQ ID NO: 60324 - protein, 67 aa, Sorghum bicolor
  Clone ID: 7661140.pep
CPHASERQQLPTTRCINTMRGFCACIELNSSLRCQWLQSPVLVDVHAHTQLCTHALFLFSCQPWSSS

SEQ ID NO: 60325 - protein, 146 aa, Sorghum bicolor
  Clone ID: 7661180.pep
PRSVTGLKTCIAAVRASAAQPAQMERKGEVKVVKLRAVEATPESFAPFGQVITGSPDGDEFGPHDAQLDLSSGIPRFYIMRLQDRPLEFSTITHHASVTQCLGAIGGQDWYLGVAKPSIVDGASEQSGPEGRKLLQSAAGHCYLPP

SEQ ID NO: 60326 - protein, 141 aa, Sorghum bicolor
  Clone ID: 7661196.pep
RVTRATTAILSTSDNDPTRRTTSRGRSGSRCAAASTGSRASAPAWCTAGGDRVALPPPSAGRPRRAPCPPPLVCPSEWYYYYVYEYELSVSWCMLSSDITRRLSSDLFFSISLDLFCSWMELGIFLGLLLLGDGWIWWHVA

SEQ ID NO: 60327 - protein, 60 aa, Sorghum bicolor
  Clone ID: 7661231.pep
VFRVSGSKFLKLNKGTWHAGPLFKADAVDFYNRELSNTNVVDHITRYFKKHDGITFVVED

SEQ ID NO: 60328 - protein, 98 aa, Sorghum bicolor
  Clone ID: 7661241.pep
TNPASGPVIQQPMYDPFYASNPMAAARSVQMVAMEQQQHAFMLQQQQHQQQQMMMMAQQQQQASSNPFANLYMHAGAHPYAAGVQLHAGNAYFGTGMM

SEQ ID NO: 60329 - protein, 213 aa, Sorghum bicolor
  Clone ID: 7661248.pep
ISFYVHQSSSEFSNQQTPAGTYDETTLQPQQQRDQIMITSHNNLYMQYIYRKRRGKKRNCCLPGAAASMWSCPKPSNADLMRWWSVPRDREVGALLLLAAVLPLALVLDPLEPLRRAFLHLPDPGGRGRLGLLPHAAAAAAGLAAACVVARRPRARVAAAVVPLVRPRRPERVVPLHPCRRCPPAARSEAEKPIENESCAARSIESRRKTKEK

SEQ ID NO: 60330 - protein, 140 aa, Sorghum bicolor
  Clone ID: 7661256.pep
MEHAVRSVKLAILPSINCKKNIILQYTYYKTQAATCHIQSHLLCGSYSVPASKHRLQNRMSTVGQLGSIFTWPLMANLTACSAGSLAPSEIIRTMSTICLKNERCWMPTSKLPYVDCALSASNPSLSHSSIRMPPSNIKP

SEQ ID NO: 60331 - protein, 66 aa, Sorghum bicolor
  Clone ID: 7661258.pep
DKSFTARVEDIQDVISTLQNKSFVGPPLLLQGAQDQGRRHIDGASSSNIPGNSKKARVKRIKDGKK

SEQ ID NO: 60332 - protein, 45 aa, Sorghum bicolor
  Clone ID: 7661275.pep
CLCCGWLQDAQKTKGSLLDLNRGLSPPKNAICCIGVPKNFEVLGF

SEQ ID NO: 60333 - protein, 65 aa, Sorghum bicolor
  Clone ID: 7661281.pep
KCHRESFLWGETEGKPIPWQGRASCSRKYMFLITQNKRPNMLTSKVKFALPGETVYDAFSLAIFF

SEQ ID NO: 60334 - protein, 35 aa, Sorghum bicolor
  unsure (1)..(35): unsure at all Xaa locations
  Clone ID: 7661309.pep
YESTCCSIYTVIMQLGFLCLFTCKTSQSSTTGXMY

SEQ ID NO: 60335 - protein, 139 aa, Sorghum bicolor
  unsure (1)..(139): unsure at all Xaa locations
  Clone ID: 7661313.pep
QVFEDEDDMLWRSPGTPVFTAPECCQVXGSAYHGRTSDTWAVGVTLYCMISGHYPFLGDTLPETYDKITNDPVQIPDDMNPQLADLLQRLLCKDPGERITLQTAAEHPWVAGDKGPVPEHICRCGFGRWKRSDTGNQVQ

SEQ ID NO: 60336 - protein, 73 aa, Sorghum bicolor
  Clone ID: 7661325.pep
PVARILELCILHIAMAEMTSKGTPHKVVINEAVDLAKRFCDGGAPRVINGCLRTFVKDHVDIAGTSQGAESKS

SEQ ID NO: 60337 - protein, 133 aa, Sorghum bicolor
  unsure (1)..(133): unsure at all Xaa locations
  Clone ID: 7661328.pep
MDTVLSHAESGLVHPDELDEEFDTFPTSKPGDVVRMRYDRLRSVAGRVQTVVGDLATQGXRAQALLSWRDPRATAIFIMLSLLVAVVLYVTPFQVVAVVLGLYLLRHPRFRSKQPSVPFNFYKRLPAKSDMLL

SEQ ID NO: 60338 - protein, 81 aa, Sorghum bicolor
  Clone ID: 7661376.pep
TFAAQPKQEEAPTTTSELQLVAGLSAAAPSSSSVVSEDMAPFASLDAAGIFELGDAASAAAYWNAGSCWTDVVQDPSMYLP

SEQ ID NO: 60339 - protein, 116 aa, Sorghum bicolor
  Clone ID: 7661378.pep
CQHEVAGLEMQSRDGDWIVVEPSPTSLVFMVGNALRAWTNDRLYAPFHRITVAGDVARYSAMLFSVPSYKVQVADELVDDEHPPRFKPHDNNDFVCFCVSEEGARHQDKLKAFCGV

SEQ ID NO: 60340 - protein, 124 aa, Sorghum bicolor
  Clone ID: 7661383.pep
LADQIFRNPDYHKHVRKAVVKQLKEFKKHYEGYVPMEYKVYLKKMKRSGEWGDHVTLQAAADRFAAKICLLTSFRDTCLVEIVPRDATPTRELWLSFWCEVHYNSLYAVEDLPTRKTKKKHWLF

SEQ ID NO: 60341 - protein, 63 aa, Sorghum bicolor
  Clone ID: 7661385.pep
TNKLTLSPPLGLMDIPTGALLNPFFFYTMHYKLQQTRAEFIPSRSINNTHYTNWSRKELTLTT

SEQ ID NO: 60342 - protein, 73 aa, Sorghum bicolor
  Clone ID: 7661413.pep
DPIKTRMQVMDGAGDPIPVGRTVRRLIKEGGLAACYRGLGPRWGSMSLFAPPMIPPYEFLKRFSDKGQESVFA

SEQ ID NO: 60343 - protein, 129 aa, Sorghum bicolor
  Clone ID: 7661469.pep
LMAYVDYFGSPPEHILRAVKAGLKDKGLDAMLALIEDETLSSFSSASSSSDEEAAGRAQLRRPSSGSYGRRSAEEPVVCSPASSLVAVMVQALAHRVSYVWVLDEDNDCRLAGIVTFADVLRVFREQLL

SEQ ID NO: 60344 - protein, 137 aa, Sorghum bicolor
  Clone ID: 7661483.pep
DKEPLFDSVKAVLGMLEVCTEFAQNISFNSKRIQSSLPAGYLDATTLADYLVKKGIPFRTSHEIVGRSVALCVYKQCQLAELELDDLKSVHPVFEGDVYEYLGVENAVNKFISYGSTGSEQVKKQLEDWRIQLGISS

SEQ ID NO: 60345 - protein, 125 aa, Sorghum bicolor
  Clone ID: 7661510.pep
AQVFTEGIAAAWPGTFSLPVRAAVPVMYSARRMFAASEWLREELQERDDLGRGPPVPQRRVVAGRALAAANLAFWGFNLFAFLLPFYLPRALRRYYLGSDHEDDGGAHAHLKQQQQPQDEGKKDS

SEQ ID NO: 60346 - protein, 39 aa, Sorghum bicolor
  Clone ID: 8087897.pep
EKELKGLQERESGAKAEEKHILTQMEELKTEADDWKAKS

SEQ ID NO: 60347 - protein, 135 aa, Sorghum bicolor
  Clone ID: 8087898.pep
TRLKVTGQRNQDLPSVEEVVKRESEKRIENEKLAQVGYAYDLAHSKAWEHMEKVTEIRNKRDQEKATSHRQKERRRQWERRHISRDVTKKHKKKNGEKKERKKEQREELTKKAIEAAAKAESKSENVSGVSTPLD

SEQ ID NO: 60348 - protein, 46 aa, Sorghum bicolor
  Clone ID: 8087901.pep
RPASLGLRQRNEVNGHERCWLRSAAGTLAAIDAVGYQTAALWPPRA

SEQ ID NO: 60349 - protein, 52 aa, Sorghum bicolor
  Clone ID: 8087902.pep
NIKHAADQTETAWHGCGQQNGIEIWRINQFKVEKVPKEHYGQFFEGDSYIVL

SEQ ID NO: 60350 - protein, 52 aa, Sorghum bicolor
  Clone ID: 8087907.pep
EPFPPLLVGITTHSRADHPRICVSQTTPPKPAAYVKAQKLLQPYSVLLEPWV

SEQ ID NO: 60351 - protein, 52 aa, Sorghum bicolor
  Clone ID: 8087908.pep
PTGMASSATAVAPFQGLKSTDTLPVARRCTTKLAKVSNGGRIRSMHVWPAYG

SEQ ID NO: 60352 - protein, 87 aa, Sorghum bicolor
  Clone ID: 8087917.pep
PLTFVSWPPTWRRNLKSVPNHLFPAWQMPASGSSSSVRSKGGGLEDWDDLEGADVDRYGFITLPPPPGSRTGTPTETRSASGSPRKR

SEQ ID NO: 60353 - protein, 63 aa, Sorghum bicolor
  Clone ID: 8087936.pep
LTICFLYQMKKSFFAPAPLLPPTLKVGFKEYVEYVQAYNLYVDFLAGSMASWKKTVKERASKV

SEQ ID NO: 60354 - protein, 85 aa, Sorghum bicolor
  Clone ID: 8087938.pep
IAIAVYLTCQNEKTTLLGKTKQDYACILRWMSYANTEILTPLGGWFRPLVGRDPYNKKNIEDSKAAATKAVHVLEEYLLTHTYLV

SEQ ID NO: 60355 - protein, 60 aa, Sorghum bicolor
  Clone ID: 8087940.pep
MRNCWNDGVPMVTQRPIPTNGNFTYRFDVAWQEGTLWWHAHDAFLRGTIYGALIIRPRQR

SEQ ID NO: 60356 - protein, 53 aa, Sorghum bicolor
  Clone ID: 8087945.pep
PWLGGEPSLPHVAVPVPVAAAPVNAVPGGLGHGQRSGGWSEGRAGLGVGGREI

SEQ ID NO: 60357 - protein, 65 aa, Sorghum bicolor
  Clone ID: 8087946.pep
TRTTSEPKGVVHCHRGLFLITLDSLIEWAVPPHATYLWTLPMFHANGWSFPWGMAVVGGTNVCLR

SEQ ID NO: 60358 - protein, 174 aa, Sorghum bicolor
  unsure (1)..(174): unsure at all Xaa locations
  Clone ID: 8087948.pep
ARGRTHARTHWPQMLKLKDWPSSSSFDKRLPRHXREFISALPFREYTDPRCGPLNLAAKLPAGVLKPDLGPKSYIAYGLYKELRRGDSVTKLHCDISDAVNILTHTAEVTCQTDHRQIEKIQKDMREQDLQELYGGLKSCSELKLSPPPTECRDESADEGLKTSYIREDNCVNR

SEQ ID NO: 60359 - protein, 33 aa, Sorghum bicolor
  Clone ID: 8087950.pep
ARGFVKLAKQAGLFVHLRIGPYVCAEWNFGGFP

SEQ ID NO: 60360 - protein, 44 aa, Sorghum bicolor
  Clone ID: 8087954.pep
PYSQCPLPSAHCPCHCLASAYATHGSYTQRSAQLIWLRIPFARC

SEQ ID NO: 60361 - protein, 57 aa, Sorghum bicolor
  Clone ID: 8087959.pep
PTRICQPGIPPASLVRSALKNSGAAAGRGSSELYSAATGRWGVHVRRQATLPLPAAA

SEQ ID NO: 60362 - protein, 45 aa, Sorghum bicolor
  Clone ID: 8087961.pep
MSSGQDAVLLYSAMALENLSLHSARLTDVPEPTPPPGSLLMCGCF

SEQ ID NO: 60363 - protein, 57 aa, Sorghum bicolor
  Clone ID: 8087965.pep
LDILTNVDPLPCVVLAICFFELLQDNGRFYAIGRAPSEKLNPLACLETRGTIAHSVF

SEQ ID NO: 60364 - protein, 66 aa, Sorghum bicolor
  Clone ID: 8087979.pep
RRRWRASSRPPPCGGGTASERVRQAGLPRGGEQRRRQRRRAPAARRGPAPLCRSITSTRSRGRPRA

SEQ ID NO: 60365 - protein, 88 aa, Sorghum bicolor
  Clone ID: 8087982.pep
MLVGRSPTLPLVTAETPAFGLFITARNVSSAMVVKLSDNKCGGKLSVGRNIEPGKSRREWRALSADQAQASVMDVDEECKQVLTSLDV

SEQ ID NO: 60366 - protein, 121 aa, Sorghum bicolor
  Clone ID: 8088001.pep
CGNVQIDSLLPPPPATAAAWALLLGTIHTVPGIWLCVYPAICCWYCCCCCCISCSHRRFLDRSELAAADDDDGDTSRPTLPEWKLSSSGDDADDVADGGPSAPPNPRPTTRSHGSPRAPLV

SEQ ID NO: 60367 - protein, 127 aa, Sorghum bicolor
  Clone ID: 8088003.pep
ARGFDAWFSLIHQLQQRVVIFSDAGPDTRWVGDEAGVAGYTCWSPFNKSSVTIGHTIAEYSRSGDPFGQDWVPAECDVSIRPGWFWHASEKPKNATTLLDIYYKSVGRNCLLILNVPPNSSGLIANE

SEQ ID NO: 60368 - protein, 124 aa, Sorghum bicolor
  Clone ID: 8088004.pep
HEARLLELESAEPQLLQVRVSPAQATSAAAPSDELILLHAATRHHAVDGGAGGVCSKLPPHFAPRDDRRRSRTRMGRTVPLRVTVSEGYPRRHCFCQSFHEHNMLCKPDTNGAAQIVFGANLST

SEQ ID NO: 60369 - protein, 80 aa, Sorghum bicolor
  Clone ID: 8088012.pep
AVKTNTMSDLYKSSMQARIAKLPDLSSLHLDEEDEDEEDELDGIGELPSGLGPPAMPSTTRHPRSSARDSTPNPAYAPIS

SEQ ID NO: 60370 - protein, 153 aa, Sorghum bicolor
  Clone ID: 8088013.pep
HEAITSDLFPSPSPAATSDPEPEPPGGEQEPSSNSSCTSSSLADFDAAEQLIHLWDTTPEALVFEAPEDDAAHYLGGVDVAVDHLSTPGVSGRAGVAVQLAMSRLEDELRHLMLRHSVPLDASGLYCSLRRLSLGSMDDLDTSSEFDPTTPHS

SEQ ID NO: 60371 - protein, 50 aa, Sorghum bicolor
  Clone ID: 8088021.pep
RQTRRSPRGRRRRARRRLVPRSRGRWEREAPRWGRRRAVLSEQRPGRPRA

SEQ ID NO: 60372 - protein, 57 aa, Sorghum bicolor
  Clone ID: 8088053.pep
LHGVLVSTHFRCRVARQFLSASSGAGRGSDRIGSESLRRGRSWLSLEVRERRRRRAR

SEQ ID NO: 60373 - protein, 168 aa, Sorghum bicolor
  Clone ID: 8088078.pep
TRVVVGVLDTGAWPESKSYDDAGLPEVPSWWKGACESGASGFDAASACNRKLVGARFFSKGYEAAMGPMDTDRESRSPRDDDGHGTHTSSTAAGAAVPGASLFGFAAGTARGMAPRARVAVYKVCWLGGCFSSDILAGMDAAVADGCGVLSLSLGGGAADYSRDSVAI

SEQ ID NO: 60374 - protein, 146 aa, Sorghum bicolor
  unsure (1)..(146): unsure at all Xaa locations
  Clone ID: 8088080.pep
MLVSSSTSSSSPSASQQQRQPPPAHPPPPPPSSSCLTDQQPSPAKRKRRPPGTPDPDAEVVALSPRTLLESDRYVCEICGQGFQREQNLQMHRRRHKVPWRRXSSSTAGGGGAPRKRVFVCPEPSCLHHXPAHALGDLVGIKKHFR

SEQ ID NO: 60375 - protein, 111 aa, Sorghum bicolor
  unsure (1)..(111): unsure at all Xaa locations
  Clone ID: 8088085.pep
LHQKFDLPAPFVLHTDCPHYWRYHLPGETEEEFATRLATNLENLILKEGPETIAAFIAEPVMGAGGVIPPPKTYFEKVQAVVKKYDILFIADEVITAFGRLXGTMFGCDYY

SEQ ID NO: 60376 - protein, 152 aa, Sorghum bicolor
  Clone ID: 8088098.pep
MAGGNRDASDAAAAEAELRAGFETLAVTRPDPSAGVYEVRLNRPAQRNALSPAAFAEIPRAMSLLDRTPTARAVVLSAAGPHFCAGIELGGPGNPLAAASASADPVAAAEALRRAVLDMQAALTAIERCRKPVVAAVHGACVGGGVDVVAAC

SEQ ID NO: 60377 - protein, 110 aa, Sorghum bicolor
  Clone ID: 8088124.pep
NRAAWKSAARVNQAQRGVQGAAAGVGGKKTSLAQRSKYQMEPDSEDDEMENEIENNLDQLHIAAKSLNQLGRAMGTEADKQNEHITRITGKTDAVDDKIARNRLKLDRIH

SEQ ID NO: 60378 - protein, 83 aa, Sorghum bicolor
  Clone ID: 8088125.pep
IREVSVIVTRGVIRAAQKNGVDRAVELRDMSDEQLDEYIKKNMYDPYTERQYFDRKVSHLVASEKLNGTTVGVTEVTNGLAHL

SEQ ID NO: 60379 - protein, 84 aa, Sorghum bicolor
  Clone ID: 8088128.pep
RRFALRDHRRAPARAGHLPRVPPALARCGGRRQGRRRRRRGTRRPRDGLRLYQRRRGLWSSRHLAPPLVHAMHSAAGDCVCRAS

SEQ ID NO: 60380 - protein, 87 aa, Sorghum bicolor
  Clone ID: 8088145.pep
MKNAENQREKKKRDDPWRSTTVAPVQHTTNQSMQETIKSILIFRFGVGIAGVVRIAVSVTFLARGIGSLPKLLGLGSLSSLQSLHLA

SEQ ID NO: 60381 - protein, 133 aa, Sorghum bicolor
  Clone ID: 8088155.pep
DCLARLRRNDFVAHLSTPPLPLRAVLPARLDLAGYTLVAAVARCQVSEARGCQTRLCFVRHDLLRSRALPLGTGGRLVYAFQEMLDIKQKQKLKVCERKCYEKRGKTAEKKRYNRREKNRLFTLAVGMLCTQV

SEQ ID NO: 60382 - protein, 120 aa, Sorghum bicolor
  Clone ID: 8088172.pep
PLHACVYSTRAQKLDAAPENGKNQRSASSCFIRSCSRPSHTSSPSPPSTPPPSCQSPGAAAAASALHGDGVISIGVVCVSAFAAAVAQASPPWPWPWNGSNASWPGKLSLARAPRNSMAA

SEQ ID NO: 60383 - protein, 148 aa, Sorghum bicolor
  Clone ID: 8088189.pep
TPIMNYPKMMYGPNTQKIQHSKTPRVGAMREREREIVRKREMGREQPGKRCESSATLGGHFHVLPSFSDKRLLHTQQSPQCLFLVEAQRGAGVGGEPPVLRPGRAYKIKHFLVFFSFLVSRAARVACSNTSRTPSFVLAEHSRYFWAP

SEQ ID NO: 60384 - protein, 86 aa, Sorghum bicolor
  Clone ID: 8088212.pep
PIWKLKPSVLFPSPFWNHKSRDKGKSSVLTPESRSNSVLRRGLALYKQLQLQAPLKVISTAQTAYVSHEITTATIIATLSLVSIHS

SEQ ID NO: 60385 - protein, 183 aa, Sorghum bicolor
  Clone ID: 8088235.pep
FPQLPRVADLVSDSGIPVIAAGGIVDGRGYVAALALGAQGVCLGTRFLATEESFAHPIYKQKLIEMSRTGYTNIFGRARWPGAPQRVLETPFYVEWKDNFPDQETEENHPIIGHSIIHGVHKDIRRFAGTVPNATATGDINIMAMYAGQGVGLIKEIVPAAEVVKSLVAEAKEVIREKLSGYQ

SEQ ID NO: 60386 - protein, 191 aa, Sorghum bicolor
  Clone ID: 8088262.pep
CTRDINQQYILDPACPDDDLWSPKTVAETDGMSRVMLESALLASKCTESLYSLSYTWGNDETVQESLGVRKGTIGEWKRFNHELLYNHDIQSAVGYHSRLATKGYRALIYSGDHDAVVPHVGTQAWIRYLNLTIVDDWRPWYVGGQVAGFTRSYASGLTYATVKGAGHIAPMYKPLECQKMLIRWISGDSL

SEQ ID NO: 60387 - protein, 77 aa, Sorghum bicolor
  Clone ID: 8088265.pep
APGPASRRPSPRPPAVSRRRRRRGRRRPSRRTRSSPPARTSGAGRTRRGTQPRSRSRRGSGRRRGTGAPRPECRSRC

SEQ ID NO: 60388 - protein, 105 aa, Sorghum bicolor
  Clone ID: 8088270.pep
LGARHPAMMQAGPSLEFQNSFMKSIRDVAVFAWALTGINGSLVDYARGKPVGESQPPDGFPVWNPLPDPNFLGVKQPSAAPSGYGSGSNSSASNDPFGFGDPGLR

SEQ ID NO: 60389 - protein, 161 aa, Sorghum bicolor
  Clone ID: 8088271.pep
DTPQFKYLRMVIKETLRLHPPAPFLIPRETTQHVQVLGYDLPPKTRVFVNVWAIGRDPACWKNPEEFYPERFEDADIDFQGTDFELLPFGAGRRICPAIPMGLMNVGFTLASLLHSFDWRLPEGMAPEDVSMEGTGRQIVSRSTPLYLIPSPYISGQTKLY

SEQ ID NO: 60390 - protein, 114 aa, Sorghum bicolor
  Clone ID: 8088276.pep
QHYARVMQISKSHTSAEQCADDQGHKGSTCSGSGLDTFGVRACFLQVPKEEEDPVGYLPVLVSSVLPRRVLAAIAIRVRVLAGAQVPLDLALGDQVVVLPFPDDPDTQSVSVAP

SEQ ID NO: 60391 - protein, 161 aa, Sorghum bicolor
  Clone ID: 8088286.pep
QGVKSYPTIKWFPAGSKKAVAYESGRSEQAFVDWINEHAGTHRVTGGGLDTVAGTVESLDTLVAKITGGAAIADVAEEVKKEVENLTDSAQKTYAEYYVRVFDKLSSNNDWVSKELARLDGILTKGGLAPAKRDQIQQKTNVLRKFTQKVEEKVEEIKDEL

SEQ ID NO: 60392 - protein, 138 aa, Sorghum bicolor
  Clone ID: 8088293.pep
GDTVPGVALKYSVQVTDIKRFNNMMSDHGIYSRERLLIPISNPEILMGSTCYIEMDHNAKREVAIFYPEGRPGGKTESVASIVAAERRSKRILESVRRSLHVDDGTAAYYLSVTEGDPRAAMMEYSEDLRWEQQRAGG

SEQ ID NO: 60393 - protein, 79 aa, Sorghum bicolor
  Clone ID: 8088298.pep
HAVGVRRRLVVGATTRCAEEAISISTRRLFSFVAPRPRFFFVFVLSNESRGCSQCVCESEIDRRKMNRSTKKKSVLPAS

SEQ ID NO: 60394 - protein, 38 aa, Sorghum bicolor
  Clone ID: 8088305.pep
SSKCGSTDRNFAGTARPAHMHKANPKSNSIITSMGGRE

SEQ ID NO: 60395 - protein, 136 aa, Sorghum bicolor
  Clone ID: 8088306.pep
LNEIRRADNIKRLKKINRQDIRDRSAPRLDLLKGLKALHQQHDVLLKEVAAPPKLKHVETKDKTKPNLFFDKNVHVHKFEKAPLLDEVRKGFKANAKHVETKDKSKPLIDKDFHLKRLDRQGFLAEVRQGTQLKHV

SEQ ID NO: 60396 - protein, 85 aa, Sorghum bicolor
  Clone ID: 8088313.pep
EWHHQRIIPLPKPNSYWDIFAAAAGYLLLKAKPRDSSQIAKWESQYFTLNLKTFLVERLCVSNFQYTRGALLYASFLSPFSLPSI

SEQ ID NO: 60397 - protein, 131 aa, Sorghum bicolor
  Clone ID: 8088317.pep
SSDGFHHYAIAWDAATIEWRVDGELIPREERREGEPWPEKPMYLYASVWDASYIADGKWTGTYHGRDAPYVCSYKDVMVPTAKHLVEEDEENQDADAADAPAVDPAADADAAAAAAAAAAGKEKDAGAGEV

SEQ ID NO: 60398 - protein, 48 aa, Sorghum bicolor
  Clone ID: 8088320.pep
AMIKSMLLSDDFRVLFAVIVHNRRFRHQHCLKSPLVTAVTQYPCFLPG

SEQ ID NO: 60399 - protein, 171 aa, Sorghum bicolor
  Clone ID: 8088340.pep
GSNCVNKGSPRLRSAIDGPGKWSGEPLVECTSHMCPVKINWHVKQNSKDYWRVKITITNLNFRMNYSEWNLVVQHPNFDNITQLFGLNYKPLTPYGGDINDTAMFWGVKSYNDVLMQDGKLGMVQSELLLRKDSRTFTFEKGWAFPRRVYFNGDNCVMPAPENYPSLPMQA

SEQ ID NO: 60400 - protein, 22 aa, Sorghum bicolor
  Clone ID: 8088361.pep
YLSRNYIREEWKAELQEEPSSV

SEQ ID NO: 60401 - protein, 124 aa, Sorghum bicolor
  Clone ID: 8088413.pep
TRLYCKGAGRLVALEEDRARDLRLPDGGVLPSVPPDVEVEQCRRDPQRIRPFPSGPGSAVADAPFVCSFDKMAEYFNLKSCLSETVPLGSFNSLFSFTGSWKNDAAATKALAIDGYSLPLFRVK

SEQ ID NO: 60402 - protein, 57 aa, Sorghum bicolor
  Clone ID: 8088431.pep
MAGDSPGAESLRQELKTQQLKVKRLKEESLWNQSYKKAVGLMARAACAVFVRICSIF

SEQ ID NO: 60403 - protein, 49 aa, Sorghum bicolor
  unsure (1)..(49): unsure at all Xaa locations
  Clone ID: 8088433.pep
SSSLXHAPLFVCAFSQHGDLPMATSXELKETRPPLVAPIDREHLARLRS

SEQ ID NO: 60404 - protein, 110 aa, Sorghum bicolor
  Clone ID: 8088445.pep
FKNGDIAAMYSIWAKGDHVYVIHPAAGRISGYDVVMQSWEMVCNADYEFPLNIDLKNIEVHIRGNLGYVTCLEVVKTKGRTWGKQIATNIFEKVDGTWLMCVHHASHIEE

SEQ ID NO: 60405 - protein, 106 aa, Sorghum bicolor
  Clone ID: 8088469.pep
AAVRSKLREWWRDPGPLDEALARGWKDGVDRIMAWLGPMARDTVQWQAERNMDRTRRFDGAPRVYALQTLRWADKEKAEAAIVEVLVALSCICWYEERRRGSVRLG

SEQ ID NO: 60406 - protein, 143 aa, Sorghum bicolor
  Clone ID: 8088472.pep
GIDPQTHRALGVRADAATAPGAVAAHHRAAALLHHHAGAVVVPVAPVKLLAVKPAPAESSSDDGGSSSTGSSGGGSAGEPRCPDLNLNLDLSVGSPPPAAAADTPTSLCLCYRLGLRAGEACGCEADITGQQGFRFFRPLEQG

SEQ ID NO: 60407 - protein, 195 aa, Sorghum bicolor
  Clone ID: 8088507.pep
RPVVGLKLLLEGAKQNRLAIHLQHLGSLPKIFLPHWDSHITIGPPKWQGPEEQDSRWFEPIKWKNFAHVSTAPIEYTETNITDLSGVYIVTGAQLGVWDFGAKSVLHLKLLFSRVPGCTIRRSVWDHSPSSSSIHKTDESSSSSSDNAKLLKIVDMTETLKGPQDAPGHWLITGAKLGVEKGRIVVRAKYSLLNY

SEQ ID NO: 60408 - protein, 77 aa, Sorghum bicolor
  Clone ID: 8088524.pep
SLLCLWNQKPLSFSFLSLSLSLPLSPSLSFFLLHHGKPCLVTVGSVGIHVKTPKSESTASRYTWILRFFAPVIALKK

SEQ ID NO: 60409 - protein, 159 aa, Sorghum bicolor
  Clone ID: 8088535.pep
ARGWQQGHRFDDSVILLDPYAKLVSGRKHFAVEEEKPSQLFGTYDFDSSPFDWGDNYRLPNLPETDLVIYEMNVRAFTADESSRLGPAFRGSYLGVIDKIPHLLELGVNAVELLPVFEFDELELKRFPNPRDHMVNTWGYSTINFFAPMSRYASAGGGP

SEQ ID NO: 60410 - protein, 31 aa, Sorghum bicolor
  unsure (1)..(31): unsure at all Xaa locations
  Clone ID: 8088556.pep
TRICSENICFVTWFSCXRGCNNFKLLVISYF

SEQ ID NO: 60411 - protein, 78 aa, Sorghum bicolor
  Clone ID: 8088563.pep
MITSPSPSPSPSSSRTPNKGGGGSATPPPPRSLQASKWRSGAVRGVYGRRLLDALRATGGGQPRAVKAAADSALALTA

SEQ ID NO: 60412 - protein, 184 aa, Sorghum bicolor
  Clone ID: 8088564.pep
AGFDADTGVVSKEVVIDAATGATVRLYLPPAVQGGATTTKLPIVVFFHGGYFIVGSTSEPMYHRYVNSLVARARVVAVSVDYRLAPEHPLPAAYDDSWAALRWSVSAGADPWLSDHGDLGRVFLVGVSAGGNIVHNMAVSVGVNGLLPAAEPPRIEGVILLHPSFSSEHKMEAEEGGFWRANNN

SEQ ID NO: 60413 - protein, 141 aa, Sorghum bicolor
  Clone ID: 8088582.pep
MAATATATARKLIVEVVEARDLVPKDGTGTSSPYARADFDGQRRKTRTVARDLNPAWNEALEFDFPPAGVDPVEGEPLEVAVLHDLRVGPTRRNNFLGRVRLDARQFVRKGEEALIYLPLEKNKGFLNSFNWVRGDIGLKV

SEQ ID NO: 60414 - protein, 141 aa, Sorghum bicolor
  unsure (1)..(141): unsure at all Xaa locations
  Clone ID: 8088587.pep
MGGDAMRVDDLLDLSTGAGAGAHDFFPTAAAATDKGHQHHSGAMGEPSPTANSSDHQTSLLSFADEFYIPSEEAAELEWLSKFVDDSYSDMPNYSSAAHAAMAAAAAANAAAGNGGGGTSAGGQDSCVTGAAPGRGARXKR

SEQ ID NO: 60415 - protein, 104 aa, Sorghum bicolor
  Clone ID: 8088594.pep
SVQHDFVERADGFAEVFPEHKYTVVEMLQQRGHLTAMTGDGVNDAPSLKKADCGIAVEGASEAAQAAADIVFLAPGLSTIVLAIKTARQIFARMKSYIRYRIAL

SEQ ID NO: 60416 - protein, 85 aa, Sorghum bicolor
  Clone ID: 8088615.pep
QARDNAALLKGKGKGKEKGKVQERLRVLARLVPGCRKLPAPTLLEEAADYVAALQMQVSAMRALADALAAAQLSSPSDADAEAGR

SEQ ID NO: 60417 - protein, 116 aa, Sorghum bicolor
  Clone ID: 8088616.pep
MEAEEGGFWRANNNRWAVIFPGAIGGADDPRINPMAAGAPSLAKLVGERLLVCTASLDPRAPRGPAYCQPVRASGWRGKVEWFETEGEDHGFFVHNPGNHKAVEVMDRVVAFLEDQ

SEQ ID NO: 60418 - protein, 99 aa, Sorghum bicolor
  Clone ID: 8088622.pep
FVGMGLSGVVPAVHAAAVNWHEPARNVTLAYEGAMAVSYLVGTAFYLTRVPERWRPGAFDLAGHSHQIFHALVIAGALAHYGAAIVFLKARDEMGCPAS

SEQ ID NO: 60419 - protein, 110 aa, Sorghum bicolor
  Clone ID: 8088627.pep
MSAPRATSPNAASSGSTTARPASPKPPGGPATVMRRKAAADRAEKNANQRPSSTRAAGAGGSSSTMLRLYTDESPGLKVDPVVVMTLSVVFIFSVVALHVIAKIMRRFSA

SEQ ID NO: 60420 - protein, 159 aa, Sorghum bicolor
  Clone ID: 8088637.pep
VEVVDAVVHEVGARRVGVRLSPFVDFLDCVDSDPLALGEYMVQQLNRHEGLLYCHMVEPRMANVDGRRQIPHRLLPFRKAFNGTFIAAGGYDREEGNKVVGDHYTDLVAYGRLFLANPDLPRRFELGAPLNKYNRSTFITQDPVVGYTDYPFYEDNNHV

SEQ ID NO: 60421 - protein, 139 aa, Sorghum bicolor
  Clone ID: 8088643.pep
NGSRGKKSPASPGGGPAGVEVGLEGGVRRCTHCASEKTPQWRTGPLGPKTLCNACGVRFKSGRLMPEYRPAASPTFVLTQHSNSHRKVMELRRQKELILIRGSHSHRDAAAAAAAAAAAAAGSAAGPRPELIFRDYGVC

SEQ ID NO: 60422 - protein, 127 aa, Sorghum bicolor
  Clone ID: 8088649.pep
PLDPTLSGGAHLVQWVREHVQAKRDAAELLDARLRGRASEADVHEMRQVLSVAALCVSRRADDRPAMKDVVALLKEIRRPAAVDDAKQPSPTATGAAATPAPVSPVVSAHSRGQSSSCSFAVSEYSA

SEQ ID NO: 60423 - protein, 101 aa, Sorghum bicolor
  Clone ID: 8088670.pep
ESPSPGFDPGSQGSGLDFASRESKCHNCGISEKMTPAMRRGPAGPRTLCNACGLMWANKGTLRSCPKAKVESPVVAIEQGISDNKALVTPSNDNVAASNGE

SEQ ID NO: 60424 - protein, 56 aa, Sorghum bicolor
  Clone ID: 8088681.pep
TAATRIPMFLAGRFFAGYGVGLISATIPIYQSETAPKWIRGTIVGCYQLAITIGLL

SEQ ID NO: 60425 - protein, 149 aa, Sorghum bicolor
  Clone ID: 8088683.pep
QKVMQVAHRLAKEKDELQSLRKEKEEADRLQEERHHLEESTRKKLLEMESAISRANAQLEKAEASARRREVENAQLTLQMEAAKRHAAESATNISELLKKDENSRKRSQRWESDRALLQEDLAAQKSKLSRVQEQLQHAKELKDQVQAR

SEQ ID NO: 60426 - protein, 100 aa, Sorghum bicolor
  unsure (1)..(100): unsure at all Xaa locations
  Clone ID: 8088702.pep
HEAYQPPPPPWEARTAARTSTYPTPTRRTPSPGPPTTPPTTERLPRPPPPPSWPAAEGRRPPRALSTPXPPPSPAPPXSTTSPSPRTLAPGPHPAPTPPR

SEQ ID NO: 60427 - protein, 37 aa, Sorghum bicolor
  Clone ID: 8088703.pep
TGVLCVGIKDISFVLGVVTVLNCFVMLFVIIAGSYIG

SEQ ID NO: 60428 - protein, 154 aa, Sorghum bicolor
  Clone ID: 8088705.pep
MARVAGLCELLLLLLLATATASAATPLGRKGGHEADDDGELELAAKNENDGVVAAAGSRTSAGRYAVIFDAGSTGSRVHVFKFDKKLHLVQIGDDIEFFAKVKPGLSSYAGRPQEAASSLLPLLEQADKIVPRRLQKNTPLKLGATAGLRLIGD

SEQ ID NO: 60429 - protein, 86 aa, Sorghum bicolor
  Clone ID: 8088710.pep
MAPISIADLVAALPAEDAWGPATSGDNMLEGVPYAPFSKGDKLGRMADWTAESKDRAGQGRQQYNRNFRDQQVYGAGTTRLFTIQA

SEQ ID NO: 60430 - protein, 50 aa, Sorghum bicolor
  unsure (1)..(50): unsure at all Xaa locations
  Clone ID: 8088714.pep
PVGGEGRRTRHLXGRAAGFRGGSSPAAAERRRLACASHDPRARAGGGPRA

SEQ ID NO: 60431 - protein, 130 aa, Sorghum bicolor
  Clone ID: 8088716.pep
MCGIFGYINYLVEKDRKYILDTLVNGLARLEYRGYDSAGLAIDGDKKNEVFAVKEVGKVASLKKLVDEQNFDLTKVFDSHAGIAHTRWATHGPTSRVNCHPHRSDPNWEFSDVHNGIITNYKELKTLLEA

SEQ ID NO: 60432 - protein, 103 aa, Sorghum bicolor
  Clone ID: 8088733.pep
KEWLAEVIFLGQLRHRNLVKLVGYCSEEEHRLLVYEYMPKGSLENHLFKKFPPVLSWATRLNIAVGAARGLAFLHNHEKPVIYRDFKTSNILLDPDYEAKLSD

SEQ ID NO: 60433 - protein, 73 aa, Sorghum bicolor
  Clone ID: 8088749.pep
AATGERETRRGGTRKRRRRRPGRRTRRGPLGGGRRDRARSSGSGTCLLRPELDREKRSSRVVWRDLTIGFLFF

SEQ ID NO: 60434 - protein, 117 aa, Sorghum bicolor
  Clone ID: 8088775.pep
LQCEAVMSGELKHGVLALVDENLPIVMILTRDDMFAKSLNAYQQVIARSGRPIIICNQDDPEFPMDKTDRIEVPRNVDCLQGLINVIPLQLMSYWMAVAEGVNVDMPRNLAKSVTVE

SEQ ID NO: 60435 - protein, 131 aa, Sorghum bicolor
  unsure (1)..(131): unsure at all Xaa locations
  Clone ID: 8088784.pep
VATLVELLLDEGGRRVPELAVVAIDHLCGCAEXRSELVAHPAGLAVVSKKVMRVSVVATESAVRALHAVARHSPTPSVLQDMLAVGVVAKLLLVLQVNAGDRAGIRAKDMLKTHARVWKDSPCLQRDSYPC

SEQ ID NO: 60436 - protein, 143 aa, Sorghum bicolor
  Clone ID: 8088799.pep
IFIDKDGKEKNGFSGRMGNRIAAPRLLKLNPLDSHLAGANNRFREGRFSWVTENGKQERHLVATVGKYSVVWNFLQVKNSHHECYQYQEGLKSCYCYKVIPKDESIVASRFMHDRYSVSDSPEAPLVVATPLKVTSFSISSRH

SEQ ID NO: 60437 - protein, 184 aa, Sorghum bicolor
  unsure (1)..(184): unsure at all Xaa locations
  Clone ID: 8088801.pep
CILRGFSGKYTYNGKEYDATASPEGAVYDKCREEIIKALKLNAPCESKNCTFNGAWNGGGGAGQDNLYVASXFFFDKATQFGFIDSKAPSAKSTPEAFKGAADKVCSLSAQEAKVMYPNVLDVPYICMDLIYQYTLLVDGFGLAPTKEITLVARVKYGEYYIEAAWPLGTAIEAIAPKKMRQDA

SEQ ID NO: 60438 - protein, 41 aa, Sorghum bicolor
  Clone ID: 8088813.pep
SIDMTIFNDDDGKAYLIYSSEDNSELHIGPLTDDYLDVTDV

SEQ ID NO: 60439 - protein, 150 aa, Sorghum bicolor
  Clone ID: 8088826.pep
TRGTLPQVFPNLKWYYILVAYIFAPVLAFCNAYGTGLTDWSLASTYGKLAIFIFGAWAGASNGGVLVGLAACGVMMSIVSTAADLMQDFKTGYLTLASPRSMFISQVIGTAMGCVIAPCVFWLFYKAFTDIGMSGSEYPAPYAIVYRNMA

SEQ ID NO: 60440 - protein, 153 aa, Sorghum bicolor
  Clone ID: 8088833.pep
MCGIIAILGCKDPKASRARAVELATRIRHRGPDWSGYHVQGNNVFAHERLAIVDVQNGAQPLFNEDKSIVLVVNGEIYNHKDIEATVLKGDHKFATQSDCECIVHLYEEKGNDFVNELSGDFAFVVSKGDTYLAARDPIGVCPMYIGYAADGA

SEQ ID NO: 60441 - protein, 51 aa, Sorghum bicolor
  Clone ID: 8088849.pep
HRKILAGTRIPMCPLCSSAYHQTWERHHCKVIVNCMLLILGSLSIWLRIQI

SEQ ID NO: 60442 - protein, 173 aa, Sorghum bicolor
  Clone ID: 8088868.pep
RRVKNLHLSDCLRANKACMAWGVEIRVPFLDKEFLDVAMDIAPEDKLCSKERIEKYVLRKAFDTPENPYLPESILWRQKEQFSDGVGYSWIDTLREWTESEVNEEEYARRAELFPHNTPSTKEAFYYRKIFSQLFPNPTADKTVAPWVPTWSNSTDPSGRAQKIHEAAYENKA

SEQ ID NO: 60443 - protein, 67 aa, Sorghum bicolor
  Clone ID: 8088871.pep
MRTDDIGGSAFVKLVKQGSAALLNAYARRGFPFNSWEVKALLLEALVSEEAAVVQAERFEQANESCV

SEQ ID NO: 60444 - protein, 126 aa, Sorghum bicolor
  Clone ID: 8088878.pep
GALGARALSVENETEGSGGGGGAVPDFSWQGLSATDNSAVVELGGAKKRARTEPEPQEVAQAPPSDDSADMLFDAFMFGDQFSLFNGGGVYDEPAATAMDGLLGGDAVLCNDSVGLWSFDDSVCYY

SEQ ID NO: 60445 - protein, 173 aa, Sorghum bicolor
  Clone ID: 8088891.pep
RNPRDRCTAAQLLEHPFLAGCGGVKAAAAAAAAEWVSPKSTLDAALFWESDDSDDDSDDEGDVSESPAQRIKALACPGSALPDWDSEEGDWIEVLDEQCEAKATNLVPTEDVASEDECQLLQSEVLETEVVDFIDADAEGDDPECSVAVGLPSAAPSVELQEEQRTVLLTDAC

SEQ ID NO: 60446 - protein, 132 aa, Sorghum bicolor
  Clone ID: 8088898.pep
HEAYILALFNCLLYTWYGLPVVSSGWENLPVATINGLGILLEITFIGIYIWFAPAEKKRFALQLVLPVLALFALTAALSSFMAHTHHMRKVFVGSVGLVASISMYSSPMVAAKRVIETKSVEFMPFYLSLFS

SEQ ID NO: 60447 - protein, 131 aa, Sorghum bicolor
  Clone ID: 8088901.pep
TRATPAQDVRPPVALFGVDGTYATALYTASAKSAALDQTAKAIATLGQTLKADPKLSTMLGAPTLSMADKQEIIKELQKVAGADKADILKNFLQTLAENNRLATLEGVCEKFGTLMSAHRGEVELNITSAQ

SEQ ID NO: 60448 - protein, 55 aa, Sorghum bicolor
  Clone ID: 8088902.pep
PAYCYFFASAPTSPSRASYAGDASATPGGGDEATFDFTLGFSGQLQEATPILADD

SEQ ID NO: 60449 - protein, 62 aa, Sorghum bicolor
  Clone ID: 8088913.pep
TRRFSNPSLPSPSGLKPGSGHKRLDLVSDGGGGGGSSADGLRGHGKPGAADRSCRRHGRHAN

SEQ ID NO: 60450 - protein, 140 aa, Sorghum bicolor
  Clone ID: 8088928.pep
FAAFGDRVRFWTTFNEPNLSTKFQYMLGVYPPRHCSPPFGSCNSGNSHREPYVAAHNIIMSHAAAVRNYKESYQAKQGGSIGIVTAMKWYEPLTNTTEDILAARRAQPFETEWFLDPIFFGDYPRAMREILQSNLPTFTA

SEQ ID NO: 60451 - protein, 74 aa, Sorghum bicolor
  Clone ID: 8088949.pep
GREGCTGSSHDGDGTQGRHHWCVLEPHRGRAIRVICSPHCSTDRKFYATKQRILVLCWCRAPCKFKFPSELILH

SEQ ID NO: 60452 - protein, 62 aa, Sorghum bicolor
  Clone ID: 8088959.pep
VFDVPLQVDPAHGPSRAPVGETETGTTCSQKGRRRWRAKIRIEYRGVLQSCLPAQIEKLTNN

SEQ ID NO: 60453 - protein, 66 aa, Sorghum bicolor
  Clone ID: 8088976.pep
KLCINYQTWPEFFLLAIPWAFVTLQHGGSLLRGRTAHEPYFLLIRLGDGKSSEVLAWAVGLGRKLR

SEQ ID NO: 60454 - protein, 135 aa, Sorghum bicolor
  Clone ID: 8088978.pep
TLSMADKQEIIKELQKVAGADKADILKNFLQTLAENNRLATLEGVCEKFGTLMSAHRGEVELNITSAQELDAKTISRLEKAVAKSEFSQGKKLKVVTKVNPDIVGGLVVEIGDRTIDLSVSSKIAKMNKALTDAL

SEQ ID NO: 60455 - protein, 42 aa, Sorghum bicolor
  unsure (1)..(42): unsure at all Xaa locations
  Clone ID: 8088992.pep
XTXHFARTRRCLYTSYLAARLLGSCACSLGYRSQMPLLLPRA

SEQ ID NO: 60456 - protein, 78 aa, Sorghum bicolor
  Clone ID: 8088994.pep
MGIDYHVPSNYIRQPSHLGHTYSNGSTMSNGFSESIYEDALSEDCEDDDIKGQDGIDLFKENEDEPLGNLDITIKGRK

SEQ ID NO: 60457 - protein, 102 aa, Sorghum bicolor
  Clone ID: 8089003.pep
LWGDDCREFRPERWLDGGGEFVAVDAARYPVFHAGPRACLGKEMAYVQMKTVVAAVVRRFAVEPVRAASMEAPPPYEMAVTLRMKGGLPVRIRRRESDAGRH

SEQ ID NO: 60458 - protein, 128 aa, Sorghum bicolor
  Clone ID: 8089004.pep
KRRKLPLPASSCSPRRRGPRRRRTNRGCPRREFPSRGRRSSQFRPVPRRCGSRGGRAGPARSLLGCPACGCRWPRYSRSPRCSGSPCSTTAPTSPPRCGGTAAARRRTPSSRPPTTAAAVEALAPTAR

SEQ ID NO: 60459 - protein, 125 aa, Sorghum bicolor
  Clone ID: 8089005.pep
MAMSLTRTALGAPQSRLITAAAAITARSIAAHRSFSTTNHALLPSGFGSPVLPSYFSKPRLPANTVVRFVPQQTAWIVERMGKFNRILDPGLAILVPFIDRIAYVKSLKEVAIEIPSQSAITADN

SEQ ID NO: 60460 - protein, 109 aa, Sorghum bicolor
  Clone ID: 8089015.pep
PSRKHLGGQLPVPILEGGLASISSEFAALSERSFQKQHTTCHLDISQALSNRNATVRGDLDATFSLPHISLCSHFLLILSLVYISTRFGIHDFYDHVLRGTTVPIHHVL

SEQ ID NO: 60461 - protein, 128 aa, Sorghum bicolor
  Clone ID: 8089037.pep
LLILLSCSLAAATSPLGTIERVTKQQILASIPPVGGAPVLFLTSPSGKYAAYFVRTHTVPGAGGLGADFCYVEIIDTTTTAASGAHGGTVEGEEEGAAGTSVWESECHPISTVNTCALLFSWHGLEVF

SEQ ID NO: 60462 - protein, 111 aa, Sorghum bicolor
  Clone ID: 8089039.pep
ARGAPLLVSSSGTGTSSLPQTQLVGTTSNNKTAQNDAPQTTLDLTKPFDGLPKGGIAAMLLGNKRRLNLGEVEEDEEPVSKRAATGPTPIVTNGHDGVEPAALVPVQHGGC

SEQ ID NO: 60463 - protein, 88 aa, Sorghum bicolor
  Clone ID: 8089050.pep
DSLLSGTMEISKKDSKPFLSRLFHPFGPRLENDGFPGTGYLSTGGGVREMTVKGNRKSFSEGIDKSPSQHHLPAAKRLSLHIPARQPV

SEQ ID NO: 60464 - protein, 56 aa, Sorghum bicolor
  Clone ID: 8089059.pep
CRYMVFGLSISPIAVVWLFACGHGNSDWEVQAVLQPINCLVPGSPKVQLVSLVKLR

SEQ ID NO: 60465 - protein, 141 aa, Sorghum bicolor
  Clone ID: 8089061.pep
TEERVAHDSPAAEAPLESVQVRLSNVQSKFAGAISDGGDIVLEGRVKYGVPHLTLVGPYEVDVSLEGNLILCRQIDQPGMIGKVGNILGQRNVNISFMSVGRTFRGKQAIMAIGVDEEPDKETLENIGAIPAIEEFVFLEL

SEQ ID NO: 60466 - protein, 136 aa, Sorghum bicolor
  unsure (1)..(136): unsure at all Xaa locations
  Clone ID: 8089064.pep
RDDPRNISLEFASFRPGXPTVTDGGNGLAYTNLLDAMVDAIYAALEKAGAPGVQVVVSESGWPSAGGFAASVDNARQYNQGVIDHVRQGTPRRPGLLETYVFAMFNENQKTGDEIERHFGLFNPDKTPVYPINFPN

SEQ ID NO: 60467 - protein, 93 aa, Sorghum bicolor
  Clone ID: 8089098.pep
AEKYVDAFGKLARESTAVVVPGNVGDISGMIATGLSVFGKVGQAQAQTMAKSLVEPKKEGSETETDTPSELDGQANPGVKETVIESFNQAAKR

SEQ ID NO: 60468 - protein, 73 aa, Sorghum bicolor
  Clone ID: 8089106.pep
MACRAWPIGRLLDLMQHADAAHRKEFTWFNAPFSFGSERWQSHHSLSYAANNIPLEGSVALLITLLSCEDHDK

SEQ ID NO: 60469 - protein, 35 aa, Sorghum bicolor
  Clone ID: 8089107.pep
FAQSMCFMLRLMGVVWDQCLIWSTYLRYCDYIMTE

SEQ ID NO: 60470 - protein, 147 aa, Sorghum bicolor
  Clone ID: 8089109.pep
LQRIIKMVVQRKEAENLESSVSIAHLETRIAGALQVGAREEFRLYLFTYAKRLGAEGARLKVEELLNSLLGGILEENEEEDEEDDGHGWFSKEGDLCGWDRRELLKDVVMILGKYRELQRLTLQYAKVLDISLEDGSVDVEQMDVEA

SEQ ID NO: 60471 - protein, 63 aa, Sorghum bicolor
  Clone ID: 8089111.pep
RCVCFLDKWATTCKFNVVKVNVQRIKHHHSYVDFYVMADFFGTANRTDSTSNCLGFKCSIGEQ

SEQ ID NO: 60472 - protein, 115 aa, Sorghum bicolor
  Clone ID: 8089113.pep
LPPFAEPLGAHSSNLPFGQEPDGNGHSAELPQAADVGSGAAAFGGAAGVTGPELGQGEHDPAGVGGAAAGFGTQPLVDNSPYDSGAWKEGRGAHITAIGVALCVCAVLGAMGTGL

SEQ ID NO: 60473 - protein, 65 aa, Sorghum bicolor
  Clone ID: 8089163.pep
MTLDTPAAVVLELMTMGQQSAAHLRDLLRASSPAASSPHQELAAEILRCCGRVIDALRATTNGRK

SEQ ID NO: 60474 - protein, 150 aa, Sorghum bicolor
  Clone ID: 8089202.pep
FVKLFEFPSAVDDCNLAIKKDPAFIRAYIRKAQAYFGMRKYSECVDACDEAMRVDVEHHKGANAREIEQQQQKALSAMYSARENETEEQTRQRLMQDPEIMGIMQDPVMQSILQQSQSDPMALNEHMKNPSVRSKIQKLMAAGVIRVGGR

SEQ ID NO: 60475 - protein, 34 aa, Sorghum bicolor
  Clone ID: 8089215.pep
RVIQQVTHTLPPTNASTLFNPTHHQLANPIPIPT

SEQ ID NO: 60476 - protein, 66 aa, Sorghum bicolor
  Clone ID: 8089232.pep
QANPALVSNSCLPHSVMYYNCCCIRVEMRWDSQLDPFLNKSIYIYVKGENEDLSLFHSFDYLLVRL

SEQ ID NO: 60477 - protein, 118 aa, Sorghum bicolor
  Clone ID: 8089251.pep
VVTHYCSVGLTVLTYGVHVLQRRRQHMSSPDLPLVCCCYSKNNLLLKRSDVMEEEPAEVGAVLEDGFPSEAAVQELHHRIRSSRVVPLVQRLEVEPDLGRRRRRPPSLRHGGRRRASV

SEQ ID NO: 60478 - protein, 74 aa, Sorghum bicolor
  unsure (1)..(74): unsure at all Xaa locations
  Clone ID: 8089265.pep
XSAEELMELGEKVLVPVPAPAAEASRAPGKKISSVRSDGHNTSCGLFVRDGDAIVDRANKHECKHDRRRRQVTS

SEQ ID NO: 60479 - protein, 105 aa, Sorghum bicolor
  Clone ID: 8089274.pep
QTRGFPQASCSFAASVTISTNPAEPVEKSLPEPHGAGSFSAAEELARSGGRRRRRRRGSSGRGDDGLKGAQGGIRWWPPVTRGVYFIWRRRATRRGWGLGRGTRE

SEQ ID NO: 60480 - protein, 168 aa, Sorghum bicolor
  Clone ID: 8089276.pep
HEAQTISGTGALRIGGAFLQRFYPHAKKIYLPNPSWANHNAVFKDSGLEVEKYRYYNKDTIGLDFEGLIADIKAAPNNSIILLHACAHNPTGVDPTQDQWRQISDVVKEKGHFAFFDMAYQGFASGNADQDAFAPRHFVKEGHNIALCQSFAKNMGLYGERVGAFSLV

SEQ ID NO: 60481 - protein, 71 aa, Sorghum bicolor
  Clone ID: 8089294.pep
FQKALEGKGIKFYLSAGVDRAEPSASDPSKVGAVYLKDGTKLDADLVILGVGVSPETTYLRGNTAVQLERM

SEQ ID NO: 60482 - protein, 110 aa, Sorghum bicolor
  Clone ID: 8089297.pep
TARNHGWPSTVSRICATACSRVSHRGRFTRYRITRSSDAHDMKASTSASARLSSRSDTTAGACCRPPSRRCPCTPPSPAGSSIVVARLRRRTELCSIWPPSPSPRPRPSC

SEQ ID NO: 60483 - protein, 93 aa, Sorghum bicolor
  Clone ID: 8089304.pep
RLCRLRRSRPSPCPLTPSLPLPLYLSLWPCWHRGLAWRGHLHVRRRRRRCAQQPRQQPRWCRGGRQRARWCRGGRLPPQRGTQLPPPGTAPCG

SEQ ID NO: 60484 - protein, 50 aa, Sorghum bicolor
  unsure (1)..(50): unsure at all Xaa locations
  Clone ID: 8089306.pep
AWRGLAPEMVRLLAXXTGARTAGRAALTAIWEXRREAKTREEAIVIDPRA

SEQ ID NO: 60485 - protein, 178 aa, Sorghum bicolor
  Clone ID: 8089320.pep
MAPSLVETTASAIPLVEGKISVKGLAREPLKLSGALDAFDKFDVTPVIGREFPNASLKEFLRAPNSDELLRDLAVTISQRGVVFFRKQDDLDDDLQKELVQRLGELSGKPKTSGLHIHPVANSGREHSVEDDEISIISSQQRKALYTQRNGLKQSARTEWHSDITFEPIPSDYTILRL

SEQ ID NO: 60486 - protein, 44 aa, Sorghum bicolor
  Clone ID: 8089325.pep
KCSCTSKHLAVHNPHLILLPLQGHHAAYNPSLKAMIGGIDIFFP

SEQ ID NO: 60487 - protein, 34 aa, Sorghum bicolor
  Clone ID: 8089326.pep
ILLRNSLLYMMSRPRHRNIANHVLTPAQIDHEPV

SEQ ID NO: 60488 - protein, 191 aa, Sorghum bicolor
  Clone ID: 8089330.pep
LTELPKTGGDTLWASGYEVYDRLSEPYQKFLEGLTATYAQPRFNEVAKNNNFKIHPGPRGAPENVGEELRAEHPVIRTNPVTGWKSVFAVGTHVQKVNGVTEEESAHLLKWFVDLIVENHDLQVRLRWQNPNDLAIWDNRSVYHAATWDYEEIGPRTGHRVVGLGERPYLDPKSVSRRQAWKEASRVQELI

SEQ ID NO: 60489 - protein, 61 aa, Sorghum bicolor
  Clone ID: 8089341.pep
GDSGKTGSGAHGLGLGGRPCCTIHKPQEETMTESLFSRQNFGFFFFATVALSFLFDKHCSI

SEQ ID NO: 60490 - protein, 57 aa, Sorghum bicolor
  Clone ID: 8089350.pep
LESLDIGICPNITSLPVLPSSLQRITIYGCDDLKKNCREPDGESWPQISHIRWKHFV

SEQ ID NO: 60491 - protein, 124 aa, Sorghum bicolor
  Clone ID: 8089351.pep
YLQTSLGTILKTLVLFLITAAGAAHRPQASRCHRPTGARASSMHDQPPRSKHEQPHGLRTSSMHEQPHRAQARAASSATQATGLSNRGHRGLALPGRRAGCVAAAAGARCQSLGLSAGHTHAAP

SEQ ID NO: 60492 - protein, 54 aa, Sorghum bicolor
  Clone ID: 8089355.pep
SAIYYDQFYNELLAGLLLPLPEPPNNESICLSSIVYVLYTLSVHACYKLMSCSS

SEQ ID NO: 60493 - protein, 111 aa, Sorghum bicolor
  Clone ID: 8089362.pep
DARPVPVGQVSVWPYADEGGRRANIGYALAHDQWGRGIAVAAIRMVVGRVFDDLPGLERLEAVTDVENVRSQRVLEKAGFHREGVLRRYIAGRGGEARDAVMYSFLSSDRA

SEQ ID NO: 60494 - protein, 132 aa, Sorghum bicolor
  Clone ID: 8089365.pep
YPYHGPGGNGGLVRIEHWNVAQNAGRAVATHIVNPSASTTHFIPVFWSALGAQLRYSGNTIASGWDDVVVDGDVAAGKFLAYYTKGETVVAVASQGRDPSVMQVSELLRLGRAPTKSQLKSGVDIFSIDVSA

SEQ ID NO: 60495 - protein, 127 aa, Sorghum bicolor
  unsure (1)..(127): unsure at all Xaa locations
  Clone ID: 8089386.pep
VESQIKIXIRPLYSNPPIHGARVASTIMNDPKLNQQWLGEVKGMADRIIEMRSLLRKNLEELGSKHDWSHITSQIGMFAYTGLKPEQMEVLAKEHSVYATKDGRISVAGITTGNVKRLAESIFKVTG

SEQ ID NO: 60496 - protein, 92 aa, Sorghum bicolor
  Clone ID: 8089496.pep
MQVEWNEDEVFNFLVNYYGKMLVSSYRETSMESLLQVTKQVGSISDDSSASSAATVPIGAALGIALASCTFGALACFWRTQQKNRKQRKNWN

SEQ ID NO: 60497 - protein, 37 aa, Sorghum bicolor
  Clone ID: 8089521.pep
QLCKPTKHYPFGHLSWVLSAKKIKLPWNTEISFASYN

SEQ ID NO: 60498 - protein, 66 aa, Sorghum bicolor
  unsure (1)..(66): unsure at all Xaa locations
  Clone ID: 8089568.pep
WWAPHHXRRVRAGKLRHGRHAHALPVQPARQRAGPEPLLASYLSGGRSIRSSGRSPHCRRRQRSTT

SEQ ID NO: 60499 - protein, 31 aa, Sorghum bicolor
  Clone ID: 8089575.pep
TPIFDKQCDATLLDMTSIANVLTSRCYMLGK

SEQ ID NO: 60500 - protein, 87 aa, Sorghum bicolor
  Clone ID: 8089591.pep
GICFYHIYIESYRHQPRCSAAFFSFRWVQVRRSERVAFGKELGVCRILIVPVVQIFRVPFSLFFPAFPLWISFVVKVGAGWPGATVQ

SEQ ID NO: 60501 - protein, 51 aa, Sorghum bicolor
  Clone ID: 8089613.pep
CKAGVLANLKNDWKKIATVNIIFLIFLIVVYSVGCCAFRNNRQDNSYPAWK

SEQ ID NO: 60502 - protein, 97 aa, Sorghum bicolor
  unsure (1)..(97): unsure at all Xaa locations
  Clone ID: 8089614.pep
VRRHLQLRRRRQEEAPRVXVEIRNRQGLARDQLNKRWKRTPFFVHSFNHAPPTFPISRDMKMSDYPQRKNITCAGCRSRVLLLETSIVYILHDIHFA

SEQ ID NO: 60503 - protein, 80 aa, Sorghum bicolor
  Clone ID: 8089616.pep
NQQHVVDQRTFTRLVVLLVLFGGAVQASWIGQMNSGDFNPRRQSDKRRTYGDEETRRPPGRKLIPYLELPIDLFSLFFFW

SEQ ID NO: 60504 - protein, 39 aa, Sorghum bicolor
  Clone ID: 8089620.pep
FLFLGKFIVISTCTNQEDEKTKSVTTTLFTCYLPEDIRV

SEQ ID NO: 60505 - protein, 37 aa, Sorghum bicolor
  Clone ID: 8089622.pep
KNNFGTSFEHELQLDPQPNKLNNDSKLLIIACHLCDL

SEQ ID NO: 60506 - protein, 69 aa, Sorghum bicolor
  Clone ID: 8089649.pep
NTHRQARRRHHATHVDSTTAALVRLGDIISGAGCRGGARRPGRARRQRATRRRTRRRRWGSARGRRRRR

SEQ ID NO: 60507 - protein, 117 aa, Sorghum bicolor
  Clone ID: 8089712.pep
ARGFHARPFFPAVEWSSGAASAAMDWVETPASHVLRVNVPGLGRDDVKVQVEEGNVLTIRGAPPAAKQKGKEDEEEGTVWHVAERGKPEFARAVALPEKVRVDGIRAGVENGVLTVV

SEQ ID NO: 60508 - protein, 171 aa, Sorghum bicolor
  Clone ID: 8089728.pep
TRLKEKNFDIRKTAGGRSYVAVYKKYNATVSKNFLEIHLFWAGKGTCCIPTQGYYGPMISALSVTPNFTPTVRNGVPKKKSKAGAIAGIVIGAAVVGLAALAGIFMLVQKRRRVAQRQEELYNMVGRPNVFVPHRPSPHPNHTNQRSPRAPARKTMCRARPPAMFPRARRH

SEQ ID NO: 60509 - protein, 97 aa, Sorghum bicolor
  Clone ID: 8089797.pep
RSGDHFFFWPQSLVSGDKCLTAATYQPYQKHHGDQHVSSGWGSPRPPRTHSCDALTHILLLLYPYPTNAKHPKDTTLASSLGKGCMNEPKTAALNLM

SEQ ID NO: 60510 - protein, 118 aa, Sorghum bicolor
  Clone ID: 8089822.pep
MDTAAAAASAQRRWLLWARRQAAAYLAAAGGGDDGWAASAVSAVRVVVCFLAMAITTAAWAVIMLLLLPWPSQRIRQSNVYGHVTGRMLLWILGNPIKVEGAEHLKTMGIFICNHAWP

SEQ ID NO: 60511 - protein, 96 aa, Sorghum bicolor
  Clone ID: 8089847.pep
LWRRSNITARILEDCNFPVINSSDSSSDQARVLCERHWQQLLYDVSMRPVSFSELSIMNCFEMADQGFDISFHRNGKTEAIPMYREYMPVENDRRR

SEQ ID NO: 60512 - protein, 97 aa, Sorghum bicolor
  Clone ID: 8089861.pep
QGKSAKRIRNFLSRRRYQPALLASDWVSQPNQGSTNSFDGQEMLLFNQSVISHHRNAQETLHLRASCICVLLVAPNFVTKFVETEKGLLLYVCWGCM

SEQ ID NO: 60513 - protein, 129 aa, Sorghum bicolor
  unsure (1)..(129): unsure at all Xaa locations
  Clone ID: 8089876.pep
XCTAHGFSLPSPGRTNGRPSHHRRRCRHGRHGRRLRCNRAELEHDPAHLPRRACLLLRGRRPGGAVPRREAAPSLPLHPLSRPHVSNTTPANPSRYETDTHLLPSTLSALRSHDGTTAAVVEIRYEPRA

SEQ ID NO: 60514 - protein, 184 aa, Sorghum bicolor
  Clone ID: 8089905.pep
HEAEQFNQELSLSGKIPSGFFNTMFEFSGSWQKDAANTKTLAFDGWYVTLYSVALSKGQIVLRDHVKQAVPSTWEPATLARFIRKFGTHIVVGLKMGGKDVIYLKQQHSSTLQAADVQAEPDVISMSFIPITSLLNGVPGSGFLNHAINLYLRHKPPIEELHQFLEFQLPRQWAPVYSDLALGP

SEQ ID NO: 60515 - protein, 47 aa, Sorghum bicolor
  Clone ID: 8089921.pep
ARGPLPNIPKARHARIEISRGHSCSPSTRTIPLALDHSTTMGSIPAA

SEQ ID NO: 60516 - protein, 163 aa, Sorghum bicolor
  Clone ID: 8089923.pep
ARGASLDPVPRIITPTQMISNATGVPLENILYLGGPNIASEIYNKEYANARICGADKWRKPLANFLRQPHFIVWDNSDLITHEVMGGLKNVYAIGAGMVAALTNESATSKSVYFSLCTSEMIYITHLLAREPEKLAGPLLADTYVTLLKGRNAWYGQKLAKGE

SEQ ID NO: 60517 - protein, 100 aa, Sorghum bicolor
  Clone ID: 8089931.pep
HEALVGLPGVNGLSTEQRKRLTIAVELVANPSIIFMDEPTSGLDARAAAIVMRTVRNTVDTGRTVVCTIHQPSIDIFEAFDELFLMKRGGEEIYAGPLEH

SEQ ID NO: 60518 - protein, 160 aa, Sorghum bicolor
  Clone ID: 8089936.pep
ARGRFSETDSDEAEAVHNTLAVLENLLDLRPNLADKVCDGTKLLRWLLSRLKAREFDANKQYASEILAILLQNSPANQKRLGQINGVDALLQAVAMYKSRDPKTSDEEEMLENLFDCLCCVLMPLENKERFVKAEGVELMIIIMKQKKLAYSSAIRTLDF

SEQ ID NO: 60519 - protein, 110 aa, Sorghum bicolor
  Clone ID: 8089941.pep
HTLVHRNQAKQKDDMLTAHSTLSHHRLSLRMHASGRLRRTGKQQLLASVLVAIAGLSSGCNIFAFFLFPLGFFAHPSSLSWLSQQFSFFSWLAQQQDLQLAHLKWTSMQP

SEQ ID NO: 60520 - protein, 111 aa, Sorghum bicolor
  Clone ID: 8089953.pep
MAWSETDAALFAAVLGRDAAHHLATTPPHLGGPAASASASAPELQARLQDLVERGSGAWTYGIFWQESRAGGRAVLGWGDGHCRDASGGGSASASHDDDDDAAERSVARKR

SEQ ID NO: 60521 - protein, 139 aa, Sorghum bicolor
  Clone ID: 8089959.pep
HEAQDTASGILNEVKPDYIAWSAGAGGKGGAERTFKVDRDAAVHFINAAASVPTITKFLLISYLASRRSGASWWPAGEWDEYNEKVNNGVLANYYKAKIEADETLYKVSKKSPTLVGIDLRPGTLTDDPATKVEFGKTK

SEQ ID NO: 60522 - protein, 69 aa, Sorghum bicolor
  unsure (1)..(69): unsure at all Xaa locations
  Clone ID: 8089960.pep
MQAVKEKVKDAMSTAKAKAREQEAKAEEKAGKATASSSAEKELVHQRAKAKVAAAKMXLHQXKAIHKGG

SEQ ID NO: 60523 - protein, 131 aa, Sorghum bicolor
  Clone ID: 8089972.pep
HEAESVTDCQSDCSDSWASALITELDQFRNDKSGASTRTASLAAADIGVMDDFLEMEKLASANGSSKGDAVEDASGQLSKLEEKARKLAAEKAEREKALHEAQRELRTCRHRVMVAEEKSAELQRQLNLAN

SEQ ID NO: 60524 - protein, 49 aa, Sorghum bicolor
  Clone ID: 8089997.pep
EGCDELVGGARLVPVVEAPVAAASSNSCCSSRHGDRPESAGMEEVVKRA

SEQ ID NO: 60525 - protein, 156 aa, Sorghum bicolor
  unsure (1)..(156): unsure at all Xaa locations
  Clone ID: 8090002.pep
MDPPQESAAAGRKRRRRGGVRNRKKLSSQKGLPPAAAPPTPASPPVKRRRKDVAGQAAAMPKRGNTSSLLDKMRARLSGGHFRMLNEKLYTCSGEDAFDYFKNDPNLXDVYHTGYQEQMSHWPEQPVNVIINWLKSHNASWTVADFGCGNATVAKN

SEQ ID NO: 60526 - protein, 98 aa, Sorghum bicolor
  Clone ID: 8090015.pep
QKKEILARRTAEMIGAGRGRRRGRPPASLPTSAASRRSEHSISCWYCDCKIYALNDALFNLGWNYARYMRAWFSVGVYLSLIALVSISLMLLWESIGV

SEQ ID NO: 60527 - protein, 66 aa, Sorghum bicolor
  Clone ID: 8090029.pep
MALLNEKTKIIDLSRVEIYKLRLVLQASKQQNLLLAQNNSQMLAEINTGKDRIKLLQHELSCTAAL

SEQ ID NO: 60528 - protein, 93 aa, Sorghum bicolor
  Clone ID: 8090085.pep
MVKVQRMGGVVLAAAVLLVAMVAMVAAELVPVMDKDLESEASMMNLYQRWRSVYNGSLDHVEKPSRFDTFKENARHINEFNKREDEPYKLGLN

SEQ ID NO: 60529 - protein, 134 aa, Sorghum bicolor
  Clone ID: 8090104.pep
TRGLPAYVILNALLRSAKADSVGLILSDGSEITSDNRPKSTIFDWFFDPLMVIKEQIKAENLSEEEEEYLKMRVLLAGDPSRLKGSLPHVPSLTERKKADIDAFARRLQRITKSMSIYPTAKRRFDILVKALLS

SEQ ID NO: 60530 - protein, 69 aa, Sorghum bicolor
  Clone ID: 8090110.pep
GSDAPGNLLTGFGFYEPYWLIDFANACIILHLLGGYQVYSQPIFQFADRLFSERFPDSGFVNDFHTGRV

SEQ ID NO: 60531 - protein, 178 aa, Sorghum bicolor
  Clone ID: 8090139.pep
MVVSLPLCITKLQKLQHIRAGTSITTAQLDDDVSSSGTAQRLPAAAEAGSASSSSMDRQPRAAAALVSRSRLRLPGLCARRRRGQRLCGSRNGGVEAPPGIGEMMALHNISVIDVSVASGRAIIDELKNLTQLRKLGVSGVRRENCIEFCSAISGHPHLESLSVWVDHNQAGCLVAIS

SEQ ID NO: 60532 - protein, 174 aa, Sorghum bicolor
  Clone ID: 8090313.pep
MAAAIGTRVAVVTGGNKGIGLEVCRQLASNGITVVLTARDEKRGAAAVEELKDAGLSDVIFHQLEVTDAQSIARLAGFLKARFGKLDILVNNAAIGGVETLPIENPAEIKGLDAFQMMQWMGKQCRPTSDAAKAGIQTNYYGVKNVTEALLPLLQASSDGRVVNVSSDFGLLSH

SEQ ID NO: 60533 - protein, 44 aa, Sorghum bicolor
  Clone ID: 8090315.pep
LGDQKQDQITKRKKKLTRTIHVESNDLDFEIHYAFLDEPHILLA

SEQ ID NO: 60534 - protein, 103 aa, Sorghum bicolor
  Clone ID: 8090320.pep
RKKAAGPSRFQNKRSRGAAGPYPFPAAKAARGSNFGPRFQNPISRSLNYAAHAGYINPAAASSYYVPGSVSGRRGGVPFGGSGATYGGSPNFAAGGGQQSFRR

SEQ ID NO: 60535 - protein, 41 aa, Sorghum bicolor
  Clone ID: 8090330.pep
FFFFPAPYEKSKSLGSGGSMVARLKLKGIDGRAPPGVEPAA

SEQ ID NO: 60536 - protein, 169 aa, Sorghum bicolor
  unsure (1)..(169): unsure at all Xaa locations
  Clone ID: 8090340.pep
MSXSWEXVQQPICYGGLGIHNLEVLGWSLHIRWLWEQKIDEESIWAGLPVQVPCSAQTLFKLXVQTMVGNGASIKFWSDCWLHGKTIAEDAPNMIQIIPKRAGKQRMVAQALHNRRWMSDIKXALTVEVLVEYLQICLLMIFISNMTSPIIISGCLWGLVLNGCFLLGP

SEQ ID NO: 60537 - protein, 121 aa, Sorghum bicolor
  Clone ID: 8090343.pep
MALDAAIDVSSSKPPVPPPSPPRIDSWARGGRRSKRRAGSPASDGGSGGGDHDQSEQEYLALCLLMLSRGLRGDDATDVGGGAAPTVAKTTQHHHQHGYECSVCGKVYPSYQALGGHKTSH

SEQ ID NO: 60538 - protein, 34 aa, Sorghum bicolor
  Clone ID: 8090368.pep
EHKEAEMIKALENMVDVYMVSAEECSEAAKGKSQ

SEQ ID NO: 60539 - protein, 108 aa, Sorghum bicolor
  Clone ID: 8090423.pep
EERLDELLSAFLRDFEAGALDARGWPTEFSAYKVAKVALNSYSRVLARRHPELRINCAHPGYVKTDMTRQTGLLTPAEGAANIVKVALLPEGGQTGAFFALGQEAPFV

SEQ ID NO: 60540 - protein, 40 aa, Sorghum bicolor
  Clone ID: 8090424.pep
LIESVKSPYVSLFQKIVLSQFGWVCEHFWWGPPVWLELCN

SEQ ID NO: 60541 - protein, 67 aa, Sorghum bicolor
  Clone ID: 8090445.pep
PRSSPRSWRTASRSTAPSTRYVLLYFPSTVYPCVRDTFGSVTPDHRLTAGCFAATATCTPHHKYSCT

SEQ ID NO: 60542 - protein, 137 aa, Sorghum bicolor
  Clone ID: 8090502.pep
MARAHLALVSFVAALAAASIIGAASKSFTVTNNCEHTVWPGILSSAGSAAMDTTGFALAPGESRAMSVPSGWSGRLWGRTLCSTSTSADGTGRFACVTGDCGSGRQDCAGGGAAPPATLAEFTMDGSGGMDFYDVSL

SEQ ID NO: 60543 - protein, 153 aa, Sorghum bicolor
  Clone ID: 8090529.pep
QGRRDPPPCSAACASFSSPFGFCSCSKAESQACDPTDLKALLAFSDGLDSKPARLIGWGHGDGAACCSSTGVACDLGRVVTLYLSNKSLHDGISSALASLDALAALNLSRNALRGAAPEELARLWSLRVLDLSANAPRVADARVVAQRSIATT

SEQ ID NO: 60544 - protein, 89 aa, Sorghum bicolor
  unsure (1)..(89): unsure at all Xaa locations
  Clone ID: 8090535.pep
PPPGGLPSPTPPLGARPGPXPPPPPQPPVPPPPSPLRPSRSTXAPLTSTNQPPPPPPPPPTPPTGKLPPPRAPRASKQSNNTTPDCGLV

SEQ ID NO: 60545 - protein, 213 aa, Sorghum bicolor
  Clone ID: 8090574.pep
TRDQANEISNRANMPSRTTDLNESGFVSQVLKQASEIESLKQENLRLVEEKDGLEINSHKLAEESSYAKELASAAAVELKNLAEEVTRLSYENAKLNADLAAAKELNASMSRSNIHPDPKRRDHESGILVEELQKELVASCQREAVLEDTLSKKDRRETELLKIIDDAKCREHEMENELASMWALVSKIKKENSQQDVFEFKAKQNGFHSSKT

SEQ ID NO: 60546 - protein, 182 aa, Sorghum bicolor
  Clone ID: 8090579.pep
MALQTLNPHRHAAAVSPSPAPSPVPRRGHPPPQPLLHLPPRRRLAGGAARPRAVAAAVSGAVNEARRRGAPQEGGEDGRKDTDLATLGNLCVDVVLSVPQLPPAPREERKAYMERLAASPPDQKFWEAGGNCNLAFAAARLGLSCSTLGHVGEEIYGNFLLDVLQAEGISVVGMLEIPMLLR

SEQ ID NO: 60547 - protein, 178 aa, Sorghum bicolor
  Clone ID: 8090607.pep
ARGEIYLFSLPIKKSEIIDFFMGMSLKDEVLKIMPVQKQTRAGQRTRFKAFVAIGDSNGHIGLGVKCSKEVATGIRGAIILAKLSVVPVRRGYWGNKIGKPHTVPCKVTGKCGSVQVRLIPAPRGTGIVGAPVPKKLLQMAGIEDCYTSARGSTGTLGNFAKATYAAIAKTYAYLTPD

SEQ ID NO: 60548 - protein, 189 aa, Sorghum bicolor
  unsure (1)..(189): unsure at all Xaa locations
  Clone ID: 8090630.pep
HEAEMMENNRERRIALVAAGSAAGIASGFNAAVAGCFFAIETVLRPLRAENSPPFTTAMIILASVISSTVSNVLLGEKAAFIVPXLPLYLILGMLCGVVSVAFRQLVVWFTKTFDLIRKKFGLPAVVCPALGGLGAGLIALRYPGILYWGFTNVDEILHTGKSASAPEIWLLAQLAAAKVVATALCKGS

SEQ ID NO: 60549 - protein, 162 aa, Sorghum bicolor
  Clone ID: 8090642.pep
HEGYLEAESPLCKVLEIYDHNIMKELEKSDCEAAEVYLNALGLLLRLYIRGHIDSAKERLTALLDALKNESIWHAEWLLDLLILWALASMSELKSAHNMLESLKSRVRSMDRNRQQVMQKAIKLAEAAYEYGKGDHMKVFDTLGPDFDALGYKVGTGTFLLL

SEQ ID NO: 60550 - protein, 63 aa, Sorghum bicolor
  Clone ID: 8090697.pep
TFEEARAAYNYERMRCKELESVVSRLKGEDLRGLDIKVLEELQNFHVEALSRICQEKMASQAL

SEQ ID NO: 60551 - protein, 86 aa, Sorghum bicolor
  Clone ID: 8090702.pep
ATGCGAGRNVARLDKVLQLLKEADLNEEDTWTELIEGNSLCIEVSIMSGMARNGFGERIVHVPVTKVVSDILPMFEAVSERSAVQA

SEQ ID NO: 60552 - protein, 40 aa, Sorghum bicolor
  Clone ID: 8090718.pep
TYAAIAKTYVYLTPDLWKEMPLTKAPYAQYAEFLSKNHRP

SEQ ID NO: 60553 - protein, 114 aa, Sorghum bicolor
  Clone ID: 8090756.pep
PSTSLAPFTTKSPTPLASPEIPKPRGSFNLPHWSNHSIRGRWHSPEILRVAGSADGGARVRFLSVGLDAGRRRADEQKSRWESERRRARRWEAERTAESTSSQRRPASESTRRR

SEQ ID NO: 60554 - protein, 152 aa, Sorghum bicolor
  Clone ID: 8090767.pep
DAGDPREERAMVFFFNRFYFCVSLGSLFAVTVLVYVQDNVGRCWGYGVSAVAMLLAVAVLVAGTPRYRYRRPQGSPLTVIGRVLATAWRKRRLTLPADAAELHGFAAAKVAHTDRLRCLDKAAIVEADLSAPAGKQQQQASAPASTVTEVEE

SEQ ID NO: 60555 - protein, 195 aa, Sorghum bicolor
  Clone ID: 8090771.pep
ARGINFDDDEEETEEPEVNITEAAEKASLLEENIKPRANLPPLLVHLRDRRREKLHYLGVSFGLTQELFRFWRKHNFYPFYVGQIPSAVTGEHTCMVLRPLNSDDIEVSESNKCGFLDPFYQDFRQRFRRLLGTSFRHLNFKLSMSVLASKIDYSNHEPSEYDNNSTSKLLGDMLSPHDMKRLEAYSNNLVDYHL

SEQ ID NO: 60556 - protein, 38 aa, Sorghum bicolor
  Clone ID: 8090786.pep
MADLTNIGCCGCFSFLRKPSVPARQPPDADVMLSQDLL

SEQ ID NO: 60557 - protein, 168 aa, Sorghum bicolor
  Clone ID: 8090802.pep
HEASSSAGARPCLLLAGPASRRARALAAPPPPRAVASSRAPLVVTSPPPPEASGTPAPAHAKVDRSGRFCSPRAARELALMISYAACLEGTDVVRLFDRRISARREPGFVFDKACLLSYNHMSFGGVPLEVGTEEEAEKLTSQNEKDSANEEDVLSAPPKLVYNNFVL

SEQ ID NO: 60558 - protein, 37 aa, Sorghum bicolor
  Clone ID: 8090817.pep
AGRPRRSGRSRRLGPPTSPPPSSSPPPGSRPLVNPRA

SEQ ID NO: 60559 - protein, 111 aa, Sorghum bicolor
  Clone ID: 8090857.pep
MQEFQSIPGLAGRLFGGAGAGDLRRAQAHAQQGPGARCGGVSPAAPPEVVKCPRCESTNTKFCYYNNYNLSQPRHFCKSCRRYWTKGGVLRNVPVGGGCRKTKRASSSSSA

SEQ ID NO: 60560 - protein, 180 aa, Sorghum bicolor
  Clone ID: 8090859.pep
HEAQIDFSRVVPSAPGGKAWSDVRGEVMKALSTFGCFEAQYPALTPQLRAELFDGAVRPLFALPADAKRRNYYGADRPFHGYLGDIPGFPGYESLAIVDATKDDSVRDFAGLMWPDAGDNNDGFCGTVGEAARRIFEVEEAVRRMVMEGLGMAKHHDALSASMWHLFRMAEYKAPNAAEK

SEQ ID NO: 60561 - protein, 104 aa, Sorghum bicolor
  Clone ID: 8090863.pep
MTEHQECVSKSSSSSISSSTQESEEELTIGTLITEATNTTNSAKSLGRRLSHLDSIPHTPRVNGKIPDFNNATIDHESLLERLGTYGLAEYQIEGDGNCQFRAL

SEQ ID NO: 60562 - protein, 146 aa, Sorghum bicolor
  Clone ID: 8090883.pep
SKRPAGHPSCGCGRLGSRAERSSEVGGNPRRRLQLAEGDGGDADPGPGDLGHPGDAGVRAVPAAGGAGGQAAGAGGVHHAAATAAAAAHGLVGVGPRRRHSYHGHHDVRCGFRPCSCCGGLRSRSRFEFDTPASCKLQWRLVRGGG

SEQ ID NO: 60563 - protein, 47 aa, Sorghum bicolor
  unsure (1)..(47): unsure at all Xaa locations
  Clone ID: 8090899.pep
QAEVSFVNGINQTNRSTNXERPCTTTHRIKKELSVCQSLLCLDLVLV

SEQ ID NO: 60564 - protein, 142 aa, Sorghum bicolor
  Clone ID: 8090998.pep
MAFTSQSLIFRAAASPPCPRIAPSPGRVTLRDHRAAFPPLAAASTSMASSESEDKREAKLWGGRFEEGVTDAVERFTESISYDWQLYKYDIMGSKAHASMLAGQGLITATDRDIILEGLDQIERLIQEGKFEWRKDREDVHM

SEQ ID NO: 60565 - protein, 181 aa, Sorghum bicolor
  Clone ID: 8091026.pep
ARGMSIWDYIWRGHDPTSVAVMTEDGAAVTGLAIAAASLVAVQMTGNAMYDPIGSIIVGNLLGMVAIFLIQRNRHALIGRAIDDHDMQRVLEFLKSDPVVDALYDCKSEVIGPGFFRFKAEIDFNGVVLVQNYLERTGRGTWAKQFREAAVSKDDTELLRVMANYGEDVVEALGYEVDRLE

SEQ ID NO: 60566 - protein, 129 aa, Sorghum bicolor
  Clone ID: 8091031.pep
MSGGVGPTAGGGITLPSMGAPPPPLHPTPTSPTARPHHHYYLFSIKQLNTLGAAAVLAFSTTVPLSDVAFAVLLLPYLLLLARLAFPQRPGKPNPAAPVFPGAGGRLTLAVHTAVGFVVGAALPALYIL

SEQ ID NO: 60567 - protein, 43 aa, Sorghum bicolor
  Clone ID: 8091036.pep
ARGRAGTHAGSHHGRLARRARPSRLLAPRARPAHRASLPCLPT

SEQ ID NO: 60568 - protein, 35 aa, Sorghum bicolor
  unsure (1)..(35): unsure at all Xaa locations
  Clone ID: 8547610.pep
LESSWAALRLXXMLVMLSATPFILKLPPTKNWPSC

SEQ ID NO: 60569 - protein, 142 aa, Sorghum bicolor
  Clone ID: 8547613.pep
MDTTLLRSNGRRRLLPFFLLLLAAADLTAVQGQQGQQQQQGGYYQQQSFSPSMAIVIVVLIAAFFFLGFFSIYVRHCYAGGDSSNSTDPAGPNGAAARSRRQQRGLDAAVLESFPTMAYADVKAHKAGKGALECAVCLSEFD

SEQ ID NO: 60570 - protein, 48 aa, Sorghum bicolor
  unsure (1)..(48): unsure at all Xaa locations
  Clone ID: 8547614.pep
TRVSSTARFAGGAAAGIAVGAAVGVGAAAAAGALEREPSPEPEPEPHX

SEQ ID NO: 60571 - protein, 56 aa, Sorghum bicolor
  unsure (1)..(56): unsure at all Xaa locations
  Clone ID: 8547617.pep
TRNRFSKDVESIDQEVAPVAIGVVHCLASIITIVILISXITPAFLIAAFFISILYF

SEQ ID NO: 60572 - protein, 147 aa, Sorghum bicolor
  Clone ID: 8547621.pep
HEEGNMDMLNMAFLKGMEEAKKFLPTTNSLLIDLDEPSGKSLPKDRHSKTSTDFAATQVQVKEEEEQVVNAISIFGGSRSANGRGRKNRHAEEDDLEAETGRSSKLMMPEQEETGANELYNEIMNCTYESFLKRMDDLRIAMGSETE

SEQ ID NO: 60573 - protein, 101 aa, Sorghum bicolor
  Clone ID: 8547622.pep
HEGLMPGVAGMAGGAVTVVSPVDTSVAQLDSMGKGNGDLSSPMAPVPYPFEGVIRGRRSGAGVEKVVERRQRRMIKNRESAARSRARKQAYTMELEAEVQK

SEQ ID NO: 60574 - protein, 63 aa, Sorghum bicolor
  unsure (1)..(63): unsure at all Xaa locations
  Clone ID: 8547627.pep
GXCLEGEDAKXAVVPGANADDELRAQVGEPCPDRHSREAKQSLVRRKLKKLTNSNKQATLCLV

SEQ ID NO: 60575 - protein, 97 aa, Sorghum bicolor
  Clone ID: 8547632.pep
MASFASQTYTPTEEAEIQQWLTTSERLKSPEDKSTILETLNNHLSSRSTLLGSKPSKADVAIYETLAPVVAQWSPEERTGEKGHPHIVRHVDFVQNS

SEQ ID NO: 60576 - protein, 85 aa, Sorghum bicolor
  unsure (1)..(85): unsure at all Xaa locations
  Clone ID: 8547642.pep
ARRPPPPNHRFPSHRPSRRRTGPLFHQRHLKSRPSLTRPPTPGAFSSPRRDLAGLLLRGSGAERWRXRRCRRRWMRXRGXRPCXX

SEQ ID NO: 60577 - protein, 155 aa, Sorghum bicolor
  Clone ID: 8547666.pep
KMKVRAALFALLAVAVGKDVVQGDLRPDEVMANNTDPSFALQGSPPDWVYPETLLSMPQCIAQQDQSAWLSAMTKCTKKQCMRHFGVICTRHQWRTQLSCLNAEFSPQVVQEYISYCSRSVLAKAQLYQWIRAVTDRTWLVEVGDANGLHRLSPA

SEQ ID NO: 60578 - protein, 79 aa, Sorghum bicolor
  Clone ID: 8547669.pep
NGGAATREAPAGAHHGGGDDAGHGERARGAAVLLHGVLVVLVVVDELHVTLLRRRSPHRRHHDGRERENGKASVVVPRA

SEQ ID NO: 60579 - protein, 140 aa, Sorghum bicolor
  unsure (1)..(140): unsure at all Xaa locations
  Clone ID: 8547671.pep
ARGINLTERLYQVLRWSTGSLEIFFSRNNPLFGSTFLHPLQRVAYINITTYPFTALFLIFYTTVPALSFVTGHFIVQRPTTMFYVYLAIVLGTLLILAVLEVKWAGVTVFEWFRNGQFWMTASCSAYLAAVCXVLVKVVF

SEQ ID NO: 60580 - protein, 82 aa, Sorghum bicolor
  Clone ID: 8547695.pep
MASSARQFARVATRTTTRTFAAAPRQAFRQQGRRFYSSEPEKKSSSSLLYLGAAAAAGGLGIWYFTSGASASSKTFVPTQAD

SEQ ID NO: 60581 - protein, 100 aa, Sorghum bicolor
  Clone ID: 8547699.pep
IPMSVLHAAVRRRPASNVGAMVVFSPIRHRSRHLRCSQWDGQLVSGIYSDATMTVSRSTCEEGLLCFVVVMKLGTAHYIYAYADARRLSSQRSWSNLYFQ

SEQ ID NO: 60582 - protein, 73 aa, Sorghum bicolor
  unsure (1)..(73): unsure at all Xaa locations
  Clone ID: 8547711.pep
DPNLPLPKLIALAEMVSSLPRPTHDGLYRAIDMYLKEHPGLSKSEKKKLCGLMDCKQLSQDACMHAXQNERXP

SEQ ID NO: 60583 - protein, 140 aa, Sorghum bicolor
  Clone ID: 8547728.pep
HGRAPRGERTDWVMHEYTLLADALPPAAQGRESYALYKLFQKSGAGPKNGEQYGAPFREEDWLDDDDEGVTADAAANSVPNTNNPPCTVEEHAITDRELPIEDLDELLSNFGNDQEFSEAQPTSSHGQGQGWLSEGGDKA

SEQ ID NO: 60584 - protein, 82 aa, Sorghum bicolor
  unsure (1)..(82): unsure at all Xaa locations
  Clone ID: 8547730.pep
RAGLVGQVEXXHXQRLVGRIGSDWTRMSDEIRAPRTKKEEGWLAGAKEREGDGWILLGLGVWKWIRSGTLGTLPSCCDVTLV

SEQ ID NO: 60585 - protein, 152 aa, Sorghum bicolor
  unsure (1)..(152): unsure at all Xaa locations
  Clone ID: 8547734.pep
TRTNSTDGFIEFVTSPNNPDAMLRKPVLCSSAAAIVDHAYYWPHFTHIPAAADEDIMMFTISKPSGHAGSRFGWALIRDDKVAERALDYLSNSNMGASRDTQLRMLGIVRFMLANLHGEDDIFGFGHGVMRSRWLRLSAVXSRAPRISLQKI

SEQ ID NO: 60586 - protein, 154 aa, Sorghum bicolor
  Clone ID: 8547775.pep
KLEATRMHYHSNHADSRGHIDHSTKIMHVITWNRSFKNLPEHEDLNDNFDIDDRFETHAAVLDRMLAWEKKLYDEVKAGELMKIDYQKKVSLLQKQKKRGVKLETLEKTKAAVSHLHTRYIVDMQSMDSTVSEINRLRDRQLFPKLVDLVDGMA

SEQ ID NO: 60587 - protein, 105 aa, Sorghum bicolor
  unsure (1)..(105): unsure at all Xaa locations
  Clone ID: 8547776.pep
MNQRPPPPAPAPAPAPAPPPAPAPIPTPTPTPMPMPRPPPPPPPRPTPCPRPPPAPPPPPRPPPPPRPPPXPSPPPAPPPNPPEDGGWWDPVEGGDGEPWEWASC

SEQ ID NO: 60588 - protein, 87 aa, Sorghum bicolor
  unsure (1)..(87): unsure at all Xaa locations
  Clone ID: 8547783.pep
TRANSIIGAGIIGQPYAVRQAGLVGGILLLVGLTVVVDWTICLIVINSKLSGTSHFQGTVEHCFGQSGLIAISIAQXVFAFGGMVAY

SEQ ID NO: 60589 - protein, 146 aa, Sorghum bicolor
  unsure (1)..(146): unsure at all Xaa locations
  Clone ID: 8547786.pep
MANSAPSCRAFSWLWLWLLLLLRLWCLLLVLYCPMMSSALVVRELPGFDGPLPFFLETGYVEVDESNGVQLFYYFVQSERDPASDPLLLWLQGGPGCSXLSGLVYEIGPLLFDVQYTANGYEGGVPRLLYRPETWTKVSNIIFVDS

SEQ ID NO: 60590 - protein, 79 aa, Sorghum bicolor
  Clone ID: 8547788.pep
TRAYAVQQICLHMHDPREVHLVAAKRILRYLQGTLHFGLIIPRSAPTQLVVYTDADWAGCPDTRRSTSGYAVFLGGSLV

SEQ ID NO: 60591 - protein, 92 aa, Sorghum bicolor
  Clone ID: 8547798.pep
HPEPPDRAKEPPFSPEPRHGHLLLLLPCWPRRQQRRRFASTDRRSRHRPPRYPEHHRPPRGHAGRRNELLVVPHQITYSLSLPLGCVLAPRA

SEQ ID NO: 60592 - protein, 114 aa, Sorghum bicolor
  Clone ID: 8547803.pep
MDGDPAVEPQLDGFSLTFPLPYRVGFIVTLAVWGWGLNLHWLHAFRIDVPSLIRYPGRNSPQHISHHLSTYRLAIVLSALFSLSITVFWLCTWRVPSRVIAFDWMPMTYLVAII

SEQ ID NO: 60593 - protein, 139 aa, Sorghum bicolor
  Clone ID: 8547809.pep
TRETPGEDPTMTGKYAAVFVRGVQGYGVAGPVNSTDLEASACCKHFTAYDLENWKGITRYVYDAKVTAQDLEDTYNPPFKSCVEDGHASGIMCSYNRVNGVPTCADYNLLSKTARQSWGFYGYITSDCDAVSIIHDAQR

SEQ ID NO: 60594 - protein, 120 aa, Sorghum bicolor
  Clone ID: 8547813.pep
MAGAEGRGPRRSRVAFVLVDRIGDVSIPSLGGRTPLEAACAPRLDAVAAAGVTGLMDPVEPGLACGSDTAHLSLLGYDPRVYYRGRGAFESMGAGLAMAPGDIAFKSNFATLDENTGVIV

SEQ ID NO: 60595 - protein, 75 aa, Sorghum bicolor
  Clone ID: 8547818.pep
TRVRWANWEFHVGFDMRAGMVISLASIQDADDAAPGGQRRRRVLYRGFVSEVFVPYMDPAEEWYFHTFIDAGDYG

SEQ ID NO: 60596 - protein, 185 aa, Sorghum bicolor
  Clone ID: 8547830.pep
MPFGKWIDRHQPGVCPTNPSKRLSQKMKKQKLIDLLNDPYDPVNVKWTTERCAVCRWVEDWDYNKIVICNRCQIAVHQECYGVTGKQDFTSWVCRACEKPEQKRECCLCPVKGGALKPTNVDNLWVHITCAWFQPQVAFASDELMEPAVGILNIQPLLFMKMCVICKQIHGSCTQCYRCSTYYHA

SEQ ID NO: 60597 - protein, 170 aa, Sorghum bicolor
  Clone ID: 8547839.pep
ARGKASSNSDARAKWRKRKRAAASASPSKQPGDHSDDSDTAAAANGDDEASRATSANGGRGTLAGGGGGGDDDPALDLRAAEVLSPNAELVSTFPAAVRRAVGRPHPSVLAVIAAERAAASSDGAPATPAPVPVLENISHGQLQVISAMLPDHPSLSYEPDKPSTYVCTH

SEQ ID NO: 60598 - protein, 177 aa, Sorghum bicolor
  Clone ID: 8547840.pep
SFGHSVFKDSFKRIFEGGEQSLGLSFNGTIEINCSKDIKVQGIIGPCTSLEKKGAVCADTVVGQGNTAAWKMCGLDRNTSLTVFFDVSPSERSSQPGHQNPHLYIQFVTSYQHPEGQMRIRVTTICRKWVDGSTNTEELVEGFDQETAAVVLARYISLKMEMEEEFDATRWLDRSLI

SEQ ID NO: 60599 - protein, 50 aa, Sorghum bicolor
  Clone ID: 8547855.pep
SDCWGWLHGVRQRSNSRGGSRVSVERATRRLMRTDQGVWRVETGGELPRA

SEQ ID NO: 60600 - protein, 64 aa, Sorghum bicolor
  Clone ID: 8547878.pep
HEERFAYKGVAANLITYLTGPLGQPMARAAASIDAWKGVSQMLPLPLACVADAWLGRYRAIVLG

SEQ ID NO: 60601 - protein, 132 aa, Sorghum bicolor
  Clone ID: 8547886.pep
TRHRFTYKDLFRATEGFKSKMLLGVGGFGRVYRGVLPKSKLEVAVKKVSHESRQGIKEFVAEVVSIGRLRHRNLVQLLGYCRRKGELLLVYDYMPNGSLDKYLYGKGDDDKAMATLDWVQRFRIIKGVASGL

SEQ ID NO: 60602 - protein, 37 aa, Sorghum bicolor
  Clone ID: 8547902.pep
HEGHAPLLRRPNLTTLATCSFLTLPYLRARRKATQRR

SEQ ID NO: 60603 - protein, 50 aa, Sorghum bicolor
  Clone ID: 8548004.pep
HEADFLFSLEDIPSMWCPTMILQVTAWSLSLILSCVNDALRIFDDDTNEL

SEQ ID NO: 60604 - protein, 40 aa, Sorghum bicolor
  Clone ID: 8548021.pep
RGRGGVGRAYGKGDAVLIRAGAFGLANRDADAGGETKPRA

SEQ ID NO: 60605 - protein, 66 aa, Sorghum bicolor
  unsure (1)..(66): unsure at all Xaa locations
  Clone ID: 8548117.pep
ARSSPGSRAACSSCXSGSCRGWGRRCRTWWWAQEEEEPGSLRLIRRRRLVLVNGTMPRSGREGASC

SEQ ID NO: 60606 - protein, 140 aa, Sorghum bicolor
  Clone ID: 8548236.pep
TRDVSSNYLDGAWNGSDTGVLATTNCFYGVPGQRSSADCEEFYRKQGVKLVDAPAPSPVPLPQSPPSPEKKKQRISKNVLVGVLVAAGALLALFFIALLFCLFKRRSRGTRGTRGVEPNEEGTRSSRRRDSSVNPVMSLP

SEQ ID NO: 60607 - protein, 95 aa, Sorghum bicolor
  Clone ID: 8548253.pep
CVCFDTSSVSDSLSPQHNHLGRSTTINSKLRDIESCFEITYKPLLALTLSNLYPRCAVLINSRVLQEHLPGLAGLLALPTPSFNFWYSSTFWLYL

SEQ ID NO: 60608 - protein, 126 aa, Sorghum bicolor
  Clone ID: 8548264.pep
MGTGGVALVAAALAVVVVTRLWTALLHLVWRPYAVARAFARQGVRGPPYRVLVGNSKEVQAMRAATSGDTLELTSHDYIPRVMPQYRAWMSLYGKVFLTWSSSTPALFAGSYDMVKRILSDKSGLY

SEQ ID NO: 60609 - protein, 49 aa, Sorghum bicolor
  Clone ID: 8548334.pep
WPCRRRGTTQQETRRRPPVDGFAAVRRRRRRRPSSTIDHLASYYMLCLL

SEQ ID NO: 60610 - protein, 34 aa, Sorghum bicolor
  Clone ID: 8548345.pep
ARVGGARVVRHAGARPRGTARGARARAGGLRPRA

SEQ ID NO: 60611 - protein, 134 aa, Sorghum bicolor
  Clone ID: 8548350.pep
PSLIAIAPYIAVNFCVFDLMKKSVPEKYKNRPQTSLATALLSATFATLMCYPLDTIRRQMQMKGTPYNTVFDAIPGIVERDGLTGLYRGFVPNALKNLPNSSIKMTVFDTVKTLIATGQKEMDKLIQENEEKTS

SEQ ID NO: 60612 - protein, 55 aa, Sorghum bicolor
  unsure (1)..(55): unsure at all Xaa locations
  Clone ID: 8548351.pep
QTNCTPLQYTNATNYTMKYLRPSLISIFFIMKSCQFPVVQNLPLLTQPLXLQPRC

SEQ ID NO: 60613 - protein, 54 aa, Sorghum bicolor
  Clone ID: 8548357.pep
ARGSHHVLNLPYPVPTLHSSPPTGTSNPKLDLVRSSPLPSSPRVSKLDPVRLLG

SEQ ID NO: 60614 - protein, 83 aa, Sorghum bicolor
  Clone ID: 8548360.pep
TRHQTNLLLPHHPLLGFSLCLVRPQKGKSRREGREAVAARATRLPSRSYSKQQRPSRREPPPPTHLLPPVASAWLFVEQLVST

SEQ ID NO: 60615 - protein, 35 aa, Sorghum bicolor
  unsure (1)..(35): unsure at all Xaa locations
  Clone ID: 8548373.pep
HEAYLKQSLAXRNRATSSRESGXNSFXSPPAPPDX

SEQ ID NO: 60616 - protein, 112 aa, Sorghum bicolor
  unsure (1)..(112): unsure at all Xaa locations
  Clone ID: 8548380.pep
MAKVHPNAAAVATELATATTRAAADQQPEPPTTVLTVWRKSLLFNCDGFTVYDANGDLAFRVDCYARRHAEVVLMDAAGXAPLLTVRRKRLSLAERWLVYDGDAAASTTRPP

SEQ ID NO: 60617 - protein, 54 aa, Sorghum bicolor
  Clone ID: 8548382.pep
LLFAGRRSTCSSQVVGDMETTVVGDLMATELRLGLPGTVDDSCSLQSQVKATTP

SEQ ID NO: 60618 - protein, 117 aa, Sorghum bicolor
  Clone ID: 8548388.pep
EIGGLRLLRKLDFWLYFFSYMFSGTLGLVFLNNLGQIAESRRLGHTSTLGSLSSSFGFFGRLLPSFLDYYSAKSGYSISRTGSMASLMAPMSGAFFLLLNSSDLVLYLSTAVIGTCT

SEQ ID NO: 60619 - protein, 92 aa, Sorghum bicolor
  Clone ID: 8548405.pep
LSTHSLTHSVTETPQFVPLVQLNTHSQLSQLKLPDLIHAHHGLPLLYRPSSPESMGAHDSPRPSHLITFNISGFPLVPRWTPPPRAGLSPTA

SEQ ID NO: 60620 - protein, 96 aa, Sorghum bicolor
  unsure (1)..(96): unsure at all Xaa locations
  Clone ID: 8548461.pep
FARGLPVPGRDSLSTTHRTIPRAHTRTQRSLITEPLLSSPTPDLNGALAPPPPSPPHGHGHGVLPPRALRRAGAGPRRARPDAGRRWRXRGHQGAA

SEQ ID NO: 60621 - protein, 65 aa, Sorghum bicolor
  Clone ID: 8548463.pep
ARGHYSARTAEEVFRDFRGRRAGMIKALTNDVEKFYQLCDPEKENLCLYGYPNETWEVTLPAEEV

SEQ ID NO: 60622 - protein, 122 aa, Sorghum bicolor
  Clone ID: 8548471.pep
MASNGSNAALTSHMDVDSVAFTGSTEVGRLIMESAARSNLKMVSLELGGKSPLIVFDDADVDMAVNLSRLAIFYNKGEVCVAGSRVYVQEGIYDEFVKKAVEAAQNWKVGDPFDVTTNMGPQ

SEQ ID NO: 60623 - protein, 126 aa, Sorghum bicolor
  Clone ID: 8548476.pep
RYTWLCLLSPVCATSLTNTAASLFLSCKKHQSSLVYASIQTPILDFCCKGCASCSKRPKHLIPSQLGIGSLRGPGGRPWRHAPTPTSSTWPPEQPTRRRRPPRLARSGGGSRAWSPTPGSSTTARR

SEQ ID NO: 60624 - protein, 81 aa, Sorghum bicolor
  Clone ID: 8548481.pep
MASGVNDGSGKSLTHWLRENGFDDDAVARMSRRCRNLHSLDAGEASGVWDYLLTGVKMERRKLRHVVAKCPKVLTLSVDRK

SEQ ID NO: 60625 - protein, 115 aa, Sorghum bicolor
  Clone ID: 8548485.pep
LLAYKNLDVGLRRKFVAAPILVSILSWAAEALASLGKGSARLSRWPVIVVGAESAVAANGARSIPRSHLAQGAWAAVLRVSRGKLHTAHFPFEQAVITLRHGTIGRGAVGVGGAS

SEQ ID NO: 60626 - protein, 161 aa, Sorghum bicolor
  Clone ID: 8548502.pep
ARGQYSTQATRFGSSEVLSDCQVTTNNATHNSAGAGISAVNEETTMPAVSRKRRISVPVKVNDTCGNIGRSEKHLENSSGPDVADAIEVLSSKIQDVQSPRSIFEPDNSVVQEQKDTHSFGISRSWLNMQPTQDNTPGTKVKNLNSAPVPSPAPITYYPFS

SEQ ID NO: 60627 - protein, 117 aa, Sorghum bicolor
  Clone ID: 8548511.pep
LLGLLNAGVLVLAVVALGGGAWLSHRASTTDCERFLERPVIALGVLLLVLSLAGLAGALCRASCLLWLYLLALFLLILLLFAFTVFAFVVTNRGAGWVVSGRGYKEYRLGDYSTWLQ

SEQ ID NO: 60628 - protein, 154 aa, Sorghum bicolor
  Clone ID: 8548513.pep
MFKKASLCNHGGIQLLSSSISALPPTRVSFQASCFTRSPLRSDRGYATASDSSDNLYQWPSSSSFTPYDVLNLRRNAPYSKAQYYDLVKIYHPDRSCDEHPLCRNISPEVRLQRYRIVVTAHEILSDPARRAAYDQTGAGWSHHPQRYSTAAEA

SEQ ID NO: 60629 - protein, 101 aa, Sorghum bicolor
  Clone ID: 8548519.pep
GKPCSSSTVGAPDGPASARCRRTPVLSSTVRWVMMAVWSSSALGVAAAAAIAAGSCSWLGLSSSSKQQQEQIRPPRQEDVPMNNGHRMHCLVGFSFAWWRR

SEQ ID NO: 60630 - protein, 104 aa, Sorghum bicolor
  Clone ID: 8548521.pep
VAIFFWAARSMLQAIEDSILFSCSHPACRGLDRTRDKYIAIIHSHAHIHRLSLEQHDFMMMYGSSAGLRSEFISVLKPRAKASISVSHQCRYISIHVCISVSQA

SEQ ID NO: 60631 - protein, 170 aa, Sorghum bicolor
  Clone ID: 8548546.pep
MASVPKLLLLSLLVFLSYRSPIAHAGDHGSYKVLSLGSLRTKSVCSESKAVKSSTGAATVPLHHRHGPCSPLPTKKMPTLEERLHRDQLRAAYIQRKFSGGGVNGSRGGAGDVQQSHATVPTTLGTSLDTLEYLITVRLGSPGKSQTMLIDTGSDVSWVQCKPCSQCHSQ

SEQ ID NO: 60632 - protein, 156 aa, Sorghum bicolor
  Clone ID: 8548554.pep
ARGGGGGGATVTVYEKEDYLGGHARTVAVEDDDADGGGTVQLDLGFMVFNRVTYPNMLEWFEGLGVEMEISDMSFSVSTQLGTSASRCEWGSRNGISGLLAQKSNALSPSFWRMIREILKFKNDALKYLEDHENNPDMDRNETLGQFIQSHGYSQF

SEQ ID NO: 60633 - protein, 137 aa, Sorghum bicolor
  Clone ID: 8548568.pep
MAPFSSRLLHGVPLLLILVGAAAAVTTAVHADTGGYRRRHARLFAFGNSLTDTGNAAIFPATAGGPSTSPPYGETYFGHPSGRASDGRLIVDFLVEELKVPEPTPYLAGGRTTATAADFVNGANFALGGATALDQAF

SEQ ID NO: 60634 - protein, 60 aa, Sorghum bicolor
  Clone ID: 8548575.pep
WHFSLAVVFRVNQIHATIMKYIPLQLLTSKICHHDLLYLCDVPLCHFVSMFINFENCYLT

SEQ ID NO: 60635 - protein, 40 aa, Sorghum bicolor
  Clone ID: 8548577.pep
HTLISYIYIDEQAKLAADSIYRSTNYLALAACLHADICLF

SEQ ID NO: 60636 - protein, 197 aa, Sorghum bicolor
  Clone ID: 8548585.pep
TRKELILSPTPAMRRILLSGLGIHFFQQASGIDAVVLYSPRVFKAAGITSDNQLLGTTCAVGVTKTLFILVATFLLDRVGRRPLLLSSVGGMIISLVGLAAGLTVIEHHPDGKIPWAIGVAIASTMAYVAFFSIGMGPITWVYSSEVFPLHVRALGCALGVASNRVTSGVISMTFISLTKAITIGGAFFLYAGVAVL

SEQ ID NO: 60637 - protein, 53 aa, Sorghum bicolor
  unsure (1)..(53): unsure at all Xaa locations
  Clone ID: 8548586.pep
ARGSGIAALLKSLHPDWTPXAIKSXIMTTSDAXDRTXLPIKDEQYXHATFYAX

SEQ ID NO: 60638 - protein, 130 aa, Sorghum bicolor
  Clone ID: 8548590.pep
FGTRVKQASDLKGHSIKVLNCHDSVIYILAPLKYATVYGCSDTTIILGAIGKVVKVEHCERVQIIAASKRICIANCRECIFYLGVNHQPLIVGDNHKLQVSFALPSVPFSTSSDVYQYMVIRNVSILILL

SEQ ID NO: 60639 - protein, 133 aa, Sorghum bicolor
  Clone ID: 8548597.pep
MRSLEMAGEERKRVLVVGGSGYLGQHLLAASSAADRLDVAFTHHSPAPPQPLLDALPSVRAFRADLRSGDGLEAISASFGQPHLVVNCAAMSVPRACEMDPPAAMATNVPSSLVNWLLSFGNEDSLLIHLSTD

SEQ ID NO: 60640 - protein, 139 aa, Sorghum bicolor
  Clone ID: 8548606.pep
HEDPNLPVQPRSMDPSKDLAAYGYGSVAWKERMEGWKQKQERLQHVRSEGGGDWDGDDADLPLMDEARQPLSRKVPISSSRINPYRMIIVIRLVVLGFFFHYRVMHPAKDAFALRLISVICEIWFAMSWILDQFPKWLP

SEQ ID NO: 60641 - protein, 147 aa, Sorghum bicolor
  Clone ID: 8548616.pep
LPGKMAPMMTFYGFMSLAYLALGLLWFIQFVRCWKDILQLHYHITVVIALGMCEMAFWYFEYANFNSTGTRPMGITLWAVTFTAVKKTVSRLLLLVVSMGYGVVLPTLGGITSRVAALGFIYFVASEALELVENLGNINDFSGKTPR

SEQ ID NO: 60642 - protein, 106 aa, Sorghum bicolor
  unsure (1)..(106): unsure at all Xaa locations
  Clone ID: 8548618.pep
TLLSSMDSDLKAFSHNPTDGSFTALAVQLTVFTNYPIQGFLSYXPELLSQYPFIXGKTNLSHDGLNPAHVPYXRVNNPTRCEFCFTMIGRADIEGSKSNVAMNAWL

SEQ ID NO: 60643 - protein, 182 aa, Sorghum bicolor
  Clone ID: 8548637.pep
TRVLRACFGTTKYCHAWLRNITCGNPDCLYLHDVGSQEDSFTKDEIISAYTRTRVPQMASSVSQRRTGTVLPPPGDDFSYSAVVSAKHTFKNGALNTTNQPRLSPPNSSSGRSTLPPAASWGQRDLNARTTATGATSSQSHTKPKSESQSNPFSSSPVISSTKTPSSWNDDTSTATKMSSGQ

SEQ ID NO: 60644 - protein, 96 aa, Sorghum bicolor
  Clone ID: 8548641.pep
TTVATISLALNFPTLPSVMHSLVNSYKKVLAVAIETDFSWPEIEQLKDRIANPDAYAAAAPAASSGAAAATEAAPAEEKKEEEEEEDEEGFGGLFD

SEQ ID NO: 60645 - protein, 149 aa, Sorghum bicolor
  Clone ID: 8548676.pep
QLSVSRLINLSHSPRTHRSNPARKAVVCYAMLVINPNAMQRRRGQQIQVARAIVSHSQHRRMRIHRRRPAGPPTDLRRKTPQRRRRPGTRRGRRWTRRWEAEGTSGPPLASARSSSAPAARRGSPGRVPWPWAPEPGPASASERARGRR

SEQ ID NO: 60646 - protein, 166 aa, Sorghum bicolor
  Clone ID: 8548681.pep
MGGKSANKAGYFDKLKGLLQDYKSIFIVEIDNVSSQQMHEIRHALRGKGVVLMGKNTMVRRALRTFLVDTPEYERILPFVKGNVGFVFTNGDLKEIRDQILANRVAAPARAGAVAPVDVWVPAGNTGMEPGKTSFFQALGVPTKIARGTIEITTDLKLIEAGNKVG

SEQ ID NO: 60647 - protein, 136 aa, Sorghum bicolor
  Clone ID: 8548708.pep
VAKSLPIQWIDGVLSQGQQVEFFNDEFRCPVYVKDMVDVILSLTKTWLSNGEKVQVLLNVGGPDRVSRLQMAESVAVVRGYDPRIIKSVSASSVNRGVASPPDISMDITKLTQILGIKPISFRDGVRSTLDAEAST

SEQ ID NO: 60648 - protein, 101 aa, Sorghum bicolor
  Clone ID: 8548712.pep
ISDDAVAVIRRPPMVDDALRARRRREMELLNGQVRPPHAPNHALGQRLGHRGLLLQWRWRQSTDRSRRAKQGRRREPAHQEPGGQVDTDVRHPGRDQRGEA

SEQ ID NO: 60649 - protein, 106 aa, Sorghum bicolor
  unsure (1)..(106): unsure at all Xaa locations
  Clone ID: 8548715.pep
EEGKVVGKRQYDDQGDFILCRLSNKRRVTLSEFKGRSLVSIREFYVKDGKEMPSAKGISMTMXQWEAFCNAVPAIEYAIKKFEDSDLRTCFRSPLLLPVANQKAYL

SEQ ID NO: 60650 - protein, 44 aa, Sorghum bicolor
  Clone ID: 8548754.pep
SMIRQYLSNTNQNATIPILQKKLELNKALVYWIERAKKNLAYVI

SEQ ID NO: 60651 - protein, 108 aa, Sorghum bicolor
  Clone ID: 8548761.pep
LGMAMFSLGLFMALQPRIIACGNKVATFAMAVRFLTGPAVMAAASFAVGLRGTLLHVAIVQAALPQGIVPFVFAKEYNVHPDILSTAVIFGMLIALPITLVYYILLGL

SEQ ID NO: 60652 - protein, 147 aa, Sorghum bicolor
  Clone ID: 8548791.pep
QFARRNNVRLVTSGTGHDLLGRSDGFGSLELWLRYYRNKIVFQKVYKPTNGCTKSPWKGSAMVIDGVYQWRDVSAVAKANNVFVATGGTPSVGAIGGWSQGGGHGPATTYVGWGVDQVLEAEVMLANGQIVTANSCENTDLYRSLRR

SEQ ID NO: 60653 - protein, 174 aa, Sorghum bicolor
  Clone ID: 8548792.pep
HEARISRDASKLFDHTAEPISPPRRLTRSALAKFAFISTEESKPTIADIEDSGGPARKRRRAVVTKTESSKSAQVVKPEVVDEALDDIPSPPAKARRVRKPARKAFDATIGVTKMDPPSDWEAVYDTVRKMRAPGGRAYGAAVDTMGCERLADRNASPKDQRFHTLVALMLSSQ

SEQ ID NO: 60654 - protein, 109 aa, Sorghum bicolor
  Clone ID: 8548801.pep
MAWMAAATLCCRLLRLPSARRPPSSRTRCSAAQSPDAVDKEYADLNLRPLYPNRGHHMRIRQHVNPLSSSFSEPTEPPEWKEVFDDPLLPLMVDIGCGSGRFLIWHAKN

SEQ ID NO: 60655 - protein, 76 aa, Sorghum bicolor
  unsure (1)..(76): unsure at all Xaa locations
  Clone ID: 8548807.pep
ESVALVQCGYKDFFDILPGQAVIIEKGKEPVFRQVAKQEAYTPDIFEYVYFARPDSVIDGIDVXESRRNMGFTLAE

SEQ ID NO: 60656 - protein, 93 aa, Sorghum bicolor
  Clone ID: 8548808.pep
RTVKPSQGTTHTEYTITLAVNFLFTFLSSLGNSLNESQKVNGPNGLYSNGATNGAIQHSLEKHLKFDSNDLPIRSRQEMFLTDEYKPVGKPIK

SEQ ID NO: 60657 - protein, 120 aa, Sorghum bicolor
  Clone ID: 8548811.pep
SSSSSPRTARSTPGPGSCPCSSPATARPPRGAAAALRPPSTTPPPAPSGTTRRLVVASPWLAGRPAPQWMSGPGWVRWLGVVCGAASWSERRGRGGAGRGGGGGAGTKRWSRTAMVACSG

SEQ ID NO: 60658 - protein, 74 aa, Sorghum bicolor
  Clone ID: 8548817.pep
ALNNVMGSVFGTRYDVTSGATAGAAEAEQLKSMVREGFELLCAFNWSDHLPWVAHLYDPSNVTRRCAALVPRVQ

SEQ ID NO: 60659 - protein, 87 aa, Sorghum bicolor
  Clone ID: 8548831.pep
AHGACNFIGAYALCRVIKRHELQGGEPPAGSRAKGAAASSSSGSARGQMSKVSSSSSLVTSEQLSASFTPSNSNSPPPTLDVMFQFQ

SEQ ID NO: 60660 - protein, 56 aa, Sorghum bicolor
  Clone ID: 9280845.pep
IRPEGDIGSTTTAIVKPRDVGDEQPQDRRRRLGRRPCLNNGGARTQLTGSYLDAAT

SEQ ID NO: 60661 - protein, 152 aa, Sorghum bicolor
  Clone ID: 9280849.pep
FIRVVGGESGAMSSLAPKLGPLGLSPKKVGDDIAKGSQAWKGMKVTVKLSIQNRAYTVEVVPSASALVIKALAEPPRARKKEKNIKPHGNLSFDDVVKIARQMRARSLARDLAGTVKEILGTCVSVGCSVNGASPKEIQQKITDGELEVPAN

SEQ ID NO: 60662 - protein, 94 aa, Sorghum bicolor
  Clone ID: 9280868.pep
AKPCVVYFLPNPDGHPRSSGGSTCPACVGSYGFTHGCIYKSCGWSWCFLCGLGYVGSLVLKLRLVPAALSIGRMYYFVASSNVSPKPDVLVCSL

SEQ ID NO: 60663 - protein, 94 aa, Sorghum bicolor
  Clone ID: 9280871.pep
TVHKKGVTAEVARKRARKTVKVERAVAGATLEKIKALRSQTAEFRAAQREAAVREAKARKQAEAKKKAEAKKDAPKVKPQKAPIAAAKHAGKGR

SEQ ID NO: 60664 - protein, 118 aa, Sorghum bicolor
  Clone ID: 9280874.pep
SGALKCYLASHMHIHEKLKRMPNIENMERKGSRDQRLDIRNSRFDFGMTRDPSSILRSSRSEPCEIYTLSHYHHHREPSILRCHHLEDVYFLRKEQPSVNLALPPVGWQRTCEQPWQT

SEQ ID NO: 60665 - protein, 64 aa, Sorghum bicolor
  Clone ID: 9280882.pep
GKGLLASDQVLHTDTRSRPTVDALARSRVAFDRAFVDAITRLGRVGVKTATARGNVRRDCAVLG

SEQ ID NO: 60666 - protein, 90 aa, Sorghum bicolor
  Clone ID: 9280883.pep
SSGPRYRSLRTTQSSVVKEVKGGVSWGTRQRYRYEATDGFGCYLRNVASRGYSIASDQANEVCAKGGGGAPAGGSVTAASGADEAGLVRN

SEQ ID NO: 60667 - protein, 75 aa, Sorghum bicolor
  Clone ID: 9280888.pep
GSLTLLYNFFCVTAGTNNTMIIYTLCFLLLQKNDNASVSKCRYGRIRRQQLPCWPCGCTTQSATETPSSAPSAPP

SEQ ID NO: 60668 - protein, 79 aa, Sorghum bicolor
  Clone ID: 9280906.pep
MGLLTVAGSPRFRVYDLDFGFGRPAKVDIVSVARTGAVAVAESRSGDGGIEVGVSLQPAAMERYRKCFADATLWLHQKT

SEQ ID NO: 60669 - protein, 89 aa, Sorghum bicolor
  Clone ID: 9280907.pep
ASDIEERLELDYQLGEDIKEKLIPRAVDWFTGEALAYEEFDEDDMDGPDFDDDEDDEDDMSEDHDDDEESDEDDESGKPKQEAAECKQS

SEQ ID NO: 60670 - protein, 103 aa, Sorghum bicolor
  Clone ID: 9280909.pep
TVLQHRDQVRKLLPEAKLQRGRDLPGITKQKKKENEGKKNEISIYHDLQQHFMHQGDCKALINMKRKKNTTVSSLLQRQCAEDDRFDDDTWTGQQRESNRSSS

SEQ ID NO: 60671 - protein, 55 aa, Sorghum bicolor
  Clone ID: 9280925.pep
SMHANCCIGLRSKIHDLRIMMEHWRSYLSLPPNLKRLQISAWRVPQNCSLSWSHR

SEQ ID NO: 60672 - protein, 32 aa, Sorghum bicolor
  Clone ID: 9280928.pep
KLHILHSHYPAYFSLKAPRPKKKTHLNRESQA

SEQ ID NO: 60673 - protein, 42 aa, Sorghum bicolor
  Clone ID: 9280935.pep
YNIILIGTYTYTNFNFREKPCSISVIYYVATVVVKLKIVLES

SEQ ID NO: 60674 - protein, 85 aa, Sorghum bicolor
  Clone ID: 9280945.pep
SRFPHQSIESSKNLPSFLILSPSSSHSLLVSGQHPLYGWPFRAAIPPGAHSFAAGDNLSVPTCEKPLDQRNVVYIHESEFIPSHV

SEQ ID NO: 60675 - protein, 75 aa, Sorghum bicolor
  Clone ID: 9280948.pep
QGEAVVASHVEGKLIPPTPNDPGLSTLGTEANTQKFVYVSEGAPYGGRQSKSLSRGNYKAVRLSAVWPFPVQCPC

SEQ ID NO: 60676 - protein, 98 aa, Sorghum bicolor
  Clone ID: 9280957.pep
SIHVSPVQHSLYRSNYFSPKGKKKTNKLMERSPASPARQPAQVQQCTSPTPIQCQPNIIPNQCSRSRSRFRTSWARTNKATPSGRRWAAEVVAICMVK

SEQ ID NO: 60677 - protein, 73 aa, Sorghum bicolor
  Clone ID: 9280968.pep
REIEANKFNLKNSEKSLDANASNASDKSGSDLANEEKTHARDDNPKHEESANTGLLGSLKSFAYGIRNFWKNM

SEQ ID NO: 60678 - protein, 57 aa, Sorghum bicolor
  Clone ID: 9280969.pep
GAKEKMLIMKFMGAQSQPTKGGTQYFHYPANSKYPLTSLGRAAMAAWQDKTQSTDTH

SEQ ID NO: 60679 - protein, 143 aa, Sorghum bicolor
  Clone ID: 9280971.pep
PHLHLYLHREIERCVQSGQKSYDFEYYLLITSQYTVTKPLPEEDEDEGPKKKKRRVSNELKIGAVEWYRFEEATYAQHAAGMFSCERKRPASDEEDKMTLAAYTKDSRVFMVLTREQINKKVIPHMKSIAVDPEQVKPNKEKK

SEQ ID NO: 60680 - protein, 34 aa, Sorghum bicolor
  Clone ID: 9280991.pep
GKKLKRSLRNQALQLILQGNITLESTLRNTKRER

SEQ ID NO: 60681 - protein, 81 aa, Sorghum bicolor
  Clone ID: 9281026.pep
MRRLLGEATVAGELRLWDRMLREVKLNISPGSSCHCSEPGWFRVCFANMSLDTLDVALARMSRFMDRWNKETAVSTQQQQH

SEQ ID NO: 60682 - protein, 67 aa, Sorghum bicolor
  Clone ID: 9281031.pep
FPCSYAAGGCMQLVGFRHFRTFLWCFSKCLDTILNLAGDGGLSPDGTSSSCGGRARDQNLSRMLWTF

SEQ ID NO: 60683 - protein, 94 aa, Sorghum bicolor
  Clone ID: 9281044.pep
NFALIISQIAATYVISSALLLRSNLPPEMKSKIGDALGAPLEPGFTERWFEGWFLAASAATTLGIWLGKRLKGAEWDDDGEGGDVDVEMGKRST

SEQ ID NO: 60684 - protein, 78 aa, Sorghum bicolor
  Clone ID: 9281046.pep
KLYNGLAIRRFSPLSHYNSHGPNKQPIRLSLSGESCRSFSSVFFSQEISQRYFLLWLINQTKSTNGMIYEKSANSTIF

SEQ ID NO: 60685 - protein, 52 aa, Sorghum bicolor
  Clone ID: 9281050.pep
FETGMQSSLLALALANKFFPDPLVGVPPAISVVLMSLMGFALVMVWSKKTEA

SEQ ID NO: 60686 - protein, 83 aa, Sorghum bicolor
  Clone ID: 9281053.pep
HGAPSDETRHVGDLGNLETDGQGNAKGSVTDSLVKLIGPHSIIGRTVVIHAGTDDLGKGDNEESLKTGNAGPRPACGVIGISN

SEQ ID NO: 60687 - protein, 103 aa, Sorghum bicolor
  Clone ID: 9281056.pep
LVTIQCPNPDFNKEQNRWRMVRRMLVEAVVDLLHTNGQVYLQSDVESVLLVMKEQFLSYSKGQLVIDGVSGHQIDNPFGVVSDWERHVLARGAPMYRTMLKKV

SEQ ID NO: 60688 - protein, 40 aa, Sorghum bicolor
  Clone ID: 9281075.pep
EKAKVAYERRKQLAKLRVKAEKTAEEKLGSQLEILAPIKY

SEQ ID NO: 60689 - protein, 33 aa, Sorghum bicolor
  Clone ID: 9281076.pep
GRRTKFHYQHNEITKFKGLTVLPPGAHKPHTLT

SEQ ID NO: 60690 - protein, 105 aa, Sorghum bicolor
  Clone ID: 9281078.pep
WGPLSFLIGWLVIKDSPLRYPLQLIVSLGQFYGDVLYYGTFFFDEAVHGAVYCRPEPFYFWAYFVMMNGFWIVIPGWLIIQSVIECTKALRVAQEVAKRESPKSQ

SEQ ID NO: 60691 - protein, 121 aa, Sorghum bicolor
  Clone ID: 9281085.pep
LATIAARKGAFALIYPGAFNTTTGPLHWQLLGRARAADNQLYVALCSPARAETGYPAYGHSLVADPMAQVQVEADEKETTVDWELDPDKITEARKNIPLNTQRRFDVYPDVSEGKIQFEEP

SEQ ID NO: 60692 - protein, 72 aa, Sorghum bicolor
  Clone ID: 9281100.pep
RPQLGDGQVSDVLDQRLGGDYDAAEAAAVAEIAMQCVSDTPGLRPSMADVVRVLQEKTSAVGSRLDRKMLVS

SEQ ID NO: 60693 - protein, 96 aa, Sorghum bicolor
  Clone ID: 9281111.pep
LARSGVRVNAISPHAIATPLLVRGLARLHPGVPDEQLKRMVETGMSELRGAVLQVEDVARAAVYLASDEAKFVTGHNLVVDGGFTASKRIGTPAAS

SEQ ID NO: 60694 - protein, 115 aa, Sorghum bicolor
  Clone ID: 9296080.pep
MSQRKGASMAAAVTSSKHHEDQEMMMELRRGPWTLEEDNLLMNYIACHGEGRWNLLARCSGLKRTGKSCRLRWLNYLKPDIKRGNLTPEEQLLILELHSKWGNRWSRIAQHLPGR

SEQ ID NO: 60695 - protein, 102 aa, Sorghum bicolor
  Clone ID: 9296091.pep
MASPALRLRLRLLLLLAVAATATARGAGAGRVDLWPMPASVARGAQTLLVSKDLKLSTAGSSYADGNGILKEAFQRMLAVVELDHAINGTYSSHGAPVLAGV

SEQ ID NO: 60696 - protein, 113 aa, Sorghum bicolor
  Clone ID: 9296098.pep
MGRGKIVIRRIDNSTSRQVTFSKRRNGIFKKARELGILCDAEVGLVIFSSTGRLYEYASTSMKSVIDRYGRAKEEQQLVANPNTELKFWQREATSLRQQLHNLQENHRQLMGQ

SEQ ID NO: 60697 - protein, 91 aa, Sorghum bicolor
  Clone ID: 9296117.pep
MSNTLLRVCPSDLKMPFELKKHNSACLELINKTDQWVAFKVKTTNPRKYAVRPASGVVPPRGSCGITITMQAPKEIPPDYYCKDKFLVQSI

SEQ ID NO: 60698 - protein, 59 aa, Sorghum bicolor
  unsure (1)..(59): unsure at all Xaa locations
  Clone ID: 9296134.pep
MGLISGMVMGMVVGVXIMAGWSRVMRRRSTKRVAKAADIKVLGSLTRDDLRKLCGDNFP

SEQ ID NO: 60699 - protein, 61 aa, Sorghum bicolor
  Clone ID: 9296149.pep
PSGAPRLSRWPGPAAASTAPALAARLPEAPRQPRRSSDPPRPAASSRTGARRGPPLPRAGV

SEQ ID NO: 60700 - protein, 76 aa, Sorghum bicolor
  Clone ID: 9296155.pep
AAVASSTTAAAAPWADAATTSPSTGARRRRRRGGRTSSCSRRRRGSSVIISINGEEESRSNRSNRERLLASSLKPS

SEQ ID NO: 60701 - protein, 122 aa, Sorghum bicolor
  Clone ID: 9296190.pep
DSDVDHEVGRPSTSNSATGQGHTLRSRASDDEDDSTSKLELESRYAEENKKMQKELAGPFKDDSVSKLELESRYAEENKKIQKELDLLRKTKASAGGFSATFVLLVFLLGSLLGYLMFGSKA

SEQ ID NO: 60702 - protein, 85 aa, Sorghum bicolor
  Clone ID: 9296202.pep
MPNYTRYLIKTYNFSGYTSYHMICFYAQLYEKEAAGEVNRDSTTPYNFAVAENANIPIHLELNTTPQEHDVEPPAAPKLGLQLNP

SEQ ID NO: 60703 - protein, 69 aa, Sorghum bicolor
  Clone ID: 9296227.pep
WNSGARRRRSRSRRRRSPSRRRWAPAPRRRPPSPPPPPPPLPPPRGTRTTPPRRGTTSACATTRRRWAA

SEQ ID NO: 60704 - protein, 146 aa, Sorghum bicolor
  Clone ID: 9296228.pep
MESHNGGGGKARDMFSVYQNPSLTRALDSRSARPSVTVLVVLAILPIASASSLLALSSREQQLSKLAGRAGISVLAAVFVFRLVEAALGLVALFTLLGFFRALMLYNGKKALAKDDKVVLSERQLGLLGLKMAGSEGGGKGEQTKR

SEQ ID NO: 60705 - protein, 168 aa, Sorghum bicolor
  Clone ID: 9296230.pep
HEDSQSPLPARLTPPVAAPSQRQTPLPAAPSQRSTPPLVSPPPRATSPPVGSTARQTQRPVALQIRSTPPPAASAPRSTPPPPVPPQTRSTPPPVAPAPRPTPPPPVVPQTRSSTPQPTTPQTPVAATVPAVKSGAAPSSTFWTVCSACCHIHQFDGQYEMRKLLCPS

SEQ ID NO: 60706 - protein, 176 aa, Sorghum bicolor
  Clone ID: 9296236.pep
HEADSKIADTEVGVLSNYNPGQTGTNGTLIIDNVDMTSVPVAVKNGGTDATILPGNAKIESFVQGRAYTGGNGKAIQATQTPVEKPKAILDSNGNVVTKSKPQYEGVPASNFVSVKSKGAKGDGKTDDTAAIQAVFDGIQEGQIVYFDHGAYIFTDTVKVPKNIKIVGEIWPLIMA

SEQ ID NO: 60707 - protein, 192 aa, Sorghum bicolor
  Clone ID: 9296238.pep
KSAVERAGLQPTDVEEVFVGNVLSANLGQNPARQCAIGAGLPESTVATTINKVCASSIKSIIVGAQTIITGNAQIVVAAGAESMSNTPHYLPNMRNGAKFGDQSLVDGLLKDGLTDAYKKEHMGLQGEECASDHGFSREDQDEYCIRSYKKANAAQEAGWFKEEIAPIEVPQGRGKPPVVVDADDEPKNFNE

SEQ ID NO: 60708 - protein, 111 aa, Sorghum bicolor
  Clone ID: 9296242.pep
LVQFLGAVAELARGAAAPTVRPVWCRELLEARDPPRPAFAHREYDEVPDTKGTLIPLDDMVHRSFFFGRQELAAIRANLPPALRARASTFDLLTGLLWKCRTAALAPDADE

SEQ ID NO: 60709 - protein, 136 aa, Sorghum bicolor
  Clone ID: 9296243.pep
TRIQRAVAAWKIVLNGRFRLLDRWCNFVEKYQRHNISEDTWQQLLAFSRCVNEDLEGYDPRGAWPVLIDDFVEQMHRIYHSTDCSSAMEAQCSISSTFKGLDPLPGSKRKCPHFKSNEEDVELSDSFTRSVHLTPI

SEQ ID NO: 60710 - protein, 143 aa, Sorghum bicolor
  Clone ID: 9296244.pep
MNKETVSQNSESSQNSFAAMHAKQVNQALGSSKVGAGTESQSPQLSAKPLTTTSLSQTQSHGIQEEAKIQIQSSVQAPPAAASKTPQRKATSGQKKPLEALGSSPPPSSKKQKVSGGFHEQSIDQLNDVTAVSGVNLREEEPR

SEQ ID NO: 60711 - protein, 77 aa, Sorghum bicolor
  Clone ID: 9296253.pep
TRHTKAPANTTTASNLPTTPTTPPTTTNPPRCRSTTSPTRLPPGRARAPNGRASRRASSARTASTAAASIACPLAVP

SEQ ID NO: 60712 - protein, 168 aa, Sorghum bicolor
  Clone ID: 9296264.pep
RGRQRRRRRAGRRRRAGPELHDWGAVLLPSHPPGGLGHAAVDVLDAALVRDEDLRVGRRLLPVLVVGQRRARAVLVHDGHPRGRPGLRSLLWRVARRGCCGREQGLRVQLHDHKGGALCTKSTRSSKQQQQQEEQPAAMAAAGSSHGLASYWLVVSVEWSYRPARPRA

SEQ ID NO: 60713 - protein, 109 aa, Sorghum bicolor
  Clone ID: 9296272.pep
MSWAAVENDPGVFTEMLQQMQLKGLQVDELYSLDLDALNDLQPIYGLIVLYKWRPSEKDERPVIKDAIQNLFFANQIINNACATQAILSVLLNSPGITLSDELKKLKEF

SEQ ID NO: 60714 - protein, 148 aa, Sorghum bicolor
  unsure (1)..(148): unsure at all Xaa locations
  Clone ID: 9296275.pep
ASASKGSKKVHQWRLRSRAGRPRPXLEPPRTPXPTVPNPSPRRRSTVTRARVPNPTRRGGAGSGVAPGRRGSKDGCRSRAGPAPTAAPFLIAAFVPRAVGFSGVITGRREWEQAAGWQILRDSPRALASHASPPPPPPPLPTRSGPSC

SEQ ID NO: 60715 - protein, 161 aa, Sorghum bicolor
  Clone ID: 9296278.pep
MKRQWSHPSVVLPLLVVVFLLLTFRCSLRQHAQQAFSSRRGAAADDDAGRYAVDAKLAELAAVDPAASAVLRAAETLLERNLTWARAPPERRDAAVRGLRDWLGRQRFEPQVMAQLLDLIKRPIDRYAYAGETGGDDVPVRPYASCAVVGNSGILLAREHG

SEQ ID NO: 60716 - protein, 149 aa, Sorghum bicolor
  Clone ID: 9296298.pep
MPSSFPARGGRGLLLPAAVVVLVLLDAVAPAAGCYPRVFSFGDSLADTGNCLFVYGNNSGQAGLRPPYGETFFHRATGRASNGRLVVDFIADALGLPFVRPYLSGGSAEDFACGANFAVGGATALSPEEIRARGFDNMGNQVGLDMEME

SEQ ID NO: 60717 - protein, 72 aa, Sorghum bicolor
  Clone ID: 9296305.pep
WRMQKQDDALVQHFCDQVGVRRQVFKVWMHNNKHTGSGGRRQLPQPQEQQQPQQQPPQTQTQAHQQQPQQEQ

SEQ ID NO: 60718 - protein, 136 aa, Sorghum bicolor
  Clone ID: 9296306.pep
LLLYLFAAFLEHPKWMLHVDPTSYSGAQSSKNPLFLGVLPPKERFPEKYVALISGVPAIIHPGALILAVSKQNPPIFALYWDKKQQFSLQGRTALWDAILLLCHQINVGYGGVVRGIHIGSSALNLQSVIDSDSES

SEQ ID NO: 60719 - protein, 166 aa, Sorghum bicolor
  Clone ID: 9296314.pep
GVLIESTKGAWLWGTASEHSVLYNYHLQDASNVYMSLIQTETAYMQGNPDATVPFTVNEKYHDPDFKATCTGDSKRCARTWGVRAVNSKDVFIYGGGLYSFFDNYDQVCVGENNCQDNMISIESSKLHLYGISTKASVNMVNVDGKSAVLDKDNRNNFCAAIARFS

SEQ ID NO: 60720 - protein, 201 aa, Sorghum bicolor
  Clone ID: 9296316.pep
FKEEIAPIEVPQGRGKPPVVVDADDEPKNFNESKTRTLRPVFKPKDGTVTAANASPLSDGAAALVLASEEAVKKHGLKPIAKILGWGDAEQNPSKFTTAPALAMPKALKHANVELSAVDAFEINEAFSVVALANMKILGISEDKVNLHGGAVALGHALGASGARITTTLLGVLKEKKGKIGCAGICNGGGGASAIVVESLQ

SEQ ID NO: 60721 - protein, 65 aa, Sorghum bicolor
  Clone ID: 9296334.pep
VELSHSSLGCSKALMSAMVVDHCPTLEFMPSVLEGHLHISPTNIDRGHRINPAGRQVKKNTLSSR

SEQ ID NO: 60722 - protein, 148 aa, Sorghum bicolor
  Clone ID: 9296338.pep
MCNAAHFAEHAVCNADDGGAAAPVIVTDPRLDALCARIVKYYSLRRFVRETGRPAEEWGTRHEEGMFHYSSGMQAVVAAAGVCGRVSVFGFGKEPGARHHYHTLQRGELDLHDYEAEYEFYRDLEERPETIPFLRDSGFRLPPVVVYR

SEQ ID NO: 60723 - protein, 184 aa, Sorghum bicolor
  Clone ID: 9296356.pep
NLKELTGSAGALTGNDSYTYHWSQQKPHTVPGGSVKIIDPTTFPIAKGFSAALVVVQPGALREIHWHTTSDEWSYFLQGSGRITVFKAASSARTFDFTAGGVGYIPAANSHYVENTGTEDLIFLEVLQAPKFSDVSVAQWLALTPKQIVKDHLKVSDKFLDSLPKEKQFIKTGDVNMTAIADEA

SEQ ID NO: 60724 - protein, 141 aa, Sorghum bicolor
  Clone ID: 9296361.pep
LLSIPATVFSDAGALVDSGTVITRLPPSAYEPLRSAFAKGMEGLGYKTAPAFSILDTCYDLTGYQGSIALPAVSLVFQGGACLDVDASGILYVADVSQACLAFAANDDDTDMTIVGNTQQKTYSVLYDLGKKVVGFAPGAC

SEQ ID NO: 60725 - protein, 136 aa, Sorghum bicolor
  Clone ID: 9296367.pep
FGLMGDGQPIGRYDDMWAGWCTKVITDHLGLGVKTGLPYIWHSKASNPFVNLKKEYNGIFWQEELIPFFQSVSLPKEATTVQKCYLELAKQVRAKLGKVDGYFNKLADSMVTWIEAWDELNPPKGGAPTANGPPKK

SEQ ID NO: 60726 - protein, 201 aa, Sorghum bicolor
  Clone ID: 9296374.pep
RTMTPSVVAKISSTISELIQLGAKTLMVPGNLPIGCVPDYLMIFKSDKEEDYEPQTGCLRWMNEFSQYHNKLLVEELKKLRKLHPGVTIIYADYYGAAMEIFLSPEQYGIEHPLVACCGGEGPYGVSPTITCGFGEYKLCDNPEKYGSWDGFHPSESAYRAIATGLLLGSYTRPSIASTTTSCPQLMELGSSAEYKPLYDL

SEQ ID NO: 60727 - protein, 135 aa, Sorghum bicolor
  Clone ID: 9296379.pep
VMLEHVQAHVAPTDVDPGAGIQWLPKIHRRSSAFKRTGALLERVFMPCQMYFRYTRHKGGTPELKVKPLKELTFNSPDITAGMTSRQFQVMMDVLTNLLFARTPKKPKSNLSYPLDNDDDDIEEASDAVVPDGVE

SEQ ID NO: 60728 - protein, 114 aa, Sorghum bicolor
  Clone ID: 9296627.pep
NDTDIDATYAASLRASCPAQAGGASDGALEPLDDATPDAFDNAYFGNLLSQRGLLHSDQALFGGGGATDGLVSTYASSADQWGSDFAAAMVKMGNISPLTGTDGEIRVNCRRVN

SEQ ID NO: 60729 - protein, 91 aa, Sorghum bicolor
  Clone ID: 9296629.pep
MASPGTAAALLVVLAALLAPPPAACACSAADRDALLSIRAALSEERRLGVFSTWTGTDCCAGWYGVACDPTTGRVADLSLRGEADDAVMAP

SEQ ID NO: 60730 - protein, 111 aa, Sorghum bicolor
  Clone ID: 9296650.pep
MDFGNLGGTFGNVGKSLSNFGASVTPFASRTFQYTKEQFGQTEDKTQLPPDYIDLEKRVDALKQAHRKMLAVTSQYSNEGYDYPPNIKETFQDLGRTVSEKVSLLSTATSS

SEQ ID NO: 60731 - protein, 62 aa, Sorghum bicolor
  Clone ID: 9296653.pep
FFFFFFLSALFSVILKELIQRWLKLLRAPSFYQYGAELNQIKLLSPLPNNLQALYTTKKSEM

SEQ ID NO: 60732 - protein, 178 aa, Sorghum bicolor
  Clone ID: 9296694.pep
MFARQSFRCAQPLKQSFRKYSAEAAPKKSNLTPIYVAVGLAGVGVGLYRYSSGDSSVPAAIKLEDRPKVFTGDWVDLKLANIEILSHNTKRFRFEFEDKEAVSGLPVASALLAKYKPEGAEKAILRPYTPTSDEDTPGYLELVVKAYPGGPMSEHLHSMNVNQRLSLKGPLPKYPWEG

SEQ ID NO: 60733 - protein, 54 aa, Sorghum bicolor
  Clone ID: 9296715.pep
RSSTAFMDIISPAVAVLRRFLSALAVSGFLFGLKTLNDRGELSDNLICLLVALN

SEQ ID NO: 60734 - protein, 102 aa, Sorghum bicolor
  Clone ID: 9296732.pep
QCEFAKQCWQSIGVDIPAVAEMPSSMHFLKDAIGSRFFMESIILLCWAIWTTRNAFIFDNIQPQVSSSRTSFIKELKVLKFRVNSRSEHSFLPMAFLLLLSW

SEQ ID NO: 60735 - protein, 155 aa, Sorghum bicolor
  Clone ID: 9296737.pep
LVKYYSSTRHGISSREFGGDYGHRHSVHDGISYMIKSIRWVENGAQPQARLRGKARRERMRKAMREVKGSLGNINGIDLDKDKEGRLRGGISATWRKKEPESSASKNNDTVAEGDKQNQSSADDEQDKEKSEEKVQDVNMDDAAETPATGEKTDQ

SEQ ID NO: 60736 - protein, 128 aa, Sorghum bicolor
  Clone ID: 9296754.pep
APFGGPERLAWLWRAFLPPGATRDHEAANVPAAIRRDAGAGDDRWRTFPPTLVCVGGWDVHQDRQRAYADALRAAGAEEVTVAEYPDAIHAFYILDDLADSKKFVGDVAEFVNRHTSQRKKRALDHAD

SEQ ID NO: 60737 - protein, 149 aa, Sorghum bicolor
  Clone ID: 9296759.pep
PWEANKHDHICLIAGGPGITPMYQLARHIFKNPEDRTKVTLVFGNISEDDILLKKELHELENTYPQRFRAFYVLDNPPKDWTGGKGYITKELLKTVLPEPKEENIKVFVCGPPGLYKAISGGKVSPKDQGELTGILKELGYSKEQVFKF

SEQ ID NO: 60738 - protein, 77 aa, Sorghum bicolor
  Clone ID: 9296760.pep
LKALQLIDASPEHTFIFEDSASGVRAGVAAGVPVVGLTTRNPGMVLKDAGASLLAKDFQDPELLSVLQEIEPAAANA

SEQ ID NO: 60739 - protein, 85 aa, Sorghum bicolor
  Clone ID: 9296765.pep
MSPTVAGAAATSGDGSPRELYTIPASSGWFRWDGIHETERQALPEFFGRAGGAGFGTATRNPRIYREYRDFIIAKYREDPARRLT

SEQ ID NO: 60740 - protein, 142 aa, Sorghum bicolor
  unsure (1)..(142): unsure at all Xaa locations
  Clone ID: 9296772.pep
MISNIFDVLSSQLAIHPIQSLLLLTILTPFLYILSNEYVRYSRRIKGFPGPRNWPLVGNIPDIKYNAAEKYREWSKVFGAVYQIQLGNEPVIVVNSAEAARKLFGGNSQALSSRPVFWTFHKVLSNTAGTTIGTSPFSESLX

SEQ ID NO: 60741 - protein, 184 aa, Sorghum bicolor
  Clone ID: 9296800.pep
AHEAALKIKTDENDELIRQMDALNNQLTTDAAEIEQLKEEAASLRSTIDTLEKASQQLESQHASEIAKVQADLNEANKKADTYKSELDTLHDKHKQDLRVIGEDYEREIESLRADLEGDASRRLNTLQSDFDALVAEKNANSEQHEKVLSERSSEIEALKQEINELRDTSASATRSSEDVVAKL

SEQ ID NO: 60742 - protein, 44 aa, Sorghum bicolor
  Clone ID: 9296805.pep
AAETPTTCSRRSSGPPPAGSGFRSVLPWMSPIMDRKLGASRCAS

SEQ ID NO: 60743 - protein, 74 aa, Sorghum bicolor
  Clone ID: 9296808.pep
LVIVWSHDKVADQRCSASYSACAQMRRMVWQVTYLDSIVLPSPIIFFLFFVDDLLSRNPTLLLQSLGKFISILV

SEQ ID NO: 60744 - protein, 97 aa, Sorghum bicolor
  Clone ID: 9296819.pep
IRLENKIPINNGILCLSAKNVSVIGGTVQSLYEEWQMNQKYSGLSRPSLRLSQSDDGVGPPPFEKLDIEARPCRATKVQAYPGNHHLLFFVSTHAVD

SEQ ID NO: 60745 - protein, 110 aa, Sorghum bicolor
  Clone ID: 9296840.pep
AYSIMYGNSYETSAAQVYETAPPKRLASLSRNSLVTLASSSSRSSSSISIQEHELPEHLHSPCSPDGFISAPPSGSCVPNASSVPMRSLSMMDLHRVHRSSSSVGLKDRK

SEQ ID NO: 60746 - protein, 171 aa, Sorghum bicolor
  Clone ID: 9296850.pep
AYDDQKCGYVVALVRECLRYYTVLRLALPRATVKDVIYDGKLIPAGSTIYLNAWACNMDPEVWSDPDEFRPERWLEQPDAPLHSYGLGYRMCAGSLLANRELYLVFLRMLNSFELVPDSDVDVHPVRGSSDPTSLVTMCRAYKVVFKPRNQGILREALKAADERLAEHEKS

SEQ ID NO: 60747 - protein, 134 aa, Sorghum bicolor
  unsure (1)..(134): unsure at all Xaa locations
  Clone ID: 9296860.pep
EVVRKHXARVEPLEKENASLHDKVDRLEAILAAGDRVARAAATLGEQRHIDTLAEEDEEEGDDGDAASSLQRHKTNGTGAAKDVVGTQLAAMQETLTQLAELNNEAIVESTRTAQRLTADQEQLSLPPPPPSYQ

SEQ ID NO: 60748 - protein, 83 aa, Sorghum bicolor
  Clone ID: 9296863.pep
GLHKYKGFVTNECNPCKCRNETPLSHPLAQVKKGNSSLYKQWQNPQPLKCCYHLFCIFSLQQQHLTICNATLHQQMVYQTVQL

SEQ ID NO: 60749 - protein, 143 aa, Sorghum bicolor
  Clone ID: 9296891.pep
HEGHHGYCVESLIEEFKTQLDDALTEELKDSMVEHLKKAIYSCTADEFNQYIELIKSESDKLADWLLEIKPDQWSDAFFKGSRHGQYSCNVFGTVSEWIPTRYELSVVQLVDTIRCKLMEMMYTRRESSNAWTEVLTPAANQK

SEQ ID NO: 60750 - protein, 152 aa, Sorghum bicolor
  Clone ID: 9296901.pep
MGPSGRSWLLVLLVCATLCAHVSAAASDTTVLAAERTRRKDPLDGLRYYTGGWNISNRHYLASAGFSAAPVFAFAALWFVAVAAAALVACCCSCCCRGVGSSSYSYSRRVFALSLLLLLVFTAAAVIGCAILYDGQGKFNGSTTATLDYVVS

SEQ ID NO: 60751 - protein, 178 aa, Sorghum bicolor
  Clone ID: 9296903.pep
PSSLVCRVWPLVRGRGGWFRLWFDPSVLVAPLTRCFAERMTLSYDADADDYRNAPGVETRVSDFGSTSTLRYLDPNLKLLTGYMNTLASTLEEKAGYEEGRDLFGAPYDFRYGLAGPGHPSQVGSAYLQRLRLLVESACAANGGRAAILVAHSLGGLFALQLLARSPAPWRAAHVQRL

SEQ ID NO: 60752 - protein, 50 aa, Sorghum bicolor
  Clone ID: 9296907.pep
KNCFSFPDYLSCGSKLASVLTENDARLMRCSAMQVFSLKTYTYNLFLLTS

SEQ ID NO: 60753 - protein, 175 aa, Sorghum bicolor
  Clone ID: 9296912.pep
HEGQQDCGSRCTICGQVWNYCKESDRLERSLNYTVEACAILTLDSIPTSDGLCPFNTTLESCCFEQPTPPVTPPVAPPVEPPVTPLAPPVTPIAPPVTPPVAPPVAPTCTTVPTIACSSSVDCPKYFACDGTRCQNNQGLSCSNGITCQSNNCTAAPSCFCGPTYSSSQLCLDAI

SEQ ID NO: 60754 - protein, 168 aa, Sorghum bicolor
  unsure (1)..(168): unsure at all Xaa locations
  Clone ID: 9297379.pep
QRRRHDHDAAGRSADDGVQRRQGAADADRVRAELVHGRRGGGGGVGRXEEQSSSRSSALSLFKEKEEEIERKKVEVRDKVFSMLGRVEEETKRLAFIRQELELMADPTRREVDAIRKRIDKVNKHLKPLAKTCLKKEKEYKMCLEAYNEKSSEKATLVNRLMELVSES

SEQ ID NO: 60755 - protein, 165 aa, Sorghum bicolor
  Clone ID: 9297380.pep
ARGIGSLLSRKKPYENEWNSFYHQLVWQIGNNPDLNAVRNALDLSINYLPGNVKNCFLYCGLFPEDHQIRGEEIIRLWITEDFIEERGPTSITMEEVGAEYLNEIAQRSLLQVVQRDAYGRSEIFQMHDLVRDIVVSKSAQVRNFLFWITLVLQCIAEKHAVYQY

SEQ ID NO: 60756 - protein, 162 aa, Sorghum bicolor
  Clone ID: 9297381.pep
MASISQVVTLPLPALPEGWSAEKDFKAVGKLSGAVQRSIEPVGPHFLAHARRARHKRTFSEDDRIQAQESAKKVEDVDDGEESEAEDPMLLQLQAKDWKTQDHYKVLGLSKYRYKATEDQIKKAHRKKVLKHHPDKKAAQGRTEDDQFFKCIQKATDILLDP

SEQ ID NO: 60757 - protein, 190 aa, Sorghum bicolor
  Clone ID: 9297385.pep
RSTSFEGPLDEIPDENSPQILHRKMFLRAYLNKLCSDPSKMEFWEYLDKVGMMHVGLGRKHPLHIEYVHLGACLGFIQDIMNEAILSHPRLHIQRKIALVKALNKVIWVQNDLMAKWHVKDGAEFEAPDSDIEIEREGYLHGKKILSDEDMKDHTGAEGSPDGEEKAIPQGTCPFSGVSAAGASVKHGDS

SEQ ID NO: 60758 - protein, 155 aa, Sorghum bicolor
  Clone ID: 9297386.pep
TRLKEELESALASLTSQLGEKDEVLLSFDEHKTELIHLKGQLLGMEKTHSLMQDSLTQSEEIQRDLNCKNRSLQSQVSILENQLGTVVEAMLSSEIEASYMRSQVREAVVQLNMLRNEFEKLQLKSKEADELLRAHMSTEAELADRNSTLEAAIH

SEQ ID NO: 60759 - protein, 163 aa, Sorghum bicolor
  unsure (1)..(163): unsure at all Xaa locations
  Clone ID: 9297390.pep
MPTPGLLYVTMQPQGALPEAQFHDWYNTEHGPLRLRLPFITNGFRFRTTDGEKPEYVALYDITDMAELTRKTYLDLRTDLIKTEREKATMAQIDVGRLLYDLVYEQSSSNFRPLETQADTDPETRGSVLVAVTTTTHPDPESQAEYDRWCREEHXDMLSRVPG

SEQ ID NO: 60760 - protein, 167 aa, Sorghum bicolor
  Clone ID: 9297395.pep
HEGHGCAASLCAMAALLAGAVWLVLATTSVAAHMAAAVMLGFLWMQSGFLGHDSGHYVVMRTGPLNRAVQLVAGNCVAGISIGWWKRNHNAHHIACNSLDHDPDVQHMPLFAVSPRLFASLTSAFYRRAMRFDAAARLLVSYQHWTFYPVMCVARVNLFAQSLLLLL

SEQ ID NO: 60761 - protein, 167 aa, Sorghum bicolor
  Clone ID: 9297400.pep
RHKTNYFIEYFALDLIMQDGECRGVLAYNQEDGTLHRFLANHTVLATGGYGRAYFSCTSAHTCTGDGMAMVARAGLPNQDLEFVQFHPTGIYGAGCLITEGSRGEGGYLLNSEGERFMERYAPTAKDLASRDVVSRSMTLEIREGRGVGAEKDHIYLQLSHLPAEIL

SEQ ID NO: 60762 - protein, 185 aa, Sorghum bicolor
  Clone ID: 9297424.pep
HEAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYQAMMTVIFFWAAYKTNFFPKIFHVESLEKTAQDDFQKLASAVYLQVSTISQALIFV

SEQ ID NO: 60763 - protein, 136 aa, Sorghum bicolor
  Clone ID: 9297431.pep
MMYHAKNFSVPFAQQRAQNNEHASNIGGIGGPNVSNPANPVGSGKQRLRWTSDLHNRFVDAIAQLGGPDRATPKGVLTVMGVPGITIYHVKSHLQKYRLAKYIPESPAEGSKDEKKDSSDSLSNTDSAPGLQINEA

SEQ ID NO: 60764 - protein, 154 aa, Sorghum bicolor
  unsure (1)..(154): unsure at all Xaa locations
  Clone ID: 9297442.pep
QLIATLMXVYADWAFTSIKGIGWGWAGIVWLYNIIFYFPLDIIKFLIRYALSGKAWDLVIEQRIAFTRKKDFGREERELKWAHAQRTLHGLQAPDAKMFPEKAGYNELNQMAEEAKRRAEIARLRELHTLKGHVESVVKLKGLDIETIQQSYTV

SEQ ID NO: 60765 - protein, 123 aa, Sorghum bicolor
  Clone ID: 9297457.pep
IRDEQRSAESNLWLLPTPKVFGNTTLVVSRSHNRSYSAKNMTQFLRDIGFEQGVEPYRARIRPLVEALPEPGVPLTCLVGTGVVTVESLVYGDGGFDEDPEEVVYGDGDGTVNLASLVGPIKA

SEQ ID NO: 60766 - protein, 123 aa, Sorghum bicolor
  Clone ID: 9297458.pep
VDDKVGSPWHTILFAREAEKKADAASRIIAALETLEGAFRDCSGGRYVDYFGGDGVGFVDVVLGSYLGWFKVFEKMVGVRVLDAARTPLLAAWGERFAAAEAAKDVLPDDVDKVLEFLQQFLD

SEQ ID NO: 60767 - protein, 131 aa, Sorghum bicolor
  Clone ID: 9297459.pep
GDMVVNAMMAATVAHASTAAAAPADQKKKTPPAPPPTVYHATSSLRNPAPYAVLYRTGIRYFSEHPRVGKDGRAVRTRKVHFFGTVAGFTAYMVLRYRLPLELLRLLSLLCCGLLFSRLYAELDRKYRFVM

SEQ ID NO: 60768 - protein, 85 aa, Sorghum bicolor
  Clone ID: 9297468.pep
RRSCTSPYTSEWDILEEIITIVTSRQLITQNTSTHLHHWLSKKWLQEFVFQGHNTSLQELASRSQDMINGISQLAYDMINGISHC

SEQ ID NO: 60769 - protein, 140 aa, Sorghum bicolor
  Clone ID: 9297470.pep
KEEIERMLSDAEKYKEEDEAEGRRVSAKNGLESYAYSLRNTLNDPKVDEKIEAGDKETLKTEIDKIVQWLDENQQATREEYEEHQKELEGVANPIMMKFYGAGGEGGMPGGMPGGPGGFPGAGGAPHAGGDDGPTVEEVD

SEQ ID NO: 60770 - protein, 98 aa, Sorghum bicolor
  Clone ID: 9297471.pep
TNLSRCSKCFGPCFFKNLNAAARMRGWCSSDRSRMLATLTCTRSSCVLTNKWPIFLLATSRRLNCSNRSCLTNNSKTSCKVTSSPNICSRSTPAPPWI

SEQ ID NO: 60771 - protein, 41 aa, Sorghum bicolor
  Clone ID: 9297481.pep
HTVMSSLLQNQRHELMNSIEQNKDLTQKLAEQSLKAEEFKN

SEQ ID NO: 60772 - protein, 201 aa, Sorghum bicolor
  Clone ID: 9297484.pep
ADLLEALRVPPKAARLIGVSLGGVTVLNTSLLYPERVAAFIACDTNSSAPESNRKAWADRVAMSEQEGSTNPETNEPIVGEELAEATTRRWFVPESYETQPEVLAPVKEAVRTNSLKGFAHSVNALCAYDIRDRMASATVPGLFVAGANDGVLPQTMQKMAADLKGGAELKTIDKAGHLPMVEQPEAFADVVTDFLGKIDG

SEQ ID NO: 60773 - protein, 127 aa, Sorghum bicolor
  Clone ID: 9297490.pep
MTTKNKVAALLLCFLVLAAIVSAEIIDANGVDDDDGGDEEQLDKGGSGGHHNHKGHNKDGKGNLKPSQCGGECKRRCSKTHHKKPCLFFCNKCCAKCLCVPPGTYGNKDTCPCYNNWKTKRGGPKCP

SEQ ID NO: 60774 - protein, 189 aa, Sorghum bicolor
  Clone ID: 9297491.pep
HVERKNQNSRKKKKAEDNARLRKLLDDASAGDERIKRFRQEANAAKNKKKFEKEAAEKKAAEEAAAKKAAEEKAKADAEAAAKADREAGKKAKEAAKNALKKNKRVLKGSVKDANYFAAGGDASAAQIDAVLGDVELVQGKIEADEIAALAGKLNGLTVADEIKGVWSAEVKRLVDAGKLKEGDAKTLA

SEQ ID NO: 60775 - protein, 75 aa, Sorghum bicolor
  Clone ID: 9297498.pep
CSPTGICSKQISPSSCNFIASHQCVVVLGTLHAPTTLQDRLHRPTGDLWGDNVDPCALSVSQLKGAMTNEVFRIT

SEQ ID NO: 60776 - protein, 140 aa, Sorghum bicolor
  Clone ID: 9297502.pep
TAEIRLAMQKAMQTDVSVFRTQESLDEGVRKMTEIDAMYSQVGMKDRSMIWNSDLVETLELRNLLTCAIQTATSAANRKESRGAHAREDFPERDDENWMKHTLSFQKEPHGKVDLAYRKVIANTLDEAECKPVPPFKRVY

SEQ ID NO: 60777 - protein, 164 aa, Sorghum bicolor
  Clone ID: 9297503.pep
SSNQCSGPKPYCVNGYCHDYSCLDNACRNVDIPYCNLATPCPVNSVCENTAGSYCVGSVGGQCTSDGDCNPAYSCDNCICSYTAPDALQDVLVPNCGIAQTINCGSTVSFAMQESITTTSGLTCPTSVMNVGYPVAFIRVIGAFLTQNVTLSFSTQFNTTAPVA

SEQ ID NO: 60778 - protein, 72 aa, Sorghum bicolor
  Clone ID: 9297509.pep
TIERYQLGFLISALGCNLSNLLVFTPMTVEMMMKRHKMEKDLGIGTEVGYSKNAETAKRSPTLAAMNRKFGM

SEQ ID NO: 60779 - protein, 115 aa, Sorghum bicolor
  Clone ID: 9297522.pep
ARGPFQFSASSAHARRSFRTEPALPSASLPPSNRLPLPLSSPHSSPSRAPPPGSSGPGRSAALRRPGWRKRSTSRGSSSSAGSHAWGSLRTWSGATSPATGTWWKRWSWRTRTGS

SEQ ID NO: 60780 - protein, 83 aa, Sorghum bicolor
  Clone ID: 9297530.pep
ALSTRGAAGSRAGGVPVTSGYITPHHPPLAAEQGKAKAGCLPILARLRGGGSARESCAVRRSRNSSSMRTRRGPENGEIIRER

SEQ ID NO: 60781 - protein, 166 aa, Sorghum bicolor
  Clone ID: 9297538.pep
QGRSWAPCCHGRSSSLRSPNPHNPLSQPGAPYPDPSNPRRICQGGPRLPPLDRGLLPLQGDWGGENSSPPSPSTWGDLTLRSTSTTTGRATRMAAWRCLHLALHSPNCDCERPCADNCQQSQHAPSQKQPSGADVASSQNVVCKISKSMVRDVEKAGIELLAGVLS

SEQ ID NO: 60782 - protein, 63 aa, Sorghum bicolor
  Clone ID: 9297543.pep
SPSLRAPCVPCMVRSRLLILQLPSITPNGTRPPLSLHAVRLPSRSLRKTVIQATAFNIGVIFL

SEQ ID NO: 60783 - protein, 97 aa, Sorghum bicolor
  unsure (1)..(97): unsure at all Xaa locations
  Clone ID: 9297566.pep
EDHHGEVVAVKDLFDXEAEKEFKVEVEAIGKVRHKHLVGLIGYCAEGPKRMLLYEFVENGNLEQWLQGDVGPVSPLTWETRMNIAVGTAKGSITFGK

SEQ ID NO: 60784 - protein, 149 aa, Sorghum bicolor
  Clone ID: 9297572.pep
DDGTKSFAIINQKGIDPLSLDVLAKNGILALRRAKRRNMERLQLICGGIAQNSVDDLTPDVLGWAGLVYEQTLGEEKYTFVEEVKDPKSVTVLIKGPNQHTIAQVTDAVRDGLRSVYNMIVDKSVVPGAGAFQVACAAHLKSDAFSKTV

SEQ ID NO: 60785 - protein, 128 aa, Sorghum bicolor
  Clone ID: 9297573.pep
MTTATTTKPAAERSGRRYALLLALWDSEYAKEVYGGYYTVFVSAFGDGASGGTDERWDSFRVIAGEFPAPEDLASYDGFVVSGSPHDAHGDEPWIRRLCALVQTVHAMRKRVLGVCFGHQVLCRALGG

SEQ ID NO: 60786 - protein, 115 aa, Sorghum bicolor
  Clone ID: 9297579.pep
MDMGSGPALQYLLCLAWVAATLPIAAAALPIPTAAGGRFIHGLLCAFSSRGKTVRPSVSSSSKTRFTVPQKFFLHFYVVGAVVTTSLLLAIWFYAYMKMTPLMPEPSSYSTIASH

SEQ ID NO: 60787 - protein, 138 aa, Sorghum bicolor
  Clone ID: 9297595.pep
CRWQFKCSTNWIEVAYNSARVCVANSSLALLLRRLQLACGLLLGRFARQNLIWIARVPLIQEIMTLEAVDYRVSSPVPFNLLFVCGGCRLHAFRDERSELECIQAFRDDVCADFLPVDHVVATTTKICTRGRSTRAHA

SEQ ID NO: 60788 - protein, 91 aa, Sorghum bicolor
  Clone ID: 9297613.pep
AAASDGAAGHLRRRRRLPHRRQSRLRTISSAPEKTLAERRPERAVRPAGLRDRPACLLADAPPDGLLAGEAVDEVVEDVDGVLRVSLDAQR

SEQ ID NO: 60789 - protein, 189 aa, Sorghum bicolor
  unsure (1)..(189): unsure at all Xaa locations
  Clone ID: 9297616.pep
RLCPPLRLPPVHGVQQRGGHIPQDLRXFPPLRYLIYTATYLSLHHREKDCNFCLFMPLFDALGGTISSKSWELQKQVDQGMNXRVPDFVFLAHVVDVVSSMHVPFAFRSCSSLPWSTHLVLLPLWPLAFGFMLLQWFFSKTFTVTFYFLRGRLHQTWSVPRYGFQYFIPSAKKGINRQIELAILRADKM

SEQ ID NO: 60790 - protein, 41 aa, Sorghum bicolor
  Clone ID: 9297629.pep
RRRSPRSGRSSSRRSPCLASSLNQLCSCTVRACGVSVCASC

SEQ ID NO: 60791 - protein, 165 aa, Sorghum bicolor
  Clone ID: 9297647.pep
MSGSEPFPLLNTANDQLHQRRPADQADSYVSSSNTTATQDAINNARRRRKSSLLGGEIRGDTGAPALASSRASLEASDNHSNGHSGGRKRLSKRRRARGLIGRARQTMIKHTFVLPAVLLAFFLVGYAINPTESNPIHHFIFLSYKLPQDDPNEPAQYGKGRWDI

SEQ ID NO: 60792 - protein, 36 aa, Sorghum bicolor
  Clone ID: 9297657.pep
LSTNQRLLLLGRVLLLYTQMLGQLVLVYAMTYLSNN

SEQ ID NO: 60793 - protein, 91 aa, Sorghum bicolor
  Clone ID: 9297665.pep
DHGGSGMGWDGMGWEMDGNGVQLGVVGPHCRFCIKYAGVPRESELNGLIICCIVLQWQVAELDNRQPYIHMRVHARTCWACCVNIGSQEGF

SEQ ID NO: 60794 - protein, 118 aa, Sorghum bicolor
  Clone ID: 9297680.pep
MVGLFAACTAVAAAVEEEVREGAQERWDACVARVKEAVANGTLSVAGSPRFRVYDLDFGFGPPAKVDMVSVAKTGAISVADARPGGGGGVEVGISLPAATGDMDRFRQTVAQGMAWLL

SEQ ID NO: 60795 - protein, 102 aa, Sorghum bicolor
  Clone ID: 9297695.pep
GRPAPPAGGAVVVVAVGRGARARPRPAPRLLPVLLPGPVVPAGQTPVIELSPSLAGGITSFLQCCSIARAAPEMGKNHQLASSRMLLLAEQWRRCDFDKHTC

SEQ ID NO: 60796 - protein, 65 aa, Sorghum bicolor
  Clone ID: 9297708.pep
GQGYGQGGGSGYGSGYGEGSGSGSGSGNGVVGIGSGQGYGHGSNSGGNLEVINVSCCILQCILFY

SEQ ID NO: 60797 - protein, 161 aa, Sorghum bicolor
  Clone ID: 9297713.pep
MEEEPPASDLAARGDLRSALPFLPVVLRGGALFWPPAAQESLRALALGPDVSRVASGDVLADALTDLRLALALPALPQRAADGLALFFDDLLSRAQARGWFAEVVPNLARLLLRLPTLLEDHYAKAGHGASGLRVLASQDAGLVLLSQELVAALLTCALFC

SEQ ID NO: 60798 - protein, 178 aa, Sorghum bicolor
  Clone ID: 9297733.pep
ARGPIEVSEAISQDTVPFGYGYMRFLDVSLAAETCEELFTANAPRIDLALNGVEVFMNASGSHHQLRKLNLRIDCIRNATQTCGGVYMYANHQGCDGGRLYYDGCCCIAVNGDLIAQGSQFSLKDVEVLDALVDLDAVSSYRASVSSFREQASHRKNVPFAKVPYKLCQSFESGMIAT

SEQ ID NO: 60799 - protein, 176 aa, Sorghum bicolor
  Clone ID: 9297741.pep
MQTMHAVASRCSNCGSYGHGSIACRIATADHQRGSEAATMRCGRGGAAAAAGLRLFGVQLHAASTCSGGAAAPTTPTAPSLQLHRSYSVDCGCLSLQGGWPLPVALSPSSGCDGCYLSDDGGRGSAALRERERKKGVPWSEEEHRLFLVGLEKLGRGDWRGISRGFVTTRTPTQVA

SEQ ID NO: 60800 - protein, 175 aa, Sorghum bicolor
  Clone ID: 9297745.pep
ARGTTGSPNWNFDGPRVSASLPEPCTQSQLRDLESLSEAFRYAALLYTERLVSPSLPSGHQSIQSLVSQVVYYATNLDTGSSAEKFLLWPLFVAGCECVNELQQNMVRSKCRDIMFRSGYMNNLAALEVLEKLWAQDSAGGEPLMLGTRTGDQRGPFNWTKCIGGPGVEVEWIMF

SEQ ID NO: 60801 - protein, 110 aa, Sorghum bicolor
  Clone ID: 9297765.pep
TRQHYIFTHNIVSFTLYKPFLSNLLIIRPQPIHHGRLAQQLWRPSSCKALSYQSSQHIKDPRPHKSKPLRPRHSKASVPAQRRQPVPRDRVSLHDFELRRSALSALWTTG

SEQ ID NO: 60802 - protein, 91 aa, Sorghum bicolor
  Clone ID: 9297786.pep
EWKQTRRARRLQHVRLQGRRKLELSVSQGISFRDGRGAASTWTVPLLPAEPGAWHVPIIVVVVDDAVHWNLACVRATYTAHRRSTNRKIEE

SEQ ID NO: 60803 - protein, 75 aa, Sorghum bicolor
  Clone ID: 9297790.pep
GRGKETSTMQIYGQRNAPGFTNCTTEMFLCQVVTNRAFMFTSTKWKKKGALCRVFQILLDPLTCAPGDSNSESGP

SEQ ID NO: 60804 - protein, 76 aa, Sorghum bicolor
  Clone ID: 9297800.pep
NSYPDHTRKKIHTCCPLAHLFQHLFNDHMIYRCHMGEQNNGRSKVLILILPETCRWLWCRINYLLFCCSLGVVGLH

SEQ ID NO: 60805 - protein, 125 aa, Sorghum bicolor
  Clone ID: 9297804.pep
RPAKQSQSRKKRAQSFSFNQPLHLDLSFTDLGGSQALAQILSSSDDNTAPSTTPSSRSFAPLRVIYELDGSNPSFDVDTSQPPDLISDYDCVSDSELDDLPSQREFLDSAATPGSETWVVLGDDS

SEQ ID NO: 60806 - protein, 87 aa, Sorghum bicolor
  Clone ID: 9297809.pep
IKSMIQWIAASQALRPFVNYYTFEDASLERLEEVIQWILRHGWTVSELWHMLIEYSSQRLRGETYKGFFAWLLPSNRPNNEVHYMSE

SEQ ID NO: 60807 - protein, 157 aa, Sorghum bicolor
  Clone ID: 9297830.pep
ACGVASAASRIAVPCSRSAHTALSCCSASPATGPVGRKRYCTRRTTYSCPPSCRALMDANSSCASCTRRSHARTGSDDGAGSWPSTSARSRSRASTASASSLTRRSVLASGCHHLPKNSTSTAPPRTREPSTAASCSSIDLRRSDRPATSPRSFSAV

SEQ ID NO: 60808 - protein, 84 aa, Sorghum bicolor
  Clone ID: 9297838.pep
MSTMKFCRECNNILYPKEDREQKVLLYACRNCDHQEVADNNCVYRNVVHHSAGEFTQVLQDVAGDPTLPRTKSVRCASCGHGEA

SEQ ID NO: 60809 - protein, 136 aa, Sorghum bicolor
  Clone ID: 9297845.pep
MVAVFNKDVLSWYLITIKLREAVDANLQKSPPPPRERDLPLRITNGADASPPPPVQRQSEQDRPATRSRALSPAHSPKPQDSEWVIAIRGKLAQARAEEAACPWARLSVYRVPKCLRDGDERAYTPQVVSIGPLHH

SEQ ID NO: 60810 - protein, 149 aa, Sorghum bicolor
  Clone ID: 9297850.pep
RRPAPAPRPPPPPTLPSATLAPQVGGSQKLVRPRLVLFGDSITEQSFRPGGWGAALSDTYSRKADVVARGYGGYNTRWALFLIHHIFPLDGLAPPLATTIFFGANDAALLGRTSERQHVPVSEYKNNLKTIVNHLKVISLRYLLVNFSW

SEQ ID NO: 60811 - protein, 177 aa, Sorghum bicolor
  Clone ID: 9297857.pep
TPTPATAPPPPPPAPPPPPSTPTSSTSASTPPAPPAPAPSATSGRARPPTLQRGRPPEPRGRTSPPAPSRRGPTSLPPPRRRRPPWRGPDPGQPPWSVTSLAGAGPPPRPPLGSASRRPTTPASSATSSAPRSAPPAPSPTRRSDPPPRRRYPGQPVRTPMPTPAALPSRWAAWRAR

SEQ ID NO: 60812 - protein, 144 aa, Sorghum bicolor
  Clone ID: 9297862.pep
MAVSTRRRHSSSRMVAVPAPVVLGVAMVVVVLASSATGASGQLRMGFYAESCPGVERMVGDFVRQHVRRVPTVAAALLRLHFHDCFVRGCDASVLLNSTAGSVAEKDAPPNLTLRGFDFVDRVKTLVEEACPGVVSCADVLALA

SEQ ID NO: 60813 - protein, 148 aa, Sorghum bicolor
  Clone ID: 9297864.pep
MEHLPLTSPATAAASLSPSQGAGKVLDAYKTALATAASAAAYAVMARSMARELLPDELRAAARWCAAAARARFGRGDKERHTVVIRHQFDAGYSENHLFDAARAYLATRIDPRAMRRLCLARSRTKEPDGSGRWNTLLCMEPGGSTVD

SEQ ID NO: 60814 - protein, 149 aa, Sorghum bicolor
  Clone ID: 9297873.pep
PRMWLPNQDAPGLAMARAFGDFCLKNHGLICTPEVYCRKLSEKDEFLVLATDGIWDVLSNKEVVKLVSSATDPSRAARQLIDRAVRAWRRKYPTSMVDDCAVVCLYLNRRASPGPGPDESLRVPGTGDDVNPFTGSSFRRALTSNGGGG

SEQ ID NO: 60815 - protein, 159 aa, Sorghum bicolor
  Clone ID: 9297882.pep
MAMEMEGRRRRRLLVCLVMMISAQTMLAAVAAGGVQQKVKRRPAAMYVFGDSTLDVGNNNYLPGADVPRANKPYYGVDFPGFPTGRFSNGGNTADFVAKSMGFVSSPPPYLSLVANSSLVLVPTALTTGVSYASANAGILDSTNAGKCIPLSTQVQYFS

SEQ ID NO: 60816 - protein, 174 aa, Sorghum bicolor
  unsure (1)..(174): unsure at all Xaa locations
  Clone ID: 9297892.pep
ELFLDPPPPGQYQQPPPPPPGQYGAPPGPPPGHYGSPTPQGQYGAPPPGQYGAPPPPPGQYGAPQPSSYGGPPTQPSLGYAQQTANIDMTSDVEAIRKAMKGFGTDEKALINILAKKDPIQIGTIRAQYDQRLMRNLIQDLEKETSGYFERGLIEIARGPLVADCYNLMEAXQG

SEQ ID NO: 60817 - protein, 184 aa, Sorghum bicolor
  Clone ID: 9297918.pep
PGWRVAWVIGPKEFIQAIGSCGSYLDGGCNVPFQEAAVEMLSPPRVRNEMRALQMHFRTKRDYVIGRLQEIGFKFPYMPNSTFYLWLDLSNLPEGINDGLNFFQACLEEKVIVVPGIFFDLNPSRRRDLFDSPCHHFVRLSYGPRMDVLEKGLDSIARIVQKYKDEPQKHRAVSHRPRGTGAPN

SEQ ID NO: 60818 - protein, 131 aa, Sorghum bicolor
  Clone ID: 9297919.pep
RLYGYPGAGAGNDTTDPSLDATYAANLRRRKCRAASGGYAEDAVVEMDPGSHLTFDLGYYRALLKHRGLLRSDAALLTDAAARADVESVVGGAEEVYFQVFARSMARLATVQVKTGAEGEIRRNCAVVNGG

SEQ ID NO: 60819 - protein, 154 aa, Sorghum bicolor
  Clone ID: 9297924.pep
WVDVEADFGAGDSGGTTTELDGLPPPPSGLTVSAAKAKGMDTYKGGQYADAIKWLSWAVVLIEKSGKDADIVEVLSSRASSYKEVGEYKKAIADCSKVLDQDKENVSVLVQRALLYESTEKYRLGAEDLRLVLKIDPTHRLARSTIHRLNKLAD

SEQ ID NO: 60820 - protein, 127 aa, Sorghum bicolor
  Clone ID: 9297929.pep
GGRKQDKQATRMQEHVGCMHGGPADIWSNLCMREREREEEDLYIDHWVRMVLYKHEIEGVGSYTCCCMGRAWPGASPCMHASSCSTASQPGRPIHTAWRWRCGSRITAAYASRRPVIRWNGRMMRTV

SEQ ID NO: 60821 - protein, 78 aa, Sorghum bicolor
  Clone ID: 9297934.pep
RWPQDKEIVPKTVNDVKLINAGRILENSKTLAESRVPVGEVPGSVITMHVVVRPPQSNKSEKQQSNSPKPNRCGCTIL

SEQ ID NO: 60822 - protein, 199 aa, Sorghum bicolor
  Clone ID: 9297937.pep
FGSDLDNPINRAAPTFAAKVDAQGLLNSLAAEGKITYTVVYTGAFLDWGLRIGFPLDPRNKKATLHDGGERLYTTTTLGGVGKAVVGVLNHPEETKNRVLRVGEAVTTIKELLALSQEVVGREGWTITEPDTAEEAEKALVKIKQGVFTLDTLMPFVYRAIWGKDTGGHFTTTDNELLGLAVLDKAGLKRLIQDIVGGK

SEQ ID NO: 60823 - protein, 149 aa, Sorghum bicolor
  Clone ID: 9297941.pep
ISLNLLCYQIFTVTTMQDCSNSMVIVLITPPPVDEEGRERFARSLYGQDARKLPERTNEMAGVYAGYCVELAREMHIPCINIWSKMQETEGWQKLYLSDGLHLTPEGNAVVHKEVVETLRNAGLKAEHMPYDFPHHSKIDGSCPEKAFQ

SEQ ID NO: 60824 - protein, 106 aa, Sorghum bicolor
  Clone ID: 9297952.pep
MGARKFAIINVGLVGCVPTVRVLDAAGACADGLNQLAAGFDDELGPLLAGLAARLPGLVYSLADSFRLTQDTFADPGASGYSDIAGACCGSGRLLAEADCLPNSTV

SEQ ID NO: 60825 - protein, 147 aa, Sorghum bicolor
  Clone ID: 9297959.pep
QSVTDLQGGIGGFAGKNAVQVCQILTSKNDAQLRAMAQSYQQRFNKPLDSVLKSTFSGHMEDVLRLLVRRAVNRPEAEAVRLEESMAGLGTKDELLVQRVVRCHWDRNFMNAVSAAYKQIYKKDLVKRIEGETRGDYERLMVACVKP

SEQ ID NO: 60826 - protein, 167 aa, Sorghum bicolor
  Clone ID: 9297965.pep
TRVKCAKLGNTKSTDQVLNEVRVLSQVNHRSLVRLLGCCVDLEQPLMVYEFIPNGTLADHLYGSMNRPPLRWHQRLAIARQTAEGIAYLHFAASPPIYHRDIKSSNILLDDRLDGKVSDFGLSRLAEPGLSHVSTCAQGTLGYLDPEYYRNYQLTDKSDVYSFGVVL

SEQ ID NO: 60827 - protein, 158 aa, Sorghum bicolor
  Clone ID: 9297976.pep
TLKTHTHTSIYPKHSSTMPSSLDQLKAAGTTVVADSGDFATIKKYQPQDATTNPSLILAASKKPEYAKLIDAAVAYGKKNGTDLENQVDVTLDNLLVQFGKEILQIVPGKVSTEVDARFSFSTEQSVNKALRIIDLYKEAGIDKDRVLIKLASTWEGI

SEQ ID NO: 60828 - protein, 154 aa, Sorghum bicolor
  Clone ID: 9298011.pep
ARGSAAEAASPLTRQNSSFDNYGVGMERMESCQSQADALFVPDMSPASVNMYSAGKQYTSEQDLFGLGANLTAANVQQYVDSNGNTLMASPESTDMERSCSNASMSSVRSNASNLERRAKEARERVLQAAKTIQLAPKPKEELAKEASAAAANR

SEQ ID NO: 60829 - protein, 164 aa, Sorghum bicolor
  Clone ID: 9298031.pep
SQVQAIAAAEAGAYLISPFVGRILDWYKAATKKEYSKEEDPGVKSVQQIFNYYKKHGYKTIVMGASFRSVGEVTELAGCDYLTIAPNLLEQLYNSQDEVPKKLIAEDAANLNIEKKSYINDEAEFRFYFNEDQMAVEKLREGISKFAADAVTLKDILREKIQQA

SEQ ID NO: 60830 - protein, 70 aa, Sorghum bicolor
  Clone ID: 9298046.pep
TFLYLHIMFFYDDKTSIVAHAVSGLYMHGAAVMLGYSELLLLKVFSSLIMLKHCSCSWSRFWSIVRLSSV

SEQ ID NO: 60831 - protein, 35 aa, Sorghum bicolor
  Clone ID: 9298055.pep
EDLLDGAGHVLGHGPEPHGLGDLNDILEADVAAVL

SEQ ID NO: 60832 - protein, 146 aa, Sorghum bicolor
  Clone ID: 9298066.pep
LSAIEEDPWENLTETYDLFVKKLNLKPTLPELELVRRTAELIGTRAALLSACGVAAICKKKGYESCHVGADGSVFNKYPYFKERGAQALREILDWPEKTDKKAEDPIEVLTAEDGSGVGAALIAALTLKRINEGNMAGILHPENFK

SEQ ID NO: 60833 - protein, 103 aa, Sorghum bicolor
  unsure (1)..(103): unsure at all Xaa locations
  Clone ID: 9298081.pep
IYAIGAGITAAAGTRLALQWILGKXLDCTHSNYQTLTRPXIVIYCHYLPVSRLGNLRRHTEESQKRQQSYYAYVLPPFLCKIPIPAALIYIIITHWNSKEQKT

SEQ ID NO: 60834 - protein, 140 aa, Sorghum bicolor
  Clone ID: 9298082.pep
AVRSLYVYSQRDRKCFIARLRYITGPGRYLEGIFPGEEKEESVAFYYYLFSSHPVHEMRMKGVAGDIRAYGVFLLFCACSDGRYGLKSSPFFVCFVLVRAKSIRVGFGVWGYSGVLESERHAGKCAGLVSFGWKSTERMG

SEQ ID NO: 60835 - protein, 195 aa, Sorghum bicolor
  Clone ID: 9298106.pep
ARGFDEDFEAELSENHEARFEVSMLAQSPDREFTEVFINTELYARVSVAVLFHQLWKQIKEKSILETAEALECGKLFLLELLDSAVNNKDLSKELYKKYSSVHRRKVRVWQMICVLSHYVEDDIVGEVTSSIHICLYRNNLPAVRQYLETCAVLLYLKFPTLAEEQLIPIFHDKGMRQQALSSYVFIAANVILHS

SEQ ID NO: 60836 - protein, 152 aa, Sorghum bicolor
  Clone ID: 9298174.pep
TEWRTKYDERVHGHISDKKSWSGMEGYSKVNAMEWFIRKGDAVSENEPYITSFVWTGLVAHGRIRKMRMTIYCDQSSEEAPIDRNANVQVLAHVEADVSHIPEHLLNRRQGKDGQMYYELSCKIEAVYLSASTTYTLLYNNQRYDTVTCEYV

SEQ ID NO: 60837 - protein, 106 aa, Sorghum bicolor
  Clone ID: 9298216.pep
MTSSRSNSRSRSRSRSRSRSRSRSPRRRDRLRSERAPRRSRSRSRSRSPHRRRERRGYRDLVCKNCRRPGHFAKECPSAPTCNNCNLPGHFAAECTSQTICWNCKE

SEQ ID NO: 60838 - protein, 152 aa, Sorghum bicolor
  Clone ID: 9298219.pep
HEGSFRLGGGAAPALDLASLPSLPRIKSGRNRTSLILAVAFSAFVALVVLAGAGAYGAYRYKNRDIIEPWELDYGPHRFKYAELRRATRGFRERELLGSGGFGKVYRGVLRGKSGETVAVKRVNHESRQGLREFVAEIASIGRLRHRNLVQL

SEQ ID NO: 60839 - protein, 63 aa, Sorghum bicolor
  Clone ID: 9298230.pep
MLHMFDSLMHHLLVHNPAFADVDAILTVECVQAVMLIIGYRSYLLKAYSYRSGLDMVPYSHMV

SEQ ID NO: 60840 - protein, 176 aa, Sorghum bicolor
  Clone ID: 9298239.pep
SPRIHPPSSKQQQPSAMAAAAFLSARAAPALLSPLRSRRLYRRLVASSSSAGGQGGGGGVEFQGKVGFLGLGIMGAPMASNLISAGCDVTVWNRTKSKCDPLLSLGAKYEPSPAQVASSCDVTFAMQADPQSAAEVACGSSGAAEGLAPGKGYVDVSTVDGATSKLIAERITSTGR

SEQ ID NO: 60841 - protein, 103 aa, Sorghum bicolor
  Clone ID: 9298278.pep
TREQQRQTLNIFPSQPMHVAEPIPAKGVSMGMVTASMLPNGNSYSPKRQEQGGQHRSVAAPAGPVVPVPSNNLAKDNRNSLTKKEETSGGKGAASAGIVQERV

SEQ ID NO: 60842 - protein, 186 aa, Sorghum bicolor
  Clone ID: 9298287.pep
TRGKSLTSSSAGSADTDDVHNLPLSSRRETFSSDEYKPVGEPIKKYGVELQASGEAVYVDDIPVPKNCLYGEFIYSTQPLAYVKSIKFKSSLASEKIVSFVSAKDIPSGGQNIGSSFTFGDEPLFGYPIAEYAGQALGIVIAETQRYADMAAKQVIIEYDTEDLSPAIITVEQAVEKSSYFDVPPE

SEQ ID NO: 60843 - protein, 141 aa, Sorghum bicolor
  Clone ID: 9298288.pep
MASTGAQENAQVPASPQRRGGRGRGRSRGGNGGAEDGHDSFGGRGRGRGGFQSRGRGRGNRDGAGGRGGHAPEKGKAPAIEAEENGQAPPALAKPNLQQSDNEDDDAEVCFICASPVQHTAVAPCNHRTCHICSIRMRALY

SEQ ID NO: 60844 - protein, 140 aa, Sorghum bicolor
  Clone ID: 9298296.pep
MATTIITVTRKSQSFVVPSSSSAPVPTTAETLELSAIDRVPGLRHTVRSLHVFRRKADDDAAAAAAAASRRPAEVIRAALSRALVDYRPFAGRFVGSLYAGEACVECTDEGAWFVEAVADCSLDDVNGLDDYPLMVSEEE

SEQ ID NO: 60845 - protein, 205 aa, Sorghum bicolor
  Clone ID: 9298304.pep
RARQNRKPLADITSEGVLTQLMNVAQSDYNESGLGRLEPAGRPRASAPPIQVSCRSWGSEAERSEALFNAPIRKILYGPTFFEEKALVEKKLPVELWPTREMLPKPDHEKKGFTNISVPSMRRFVTDSGKLAKLDELLFKLKRRSTASTSNACNIKRKTLEPHRLTGRRRELFMYLLRYSFFFFSCCQAKEPSIGGVGSENADKP

SEQ ID NO: 60846 - protein, 121 aa, Sorghum bicolor
  unsure (1)..(121): unsure at all Xaa locations
  Clone ID: 9298314.pep
MGKSRFYLGDVGNGAAMKIVVNMVMGSMMVSFSEGLLLSEKVGLDPNTLVEVISQGAISAPMFSLKGPSMVKAAYPTAFPLKHQQKDMRLALALAESVSQSIPTVAAANELXKAAKSLGLS

SEQ ID NO: 60847 - protein, 105 aa, Sorghum bicolor
  Clone ID: 9298330.pep
DVAIAKVWQARTRAIKYNPDVKVHVCFFANTRHLLTRELPNDGGFYGNCFYPVTVTATAEGVASGGLHDVIRMIRDGKARLPLEFAKWSMGDVKVDPYQLTFKHN

SEQ ID NO: 60848 - protein, 96 aa, Sorghum bicolor
  Clone ID: 9298337.pep
PSRVASSTNVNKKPVGADAFPALPAAAKPTSTLFSPGYTGRALTRDNSGRNTPVSNPWAGPSGANSGTSTPALEDVGAAGKKKGNKGKKQTLFQWG

SEQ ID NO: 60849 - protein, 97 aa, Sorghum bicolor
  Clone ID: 9298346.pep
MEATQQNISDIVVAHDVAPATFMGHMSLAMNKVAAMESFVMQADGLRQQTLHKLHHILTTRQAARCLLAIADYFHRLRALSTLWVARPRQDDGPGLQ

SEQ ID NO: 60850 - protein, 105 aa, Sorghum bicolor
  Clone ID: 9298383.pep
VDCTNERACNNCRQPGHIARECKNDPVCNLCNVSGHVARVCPKTTLASEIQGGPFRDILCRICGQPGHISRNCIATIICDTCGGRGHMSYECPSARIFDRGLRRL

SEQ ID NO: 60851 - protein, 99 aa, Sorghum bicolor
  Clone ID: 9298393.pep
MGMRPGWVGGLVEESFFVGCAAHENRKKNEKNIFCLGCCASICPHCAPAHRHHLLIQVRRYVYNDVVRLDDLERLIDCSFVQPYTINSAKVVFLKPRPQ

SEQ ID NO: 60852 - protein, 120 aa, Sorghum bicolor
  Clone ID: 9298399.pep
HEDLPRVGGVQRRRGSPRLGGGVGGSPHLLSPVASRPRLRPPRTGRRSCQKGTTNSNMKSSKVKKEEADSDDDDDFTPISQKKSAGAAGSNAKTSKVKKLKDENLEDLKEVKKRKKRVGA

SEQ ID NO: 60853 - protein, 168 aa, Sorghum bicolor
  Clone ID: 9298404.pep
MFKKLKDKIKGDDSSTRPSYGTDDHNQNSNNPYYNSPQEQQHNIAPTEKYQAPPGPPPNQASSSSKSEYSAPPGPPPHHGSSSYTAPPGPPPKRESSGYAPPAGPPPSYPQQPPPSWDPPPYHDWTVIPDTSLLPPPPSMGYDSSPTANASTEEGDRALAWTNMNPLW

SEQ ID NO: 60854 - protein, 135 aa, Sorghum bicolor
  Clone ID: 9298410.pep
ARGKKEKERRSKKWTGLAHQAAHVRLPLIAWLRNSSIKSPPALLLSSSPPLVLHSSSLHGSVASPLSLQCPALLPSLSLSLCTAGCSAPLPHCSSSRSTAAAIPFQIEQTTVSRWRNRADGDEEMAESRGALARA

SEQ ID NO: 60855 - protein, 148 aa, Sorghum bicolor
  Clone ID: 9298411.pep
MVKAVVAGASGGIGQPLSLLLKSCQHVTELSLYDVVNTPGVAADLSHISTPAVVKGFLPADDGMQKAFTGADIVVIPAGIPRKPGMTRDDLFKINAGIVKGLVEGVAKYCPKAFLLIISNPVNSTVPIAAEVLKKANVFDPKKLFGVN

SEQ ID NO: 60856 - protein, 69 aa, Sorghum bicolor
  Clone ID: 9298460.pep
MHPGESSKRSVPSALGSGGCIDALPDGVLGHILGFLPAPEAVQTCVLARRWRHLWRTATGLRIGCCSSE

SEQ ID NO: 60857 - protein, 179 aa, Sorghum bicolor
  Clone ID: 9298484.pep
KLQGQLDVLDRRWEISRRRALASFKSGDKQAAYRYVRQSKLFSQSRSRCTQLLERIEEVISLIASAESNKKVYEAIQIGILAMKDNNVSIDEVSIHMKEVDELVAAQREVEAALESVPLQSLDGEGDIEEEFNKLEAELQDDIPHIHVQEPMAPSNKESPDEVVESLSHNMSRIRLEPI

SEQ ID NO: 60858 - protein, 129 aa, Sorghum bicolor
  Clone ID: 9298490.pep
MLLKGLSKAQSLVLISVPEKIIFESDLRWCPMFSNLKTLLLDDYWCTPDDFSALACILEHSPFLAKLTLELFSEGPKYEVEMKGRCNLMERSAKISENLNIVEVKCQVVDQRVLKVLKFLCTFNISFTF

SEQ ID NO: 60859 - protein, 182 aa, Sorghum bicolor
  Clone ID: 9298501.pep
MYSVFWDSPLNTQRSKTIYFELKVIGIGRGGISFSEADAGIAIGFVAPPYPTFRLPGWERASLGVHGDDGRKYVNDAWGGIDFTSAFKPGDTVGIGITFSVPRNPPSYEESQQGRMLDIDVFFTRNGVKEGGWDGNEELDVRSEGGNTGLRGESDLFPAIGVFGGVDFDVFFHPSQWLYRPY

SEQ ID NO: 60860 - protein, 182 aa, Sorghum bicolor
  Clone ID: 9298514.pep
TTLDVVRAETFVAEIVGEKNPGNLTIPVIGGHSGETIVPLFSQAKPSVQIPADKMDALVNRVQFGGDEVVKAKDGAGSATLSMAYAGYRFAEKVIKASKGEKGIVEPSFVYLPGVQGGDAISKATGTEFFSVPIELGPSGAEKAIDVVSSANEHEKKLLQACYSGLSGNISKGVQFVLEPPQ

SEQ ID NO: 60861 - protein, 120 aa, Sorghum bicolor
  Clone ID: 9298517.pep
ACMPWSNRPPRCIKYKIGSHPLYTLATDGRSTRPAPGDPPTTRSLCLPGLATPGPCCSQQQLAFGVAASLLSSLVKTLQQRGACMALVARKGHPSLSAQLQPTNQPALPYLSLTHSLLST

SEQ ID NO: 60862 - protein, 159 aa, Sorghum bicolor
  Clone ID: 9298575.pep
MSHYSSPGEKDLKHDLENDQPALNNIPSIAGEAQVHDDVFGDITDEGPNYRAVGWIGTVALMMKTQVGLGVLSIPAVFDVLGILPGIICLIVIAGITTWSDYMIGVFKRNHPQIYGIDDAGFLIFGRVGREIFGIAFCLFWIFVASSGMFGISIGLNAV

SEQ ID NO: 60863 - protein, 33 aa, Sorghum bicolor
  Clone ID: 9298626.pep
VKDNFIKLVLWWDNEWGYSNRVVDLILHMFKTQ

SEQ ID NO: 60864 - protein, 133 aa, Sorghum bicolor
  Clone ID: 9298647.pep
ELNREQSVKQQLPVLKTELDGLQQELIHVRTACGLEQKGNLELLEQRKAMEKNMLSMAQETEQMRGELAKFEVRPWGTGGTYGMLMGSPDVTFTKNPYEDSYNIHAGVSEKGPLHPPESGSWGTYDKNRLHYR

SEQ ID NO: 60865 - protein, 202 aa, Sorghum bicolor
  Clone ID: 9298654.pep
AIAAEMKRPEHYTRSLLICQAGVTLTYIVIGCVVYLYCGSYVASPALGSAGHLIKRIAYGISLPGLLATTVLVIHFAAKYVFVRLLRGTKHLSSNSAIHWGTWLACTIITTVIAYLIASGIPVFGGLVSLVGALLGTLMSFQLYGFMWLYDNWAKGKRDPNMKWYLMVAFSIFVIVSGTFLMIGGTYGSIVGIIDSYKASGG

SEQ ID NO: 60866 - protein, 43 aa, Sorghum bicolor
  Clone ID: 9298672.pep
KNTSSGGTEGNSNPPAHSAGVSVDERVSQNGVKKALVANAVKQ

SEQ ID NO: 60867 - protein, 163 aa, Sorghum bicolor
  Clone ID: 9298695.pep
MSSSSSASAVPPEDDVCSVCHDRFRIPCQANCSHWFCGECIIRVWHHGPAVHACKCPICRRLINLLVPAALSEQEDDPQAHRILGEIQHYNCIFGGAPRSLTQRLQDLPFFIRRLFRELMDPQRTLPLVFRARMMMMVSPIGSNYSFGSYSSSVLRWEVTKIR

SEQ ID NO: 60868 - protein, 40 aa, Sorghum bicolor
  Clone ID: 9298699.pep
VMSFPFDGGGCGTVAQLAVLLLMLPMCLKLDCWIRDRSSS

SEQ ID NO: 60869 - protein, 43 aa, Sorghum bicolor
  Clone ID: 9298704.pep
AEHDEARTPSLTTPGHGGLAVLLPHHAPLPTLLTPAVCAHPRQ

SEQ ID NO: 60870 - protein, 117 aa, Sorghum bicolor
  Clone ID: 9298709.pep
GEVKPREPIDDKVDVITLKSNTTNLETRSCSSAPSPRVGTASSVLNGKMYLFSGRGGVDMATIEEQGAVWCYDTPSSSWTKITPADPSAPIPPARSYHCSTSDGKETFFLHAGCPAK

SEQ ID NO: 60871 - protein, 76 aa, Sorghum bicolor
  Clone ID: 9298712.pep
TRLTPKRLPSLSSSPTPPAPASSSSQSQTPNPSLVINLRCALLPLLPPPSLPPLHSTTPRTSPYRSLLLMQTFPYC

SEQ ID NO: 60872 - protein, 96 aa, Sorghum bicolor
  Clone ID: 9298716.pep
KCILLYDYVRVCFEEWCGPSYSHSHIFVWFMEWNRFIHHHLMPCICKLIISTNITRDVLMGWFLKINTRSATPPPQLWQCPFLLWVSLRKHFKCWN

SEQ ID NO: 60873 - protein, 87 aa, Sorghum bicolor
  Clone ID: 9298737.pep
VNEEPGLPCLATDRSCSPAERGRDKATPFCFCPAPRLACLSSAGRPERRTREGRPAGVIVIVLVLLLHATQGQRSHSPHLSPCQPRR

SEQ ID NO: 60874 - protein, 165 aa, Sorghum bicolor
  Clone ID: 9298743.pep
MSGTPAASSSLQAALSYCVRQVRAYDYHHYLCLLHLPPAMRKAAFTFRAFNVETAKAMDVVSDPRTGLMRLLWWKDAVDKVFANKLVEHPVAQALSSVVADHKVSKHWLKRSVEARINDANHDEGTIPETSTELERYAEDTQSTILYMTLQAGGIQSTVADHAAS

SEQ ID NO: 60875 - protein, 45 aa, Sorghum bicolor
  Clone ID: 9298751.pep
ADGYIGPEARSVCALLPVRLAQKYKLLTLFGERDPSSLGPAGAGN

SEQ ID NO: 60876 - protein, 86 aa, Sorghum bicolor
  Clone ID: 9298764.pep
LRRDSLHAIINSLRDPNYGTLRALTLHLWRVMDNSHMNGINCHNLAVIFGPALMGPDPSTAIADAGWQIKAIDTILQNSLQIFDED

SEQ ID NO: 60877 - protein, 86 aa, Sorghum bicolor
  Clone ID: 9298777.pep
MTVDVASPLGAGGGYAAQQMASAVGKLADLVDFVDKADHLRQQTLRNMHKILTPRQAARGLLALADYGQRLRALSSLWAARPREPA

SEQ ID NO: 60878 - protein, 103 aa, Sorghum bicolor
  Clone ID: 9298783.pep
QPLGNAIVINTGDQIEVLSNGRYKSAWHRILATRDGNRRSIASFYNPARLASMAPAIPAADAGDDDYPSFVFGDYMEVYFKQKFEAKAPRFAAMAAAGATTTK

SEQ ID NO: 60879 - protein, 90 aa, Sorghum bicolor
  Clone ID: 9298789.pep
VRMDERLPDAVFKVASVAEAHLHKARELASSVPKKAIPVLLPAVPAQVLLDTLRRCEFNVFDSRLSRGVHGVSPLWYQLKLNWNAWRNKY

SEQ ID NO: 60880 - protein, 150 aa, Sorghum bicolor
  Clone ID: 9298791.pep
MEAALMQQAAAAAAARWRCVGDASLAGHGQQHLAGVVRLGVARRAASRAVRASSSTRLLAPVRALVSEAAGERAAEGEEEEGAAVRLFVGLPADAVVSDGRGVSRPRAVSAALRALKLLGVDGVELPVSWAVVQPGAGGWFEWAGYRAVA

SEQ ID NO: 60881 - protein, 183 aa, Sorghum bicolor
  Clone ID: 9298823.pep
LNLDCDHYINNSKAIREAMCFLMDPQVGRKVCYVQFPQRFDGIDAHDRYANRNTVFFDINMKGLDGIQGPVYVGTGCVFRRQALYGYNPPKGPKRPKMVTCDCCPCFGRKKRKHAKDGLPEGTADIGVDSDKEMLMSHMNFEKRFGQSAAFVTSTLMEEGGVPPSSSPAALLKEAIHVISCGY

SEQ ID NO: 60882 - protein, 165 aa, Sorghum bicolor
  Clone ID: 9298861.pep
LHGGYGPVAEMFARHGCAVIASGVEAQPDATAEDRLARLKAACAEHGARLAAESAPLAAARDGAGAAGGVWLSAGRTRPCQFTYQRMGAEFFSPAHWPLFVQFVRALECPEEAHEDDLPGSADGGARLTVPSAAAAAPAAKPRGRCRFRPCESQGRHLSRSILDV

SEQ ID NO: 60883 - protein, 66 aa, Sorghum bicolor
  Clone ID: 9298882.pep
ADNASRKRESNGSALHDARSKIPRMQSQHGGIRSAAGNALIPPQLRGRSNVVTEDMSKLFVAKRKE

SEQ ID NO: 60884 - protein, 96 aa, Sorghum bicolor
  unsure (1)..(96): unsure at all Xaa locations
  Clone ID: 9298914.pep
IYAIGAGITAAAGTRLALQWILVKXLDCTHSNYQTLTRPXIVIYCHYLPVSGLGNLRACCLXLDVVAVSQAPSPESNPNSPSPVTTMVGPYPTIES

SEQ ID NO: 60885 - protein, 194 aa, Sorghum bicolor
  unsure (1)..(194): unsure at all Xaa locations
  Clone ID: 9298930.pep
ARGSSGSVVVASNRRLLLVVAFALACLSASPSAVVSARRRPVRLRLYMHDIVGGPGQTAVRLVKGPGPENPSMHPGNYFGDTVAVDDLLTAGLAVDSAPVGRAQGTYMTGSMSRPVFVVAVTLLLTAGPYNGSTLVVAGRDDTSLPVRELAVVGGTGALRRAAGHVLWSTARVESALHAVLLLDVHAXVPAPSK

SEQ ID NO: 60886 - protein, 165 aa, Sorghum bicolor
  Clone ID: 9298938.pep
MPRVVVGGGKVATYKGGIKGYWKRRGYDRLDAAAAQPRPRLPTAELGGGGEGEGEAQPQPQRHRRRGWRVRRRRAGVLGRRLLRALSPLRLLARLRDAYVNAMLRLASSAAVVGYGASTGPYCTAAADPFNRPRPLTRDYDEKALVEIYRSILARGGEAGPVPVL

SEQ ID NO: 60887 - protein, 192 aa, Sorghum bicolor
  Clone ID: 9298942.pep
TRHEVIQFIDIFLKEVFRTVYASRELEVIRKRWPSGEFKWLEETPIIPFSEGIQMLRDDGRDVEEEDLSTPDEMRLGQLVREKYGTDYYVLDKFPANARPFYTAKDPEDPKWTRSFDIFIRGQEICSGGQRIHNVDELRANMAAAGMAEDGMEDYLTAFELGAPPHAGAGLGLERIVAWMLELGDVRYASLF

SEQ ID NO: 60888 - protein, 145 aa, Sorghum bicolor
  Clone ID: 9298952.pep
VSSNMDDLMRIAAADKRQELSIFSREVIRFGNRCKDPQWHNLDRYFSKLGSEITPQPELKEMAKADMQQLMTLVRHTGDLYHELHALDRFEQDYRRKLEEEKRSVTFERGDTVQIIRQELKSQRKHVNNLKKKCLWSKSLDDVME

SEQ ID NO: 60889 - protein, 203 aa, Sorghum bicolor
  Clone ID: 9298954.pep
VLLVGVYVDDLIITGAEEEEVNSFKAQMKERFDMSDLGLLCFYLGVEVRQDARGITLRQTHYAKRILELGEMVGCNPAHTPMEEKLRLSRESKAEEVDSTHYRRLVGSLRYLVHTRPDLAFAVGYVSRFMERPTVEHLQAVKRILRYVAGTLEYGLHYKRAPGTARFIGYCDSDLAGDIDTSKSTSGTMFFLGDCLVTWQSIK

SEQ ID NO: 60890 - protein, 110 aa, Sorghum bicolor
  Clone ID: 9298976.pep
PEDEVLRESNKIESVDWKRQYKLRHNWARGKCAVEEVSVRDAPDENGGQKRTLVKVVEGIAITADSESGLRAWDLRTRRPITQRNLQEENESDDNAPTSLAVDESGSEKS

SEQ ID NO: 60891 - protein, 194 aa, Sorghum bicolor
  Clone ID: 9298982.pep
TRRKRRATVFDAVQGKVTQDGLVHNLRAPKAATKPLRPDEVLFKRKNAPVRYQEDDYYPAHTKLPADQQLPSGDLATAIHSYVSHLYAQADNGSARSPWKCMRETALIAMSILMEETARSVLGETGDLAFTEAEQEDENQIRRRQNEWIMFAQQQQMKRSDEERRPASRTQQPTDSVNDSWMWSDESSTYTSDD

SEQ ID NO: 60892 - protein, 188 aa, Sorghum bicolor
  Clone ID: 9298983.pep
TRVYPEFQNRGSFQQRFGSYGVTDSEFDRANGHRQSNSIERQAPYSRIGVRGRGRTSYHGRGDTRGWHERFVYRWTESHRQVQNGGSETASHKLLAPGQQGTKRNWCRAESSDSPQQDNTKGRPETVDQPPGPECHGGCEAPSHEQHAPGQGAVKRGVCEAESSDLPMQDESSEITLQSADEPLSTTQ

SEQ ID NO: 60893 - protein, 195 aa, Sorghum bicolor
  Clone ID: 9299007.pep
FATQTKLEPRQKLQLARELGLQPRQVAIWFQNKRARWKSKQLEREYSALRDDYDALLCSYESLKKEKHALLKQLEKLAEMLHEPRGKYGGNADAGAGDDVRSGVGGMKEEFTDAAGAALYSSEGGGGGKFAHFTDDDVGALFRPSAQPTAAGFTSSSGPPEHQPFQFHSSSCWPSSTTEQTCSSSQWWEFESLSE

SEQ ID NO: 60894 - protein, 112 aa, Sorghum bicolor
  Clone ID: 9299089.pep
TRLQAEKVKKAKNMAFAFDIDGVLVHGDRLIPEGKKALEILNGDNELGIKIPHIFLTNGSGKIEKDRCAQLSKILGNPVETDQFIQSHTPMSALAEYYSTVLIIGGEGYRCR

SEQ ID NO: 60895 - protein, 200 aa, Sorghum bicolor
  Clone ID: 9299108.pep
LPLLHPHSLHTDAASSSSSSSSSSSDQACARTMAMELPLFLGDGPDGALFSSLWSSFPDDLQQPPQESVAELKQTLLATTLEPEAAREELKRKEQSIAKLADLVREVAKERDDARDQLQSLRLLAAQAAAAAAAAAPAPAPPLVTSSVTDSDCSLVSSPVDPFFDPVTSADRRCKLSPATPPAPATAAAAAASKQQCQPG

SEQ ID NO: 60896 - protein, 67 aa, Sorghum bicolor
  Clone ID: 9299114.pep
CRAIPLCCRQSITIARVGGSAARSTDADAGAQRPRLSTSVYLNSPLRFTRRSCERIVSSSSCLFSSC

SEQ ID NO: 60897 - protein, 33 aa, Sorghum bicolor
  Clone ID: 9299128.pep
AAWGFICTLMYGISGKDSAAAIIDKLAGQLNYN

SEQ ID NO: 60898 - protein, 180 aa, Sorghum bicolor
  Clone ID: 9299132.pep
TRVVRDKAVESLNKICEELSPQQVEEFFIPLTIRLAKADWFTSKVSGCGLFTAPYKKVSPPVQEQLRQQFGLLVHDETPMVRRQAASNLAKFVKEMPPAIVIEEMIPLFQHLVSDDQDSVRLLTVEILIAIAEGVPKEQQASHGVLLTSLRNLIEDKSWRVRYMIADRFEKIAKAVDEEV

SEQ ID NO: 60899 - protein, 215 aa, Sorghum bicolor
  Clone ID: 9299133.pep
GTSSWKLSGVHEPLSINVATFEKPLRKLTFAHLLEATDGFSAETLIGSGGFGEVYKAKLKDGTVVAIKKLIHFTGQGDREFTAEMETIGKIKHRNLVPLLGYCKIGDERLLVYEYMKHGSLDVVLHDQAKAGVKLDWAARKKIAIGSARGLAFLHHSCIPHIIHRDMKSSNVLLDSNLDARVSDFGMARLMNALDTHLSVSTLAGTPGYVPPEYY

SEQ ID NO: 60900 - protein, 147 aa, Sorghum bicolor
  Clone ID: 9299138.pep
TRATCRAAGIMVRMVTGDNINTAKAIARECGILTEDGIAIEGPEFREKSLDELLKLVPKIQVMARSSPLDKHTLVKHLRTTFNDVVAVTGDGTNDAPALHEADIGLAMGIAGTEVAKESADVIILDDNFSTIVTVAKWGRSVYINIQ

SEQ ID NO: 60901 - protein, 158 aa, Sorghum bicolor
  unsure (1)..(158): unsure at all Xaa locations
  Clone ID: 9299145.pep
KKESARLLDESSSAPLLDPPRRRAPPHPPRRPAPKSSSAPPPDPPXESAPLRPTPPPRALRHASGRAPVAARPSANSGGRSSDYDPPPAAXPAPPLPERPRRWSRPAPRTPVAPAVRASRRVTRANFGGRLSDCDPPVAALASRAAPAARCPHAPCPD

SEQ ID NO: 60902 - protein, 176 aa, Sorghum bicolor
  Clone ID: 9299165.pep
CAANPPTAAAGDALRVADLPGRGRGLVAARNVREGEVLLSEPPVLLYPSTLSSLASYCSACFRSLPAAATVPCASCRAAAFCSPACAAASHPRLLCAALSHGGGAGVAAAAPTEAIQEPLLFLLSAYSLPESTIHSILSLSSAPPPPPGAQDAAGLHAAVAALAPPHMLPQGFSPD

SEQ ID NO: 60903 - protein, 100 aa, Sorghum bicolor
  Clone ID: 9299187.pep
MINRDSRGHSYFIVRGEILGFMKDEQLRKHLPRMKFLVEEMGRDMGEVVDYPQFFRHGLKRSLEYRHKVLKQMNSSCSLSEMLDCNQKKFAMKFGLVAAV

SEQ ID NO: 60904 - protein, 78 aa, Sorghum bicolor
  Clone ID: 9299191.pep
TKWEKNLRLEWFSWPPELRPAEVYFQMHLLARQSAAAVSQQNQLVETMQSPELWLLRAIHLNPSCPRYWKALLQQIYV

SEQ ID NO: 60905 - protein, 61 aa, Sorghum bicolor
  Clone ID: 9299197.pep
IFSRMNLVAAKISHESGLATSKIQYRTEWTAPQAGKVKAAMVTQYCILSQIGWKIKMVKSP

SEQ ID NO: 60906 - protein, 78 aa, Sorghum bicolor
  Clone ID: 9299220.pep
VEEMPGRAVFAGSVVSAAVPLELYPAAGLRESCVYFARREVEMLAPHAICEYSMMDDEMRTVPIAGGHSADVEPVWIT

SEQ ID NO: 60907 - protein, 90 aa, Sorghum bicolor
  Clone ID: 9299226.pep
PSPSPAAAKGTRGGTPGHRGGGGGRRRSAHERLYEARRAEAEEMRRRTSLPYRQGLLLFGCIGLGNRSSYGAVHGLARGLNAAAAVSSRS

SEQ ID NO: 60908 - protein, 118 aa, Sorghum bicolor
  Clone ID: 9299228.pep
QLNHHGFVETFSLIIINRRRWIPPSLACGPTRRPSTRCCCQCCSLCRLAMNPGEQLAAGSMGVSGSMDIGRFMQALEASVTASAPAAATGAATYPARAAPRGSVSGARTVGGLRHRGS

SEQ ID NO: 60909 - protein, 181 aa, Sorghum bicolor
  Clone ID: 9299247.pep
NLCMGWLGDTVFSIREAATHNLRKLTEVFGVEWASEAIIPKVMTMGNHPNYLYRMTTCFAISTLASVVSIDVISKSILPMLDKMTEDDIPNIRFNVAKTYSVLINALQRLPEQGTLYTIEQQGAGAAPTTPSPRGQELIQQRIVPNLTKLQKDDDVDVRYYATQAVAEASGTGASGGGEPR

SEQ ID NO: 60910 - protein, 154 aa, Sorghum bicolor
  Clone ID: 9299248.pep
RLMNALDTHLSVSTLAGTPGYVPPEYYQSFRCTTKGDVYSYGVVLLELLSGKKPIDPTEFGDNNLVGWVKQMVKENRSSEIFDPTLTNTKSGEAELYQSLKIARECLDDRPNQRPTMIQVMAMFKELQLDSDSDFLDGFSINSSTIDESAEKSS

SEQ ID NO: 60911 - protein, 120 aa, Sorghum bicolor
  Clone ID: 9299253.pep
RCECDRCQVESQWKDDDDDNNGGDGDDTMEEEGEDDAGDRGDDGMEEEEGDGATDGNDDFPHAYFFVRYLCDNEGCWGMLAPLPPSPNGDLSHVFEGNLCGKLRKEEDAMPDEGTSGMVH

SEQ ID NO: 60912 - protein, 175 aa, Sorghum bicolor
  Clone ID: 9299269.pep
MVKLQLLTSALGLASLAASAAVPVTDAATTCKHPIKRLEWRQLSIPQRRNYIDAVLCLQKVESVSGIPYATNRFEDFLAIHNQLTDKIHFVAQFILWHRYMVAVYENTLRKECGYKGAQPYWDYTLDADPQNLNSTSIYATEIFDPHTGFGGNGNKVVPTPEENPLNINGTGGGC

SEQ ID NO: 60913 - protein, 107 aa, Sorghum bicolor
  Clone ID: 9299270.pep
DGGAEPTKWAAVAEYCRRHGVDRGPVQCRKRWSNLAGDYKKIREWERGYAARKEASFWAMRNDARRERRLPGFFDREVYDILKGRGADDGNAVAAALEDAEEGKEEE

SEQ ID NO: 60914 - protein, 188 aa, Sorghum bicolor
  Clone ID: 9299284.pep
MGNSQASPASASSSRFVMASRAFSKQELDGLRGLFTSLAAQSQTSGRAISRSVFLEYYGVRGPLGDRLFQLVAKESGGSDGVTFEDLIISKATYGRGTRDEVDEFIYQLCDVTGDGALTRSDLESVLASVHETVFAVKKEVVEGSNNRPFEAFLNSAVLSEDAEAVSEKSMSLSDFRNLCILLPSLRK

SEQ ID NO: 60915 - protein, 101 aa, Sorghum bicolor
  Clone ID: 9299307.pep
ASSTPPVDSSCAGPDHLHRLRRRRPSGYGGSPPPSTIPTPTAASLLLPHPSTGNLADPPSGLTDLADPASRLVDLPSSPARTLDPASTNGGTTAGRAWIQR

SEQ ID NO: 60916 - protein, 215 aa, Sorghum bicolor
  Clone ID: 9299327.pep
TRIVSESGEKAPNAVYRGRLDGGRLIAVKRFSRLSWPDPQQFLAEAAGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGKIPLVLTGYCYILYLPMPLLAPWCRSFELIISPISKSSMKLKALLS

SEQ ID NO: 60917 - protein, 96 aa, Sorghum bicolor; identical to SEQ ID NO: 60884
  unsure (1)..(96): unsure at all Xaa locations
  Clone ID: 9299341.pep

SEQ ID NO: 60918 - protein, 190 aa, Sorghum bicolor
  unsure (1)..(190): unsure at all Xaa locations
  Clone ID: 9299347.pep
ARGLSGLIGSFAYSHRNVFGRNKKLNLSLERGQIDSIFRLNFTDPWIDGDNKRTSRTVMVQNSRTPGTLVHGGDHPDHGPITIGRVTAGLEYSRPFRPKWSGTLGLIFQHAGARDDKGSPVIRDFYNSQLTASGHDYDDTLLAKFESVYTDSGDHSSTMFVFNIEQGLPVLPEWLSFNRVTARLRXGYEI

SEQ ID NO: 60919 - protein, 170 aa, Sorghum bicolor
  Clone ID: 9299415.pep
QFLVRLVSSYRYSGELVDDELARAEAAELHDAVVARKQPLHGDVVRIVSSRSKPQLKATFERYRQGHGKAIDEVLEEERRSDQLAAVLKTAVWCLTSPEKHFAEVIRSSIVGLGTDEESLTRAIVSRAEIDMKKVKEEYKARYRKTVTSDVNGDTSGYYNGILLTLVGPE

SEQ ID NO: 60920 - protein, 97 aa, Sorghum bicolor
  Clone ID: 9299422.pep
SVWQVDPSYLPEMPSEAEKYMKDGAGKGPGINGKGSHFDTDSGTATASVAMGSSTSTGSASASGDNDDDSGAASLGFGALYVSAAATLFTLAGTLLL

SEQ ID NO: 60921 - protein, 53 aa, Sorghum bicolor
  Clone ID: 9299428.pep
VPGDPAGARGKPGSGYGYGVGVRVDSPLGPLRLEYAFNDKQASRFHFGVGYRN

SEQ ID NO: 60922 - protein, 158 aa, Sorghum bicolor
  Clone ID: 9299432.pep
NLDQLNSLFAQNGLTQTDMIALSGAHTIGVTHCDKFVRRIYTFKQRLAWNPPMNLDFLRSLRRVCPINYSPTAFAMLDVTTPKVFDNAYFNNLRYNKGLLASDQVLFTDRRSRPTVNVFAANSTAFYEAFIAAMAKLGRIGVKTGGDGEIRRVCTAVN

SEQ ID NO: 60923 - protein, 178 aa, Sorghum bicolor
  Clone ID: 9299439.pep
ARGRALPAVGEPVAPRAGRLPGARPHGPRLRPRPAAGAGRGHGEPLPPAPRRARRAARRAPRGAGVPAVVRGSRAERRLVRAGRRRVDRGRREEGRQGGRGGRPAPDGVPGAGAPRRPVPGQELAGAGGARRAQPPRRPSPRGGPRWPPLALPQPRRRHRRGGPGHSRQLRGAGVPQP

SEQ ID NO: 60924 - protein, 175 aa, Sorghum bicolor
  Clone ID: 9299448.pep
MVGLLPETNAAAETDVLLDAWDFKGRPAPRATTGRWGAAAMILVAELNERLTTLGIAVNLVTYLTGTMHLGNAESANVVTNFMGTSFMLCLLGGFVADSFLGRYLTIAIFTAIQASGVTILTISTAAPGLRPAACSANAGDGECARASGAQLGVMYLALYLTALGTGGLKSSVSG

SEQ ID NO: 60925 - protein, 172 aa, Sorghum bicolor
  Clone ID: 9299450.pep
TRLGSKPEIFVLEDLTWRSTTELESDVVVEVGEMSFYLHKFPLLSRSGVLQRMISEYQPPAGGGGGGMCTLQLDDIPGGAKAFELAAKFCYDVKIELNALNVVCLRCAAEYLRMTDDYAEGNLITQAESFLADVLANWKDSIKALETCEGVLPTAEDLHLVSRCITALASRA

SEQ ID NO: 60926 - protein, 180 aa, Sorghum bicolor
  Clone ID: 9299470.pep
TRKLGLCSSISDKGIAFISSNCGKLVELDLYRCNSITDDGLAALVNGCKRIKLLNLCYCNKITDTGLGHLGSLEELTNLELRCLVRITGIGISSVAIGCKSLIELDLKRCYSVDDAGLWALARYALNLRQLTISYCQVTGLGLCHLLSSLRCLQDIKMVHLSWVSIEGFEMALRAACGRL

SEQ ID NO: 60927 - protein, 126 aa, Sorghum bicolor
  Clone ID: 9299477.pep
MSISVNGQSCVPPGFRFHPTEEELLNYYLRKKVASQEIDLDVIRDVDLNKLEPWDIQEKCKIGSGPQNDWYFFSHKDKKYPTGTRTNRATAAGFWKATGRDKAIYNAVKRIGMRKTLVFYKGRAPH

SEQ ID NO: 60928 - protein, 187 aa, Sorghum bicolor
  unsure (1)..(187): unsure at all Xaa locations
  Clone ID: 9299483.pep
HEGRPPDYWWFVKGTEGWTGLVMLVLMAVAFTLATPWFRRRRVALPGPVLRRLTGFNAFWYSHHCFVAVYALLVVHGQYLYLTHKWYKKSTWMYLAVPVALYACERLTRALRSSVRPVKILKVAVYPXNVLSLHFSKPXGFRYRSGQYIFVNCAAVSPFQWHPFSITSAPQDDYVSVHIRTLGDWTR

SEQ ID NO: 60929 - protein, 44 aa, Sorghum bicolor
  Clone ID: 9299500.pep
TRGGFVTGGIGADVWCAPGIPFAAEASSVDCVVARHQMVGRGGG

SEQ ID NO: 60930 - protein, 128 aa, Sorghum bicolor
  Clone ID: 9299502.pep
MEQLRTIGRELAMGSQGGWGQSKEFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTIQ

SEQ ID NO: 60931 - protein, 202 aa, Sorghum bicolor
  Clone ID: 9299522.pep
SGFGSDQFDESDRGEKHQMMRFFNWFFFFISLGSLLAVTVLVYVQDNLGRRWGYGACACAIAAGLVIFLAGTRRYRFKKLVGSPLTQIAAVVVAAWRKRRLPLPADPAMLYDIDVGKAAAVEEGSGKKSKRKERLPHTDQFRFLDHAAINEEPAAQPSKWRLSTLTDVEEVKTVVRMLPIWATTIMFWTVYAQMTTFSVSVT

SEQ ID NO: 60932 - protein, 170 aa, Sorghum bicolor
  Clone ID: 9299524.pep
IYLKSHPWLSESEREQLCRLLNCQKLSLEACTHAAQNERLPLRVVVQVLFFEQLRLRTSIAGWFFVSDNAAGGDGARPHSGGGIVPKGAAAIAGSAQAEADDSDVEGDAPEGKETMTDVKARVSELEKECKSMKQEIRRLGKPRRSWSLLPKKCGFGAKVQQAQTAMSGK

SEQ ID NO: 60933 - protein, 127 aa, Sorghum bicolor
  Clone ID: 9299549.pep
PPRRDWERDHGLGHDGPAGGVAPQRAGGARRRARRGPARQLLRRRHRRRRRGRRRPRLLLGRRQQAARRIRRLQRRRQRRRPVELHAVVGRGRGRNVDRAAQPRLTVDDARPAGRRRRLTMYVRRSS

SEQ ID NO: 60934 - protein, 129 aa, Sorghum bicolor
  Clone ID: 9299555.pep
LIRPSNSVSCWLIKLPNLSERDKICTMAFGLLILLLEQMNKKLLGFLTQLVCHNQAIPTLVSTSVPSTSIRIYATTSSDCGMYRTLCHAKTFGSIEATCKLEVLLVELELGVGFPREILRELAQLLCQH

SEQ ID NO: 60935 - protein, 125 aa, Sorghum bicolor
  Clone ID: 9299563.pep
IMMFQTRVLLGGMNMYDRYQDWRLDVDNMTYEELLELEDKIGYVNTGLREDEITRNLKKVKHPSFSSFRFATEMERKCSICQEEFEANEEMGRLDCGHSYHVYCIKQWLSQKNTCPVCKTAVSKN

SEQ ID NO: 60936 - protein, 84 aa, Sorghum bicolor
  Clone ID: 9299612.pep
MMARQQSVDVQACLSSVLAALLFAAACLPAPAAAGVHLCTLPEALAVTASAKPGQVLHAGVDSVTVTWSLKSTEPAGADAAYKD

SEQ ID NO: 60937 - protein, 156 aa, Sorghum bicolor
  Clone ID: 9299623.pep
GRRRRTAWRWSLADATSSWPERACGQGPRPRVAPSRISLVAHKKESSSSLVSHSSPPPRAATSASPSGGAAQPGGWRPHSSLPGQSPSCSDGGHRDKERIGVRNGNGVSKGSVVNSPTDCIKLRTSVALTMDVVSAFPQRYFFEARINTLNSSLLW

SEQ ID NO: 60938 - protein, 170 aa, Sorghum bicolor
  Clone ID: 9299627.pep
TRDSGATHHMSGRREIFSELDTTVRGTVKFGDASRVEIQGVGSVVFQAKNGEHRILHGVYFIPALRNSIMSLGQLDEAGSKVEIEHGVLRIWDQRKRLLAKVKRGSNRLYILHLDAVQPVCLAARKDDDAWRWHERLGHLHFDTIHRLGKEEMARGIPVIEHAAQVCDTC

SEQ ID NO: 60939 - protein, 155 aa, Sorghum bicolor
  Clone ID: 9299634.pep
MGSREVLGAAAPTTTTTTTTQANKVAVMSRRVVIQLLVLLAVVVFLAPPLSSKMPGSSLLKEMENLVGLSPAAVAVACWAAAAAAWAYAVSRPRPVYLVDLSGYVAGAAHEASRAKTIAHFGRCGRFSDESMAFQKRMLERSGLGERTHFPASLI

SEQ ID NO: 60940 - protein, 153 aa, Sorghum bicolor
  Clone ID: 9299646.pep
MDRFAETEGKRAHDPLYSPRRAARATATGFPVGEHGEVLAGPVIVGAGPAGLAVAACLTMWGIPYVLLERHGGIASLWRHRTYRRLRLHLPKRYCELPLMPFPPSYPAYPTREQFLAYLEDYIATFGIRPFFCQAVVSAEHDGDFWCVRAVNG

SEQ ID NO: 60941 - protein, 43 aa, Sorghum bicolor
  Clone ID: 9299656.pep
RRTDGVRTRRSRAPSRRAALEDGVPLTVSPRTLTSASLTEASC

SEQ ID NO: 60942 - protein, 101 aa, Sorghum bicolor
  unsure (1)..(101): unsure at all Xaa locations
  Clone ID: 9299691.pep
SEPLLQELGXQNLQITQLIQENQAEFLRVINDPAGRAEESLPDQFGGAGMHRTIAVKPEENEAIQRLEQMTFDRDLVLEVFFACNKDEHLAANYLLDHMST

SEQ ID NO: 60943 - protein, 129 aa, Sorghum bicolor
  Clone ID: 9299711.pep
FSRSFSSASNQGIKWPRRRACLAFTRCFCPQDSAFHIVASPSFSPWNGASPLWLLGCFWSTKARPFCCWPCSCLCHWVLFCDQRSKAWVISRMATDTATDRPAKSFLTSVVLAAGDVARESEAALVVES

SEQ ID NO: 60944 - protein, 157 aa, Sorghum bicolor
  Clone ID: 9299737.pep
HEGQGGSRLKTTDMETVYELGGKMIEALGKEKVQSGDVIALDKASGKVTKLGRSIGRSRDYDAVGPHTKFVKCPDGELQKRKEVVYCVTLHEIDVINSRTQGFLALFTGDTGEIRAEVREQIDTKVAEWREEGKAEIVPGVLFIDEVHMLDIECFCF

SEQ ID NO: 60945 - protein, 49 aa, Sorghum bicolor
  Clone ID: 9299741.pep
SCPRCSPWMRPPSSQWWWWWSTWTVTAPPTPAIRRRSSVPRAPSRPSSP

SEQ ID NO: 60946 - protein, 73 aa, Sorghum bicolor
  unsure (1)..(73): unsure at all Xaa locations
  Clone ID: 9299746.pep
MAGMRAPLGVVAVAALVVAIFMPAAAAAQAPAPAPTSDGTSIDLXIAYILMLVALVLTYLIHPLDASSPYKLF

SEQ ID NO: 60947 - protein, 82 aa, Sorghum bicolor
  Clone ID: 9299749.pep
ARGLSGALVGLPGVNGLSTEQRKRLTIAVELVANPSIVFMDEPTSGLDARSAAIVMRTVRNIVNTGRTIVCTIHQPSIDIFE

SEQ ID NO: 60948 - protein, 187 aa, Sorghum bicolor
  Clone ID: 9299757.pep
HEASAVAKQKTKGTCSAATGPQTMTPRSAGKKRKSVNEPSMNSFSALTEQKTGKPSSPMKRKEASKTPAAKEKTDGTPSATNTQTESTPSAVAKQKTKGTRSAATGLETMTARSAGKKRKSVNEPAEAKEHGSGNSFSASMEHKTWKPSSAVKKQKTEKLSTAAKKHGSGNSSSESMEQTIGMLLSA

SEQ ID NO: 60949 - protein, 202 aa, Sorghum bicolor
  Clone ID: 9299778.pep
ARGNDGCQWRKYGQKVAKGNPCPRAYYRCTGAPDCPVRKKVQRCAHDAAVLVTTYDGAHNHPLSPYAAAMASAMLASSSSSSSSATAASCDDDAPRLAFPISVLPPAPQRYSCSRDVAIGAGPPPAAPAATSHGDLVPMANIMQKAVGDPNFRAAVMAAVASYVGEQCGGRISRRHLHLATSLLITDAWAHRYCVRIGNKKI

SEQ ID NO: 60950 - protein, 141 aa, Sorghum bicolor
  unsure (1)..(141): unsure at all Xaa locations
  Clone ID: 9299793.pep
REKETLEAALFERKNEIEMLKGAMASAAKQFEVELAHRDLEIDKCKDELGVLSEKYLHDKSTLEDELTKLHAVIKNMEGDLEKXSQEKLQLKSRIKELEQAAHSLEYSASEIVRLQEIIRNKQEESLENEKRISVLNQDIA

SEQ ID NO: 60951 - protein, 179 aa, Sorghum bicolor
  Clone ID: 9299794.pep
MMMPSGAIDKSISHILGGLMFSGLGLWHLFNHIRLFVSLPSTSSSSYVAPAWFPAPRVRHLELIVMLAGGVYGFATQMLAYSPMPFNADGSIPPERLPNHEHAIMYASLLVYAGSAIYLDRHRHRHRHTTLCMLLLAAVFAQELFVFHVHSTDHAGVEGRLHWFLQAAAATCLSTALLG

SEQ ID NO: 60952 - protein, 41 aa, Sorghum bicolor
  Clone ID: 9299819.pep
MRFGRTLRESIYPPWKDKYIDYAKLKSLLREDVADDDNQPW

SEQ ID NO: 60953 - protein, 98 aa, Sorghum bicolor
  Clone ID: 9299822.pep
RNTSEENFEWVETPPAPSPTTPAFDCGVKTTSYPTIANAPLPAEGSGRDSFNNYALISLLVGIPAYITWSWGMGFKTWVFLALVLFLPILGPFWWLTS

SEQ ID NO: 60954 - protein, 104 aa, Sorghum bicolor
  Clone ID: 9299830.pep
HEAQRLPPPPSSSSSHPRRVLPTAAVTDLLIRSMTPHPGRLVLPPVAPSLLFPPPAVHHASFRRHGDSLLCCTAPPPGASLVRPLRLPPPAKVWARSAAAVPGD

SEQ ID NO: 60955 - protein, 109 aa, Sorghum bicolor
  Clone ID: 9299841.pep
MEAKNQTGGDEECSRPQQQPVVMDSPRAAQAATRRKKMTKQLTGKRDDTAMHAAARAGQLASMREMMSGKDAEELGALLSRQNQAGETPLFVAAEYGYVALVGEMIRCH

SEQ ID NO: 60956 - protein, 98 aa, Sorghum bicolor
  unsure (1)..(98): unsure at all Xaa locations
  Clone ID: 9299842.pep
TRRVVARDGGAXAGGRGGGRRWIRPGVLVHEVVVVEVEVDHLHVGVRHRRHRCRRRAAGLDRVGGEEGAETRPTTATGLGLLGGSRIAIRESPSRPRA

SEQ ID NO: 60957 - protein, 74 aa, Sorghum bicolor
  Clone ID: 9299856.pep
SRVFFRFVLQSIYVLAGTRRKESQSEPQTFDSPFSISLRYRILLSTSTPIRLSCINTQHGTGRQGYGRWRWCRP

SEQ ID NO: 60958 - protein, 148 aa, Sorghum bicolor
  unsure (1)..(148): unsure at all Xaa locations
  Clone ID: 9299870.pep
ARGPIVRPRRPPLVTRNPSRSAPHQHQHPVSAMATTLCIRSTDCLAGRASFGVRAAPALAPRSPMQQQSQTPATASPPHVAMNSRSVRGRANGQQRRRHRRSPPAAGAGAGSPPHKRVMDNVVILRRGQVLMDKATAPLTATTSAXRP

SEQ ID NO: 60959 - protein, 66 aa, Sorghum bicolor
  Clone ID: 9299879.pep
KKGYGPGNKWDGAPGGGGGRGPYAGAGGGAGAAFAAGAGGSRGPRTLSDIQSNDHSSLPACGSCCG

SEQ ID NO: 60960 - protein, 181 aa, Sorghum bicolor
  Clone ID: 9299890.pep
TRVQDYALKHSHWTAVESLGAWCAREGVPAISGVDTREIVTYLREQGSSLARISIGEEYDADEDEAYIDPEAIHLVRRVSTKAPFHVSSSLGDMHVALIDCGVKENILRSLVSRGASVTCFPYDYPIHKVAHHFDGVFISNGPGDPTHCTTTVHNLRKLFETSPLPVMGICMGHQLIALAA

SEQ ID NO: 60961 - protein, 83 aa, Sorghum bicolor
  unsure (1)..(83): unsure at all Xaa locations
  Clone ID: 9299902.pep
TRVVGSYQVYAMPIFESIKXILVTRYRLPQGLLLRLVARSAYVAFTLFIAVTFLFFGDLLGFFGGFGFTPTSYFLSCSSLPLL

SEQ ID NO: 60962 - protein, 181 aa, Sorghum bicolor
  Clone ID: 9299923.pep
HEERSCIGSCKEAEISDTNVERVPNLGITVDFGNSKAGSSGFMTVDGGNSSAAVSILTSSAHHKAPKHSEARAINTSMTKGTYTVDESSSGMDDACNEHGSCNASAMECSDNSDSESEIFRVKRRSTSFDKPTSETKTSTLSEQQVLRRLKKVHPEVQQASKRPEEYDNGSVHSARMSQKS

SEQ ID NO: 60963 - protein, 196 aa, Sorghum bicolor
  Clone ID: 9299928.pep
AFCSSIAGLLSSRAVLQGVGVGNADASPTSALLLHILQDTSGRIATIIFAHRVGTALAPECKTYRLAADVFNDLAMILDCLSPMVAAGVMRVSVLSTAGVLRALCGVAGGSSKASLSAHFAKWGNLAELNAKDSSQETVISLVGMLVGSVVVSHVTGFTTTWIALLTLLALHLSLNYAAVRAVQMTSLNRQRANIV

SEQ ID NO: 60964 - protein, 92 aa, Sorghum bicolor
  Clone ID: 9299930.pep
FHRRPSNRTTHPLLLLLLLLLLHSCHLVVSSFLSTLARSEHSQPSRPDGRVPPAAPREVVVPGPRWPLPWAGGRIRRHGGRPKRDGGQLGLV

SEQ ID NO: 60965 - protein, 96 aa, Sorghum bicolor
  Clone ID: 9299935.pep
TRVVSPPLSAPLLRLYCSAPSPYAASLLARSPTRAEPSPPFFLQVLRRLDRGPLLPRRRPPAPTRSYPRRRIVQAELIGGSCALAVFISDHSDKLT

SEQ ID NO: 60966 - protein, 61 aa, Sorghum bicolor
  Clone ID: 9299939.pep
AGEASEPDDAAAAVARRACTYTVQIKTSCSSPRSSADAVSLAFGDAYRNEVYAARLTPPSC

SEQ ID NO: 60967 - protein, 116 aa, Sorghum bicolor
  Clone ID: 9299942.pep
KILGGGGWPAGRPVSRSTTTGRSWLRRRDTGAAAAASEESYRLSRTVGHERQRSPCVFLLTTTVPSEPAVLVVSMAPGCCRLSTAAAIAADDPWRGDGGTRGMQAVAADMAVRRRG

SEQ ID NO: 60968 - protein, 95 aa, Sorghum bicolor
  Clone ID: 9299951.pep
SPAVGLLGSVSLCLTMTARRRPRHQVVECCKQSRESRRRRSRRLAAPTYRVAESIRAADYWIWRLYCICSSHSRVHFFCFVFIKIVRSMIVIVAL

SEQ ID NO: 60969 - protein, 110 aa, Sorghum bicolor
  unsure (1)..(110): unsure at all Xaa locations
  Clone ID: 9299955.pep
LQASYPHAAVAYADYXDSFLTLLHNASLLGFDAASTRKACCGAGGGEYNFDWRRMCGFNGAAACAEPSTYLSWDGIHMTQAAYRAMSRLIYHGKYLHPQILSFPEKYGQT

SEQ ID NO: 60970 - protein, 146 aa, Sorghum bicolor
  Clone ID: 9299969.pep
TGKCHITSQNHGYAVDPTTLTSEWKEYFTNLNDQSNEGLIHASRPIFSAQFHPEAKGGPLDSAYLFDKYIENVKQYKEQQSSFSQRSNKPSPLLVDLLAKERVGVHPDAPDFEGHAAGMDSQQVTVGGPVAPSYQPITQNPVASAA

SEQ ID NO: 60971 - protein, 116 aa, Sorghum bicolor
  unsure (1)..(116): unsure at all Xaa locations
  Clone ID: 9299982.pep
AGGRITSQDDHAWGAHPLITIGELRSGTNLLLVASAREVHGANHMRVDGDAVHGATHMRVDGDAEVDRTSPRWLTAAAPAARSFGSARRRFLNLLVAVSPQERERERNLKYCCCKX

SEQ ID NO: 60972 - protein, 98 aa, Sorghum bicolor
  Clone ID: 9299990.pep
LHMLDLGPLLMRLASGGIALEKLHLTSWLFDSVIMCRKVPFCGVLMYLCTCPVKKYNLPNTCGTRLEINVFVMLVCQISLFLIVIDGRISKLKTVNKE

SEQ ID NO: 60973 - protein, 192 aa, Sorghum bicolor
  Clone ID: 9300009.pep
DGALQWTYLSPELESWPCTYLGSAEIGIPLDSFFKRARHYSRTSRSSAGSPSFQTAIPMTEITTLFAEESYILFLFPFSAGSNAKWHASILLKKGCTVTAQLKAWAHALLAARVLSSSPSANTCSLDSEKEFSEGIALHKTSQDVFEVVARVLGALNRGGRFGGYVDALREGGWDVDVGALETRGGRRVSSE

SEQ ID NO: 60974 - protein, 69 aa, Sorghum bicolor
  Clone ID: 9300012.pep
EEDEKLLRTILNAVFPSVGRPAVERMVASMAKQVASGERKRDGRTVSKEVQQRQLKDLEFLKQNKLESS

SEQ ID NO: 60975 - protein, 184 aa, Sorghum bicolor
  Clone ID: 9300020.pep
KTGGPSWSVPLGRRDGRLSSASGANALPSPADPVSVQRKKFADQGLTDHDLVTLVGAHTIGQTDCQFFSYRLYNFTATGNADPTISQASLAQLRALCPPPSGGDPAGRRVALDQGSPGAFDVSFFKNVRDGGAVLESDQRLWSDAATQGVVQKYAGNVRGLFGLRFGYELPKAMVRMSSIGVKT

SEQ ID NO: 60976 - protein, 145 aa, Sorghum bicolor
  unsure (1)..(145): unsure at all Xaa locations
  Clone ID: 9300023.pep
RTPALCLDVALRXRARLRQPIPRGWSACAYVIHGEAAFFGGSASDGGATTVTTAAARTLVVFGNEGDGDCVEVRGADASAGQQDGARVMLVAARPHNEAVVRDGPFVMNTREEVEQAREDYRRRRNGFEMADGWTSDHASTVATH

SEQ ID NO: 60977 - protein, 121 aa, Sorghum bicolor
  Clone ID: 9300076.pep
MWAWGCVERVAAGLLGGPLAGGGRWNTAVAVGVTAAAGLALVAIVVSSRRGGLKSPWWRRRRKAPLTAQEWRYLFTPEGKLQDGGVKLLKKVRSGGIEPSIRAQVWPFLLGVYSLDSSEAQ

SEQ ID NO: 60978 - protein, 66 aa, Sorghum bicolor
  Clone ID: 9300139.pep
STKINFSYDEEQKVWIPQDKKDAIVLILVHRQKDLQAHMHDWTDWAQQKVMHVAHRLAKEKDELQS

SEQ ID NO: 60979 - protein, 98 aa, Sorghum bicolor
  Clone ID: 9300154.pep
ARGSLLREEPTGELQLLTAPLKSIDGLILFDRPKCSLPAEDVSSMAASSSNSEAVDFDAAFADLDGKIRERLSENSCSYCLQPLPSLHYRSQKEADTF

SEQ ID NO: 60980 - protein, 105 aa, Sorghum bicolor
  Clone ID: 9300176.pep
MAPGSSIVTVVPESDCGDDDGLSEALGGIRLDVDSASKPWSTSLANVALSSLSGLNDLLECPVCTNSMRPPILQCPNGHTICSSCKHRVENHCPTCRQELGNIRC

SEQ ID NO: 60981 - protein, 102 aa, Sorghum bicolor
  Clone ID: 9300177.pep
MGPDGGVVVGGVIGVLVYGALAVVALRLVLSYKSAAHAVRRAWRWADEWAQAYQYYEVPRLVAAAGDGGGAENPLFRKAAAYVASLPSLEDADAACVLSSGA

SEQ ID NO: 60982 - protein, 143 aa, Sorghum bicolor
  Clone ID: 9300187.pep
TRVRFMACFRSKLWWMSQRMGDKGGDVPHETQFLLVESRGAGGEDAAYVVFLPLVEGAFRASLQGGAGDALELCVESGDAGTRAASVERALFVGAAESDPFAAIAGAVAAAKSALRTFRVRAEKKLPRIVDYFGWCTWDAFYQ

SEQ ID NO: 60983 - protein, 122 aa, Sorghum bicolor
  Clone ID: 9300198.pep
ARGAEVQQWIKDLAADELMAAVRARLNGLLGRYAGRFPHYDVNNEMLHGRFFRDRLGDGVAPLMFREAARLDPGAALFVNDYNVECGNDGNATPERYVELIRGLQRGGARVGGVGLQGHVTH

SEQ ID NO: 60984 - protein, 88 aa, Sorghum bicolor
  Clone ID: 9300207.pep
MAQYRDNIKYEEDFFVNSRGNRLFTCSWTPRKSQSRALIFICHGYGGECSISMGDTAARLVHRGYAVHGIDHEGHGKSSGSKGYISSF

SEQ ID NO: 60985 - protein, 148 aa, Sorghum bicolor
  Clone ID: 9300208.pep
MSAEPEHTHEKKRVHLQDASGAEKKDELDTSTAILKKKKKPNSLIVTDAVNDDNSVIALSNNTMETLQLFRGDTVLVKGKKRKDTVLIVLADDDLDDGSARINRVVRHNLRVKHGDIITVHPCPDIKYAKRIAVLPIADTHRGLTGSL

SEQ ID NO: 60986 - protein, 180 aa, Sorghum bicolor
  Clone ID: 9300211.pep
ARGAKTTLMDVLAGRKTSGAIEGDITLSGFPKKQETFARISGYCEQTDIHSPNVTVFESITYSAWLRLSSDIDDGTKKMFVEEVMALVELDVLRDALVGLPGVSGLSTEQRKRLTIAVELVANPSIIFMDEPTSGLDARAAAIVMRTVRNTVNTGRTVVCTIHQPSIDIFESFDELLLLK

SEQ ID NO: 60987 - protein, 137 aa, Sorghum bicolor
  Clone ID: 9300237.pep
VDLHEGCTFNHRYVKPNPYEVENATWMLTVFKCFGQHFCLHFEAFLLGMAPVYMAFLRFMGEESEAQGFGYSLEVGGGGRKLTWQGTPRSIRDSHRKVRDSFDGLIIHRNMALFFSGGGRQELKLRVTGRIWKEQGQ

SEQ ID NO: 60988 - protein, 163 aa, Sorghum bicolor
  Clone ID: 9300248.pep
LLKKYNLSAQDEVIASARKKFEEGSLDEAVRELIKIDQEYGSVNSCPYTIWLIGLIQARRIDDALKIFHILEESGIDITPACCAHLSKYLCWEKNLDSAVDVMLYTLNKRFIMSRHVGNRLLSSLCIRHRRKDAQALAWRMHLVGYDMDAYLRESTKGLLYNK

SEQ ID NO: 60989 - protein, 163 aa, Sorghum bicolor
  Clone ID: 9300275.pep
GARVGGVGLQGHVTHPVGEVICDALDALAAATELPVWFTELDVCEPDDALRADDLEVVMREAFAHPAVQGVVLWGFMQGHMWRQDAALVNADGTVNDAGRRFVELRREWTSDARGRLDADGQFKFRGFHGNYVAQVTTPAGTKMLKAFTVDKGDTPLVLDMDN

SEQ ID NO: 60990 - protein, 198 aa, Sorghum bicolor
  Clone ID: 9300282.pep
GGTVVLQLHRKDPLYWDGAVLLAPFCKMFDNMRPHPIIVSTLKMISTVAPSWRVIPAIDMIDKVCKDPQFKKEIRSNPYMYKGNLALQTGRELLSVGLDTEKNLHEVSLPFLVLHGTDDVVADPCGSKLLHERASSRDKTLKLYPGMWHVLMGELPEDVERVFADVISWLDDRVGGTATVPGGMADRHELVECRDAVE

SEQ ID NO: 60991 - protein, 201 aa, Sorghum bicolor
  Clone ID: 9300283.pep
VNQLLTEMDGMTSKKNVFVIGATNRPEQLDAALVRPGRLDTLVYVPLPDQASRESILKAQLRKTPVAPDVDMAFIASKTHGFSGADLGFVTQRAVKLAIKEAISLDIERTRAREAAGEDVTMGEGEVEEEDPVPELTRAHFEEAMKTARRSVSDVEIRRYEAFAQSLKNSGGSSFFRFPSAGEVQNNDTFGEAGNDDSLYD

SEQ ID NO: 60992 - protein, 139 aa, Sorghum bicolor
  Clone ID: 9300313.pep
MKPSSSGFNFAGGTQQQGQQQGAAGGHLSRISEDGCASFPAGGLVGDRAAGGRGSGESSSGGAAAAARSYSGGFSIVGPWEESRDIITTLGAYDPQFSGAMAGTALEMAGMDRYMQLQHDQVPFKVRAKRGCATHPMSI

SEQ ID NO: 60993 - protein, 151 aa, Sorghum bicolor
  unsure (1)..(151): unsure at all Xaa locations
  Clone ID: 9300315.pep
LAKMEEAMRKQQQELTALRHQLHEVEREKADGSQLVQQDSFGGRLLARLSEMPAGLDQSMAMSMSMDLDTGDQPAMQDVKVIKEDPHQQGHIRNQTATAASACTGSAVQEDDVRLSGYPEKTVLXTVFEEGDEDDAEKECGLQEEVRKEVV

SEQ ID NO: 60994 - protein, 170 aa, Sorghum bicolor
  Clone ID: 9300322.pep
LKRAHELIGVNQAPTALTLLHEHITNKRSRSAAIASLEPVMLLLVELSVEQKKGKLAKDALYQYKNLSQNTNISTIELVLKKFIELAVEKVTAAQQKADEVQSTIEATAATSNIDDLEASETPESILLATVSGEQSRDRTDRAIVTPWLKFLWEAYRTVLDILRNNARLE

SEQ ID NO: 60995 - protein, 182 aa, Sorghum bicolor
  Clone ID: 9300327.pep
PSPLLLASKHPNDDNRALEALSPLGSDNEGDSRRRSRRARFHDSEDITTQLAQALKGSRRPDTEPLIEILPSLTHDQVMKLRADYKALVKTGSERKGVNIAKHIRARLKDEDPLLMKACYSVALGMWESEAYWANFWYQGDKTRRELLIESLMGRTNGEIRYIKDAFTDKKYDNSLVKCMKE

SEQ ID NO: 60996 - protein, 118 aa, Sorghum bicolor
  Clone ID: 9300331.pep
MAPSSKLVKTSSLPKHQRSLVQPLHSPRHKRVSALCPAAPESLLQELVTAAAACDAHHQPRAKRASDETLAVHAGENLGKKGADVVGTGTGTETDSIATPIVSGTTHWFKSSEDLIAF

SEQ ID NO: 60997 - protein, 188 aa, Sorghum bicolor
  Clone ID: 9300369.pep
TRVAIIYEADEPSEGRTITYGELLREVSRVAWVLRQQGVKKGDTVAIYLPMIPEAIVAFLACSRIGAVHSVVFAGFSSDSLRDRVLDAGSKVVITTDEGKRGGKVIGTKRIVDEALKQCPDVTSVLVYKRTGAEVPWTKGRDVWWHEEVEKYPNYLAPEPVNSEDPLFLLYTSGSTGKPKGVMHTTAG

SEQ ID NO: 60998 - protein, 175 aa, Sorghum bicolor
  Clone ID: 9300370.pep
HEPPAREHQGILMANNPNDLPWFDRRTVLDEVQLLAVEDNNNAEHGWTKAQIKDSLIARHHDQQQQLPPGFDAEFGRVLSDLLRGDHLVTGDNPQCYKLHTVVPHHLPPWFGKDAVLQEVEKLDNQNNNNDGSTWAPIRNSLLETYHHHQQQQQQLPPGFDRLVRKMLSVLRNRG

SEQ ID NO: 60999 - protein, 154 aa, Sorghum bicolor
  Clone ID: 9300387.pep
MDSARAIKGERDLPEAEKRRPTVPGTVTAVFLLSLPLLLLFFLFGDRAVASIAGDSLVRQQSSGNASSSSSPETTMDRDTLHDRLLGGLLSPDFDAATCLSRYEASKRWKTPSPSPFPVSPYLVQKLRQYESNHRRCGPGTANHREAMAQLMSG

SEQ ID NO: 61000 - protein, 159 aa, Sorghum bicolor
  Clone ID: 9300393.pep
PAAAAAAGGEGRRPPLFGSGGGWREKERERDSARDSAEGGAPARTESGDRPSGGPPRLQLAGSGNKPSWRDRQAAKESGGAANDNAPPPARGPGPRDSRDFRDARSSPRDSPRDSPRDSPREDSRRGENGKTESPAAPTESLPTRTSGKWVPPHLRNKS

SEQ ID NO: 61001 - protein, 39 aa, Sorghum bicolor
  Clone ID: 9300444.pep
STHHNVLINRFHFMAVNIARLDFGSSEDLICHGQRAPWQ

SEQ ID NO: 61002 - protein, 48 aa, Sorghum bicolor
  Clone ID: 9300445.pep
HYTRRQAPALSDPNPIPMEEFQLGFYLGYTMGAMGGFRKRQVRGHDGG

SEQ ID NO: 61003 - protein, 92 aa, Sorghum bicolor
  Clone ID: 9300454.pep
LKDLEKTYNRGDRFEATMKYSFLHPVTELPIQGQPLPEGVKYAWLPRIRCLDCTTKLYTPGPDMTVKKFETHLDFSGHKNAVAKRVAREANP

SEQ ID NO: 61004 - protein, 128 aa, Sorghum bicolor
  Clone ID: 9300457.pep
NSTALRMARILERHPKIERVHYPGLESSPWHEVATSQMSGYGGVVSFELKADLHGTMSFVDALEIPFIATSLGGCESLVQQPAVMSFWGQSQEEKAKNGIKDNMVRFSFGIEKFQDLRDDILQALNRI

SEQ ID NO: 61005 - protein, 133 aa, Sorghum bicolor
  Clone ID: 9300465.pep
IKGLKVLHNSCLSDLRKLIEAHFEEVGSKQQQHQFTFLLLGDPSGAPVSRDKEASVQISRLPHWNNQPDSYLACLRAAKKPAVDNMPFSPLDSKLNTVLKDAHLAGAMSPKVNQMSSPKVNQMSPNYIRELRA

SEQ ID NO: 61006 - protein, 190 aa, Sorghum bicolor
  Clone ID: 9300469.pep
TFEIMYEQITRCTREHGLLPQVTDTSEPGARPSNGTAAKVKAVLVVSLKPEYYDKLHSVYYTNATATGEVVTVYQPSHDQDQHTEARAHNERALAEIFLLSYSDRLVTTGFSTFGYVAHSLAGLRPWLLMLPDRTTNRAAVACVRPASVEPCLHSLPSLVCRAEQDVDPVAHLPFLRHCEDVGLGLKLFD

SEQ ID NO: 61007 - protein, 137 aa, Sorghum bicolor
  Clone ID: 9300472.pep
LTQLLNDSLGGSCYTVMIANIIPSHLCFGETQNTLHWADRAKEIKTKTQTTANEEVLDQPDSETAVLVLELQRENCVLREQLAKQQQKLLIAEAQLLASKTLPQQSPARSSHVSTTGSTQRKTRRSIVAGNYFNTTD

SEQ ID NO: 61008 - protein, 128 aa, Sorghum bicolor
  Clone ID: 9300477.pep
ARVAPGGSWPASSGGSAARRGPWRPGARGPGGWRPLVGQRGRGGTAGAAHGSGGRVARNEQPGRAAPSGCARGGHGGLSWLVALRLAVASWAGQGHERGSPAGAAPGRCMACGCCPRARRERSGPSWR

SEQ ID NO: 61009 - protein, 176 aa, Sorghum bicolor
  Clone ID: 9300487.pep
DISFYLMLLHANQGEKFGLLKTMFSAFSSSFDPLDYHMIWHQRSILEAVGAFSSNDLHLLDLSFVYQLLCLGKCHWAIYVILHMPYLDDAPYIHEKLIREVLSQYCESWSRDDAQRQYIVELGIPEEWMHEALALYHEYYGDKQGALENFIQCGNWKKAHTIFMTSVAHSMFLSSN

SEQ ID NO: 61010 - protein, 76 aa, Sorghum bicolor
  Clone ID: 9300491.pep
ITRACRSVSEETAIAFQYCENGSAVGIEIQQDHSENWEGRDERGGGGAEASVAEARESFSETRREGKASGGRGVLV

SEQ ID NO: 61011 - protein, 69 aa, Sorghum bicolor
  unsure (1)..(69): unsure at all Xaa locations
  Clone ID: 9300513.pep
RKAQRDASATGELKSPSHRFTSPAPTAKKRTFWDIGGNSPSVLAANGRKTXSHVATETPKKGSSKLLQP

SEQ ID NO: 61012 - protein, 149 aa, Sorghum bicolor
  Clone ID: 9300521.pep
RVGVRLSPFTDYMDCHDSDPEALAGYMVEKLSELGVLYCHMIEPRMAIVDGRRQIPHRLRPFREKFRGTFIAAGGYDRAEGNKVVEEGYTDLVSYGRLFLANPDLPRRFRLPDADAPLNKYDRNTFYTSDPVVGYTDYPFLHDDDGADK

SEQ ID NO: 61013 - protein, 90 aa, Sorghum bicolor
  Clone ID: 9300528.pep
GGETLGAMGSSGSVMNSTGTMESGAFDSSNFGEGTSNVAHPAEALGHTVISAPEGRVRGGNIMVMLSTGMNIGKQLSCNMDASTSTGNWL

SEQ ID NO: 61014 - protein, 153 aa, Sorghum bicolor
  Clone ID: 9300556.pep
MAGGAVSASLRTLVLLLLAIVSSPLAGRRTAAALSTKYYDKKCPGLQPAVRSAMARAVAADPRAGASVLRLFFHDCFVNGCDASVLLDDAPAGEKGAAPNANSLRGFDVVDAAKAAADSACGGPGTVSCADVLALAARDAVSLLGGPSWAVRL

SEQ ID NO: 61015 - protein, 110 aa, Sorghum bicolor
  Clone ID: 9300584.pep
MLPNAQPPPCRLGIMHLTNHLKELDEMTIKLKADFEDMKLKLELDRSIADIGTKQKRQQNDRYIISQRKLLDEGSTIEQNDAAMSMQVALRQMLMQALCDQRAAFAEKMK

SEQ ID NO: 61016 - protein, 184 aa, Sorghum bicolor
  Clone ID: 9300587.pep
TRETAAAYLRAIEEGADFIETDILASKDGHLICFHDVTLDATTNVANHTEFADRKRTYEVQGENVTGWFIVDFTLKELKSLRVKQRLSFRDQRYNGKYQIITFEEYILIALYADRIVGIYPEIKNPIFINQHVKWSGGKNFEDKFVEMLLKYGYKGEYMSENWLKQPLFIQSFAPTSLIYISNM

SEQ ID NO: 61017 - protein, 44 aa, Sorghum bicolor
  Clone ID: 9300589.pep
GILVGSHIYSYQWWYSSSALLIGQGLCVSHTLLIIYDWLIYFST

SEQ ID NO: 61018 - protein, 139 aa, Sorghum bicolor
  Clone ID: 9300610.pep
MLSRTIRRSIASPLRRNVIAPVARPAFRSVTTDAASSHTDPANVPAADDQPFEVRLSDEAFETYELDPPPYTLNVTKHELKKMYYDMVAVRRMEMAADRLYKEKKIRGFCHLSTGQEAVAVGIEHAIERADHLITAYRC

SEQ ID NO: 61019 - protein, 132 aa, Sorghum bicolor
  Clone ID: 9300620.pep
PNVVMRFILHSVKELYSDLREYYDSREELGEFAFTESPTTVKFVTMLEALKPFGYRGGGQLYYLNPAPGSQPSTGLVQMDGLVQIDGQEEVDQLMLAHEKERIKTCHLYLVTGSNDDFHAGMSDMETDYYEE

SEQ ID NO: 61020 - protein, 89 aa, Sorghum bicolor
  Clone ID: 9300622.pep
FIRNYVIGIGPWKDTIVPPNPKDNCLGQPTDLVARAHALNLQVHPYTFRNENQYLHFDFHQDPYSEYEYWLNEIGVDGLFTDFTGSLHK

SEQ ID NO: 61021 - protein, 140 aa, Sorghum bicolor
  Clone ID: 9300637.pep
LSGAHTVGRARCVTFRGRVSGGGDDDPAASIDAGFAAQMRRACPDGADGNNVAPLDAVTPDRFDNGYFQDLVQRRGLLHSDQQLFGGGGGGSSQDALVRKYARDGAAFASDFAKAMVRMGNLAPAPGTPLEVRINCHRPN

SEQ ID NO: 61022 - protein, 71 aa, Sorghum bicolor
  unsure (1)..(71): unsure at all Xaa locations
  Clone ID: 9300654.pep
PAVLEAGLLPDRVADATGSRPFSCDPCPHPHIRTLPCAPGLAAPREAAHRLTPVPPQLTTSSANVPEPPRX

SEQ ID NO: 61023 - protein, 135 aa, Sorghum bicolor
  Clone ID: 9300668.pep
FWPEQLEFVRMASRFGATIIPFGVVGEDDICHLLLDYNDLLKVPFYDMLDNALNRDGLKLRTDSMGDVKDQRMHPLVLAPKLPGRFYFAFGKPIETRGREKGLRDKEEAQRLYLQVKSEVESCINYLKEKRELDP

SEQ ID NO: 61024 - protein, 64 aa, Sorghum bicolor
  Clone ID: 9300679.pep
RTREEIQRMRSTNDPIAGLKQKLLDWGVTSEEELKSIDKQARSDVDAEVAEAENMAIPEPTGKV

SEQ ID NO: 61025 - protein, 166 aa, Sorghum bicolor
  Clone ID: 9300743.pep
IQTSSQPINIHGRSEPSAEAMQTSRQDTPMSNTFTQEEWEKDLDMKLVFRYLRSRFMPRSSNPAPSTPAHLATSNSQDTAAKLARVRQHHPLVSRMRPPAERRTFKATTPGSPVAIRHPSSCASQSTRRSARRSSVSSRHYWDIGGSLGTGSVIASNGPMGSWGEV

SEQ ID NO: 61026 - protein, 98 aa, Sorghum bicolor
  Clone ID: 9300752.pep
VQASQAFHSMRIFNETKFFIHIYVFPIKLFCVIMLDILSINFIRRSYYTLLFCIFLKMHALSSFPTFTVVVTENGLCFCSRLLFLELQRYQRIILLGE

SEQ ID NO: 61027 - protein, 174 aa, Sorghum bicolor
  Clone ID: 9300754.pep
ARGGTPPRRRSSPERRKGSPARARSPPAKSSASHRDRDRSPPRDKVKERIRSPQSPAKASLSHKGRERSPPREKAKDQRVRSPKHMQEQSRSPSPARRHVSRSPSPRTKRLRRAQGEREVAQVTGSDRRKASHREEQDIVRHREHDAGRDASRDRKVDREAVQATNGDHRKSSQ

SEQ ID NO: 61028 - protein, 173 aa, Sorghum bicolor
  unsure (1)..(173): unsure at all Xaa locations
  Clone ID: 9300770.pep
MQHALRSLLFLIFSQGFDTSVGEHGTQLSGGQKQRIAIARAILKDPRILLLDEATSALDAESERIVQEALDRVMTNRTTVIVAHRLSTVRNADTIAVIHQGTLVEKGIIAKHQFQNHHLPVFDCSMHLCLTIXHFGPGPHNELLRDPEGAYSQLIRLQEANQQNNRKGDANAR

SEQ ID NO: 61029 - protein, 86 aa, Sorghum bicolor
  Clone ID: 9300820.pep
LLLQGSKGWTVVTEGILQERNQQIMRRAMEDQEGHPGVVDQCLQKSTGIGPGMNPIHHRGCPEVQHVLRFCDILPFISPYGLSVLL

SEQ ID NO: 61030 - protein, 108 aa, Sorghum bicolor
  Clone ID: 9300833.pep
ARGGSLNLSRAIGDVELKQNKFLPPEKQIVTANPDINVVELCDDDDFVVVACDGIWDCMSSQQLVDFIHERINMESSLSAVCERVLDRCLAPSTIGGDGCDNMTMILV

SEQ ID NO: 61031 - protein, 201 aa, Sorghum bicolor
  Clone ID: 9300835.pep
ARGCTHPKCPVKKMVERSLEGHITEIVYRGSHSHPLPLPNSRPSVPLSHFNDSEADGNFSSKPGPGYDSSTSQGIAPKGQFQDVHSGALETKLSGSLTTTEIADTSVMESMDVSSTLSSNEKGDRAMNGAVPSTNDMNEDETESKRRKMEVSVASNTANIVTDMAAMASRTAREPRIVVQTTSEVDILDDGYRWRKYGQKV

SEQ ID NO: 61032 - protein, 205 aa, Sorghum bicolor
  Clone ID: 9300845.pep
FLATGLSCFSAVMYQIYQFKPTAITIQGTFIVLIAYFLGNGWAKILPRGDKLEARWRSGGGQGALPFYVKVAKLLNDGPWSLKEHAICSITATSASNAAITIQVFAAQDLFYGMPLRPAQVILSVISIGLFGYGLAGLMRPIAVWHTEAVYWSTLPTVKSLQALHWQDVKNSKPLRVFWYAFGGMALYEILPAYVFPWLNSVSIP

SEQ ID NO: 61033 - protein, 171 aa, Sorghum bicolor
  Clone ID: 9300846.pep
TRLAEHVRACSGSGAGTPVNIREAVNGTVLNVVSNVLFSEDVVDLRDDQKQAQSFKSLVVPVLEEWSKPSVSDAFPFLAPLEHLLGSRRRISTHLAKLFRFFDEVIIEKRLASGKKHNDILDILLSKMAMSKLTRQQITTFLTDMFIAASDTSTVTVQWAMAELLHHPDKM

SEQ ID NO: 61034 - protein, 192 aa, Sorghum bicolor
  Clone ID: 9300847.pep
ARGYDKDDYAQEFGIKISDRLASVEARILPAPRLKYNETGREKDCLPRVGQWNMMNKKMVDGGKVRSWICVNFARNVQDSVVRGFCHELALMCQASGMDFAREPVLPPLYARPDQVERALKARYHDAMNVLGPKHKELDLLIGILPDNNGSLYGDLKRVCEIDLGIVSQCCCTKQVFKMNNKQILANLALKI

SEQ ID NO: 61035 - protein, 161 aa, Sorghum bicolor
  Clone ID: 9300848.pep
MKSQLVLAVLSGLVLFASATVYFSEEFGEGWEKRWVESSPKKPEEMGKWTVSAGKYFGNEAAEKGLKTTEDARFYDISAKADAPFSNKGKTLVIQYSVKHEQSIDCGGGYIKLLPFDTDLSKFGPDSPYYIMFGPDICGSTRKVHLIFTYKGQNYLLKKSV

SEQ ID NO: 61036 - protein, 191 aa, Sorghum bicolor
  Clone ID: 9300850.pep
KNPTLVKLDRVLSTTSWENFYPTCFAWTKTRIGSDHCPIILNTGEQGESRPRYFYFDEQWLQREGFSNMVRERWDFFNTGQDYSLDRWHGCLQSMRKYLRGWNLQLIGIQKREKEAMIQRIKDLDHIAEFRLLTSQEWEERIEVEDNLERSNRSEEIYWKQRAGNKWLLEGDANTHFFHQFANGRRRKNPR

SEQ ID NO: 61037 - protein, 161 aa, Sorghum bicolor
  Clone ID: 9300853.pep
MARKCSSCGNNGHNSRTCSGHRCQVTSISINSTSTTTSCGSLRLFGVQLQVGSSPLKKCLSMECLSPIACYGAAAASSSLSPSVSSSSSSLASIEESSQRITGGYVSDGLVVRVQDRKKGVPWTEEEHRMFLAGLDKLGRGDWRGISRHFVTTRTPTQVAS

SEQ ID NO: 61038 - protein, 195 aa, Sorghum bicolor
  Clone ID: 9300859.pep
MLRAAASRCARGAVRRLSSSAAVEASPVAVGSRRKPLLDEGDWSFHREWWGEEDGPGEGAQTVFRRHSECGNGVVSVSAYPASRPASEHWPATERWLQERNARLYPESASSDQFKVLGYQWRVMRFNDHTRQSTAKVMTCYRTSGQRSLFLMQQPHVLAVPYVKSMVSAGLIALPCSSYDLPQAATGQNTMKILC

SEQ ID NO: 61039 - protein, 149 aa, Sorghum bicolor
  unsure (1)..(149): unsure at all Xaa locations
  Clone ID: 9300867.pep
SPVLVMPACVCMGNKQDKKRLLHEQEXACACVCVLVRSEKFRTPTEARRSFGVLEKAAGGVQKWASRGQHGTLSLLCTWMLHARSRCCSCDNNFCKRPALALVSAPDVLIQFWMHVNEKKKEDSETTVSRQRGFVSCDVQAQGSSEVGT

SEQ ID NO: 61040 - protein, 54 aa, Sorghum bicolor
  Clone ID: 9300870.pep
GLTSLPDVDALWDACVGKMVSVMEDNFSRMQTANHLLLITDYAALLSATMRRYG

SEQ ID NO: 61041 - protein, 172 aa, Sorghum bicolor
  Clone ID: 9300879.pep
WRAARRACLSELLGAPRVRGFRDVREAEAAALVAAVADESSSRDGGSPVNLSDRLVATTNRIVRRVAFGDDGGGDVDSVRTRAVLEETQRLLGAFFVADYMPWLGWLDALRGLRRRLERNFRELDAFYEKVIDEHINKGTKSKEEGDFVDVLLRLHNDPAQQNTFGSRSQIK

SEQ ID NO: 61042 - protein, 119 aa, Sorghum bicolor
  Clone ID: 9300882.pep
MGDCVVEDGHGHHQSEAVEGAVPLTVAVELDERSGESREEGGGQRKKVGGIRREPSFSRWCRDPSDAAASNTAAAAATSDSDDSKEFELPLLPSSSGGGSSPMDIEAGATARSDDLPIS

SEQ ID NO: 61043 - protein, 178 aa, Sorghum bicolor
  Clone ID: 9300884.pep
TRARCLRQPTTHPFLVLLPLPLPPLPSLTMAVQAQYPSNLLFHDRGEPDRKGMDMPRPPQLAGVSPAAVYFSSAGATGNNRRKRPREAMAMAPPPAAAAAKEEYVNLFTLQPQQSTSSFANVALFHNQSRVSSPAATTALVSTGLRLAFDEQQQLQQQESKQMNALRYSSSSPSLFVS

SEQ ID NO: 61044 - protein, 166 aa, Sorghum bicolor
  Clone ID: 9300886.pep
MPFATELTKRLGIRVPVVQGGMMHVGTADLASAVSNAGGLGIITALIFPTPEELRKEIQRCRTLTKNPFGVNITLLPAMVPPNYAAYAQAIIDEGIQVVETAGNSPGPVISQLKKAGIIVLHKCTTIRHAQSAVKLGVDFLSIDGFECGGHVGESDITNFILLSKA

SEQ ID NO: 61045 - protein, 196 aa, Sorghum bicolor
  unsure (1)..(196): unsure at all Xaa locations
  Clone ID: 9300887.pep
HEGWVDERTMSPARXGAGVPVAVKKLNPESLQGVQEWQSEVNFLGRLSHPNLVRLLGYCWEDKELLLVYEYMAKGSLENHLFRSEPRKGGAAVHQPLLPWSLRLRIAIGAARGLAFLHSSEKHVIYRDFKASNILLDTHFNAKLSDFGLAKDGPAGGSSHVTTRVMGTYGYAAPEYVATGHLYVKSDVYGFGVVLL

SEQ ID NO: 61046 - protein, 163 aa, Sorghum bicolor
  unsure (1)..(163): unsure at all Xaa locations
  Clone ID: 9300907.pep
MVHINRVATSKEIEEEKAQFDDITKIGTINLSPDDELDDFTATVYGSKYASEDLPRHEMPEREMPPQVAYRMIKDDLTLDGTPTLNLASFVTTYMEDEAEKLMVDAFSKNFIDYEEYPVSADIQNRCVSMIARLFNAPSTDEANIIGTSTIGSSEAIMXGCAS

SEQ ID NO: 61047 - protein, 171 aa, Sorghum bicolor
  Clone ID: 9300909.pep
ARGSQIEEWQRPILNDKRLPEWYPVALFNELYYLNAGGTIWTDGQPPKKAGFASSLTGTEPFSIDTLLAEDGGTGGSAVDGVVRAVASAKELSHSAAAAFGAALLRDGEDNVGQFLYLEGMEYNMYNTYDVHFYASFALLSLFPSLELSLQRDFARAVLLHDPRRRRTFDG

SEQ ID NO: 61048 - protein, 108 aa, Sorghum bicolor
  Clone ID: 9300919.pep
WAIGRDENAWPRPQEFIPERFLAAGQEVHSSMVKEAYRPFGAGRRVCPGMEYTARSVPLLLASILHRNEWRLPADGDGVGLEGMDLRDRYGTVLNPATPLHAVLVSTV

SEQ ID NO: 61049 - protein, 184 aa, Sorghum bicolor
  Clone ID: 9300921.pep
IPDPAAKKPADWVDAKEILDPEDKKPEGWDDIPATIADPAAKKPEDWDDELDGEWEAPQIDNPEYKGEWKPKMIPNPDYKGEWIHPEIDNPDFVDDPNLYAYDNIGVVGFELWQVKAGTIFDNIVVTDSLDEAKEWAKKTVAAREGEKVARESELARDRAAEPEEDAEEEEDEHAGHDHSHDDL

SEQ ID NO: 61050 - protein, 123 aa, Sorghum bicolor
  Clone ID: 9300926.pep
KSNEFVYLTLSDIAITAVGYSSLQTQLGSNYLLHSGPVTRVLGFFSLLLPSLRLDAGLDSTSMSMTCMYHPIRLFVPDSCSNLCSWSWPRAAILLRYVAGPLYYEFMSSARKRHTDLNYNTIT

SEQ ID NO: 61051 - protein, 75 aa, Sorghum bicolor
  Clone ID: 9300932.pep
ILSFLRFFFSSFSFSGKALMDGFLHIMSSCTHSPATRADDRTRMMKRGKLGSAEDGLDAARPHAQAHGARHGGVV

SEQ ID NO: 61052 - protein, 72 aa, Sorghum bicolor
  Clone ID: 9300944.pep
AKKKKNRQCVPTSPHVGALQQSEIKLTARPSSSHHIASELTALQFRRISPRPPVRTPTRPILRTAFLNSWRK

SEQ ID NO: 61053 - protein, 201 aa, Sorghum bicolor
  unsure (1)..(201): unsure at all Xaa locations
  Clone ID: 9300947.pep
VFTINYXGADQASFTLNFSRGASQIIGQYYQLIRLGKRGYRRIMLNLTRTADYLAANLESMGFVIMSQRGGEGLPLVACRIDEDLGKQYDEFAIAHQLRERGWVVPAYTMAPHSEKMKMLRVVVREDFTKSRCDALLADFKQALQTLDALDAKRIEDQRQHAFAMRRRSTLVSPIFKRKATEHFQEDHSLQGKTGKTHGVC

SEQ ID NO: 61054 - protein, 63 aa, Sorghum bicolor
  Clone ID: 9300965.pep
DPSVQRAVQAAQRASENAFRLPRVDEQVHKAVMAANRAATAARVAAIKAVQNRMDGKFCDTYV

SEQ ID NO: 61055 - protein, 65 aa, Sorghum bicolor
  Clone ID: 9300966.pep
FIASLCFVLFFSAGVIDHARKLQYSFLLLLFPYLLDASFRFPSFFLMRTEDRRRSGNSDSSKKRR

SEQ ID NO: 61056 - protein, 136 aa, Sorghum bicolor
  Clone ID: 9300976.pep
DPLQGAVVSVTFIKGGEAFNVIPESVTMGGTFRSMTNDGLSYLMKRIREVIEGQAAVSRCAATVDFMEEKMRPYPATVNDEEMYAHAKAVAESMLGEANVKVRPQVMAAEDFGFYAQKIPAAFFSVGVRDEGTGKV

SEQ ID NO: 61057 - protein, 99 aa, Sorghum bicolor
  Clone ID: 9301124.pep
HINNGDRVSIAGIMDLLLLVDEDHLEEVWAVAIIAKTCVSAKPSRRPTARYVLRALESPLRVVRQGSSRSSSARQQLRSSSSRSSWQSVFQGNNHRVQS

SEQ ID NO: 61058 - protein, 112 aa, Sorghum bicolor
  Clone ID: 9301134.pep
FAKYVPNTMRMTHEHDIVPHLPPYYFFLPKLTYKHFPREVWEHEVDGNTTYQVCDGSGEDPNCSRSVFVLLWSASDHLTYMGVEIAADDWSTCRIVLGRKRRSSSKGALPAT

SEQ ID NO: 61059 - protein, 40 aa, Sorghum bicolor
  Clone ID: 9301152.pep
TCRSSGARGPPAAQPSRRTDGAPPRGRRRRLYRLTPAATR

SEQ ID NO: 61060 - protein, 192 aa, Sorghum bicolor
  Clone ID: 9301211.pep
GYTIYSLPPAQDHKRIFDGDQGPNTGGMGCYAPTRIAPKEVRDEIDRTIIQPSIDGMRRDGFPFVGILFTGLMMTKNGPKVLEYNVRGGDPETQTLLPLLSKDTDLAQIMVACTEHWLDGVSIKVEPNYSTTVVAVAGGYPGSYAKGKPITLDPTPAGSLIFHAGTTLSGNELQTSGGRVIAATATAATLEE

SEQ ID NO: 61061 - protein, 137 aa, Sorghum bicolor
  Clone ID: 9301220.pep
MRSRVALEPLAEEPGGGEEEAARRRTGLHAALHRWARLLSGGAAGDDARPAADLRVLLSVLACPLCPVPVLPRLPRHVASSAQYIIEQFTATTGCGKLEDGAVKSMYACGRVRLSMLQDPSGGGSGVIGSGGGRGHE

SEQ ID NO: 61062 - protein, 64 aa, Sorghum bicolor
  Clone ID: 9301238.pep
GFADDPNLSLLILVLSSCFIALGKENLTKAFRLKFRIHNINLIRRALPPYQSDRGQIHWAKVTS

SEQ ID NO: 61063 - protein, 159 aa, Sorghum bicolor
  Clone ID: 9301247.pep
TRPRYSCIRFLQQDKKALTDDGSTYGGLQHVPTVGNEPSPAPPAPGSNSRPVSWNFSAASALPADDRGAVAVALPDATAAVARVQQRAASASAGRRGGSAGPSAAATSPGPVQDHIIAERRRREKINQRFIELSTVIPGLKKMDKATILGDAVKYVREL

SEQ ID NO: 61064 - protein, 119 aa, Sorghum bicolor
  Clone ID: 9301258.pep
MADPDELGRRLAAVAVSESPTAAAAALETSNNNLFQVMRAVEDAEATIRQQLEENSRLKDELMLKTQELHRIRSEATNQASSRGIHHDRALAAHTDTSSTAPIGTTATAAEAFKWGAGE

SEQ ID NO: 61065 - protein, 184 aa, Sorghum bicolor
  Clone ID: 9301272.pep
VAAELGNDTTARDREEEVRWFVMGDDDTVFFPDNLVAVLRKYDHEEMYYVGAPSESVEQDVMHSYGTAFGGGGFAVSYPAAAALATAMDGCLDRYRYFFGSDERVKACLSELGVPLTREPGFHQVDIRGDAYGMLAAHPVAPLVSLHHLDHVEPITPRGKTALDAVRPLVGASRFDPARVLQQS

SEQ ID NO: 61066 - protein, 73 aa, Sorghum bicolor
  Clone ID: 9301277.pep
VDGGVAVAHAGTSTAHLARFGVGVRAARVVTRMEESWTIDDVAFNVPGLGPDAFIPPEEVRRSRSYGAAIAGG

SEQ ID NO: 61067 - protein, 118 aa, Sorghum bicolor
  unsure (1)..(118): unsure at all Xaa locations
  Clone ID: 9301330.pep
GERLGKTTIAAWXGKEEKTAAHSTSTTAYKAVDINRENRAADWQEAEKAKYLARFQMEEAKIQAWENLQKAKIEAEMKRIEAKIERKRAREQDRLASKLAAVSHRAEAKREAAEVRRN

SEQ ID NO: 61068 - protein, 68 aa, Sorghum bicolor
  unsure (1)..(68): unsure at all Xaa locations
  Clone ID: 9301336.pep
SGKEGECDKASFRAASTVHTVRVMAPRMSESDWRRAPRRQXXKTKRTRWGSVLEVRIRRCGRGELTSP

SEQ ID NO: 61069 - protein, 87 aa, Sorghum bicolor
  Clone ID: 9301342.pep
MDMDMDQHRLGEYEGDGDEEDEEEEGGSSMDGDGDDASVASEGDCSVGTAEKSTVGRLVRFIGEKVWGAWNLIGLPHLRRRSPVLVD

SEQ ID NO: 61070 - protein, 175 aa, Sorghum bicolor
  Clone ID: 9301378.pep
PSPVVRKILDSVPKSADASKYLVQTPAGDILQVWRSREEVDSEIPAEYPPDYVVDESIGPQDPCLELNTIEMQLYKVDLHGHRVELIKSLPEYALFLGYNGSMCLPVKDFPGLKPNCAYMTDDSMEYINFWKHNRREIGIWSLAERSMSKLVDASQTIYPWLNWPSPIWIQPSFL

SEQ ID NO: 61071 - protein, 170 aa, Sorghum bicolor
  Clone ID: 9301394.pep
ILIQGSFGSCNWNEYNLNPLTRNNWRASLVTLLALLEDQQLQHVITVTADLHAQLTAVTQRVTQMSALNKQQLTQLSRDVMLLIAQLQTLLTNTEQHARHSLNTTSHVITQLNHVLEARSKRHSKNSNSATSTPSGDSTATNNSSGEESSGTTPPTPAHNTAKSEDGRVF

SEQ ID NO: 61072 - protein, 114 aa, Sorghum bicolor
  Clone ID: 9301401.pep
MKISQLQLTATRFSKENNSDEDDELLSELRDKWDAMENKSSLALYGAGAILTVWISLVVVKSLDSVPLLPGLLELVGLSYSGWFVYRYLLFQENRKELAELIDDTKRKIIGDDD

SEQ ID NO: 61073 - protein, 194 aa, Sorghum bicolor
  Clone ID: 9301426.pep
ARGWDCFSSSISRSSSPNTIEDLWFPNQSPNSSPQIQCQSPSLDRNIPLISEDANGKALTTLDDFPAASAFTGPRRQNSDGESARDHDLYKKAAPFEDGLYHCPWEGQPSCNHRPEKLKCNYDKFVDSHLKPYRCKADSCEGARFSSTACLLRHEREAHGLHGHGDKPFLCVYEGCERAVHGNGFPRQWNLRDH

SEQ ID NO: 61074 - protein, 92 aa, Sorghum bicolor
  Clone ID: 9301440.pep
MAAGAGKSSKEADPARCRRHPKHRHAAGVCPFCLRDRLSRLSAAAASSGSGRSARAAGYASASPSSSSASSPPCSSWEATVAQSSSAQAPRP

SEQ ID NO: 61075 - protein, 117 aa, Sorghum bicolor
  Clone ID: 9301486.pep
TPPAPACAPRRRRSASLRPPSTRRLSCASHRGGAAAAAASRSCPASPSSPPPPLPPAPLGGPRTAQPPPSPPAAAAARGSRGGPAAAPVPTTTGLRSPPTTSTEGRRPTMMMVTRTR

SEQ ID NO: 61076 - protein, 110 aa, Sorghum bicolor
  unsure (1)..(110): unsure at all Xaa locations
  Clone ID: 9301511.pep
EAQAKFELVSASQVMAPAGKLEGGVGLGQLRHSGLLFHPSRSIPAVIHENLERXCLAPLGSTISDWNDFFWAVHPGGRAMLDSVEETLELSPGKLTASRRVLAEYGNMSG

SEQ ID NO: 61077 - protein, 87 aa, Sorghum bicolor
  Clone ID: 9301555.pep
LAIEAMADGGVAAGLPRDLALGLASQTVLGAATMVSQTGKHPGQLKDQVTSPAGTTIAGIQELEKGAFRGTLISAVVAAAKRCRELS

SEQ ID NO: 61078 - protein, 65 aa, Sorghum bicolor
  Clone ID: 9301589.pep
KNKALFLCHHTTPPRPKYKEEGPLEQNNLLCGAEVLRLVRFRFFRRATLGFDFIISLLGRLFLLL

SEQ ID NO: 61079 - protein, 84 aa, Sorghum bicolor
  Clone ID: 9301631.pep
RRGEASAGSGGGRAQGPLAAPPPSASLLKVSGSPNSAATTDPPLDGSPDAQVFGASRHVTSPPLYSSKNRSRAENIPSLPAQLE

SEQ ID NO: 61080 - protein, 201 aa, Sorghum bicolor
  unsure (1)..(201): unsure at all Xaa locations
  Clone ID: 9301642.pep
RKCLECIGRPVAESRRDALGRGSRVLRRLLSAAEVELVMRSERECAANQLRAEDVYVNGTKLSPEELVVLQGCPCPPSRLRPGFYWYDKVSGFWGKEGHKPHCIITANLNVGGSLDQKASNGNTGILINGREITKSELQMLKLAGVQCAGKPHFWVNADGTYQEEGQKNXKGKIWDKPIVKLLSPVLSLPTPNKAANQSSE

SEQ ID NO: 61081 - protein, 66 aa, Sorghum bicolor
  Clone ID: 9301643.pep
MAAPTVVLLPVWGAGHLMPMLEAGKRLLTRGGRALSLTVLLMPAPTEEVAAELDGHVRREEASGLD

SEQ ID NO: 61082 - protein, 115 aa, Sorghum bicolor
  Clone ID: 9301653.pep
VVVVAALPPAFMIIAVDDESIRLLASAAAGKRTGRPVATTMAAAKRTAARRAVAAWQRRRLVRLRQVTAPIIARGGRRARTHGGLALGRRHCTPAAAPAAEATSLSVVRSRKLAS

SEQ ID NO: 61083 - protein, 57 aa, Sorghum bicolor
  unsure (1)..(57): unsure at all Xaa locations
  Clone ID: 9301766.pep
ESAGAVRREGPRCGPPPPAPPRGPLPSGAASRRAPPXPAPPPVPIGAASGGGFLHGG

SEQ ID NO: 61084 - protein, 165 aa, Sorghum bicolor
  Clone ID: 9301772.pep
TRIEKIRRVADNCSSLQGFLIFHSFGGGTGSGFGALLLERLSTDYGKKCKLEFAVYPAPRVSTSVVEPYNAVLSTHSTIENSDCTFLVDNEAVYDICRRSLDIPRPNYEHLNRLIAQVVSSITSSLRFDGALNVDLNEFQTNLVPYPRIHYPLISYAPVISAKKS

SEQ ID NO: 61085 - protein, 178 aa, Sorghum bicolor
  Clone ID: 9301793.pep
MAPYTAKWGILATGGIAECFTKDILTDPTARDVSDVQHEIVAVASSSSVDRARDFIKKIDGPSSAAVYGSYAELVADPNVDIIYVATPHSHHFQNAMLALEAGKNVLCEKALTVTAAQTKKLYEVAKSKNLFFMEAVWTRYFPLSIKIRELIQSGIIGTVHRTFADLSFNKNTDSQDL

SEQ ID NO: 61086 - protein, 166 aa, Sorghum bicolor
  unsure (1)..(166): unsure at all Xaa locations
  Clone ID: 9301809.pep
FFILRVLRVGFFRDSWPIRSFNQTQKASTTFFTMANFSKPASMMTMLVALLSILQFTVAFQHGSHHHAHPARHADSAIEAHINEIEGELTKRQSQQGFITITGVCSSGTASNGQCNGGNTAAPRLELRTLARNADQWNLYLLXMERFMAKDKNDRLSYYQVSGVHG

SEQ ID NO: 61087 - protein, 199 aa, Sorghum bicolor
  Clone ID: 9301835.pep
SLYHVQPETEKEAPKVVASINKYRTGADESTSIICQFPKHNSVGIATTSLRIATDVDGLYTGGPAIRIQGSKGEIQVTGPAFRPTEYKVIKSDANGKVEVVNCPIPTDPKRNNWGHGMFWEADECARCLRDGKKESASMPWSESIVIMEVMDSALKQGGVSYPDLITTDIFDPNSPLNTGKKMKIRRVMLGMILELMMK

SEQ ID NO: 61088 - protein, 135 aa, Sorghum bicolor
  Clone ID: 9301856.pep
EAACAPKKKMARGVEVPPRRKLNFDSGDYPVKRLSFDISDSEEEDQYLQVIHKMILDILIVDGPLDGQQETGKNVTDSGLHGSCKTPDSKPLLTGIASTCPGAPLRPSLKALKLSPDICRKIDFDAVSDSNKENN

SEQ ID NO: 61089 - protein, 175 aa, Sorghum bicolor
  Clone ID: 9301867.pep
ISAKKSSHESFKVSDLTFQCFEPNNQMVVCDPRNGKYMAVALLYRGDIVPRDCSAAAGALKAKSSFNLVEWCPTGFKLGINYTKPISVPGSELASVDRSVAMLSNTTAIAEAWSRLDHKFDLMYSKRAFVHWYVGEGMEEGEFSEAREDLAALEKDYEEVANDSLDDEGIEEGEY

SEQ ID NO: 61090 - protein, 181 aa, Sorghum bicolor
  Clone ID: 9301870.pep
KDPSYTIIQMLLSRPHHTLSLRNGFTTLHLRVQEVTRLVNVLDGLLGDTVALLLPRHGWVGEDTVGGALGHRAVAARLVVLIAVWQRDVERAGDVLEGLSSREVSSDALENLVRSAQVRKLIVRSSRLGLVALDADVKVGDVVRVKLTVNTNNLVVEVLLEVGLNVFGTERLELTSGFLSL

SEQ ID NO: 61091 - protein, 189 aa, Sorghum bicolor
  Clone ID: 9301892.pep
TWGYIEAIREIEQQIQQSADVQFDDIVVACGSGGTIAGLALGSRLSSLNTKVHAFSVCDDPEYFYDYAQGLIDGLDSGLDSHDIVSIKNAKGLGYAMNTAEELKFVKDIAAATGIVLDPVYSGKAVYGLLKDMAANPTKWKGRRVLFIHTGGLLGLYDKADQLSSLAGSWRRMDLEDSVPRKDGTGKMF

SEQ ID NO: 61092 - protein, 61 aa, Sorghum bicolor
  Clone ID: 9301894.pep
SNQAISMRDKTNFEEFHTHYQLLNLRIMPICNNHALPFSSVPDHQSRSQKVTHPDVQHESN

SEQ ID NO: 61093 - protein, 63 aa, Sorghum bicolor
  Clone ID: 9301901.pep
DTLSKEKYMSKEEKQTSINHFHEKLFKLKDMMKTEAGKRRAEKRHRFMEDFVAEFYEEWSGRA

SEQ ID NO: 61094 - protein, 204 aa, Sorghum bicolor
  Clone ID: 9301906.pep
GAKCVVTVGAWTTKLLRSVAGVEIPIQPLHTLTLYWRIKPGRERGLNAKAGFPTFSSYGDTPVYGTPSLELPGLIKISCDGGPPCDPDNRDWASGDREITDRVARWIAEFMPGHVDSAGGPVVRQSCICSMTPDKDFVIDWLGGAFGEDVVVGAGFSGHGFKMGPAVGRILAEMAIDGEAKTAAEAGVELGHFKINRFNGSKDN

SEQ ID NO: 61095 - protein, 171 aa, Sorghum bicolor
  Clone ID: 9301917.pep
MTGKKRTFVLYPSLGVGHLIPMVELAKHLLRHGHGALIAVVDPPDTDAVSAAAVARLAAANPAIAFRLLPAPASPDVVGVHPAKRDKDTLQLANPALRDLLRDSLPGAVDALLLDMFCVDALDVAAEVGVPAYFFFASAAGDLAVFLNLPYLYPTLPSSFREMGETLVRCP

SEQ ID NO: 61096 - protein, 156 aa, Sorghum bicolor
  Clone ID: 9301924.pep
MATKPVTVGDLIHRVTTSCLSNRLPCNYTLRDSVDSDLDDDDDDPFADAVSSSEKCRRSPSAAEAEEIEEEEGDEEEEKLKIWEEGEQEKERVAAAAKGAERARDADALMAEVFDAVSGVRRAYAALQGAHCPWDPDKMRAADAAVVAELRHLARL

SEQ ID NO: 61097 - protein, 199 aa, Sorghum bicolor
  Clone ID: 9301928.pep
TRGRYSFFLIVAAATFCWEWVPQVIAQFLQLFMFPCWIAPNNIVVNQIFGGNTGLGLLPISFDWSIISGFLLSPLQTPAFAIANVSAGIFVMLLGIIGLAYAGPEFYRYLPLSANQNFDHYAQPYNTSRILNPDFTVNLTAYREYSPILLGPAFSLSYGMGFAGLISTITHIVLFYGPDVWRRSIDSRSEEPDIHMKLM

SEQ ID NO: 61098 - protein, 184 aa, Sorghum bicolor
  Clone ID: 9301930.pep
MGSSGGGGSDGGGDRQAQPLLGKLSESESSYSSSDEHLVNRTGTVWTAMAHIITAVIGSGVLSLAWSVAQLGWVGGPAAMVFFAGVTAVQSTLIADCYISHDPERGVVRNRSYVDAVRLYLGEKSHLFCGFFLNFSLFGTGVVYTLTSATSMRAIQKANCYHKGRHDAPCSVGGDVYYMLVFGL

SEQ ID NO: 61099 - protein, 84 aa, Sorghum bicolor
  Clone ID: 9301931.pep
LASKPTHVYGKPWFRCEWEPNGASSSSPPMRAAKTYHMLPDWGYGRVYTVVVVNCTFPRVPNADNAGGRLILYAHYGPSRGMGN

SEQ ID NO: 61100 - protein, 77 aa, Sorghum bicolor
  Clone ID: 9301942.pep
ARGRKAAMPGGASAAIFLSILFPPTRCRRAKNRCERVDPSVLPQAVRHPFIGAWAHLWSGGDKNSMGSYLGGGASAL

SEQ ID NO: 61101 - protein, 196 aa, Sorghum bicolor
  unsure (1)..(196): unsure at all Xaa locations
  Clone ID: 9301946.pep
XKSSLLRTLTDISFPVMAGIGTRFPIRVISRRSPSSRGSRERFRISLERAPRDVNGLQRADAAADDYRLEGDTLTMDVFEAALKDLSENKIGIRKGQGIGAKNFVPDIVRVELEGPNRSPFNILDLPGLISSEYGVNEPEPLGTQELAKEYISRQENTIICTIPATSDLGNQRAYQICKEHISDKRRLVGVFTKCD

SEQ ID NO: 61102 - protein, 176 aa, Sorghum bicolor
  unsure (1)..(176): unsure at all Xaa locations
  Clone ID: 9301961.pep
LRRPPEGGPPPPPPPKGPSPPPPPPPGGKKGGPPPPPPKVXASASSSRPPTAPGMPSGAGEQQAKLKPLHWDKMNVQSTDHSMVWDKITGGSFNLDEGIIEALFGTAAANRKPKSADTKESAGSSALGRSNTPEQIFLLEPRKSHNISIILKSLTVGRDEIIDALRDGHTELSTEV

SEQ ID NO: 61103 - protein, 169 aa, Sorghum bicolor
  Clone ID: 9301967.pep
MPPPSPSPPLSYTTPPSLNAFFCKPAEFRSTHPPIQHLIAGALVTNLQGQILILRRAAHDSWPLLWEVPGGCVDEADTDLIAGAVRELWEEAGLRAKTVKGIVGIAPITEPMPDDPLEKDLEVLYDMLVFRAHDGVWGKLTIWVDVESYEDVKIDKDEHVEFAWVTKEE

SEQ ID NO: 61104 - protein, 185 aa, Sorghum bicolor
  Clone ID: 9301971.pep
MLAASLLALRLLLLVGTAAAGAVGMSGGGQLWCVAKNNAEDGALQSAIDWACSVDGGRADCAAIQQGGACFDPPDLQQHASYAFNDYFLRSGGAASPAACDFSGAAALTALNPSHGSCVFPSSASPKNGSFTGTTTYGPTGADFSNSFSWKLNFWGRLSLSKLPVRRRLLAGAGPPSSTNPAPAE

SEQ ID NO: 61105 - protein, 175 aa, Sorghum bicolor
  Clone ID: 9301972.pep
MAAAPLLLLLLLAMFTASDAAFCVCKTGLSDQGYQAAIDYACSKGADCASTKQGGPCYGSGNKAAVCSYICNSYYQMRSGMGATCDFNGVATLTGSDPSSGTCKFASGPSSAGTGGGAGMGTGGAGAGTGGGMGAGTGAGAGTGAGTGAGTGMGTGTGTSTGAGTGTGTGAGITT

SEQ ID NO: 61106 - protein, 199 aa, Sorghum bicolor
  Clone ID: 9301973.pep
ARGDAIDKLETLPAWQPTATGANAVAPPSSSTHPDSAENSDDEAQAITVAHTAFDFPGAAGAGGGGSGAGFLPSSLDSDSIADTIKSFFPMAGTGGGEASSSTAATQSSAMGFQSYTPDLLSRTGNHSQELRLSLQSLPDPMFHHQHQDRSQQGHGGNGSAQQALFPGAASYSFVGGGGGTMWGEQAQSQRMLPWNVPD

SEQ ID NO: 61107 - protein, 154 aa, Sorghum bicolor
  Clone ID: 9301989.pep
LGRLLPAGFLDRNRGRGMVVKNWVPQAQVVRHEAVGAFVTHCGWNSALEAIVSGLPMICWPLYAEQALNKVFMVEEMKIAVALGRYEEFVRAEEVEAKVRLVMEAEEGRILRERLAVAREKALEATRECGSSQVAFAEFLRDLDKSSSVNGECN

SEQ ID NO: 61108 - protein, 132 aa, Sorghum bicolor
  Clone ID: 9301992.pep
LKHADHTPESSFVHRLLLSLHDLQQKHGLYHHMDIFLGEILGAVYLVEGLNIKPSLQLKPISIVANNTTNMDGQIVINMQSASSVKVLSDFNTEDYYSRIANSLGHKERSAVIGSFEEQTAIWSRPPLKLET

SEQ ID NO: 61109 - protein, 107 aa, Sorghum bicolor
  Clone ID: 9301996.pep
VLGDGEHRRVVNGGAHPRTPFYGEFLRAAKAVWLLHLLAFALEPPPSHFEAGRGAEFHQEYMESVTGAPPHAGAGMVVGFAVTPGFRLGNGAVVRARVYLVPRGGRP

SEQ ID NO: 61110 - protein, 203 aa, Sorghum bicolor
  Clone ID: 9302001.pep
FVCPNSEGTMILHHELKDRLHSMFCETLSKAQQELDKYCEQETQKELLLTTHEDFSTKLEGWRMLRYARAFYRGVGGDEPQDLISGQTLLNMWKEMDSSKKDRMVYDIHDVIKVYYGIFLESFISHITQTIMEGFVMDKDGPLRKMTTEYVLSLPKQEVSDMTREDKTAGQRRAQLNRDIKGLEGDQEIAKEARVKVEALKRD

SEQ ID NO: 61111 - protein, 48 aa, Sorghum bicolor
  Clone ID: 9302018.pep
MSNTHRLLFLHCCSKNKFRSELLKVSEVTTNRAIASGHSFINIQPALG

SEQ ID NO: 61112 - protein, 164 aa, Sorghum bicolor
  Clone ID: 9302029.pep
GLTCPNARTFYNASVIWGVIGPKLVFGAGQLYSWINWFWLIGFACPLIQWIIARRYPRSMARYVVFPALFGAAGMIPPATTWYLAQWCIVGLIFNWYIRRRWLGWWTQYNYVLSGALDIGTAICTVIIGLGLGLGNASFPDWWGNTVINNNLDANGDAIMRVAP

SEQ ID NO: 61113 - protein, 102 aa, Sorghum bicolor
  Clone ID: 9302030.pep
VPLLGTRRVNAFRLCFRTAYVAATTALAVWFPYFNQVIGLLGAFTFWPLAVYFPVEMYLTRNKVAPWSNQWLAVHGFSLVCLLISAFASVGSAVGVFGSETS

SEQ ID NO: 61114 - protein, 74 aa, Sorghum bicolor
  Clone ID: 9302031.pep
TDEFLPHPPLLHKKIDQNRFPVRRMNFVSHLPAHHTITKQKAHNYFQFQKIVETPSFPGQTKPLDGMSHFMQKS

SEQ ID NO: 61115 - protein, 135 aa, Sorghum bicolor
  Clone ID: 9302047.pep
LSLSPDNLLFFCSVTASVAAAFALVSLCRHLAHRRPQQEPSAYDGGLAASSGGRGSAESSEEEDQLLPLSAAAAALPPFMYNRLVRHSGKGASWTETECAVCLGVIQVGAMVKLLPACSHVYHRDCIDLWLSLSS

SEQ ID NO: 61116 - protein, 62 aa, Sorghum bicolor
  Clone ID: 9302049.pep
DNPMQQQHGGGLSPTVSAIGFTPGIGFSGMRIPTRIQGDEEHNGGSGNGDKPPPSVSSASHH

SEQ ID NO: 61117 - protein, 83 aa, Sorghum bicolor
  Clone ID: 9302062.pep
MEEYDGLFPSAYVDSSSSLLVPNGTAQGERPRARRRRRRAPRCGGGGDLNGGGDPKKRRLSDEQVEMLELSFREERKLETGRK

SEQ ID NO: 61118 - protein, 61 aa, Sorghum bicolor
  Clone ID: 9302071.pep
EIMPATAPVNAPVRAPATPKRPVRAPETTPASSLGRCSATPRSSSASSSGAGAGASATSMV

SEQ ID NO: 61119 - protein, 190 aa, Sorghum bicolor
  Clone ID: 9302075.pep
MSKVVAKPTKVAEPEVEVPASGGDDLSLDGAYNTVMLAYHNIHRLNHSASALEWDDELAGYAENTANGCVFEHDMNQGNGGYGQNLASWGATSDIDGLKNKAAAGGITNQWYNNEMANWAFYGQENPPADMNIDLYGHFTQVVWKDSTKVGCATVKCPAGTVLSFPSWYTVCNYNPQGNFGGRYGDNVLK

SEQ ID NO: 61120 - protein, 158 aa, Sorghum bicolor
  unsure (1)..(158): unsure at all Xaa locations
  Clone ID: 9302081.pep
SGDGDGGPSSDFHVDSEGLQRQIDELASFSDSPAPSVTRVLYTDKDVQARRXYIKGIMNQLGLAVREDAVGNIFGRWEGSEPELRAVATGSHVDAIPFSGKCDGVVGALGALEAISLLKRSAFLPKRSLEVIMFTSEEPTRFGISCLGSRLMAGIEEL

SEQ ID NO: 61121 - protein, 135 aa, Sorghum bicolor
  Clone ID: 9302101.pep
MEPAAKTVERLAQRLVPPAEPTPTGPHRLSWLDRYPTQMALIESLHVFKPDPARDGVSPAATIERALARALVDYYPLAGRLAVSAGGQLHVDCSAEGVWFIEAAVRCRLDDVDYLEYPLQIPKDDLLPHPLPRPS

SEQ ID NO: 61122 - protein, 180 aa, Sorghum bicolor
  Clone ID: 9302109.pep
MDEYFVDLPYPNLCLYGSCLVLAVVVARAIILSGSGKKPGGLPPGPWQLPVIGSLHHLLRGLPHHAIRDLSLRHGPLMLLRICERTAIVVSSAEAVAEMLKRHDAAFSERPSSPGIEELSRHGQGVIFAPYGDHWRLLRRILMTELLSPRRVEAFRHIREDEAARLVSSLSSLPQPVDMD

SEQ ID NO: 61123 - protein, 195 aa, Sorghum bicolor
  Clone ID: 9302124.pep
MGSRHGLRRGGQAAAVFSACPFLAFAVLLALPGLAAGDTHYYTFNVQMTNVTRLCVTKSIPTVNGQFPGPKLVVREGDRLVVKVHNHINYNVSFHWHGVRQLRNGWADGPAYITQCPIQGGQSYVYDFTITGQRGTLWWHAHFSWLRVHLYGPLVILPKRGEGYPFPRPYKEVPILFGEWFNADTEAVINQALQT

SEQ ID NO: 61124 - protein, 121 aa, Sorghum bicolor
  unsure (1)..(121): unsure at all Xaa locations
  Clone ID: 9302126.pep
TRIKPTSSASCSSTLLLEPSGSNRSNAAPPPQAPPPRRRPPXPTAAPMMRPSRGGPTPPPSPPPPPPLTASSSSSPSPASPSPPPPSPSPSPPAVTASPCRSLRLLSPSAADAPRTRSAPS

SEQ ID NO: 61125 - protein, 206 aa, Sorghum bicolor
  Clone ID: 9302129.pep
TRALRPNLTGGAMPRTAGGYSLGGGARYFSHTPTAPAQVVQNVSQAMRAFFLSGQRIRYDGTGPRGEAQYRAVSVLEDEAMRKLAAIPKFAPGAYVDFQLSPTITAMSPLAAALVQASTASGFQAETAIPSLNTEGFLDVLSADFGRALKDLTAIYADLERLSSLGDLPISLESGNLLRVRFPGVDVETVERLCDDIGIQRGIVSQ

SEQ ID NO: 61126 - protein, 176 aa, Sorghum bicolor
  Clone ID: 9302136.pep
KRGSLGGTCLNVGCIPSKSLLNNSHLYHQILHDTKNRGIEVGDVKLNLANFMKAKETSVSGLTKGIEYLFKKNGVEYIKGAGSFVNEHEIKVDLNEGGETSVRGKNILIATGSEATPFPGLEIDEKRVITSTGAIALEEVPETMTVIGGGIIGLEMASVWSRLGSKVTIVEFLGQI

SEQ ID NO: 61127 - protein, 149 aa, Sorghum bicolor
  Clone ID: 9302140.pep
AMAELIANPRVMHKAQLEIRRVMAAGQQRRVHEATLRDLHYLKAVIKETLRLHPPAPFVPRVCLDDGIKIQGYHVPRGTIVVANVWAISRDPKYWEDPDMFIPERFHQGDPDHHRCFDFKGFDFEFTPFGAGRRMCPGMNFAHMNVEIA

SEQ ID NO: 61128 - protein, 93 aa, Sorghum bicolor
  Clone ID: 9302147.pep
MISGSGGFGELARAIETFADMYERMEAAKQRHAEEMERQRIKFLKDLELKRMQAFVDMQLQLARAKHARKGDASSEMLMSLAALPFLSSPAYL

SEQ ID NO: 61129 - protein, 137 aa, Sorghum bicolor
  Clone ID: 9302148.pep
TRLYPNLVTKEDVLTADELAPFKNFFSRLAALDFIACASADVFAVTDSGSQLSSLVSGYRIYHGRGRAPTLHPNRKRYAQVLSEEESIAWGGFQRRVRQMVEEYKRVSPRPRGRSVYRQPRTPGCMCRAAGDGSVDF

SEQ ID NO: 61130 - protein, 57 aa, Sorghum bicolor
  Clone ID: 9302149.pep
KALTSPGGSERSLEGHELDDISSLGDESFVHEAFAYENSEDPWCSETDGYESMSPPT

SEQ ID NO: 61131 - protein, 159 aa, Sorghum bicolor
  Clone ID: 9302159.pep
YLSSPYFRRMLFEMNCFWSGGSIIFAAVITAIIFTVSEPVAFTLGWTLPFAWAGVWTLITIPWVQSDLRREKQAWVENRGQGGIPYVDDIAAPTARTRFASVQEAFVPWTRGKEAAPSAPQRATRMTSQLSHPKMEKSQTPTSKRQRKSLRRSRPMPRL

SEQ ID NO: 61132 - protein, 166 aa, Sorghum bicolor
  unsure (1)..(166): unsure at all Xaa locations
  Clone ID: 9302164.pep
LEAHYQRXYAGVLLADFPTTPPHPFNYTGTPPNNTFVQHGTRVVPLRFNTSVELVLQGTSIQGAESHPLHLHGYDFFVVGQGFGNFDPVNDPPNYNLADPVERNTISVPTAGWVAVRFLADNPGVWLMHCHFDVHLSWGLSMAWLVNDGPLPNQKMLPPPSDLPKC

SEQ ID NO: 61133 - protein, 112 aa, Sorghum bicolor
  Clone ID: 9302165.pep
ELLGNEYFMHASGSLYALSSEVVEALATTKSDSLRMFDYEDVTVGAWMLAMNVKHEDNRAMCDSICTPTSIAVWDSKKCSGTCNIADKIKQLHNTTVCSKSPTLPPEVEEEE

SEQ ID NO: 61134 - protein, 62 aa, Sorghum bicolor
  Clone ID: 9302171.pep
TTSTATVSFFSSFRFSMYVTHHRTLRSSLLNMGPTGHRFSSHGLDFTCLASMKMISDRVEGA

SEQ ID NO: 61135 - protein, 116 aa, Sorghum bicolor
  unsure (1)..(116): unsure at all Xaa locations
  Clone ID: 9302176.pep
NDVIEKIRRSATQISKNRGVXLSECKIISQDPPALSAKSVVDAMEFAAQQLNLEYKQMISRAYHDSLFMARVSPMGMIFIPCYKGYSHKPEEYASPEDMANGVKVLALTMGKLSLE

SEQ ID NO: 61136 - protein, 92 aa, Sorghum bicolor
  Clone ID: 9302204.pep
RVGTFPFAANSRAKTNLDTEGMVKMLADPETDRLLGVHIIGPNAGEMIAEGTLALEYGASSEDIARTCHAHPTLAEAFKEAAMATHAKAIHY

SEQ ID NO: 61137 - protein, 166 aa, Sorghum bicolor
  Clone ID: 9302243.pep
ITIPGALVSGNWNEYNLNPLTRIHWRASLVLDEPTSGLDSTAAARLVATLSALARRGRTVVLSVHQPSSRVYRMFDSVLLLADGSCLYFGAGRDAMDYFASAGFAPGFHVNPADFMLDLANGFAQADYNVTAEGGNNVKQSLISSYNKVLAPRVKASIVAADHAQS

SEQ ID NO: 61138 - protein, 175 aa, Sorghum bicolor
  Clone ID: 9302257.pep
EVNNPSRLPSISPEFTDPDRPASQSKYRTEPGFVLDLAAAAAPSSQIKANMQKHKVALCQLAVTPDKDGNIARARARVEAAADAGAKLVVLPEIWSCSYAMETLASYAEDIDGGESPSISMLSEVAAAKKITIVGGSIPEKASGKMFNTCCVIGPDGKILAKHRKVSTAAGEAVV

SEQ ID NO: 61139 - protein, 158 aa, Sorghum bicolor
  Clone ID: 9302271.pep
MALSSSRPHHLLRGFHASARALARAEPHEFAKPSGYLGSWEPAAEPREAWARLDRLRKGYARDVRQLRRQYAYEVQLMDAERQRKADARAEAARIANQERKAAKLAAAQTRAAERRAFEEDFRQTLMKERAEKLESWRKKEKLKEQKKAEQKELLRRK

SEQ ID NO: 61140 - protein, 97 aa, Sorghum bicolor
  Clone ID: 9302289.pep
RPATFKASSQALEISSLVLSGNVTLNSTKRSSSSPQLSFLINENILGKCFRSCSSFINPRISPLTMKYECPRLSLLIITPIPKANTIGPESYDVIPC

SEQ ID NO: 61141 - protein, 64 aa, Sorghum bicolor
  Clone ID: 9302317.pep
FASIPGDADATTTASFVVKSSPSTPACPPEPRIPVDRFRRARRPDLAFNVTGRPAGIVNGQTRP

SEQ ID NO: 61142 - protein, 96 aa, Sorghum bicolor
  Clone ID: 9302328.pep
RPPPASSTPPSGQVCVAGTVADGESGNYIGLCQFSCNYGYCPPGPCKCTAFGAPISPPASNGRNGCPLPGEGDGYLGLCSFSCNHNYCPPTACQYC

SEQ ID NO: 61143 - protein, 159 aa, Sorghum bicolor
  Clone ID: 9302330.pep
LYGTCVTDVGRIGIGICHDIRFPELAMLYRSKGAHLICYPSAFNMSTGELLWDLRQKSRAVDNQLFVATCSPARDRNVNSDYMIWGHSSLIGPFGEVLAAAGHEEATVIGEMDLTTIQSTRENLPLEMQRRGDLYRLIDVMVNDSMKSRSDKLCLKMPA

SEQ ID NO: 61144 - protein, 168 aa, Sorghum bicolor
  Clone ID: 9302347.pep
ARGQHRDLIHHHYIPHLIDEATRMRLKSRERRLYTNRATGPGDDHHRLWTSHAFSHPSTFDTLALDPTLREEIRADLLRFAARRDHYARVGRAWKRGYLLHGPPGTGKTSLVAAIANLLEFDVYDLELTTVPTNSHLRRLLVSTTPKSVVVVEDIDCSLDLSDRNKKK

SEQ ID NO: 61145 - protein, 145 aa, Sorghum bicolor
  Clone ID: 9302356.pep
LARGGARWPARPRAAASVRLVAARPGRRRRTRVVAAAAGERTASGPGPEPMMVEAANGSSSAVAGISTLLTSTVGKSTNILWHDCPIGQNERQNLLNQKGCVVWITGLSGSGKSTLACALSRELHIRGHLTYVLDGDNLRHGLDR

SEQ ID NO: 61146 - protein, 148 aa, Sorghum bicolor
  unsure (1)..(148): unsure at all Xaa locations
  Clone ID: 9302395.pep
MVRCLKSIKEXAFCASPYPLVITLEDHLTPDLQAKVAKMLTETFGDLLFIPSSDPMKEFPSPAALMKRIIISTKPPQEYKEFLKVKDNQNGSGNIADLPDTGSLRRIDSNADNQNGSGNLAADTGSLRRIDSNADESDGKDELDEQDE

SEQ ID NO: 61147 - protein, 78 aa, Sorghum bicolor
  Clone ID: 9302397.pep
VVARALTRFSVKNAVRFCFWTAEEFGLLGSEYYTSHLDAAELAKIRLYLNFDMIASPNYALMIYDGDGSAFNQTGPAG

SEQ ID NO: 61148 - protein, 133 aa, Sorghum bicolor
  Clone ID: 9302399.pep
MVAIARSFSAARVAARGFSNAARQPQQSTLVAARSAFRNNAARNVIQKRGIVAESTAAAMVAAAKIQGAGLATIGLAGAGVGIGTVFGGLIQGVARNPSLRGQLFQYAVLGFAFAEATGLFALMMSFLLLYVA

SEQ ID NO: 61149 - protein, 148 aa, Sorghum bicolor
  Clone ID: 9302405.pep
QVRRARGQLETNTSSSWHLRPMARTTMSCSFFHPSPCAHYYVQSPSAASHTLSHPASDSMALILSPFPNLHHDADARRHSSDGRDHDHDHDHEEASRLTLSRYSSSRGSNSSFPVGDKKPGRRRQVLRVVSGRSSGHHGDGGDEDEDG

SEQ ID NO: 61150 - protein, 118 aa, Sorghum bicolor
  Clone ID: 9302414.pep
YNTTSLVVVVFRVFSHTSYKDHQAHHHNMAMVVLLLLSLLPLSTLGSRSGPTPAVPHHGHAGHGTPKHSSPPPQPTTAELVRSTCNSTAYYDLCVSALGADPSSATADVRGLSTIAVS

SEQ ID NO: 61151 - protein, 134 aa, Sorghum bicolor
  Clone ID: 9302430.pep
VHPPGPLLSWARLAVHDAVVGGHLVPAGTTAMVNMWAIARDPAVWADPTAFRPERFEEEDVSVLGGDLRLAPFGAGRRVCPGKTLALATVHLWLAQLLHRFQWAPADGGVDLAERLGMSLEMEKPLVCKPTPRW

SEQ ID NO: 61152 - protein, 49 aa, Sorghum bicolor
  Clone ID: 9302431.pep
SRGSFSTMHIHGHHQNNPDSWYQANFILRWSQKYTLCRSQYMTLPQQCA

SEQ ID NO: 61153 - protein, 168 aa, Sorghum bicolor
  Clone ID: 9302432.pep
GCVPEALGFLPSIEVLDLSYNALSGHVPGTLSCLSGIEVLNLAHNQLTGELPDLLCDLRRITNLSVSFNFFSGISQRCDRQLGSRGVFDFVGNCVPGRDMQRPQPECDEFPGEGGLSCLHIPGARPAGCDGGGGGGVTIGVGVGVGVGGLPFGLPGAAAGGVVTVTVP

SEQ ID NO: 61154 - protein, 167 aa, Sorghum bicolor
  Clone ID: 9302433.pep
SFSVGKVQRFALGEGLDGSGVETSFLNCNSSVDMVIDNYSKVFTLRVAPPQLDMSFGRFVFAISQGDGWSHDVGPRGTSTVRLFVAAQDKPMYAAGRGMQDLLDSSHGLPLTITVKARSRYRVVGSLVRLTYRHDSQCVVLLRRTPSRSNGISVAAGKATTTCSALS

SEQ ID NO: 61155 - protein, 142 aa, Sorghum bicolor
  Clone ID: 9302439.pep
TADVRGLSTIAVSAAAANASGGAATATALANGNGTATSSNAQAAAPAATAATALLRTCAAKYGQARDALAAAGDSIAQQDYDFASVHVSAAAEYPQVCKALFRRQKPAGGQYPTELAAREEALRQLCSVALDIIALASNTSS

SEQ ID NO: 61156 - protein, 129 aa, Sorghum bicolor
  Clone ID: 9302450.pep
RLMVFTTNHPERLDRALLRPGRMDKKIELGYCTPPALRVLAKNYLGVGDEGCEDADEDPDTVNTLMAEAEGLLAPDEVQITPADIAEVFMGCDGAGAAAGLRKLVGELHRRRDAAAATAVVAPGEETPE

SEQ ID NO: 61157 - protein, 127 aa, Sorghum bicolor
  unsure (1)..(127): unsure at all Xaa locations
  Clone ID: 9302455.pep
AEDRAENIRRVGEVAXLFADAGLICIASLISPYRSDRSACRSLLPKSSFIEVFLNAPLEVCEARDPKGLYKLARAGRIKGFTGIDDPYEAPSDCEIVIHCKVGDCPSPKSMADQVVSYLETNGFLHD

SEQ ID NO: 61158 - protein, 139 aa, Sorghum bicolor
  unsure (1)..(139): unsure at all Xaa locations
  Clone ID: 9302495.pep
SAQSKPKSKSTKSKTKSSSSSKSKKSSSSSKKEKKEKKPQQLIEYRPQSKDGNEPNEGQVVLYKPRADVFLSFVDKGPESEKGVSLNRVLKRFHREREANGSELGKGKEEKELWRSLRLRQNDQGEIVCXSSKRQPSRA

SEQ ID NO: 61159 - protein, 32 aa, Sorghum bicolor
  Clone ID: 9302496.pep
YHIWTLVLIHKIPMKLDVQCVYFHNDDLLMTY

SEQ ID NO: 61160 - protein, 77 aa, Sorghum bicolor
  Clone ID: 9302515.pep
MLSKTSAMEAFAPGTGAYMNEADRLDPNYLENFYGANYGDHLKTKKKYDPDNLFYCGTCVGAEEWVERKDGPLCKKA

SEQ ID NO: 61161 - protein, 148 aa, Sorghum bicolor
  Clone ID: 9302516.pep
IPNSIEGLVSLRGVGPKMAYLCMSVAWGKHLGIGVDVHVHRITNLWGWHKTKNPEETRTTLQSWLPQDRWHEINHLLVGLGQSVCLPVGRKCGECDLGLEGLCKAADRAKVSAGRRLKAEKVESEAQSDTLVKKEVSQNIVIKEEGGA

SEQ ID NO: 61162 - protein, 112 aa, Sorghum bicolor
  Clone ID: 9302523.pep
FCWSRRRRDVNDTGGFGYPCADCIAGAFLEVERACPYRREGFFSNRNCTLELAEISIFGTGGMFGNILKQVMAPGLVLQAIGFGWLFFLLFQEWRSRKRGTSMNSTPLLSGD

SEQ ID NO: 61163 - protein, 102 aa, Sorghum bicolor
  Clone ID: 9302525.pep
HHKRRVLQQPLVDSITKNLCLGGRVFIQSDVLEVAVDMRERFDGYSDILAHVNYVDQDLQCDHEGWLLDNPMGIRTEREIHAELEGATIYRRMYQKIRDASY

SEQ ID NO: 61164 - protein, 122 aa, Sorghum bicolor
  Clone ID: 9302533.pep
ANQKFEVGVFCGKYVTPVDAGYFEHLERIRGESRKQKVMEKAREAVVHGTANPQQVRMAAKGVEVDQHGNVIPSDGNGEPDWQPTNGVSQTSTSDALANGNGEERRVTSSQDISLHNMNDFN

SEQ ID NO: 61165 - protein, 130 aa, Sorghum bicolor
  Clone ID: 9302536.pep
AHCSRFTNRLYSYGGTSSRTDPTFNPDYAGQLKGACPVNVGPTIAVNMDPVSPIKFDNIYFINLQYGLGLFTSDQVLYTDETTRPIVDKFAASQKEFFDAFVAAMIKLGRLGVKTGKDGEIRRVCTAFNH

SEQ ID NO: 61166 - protein, 155 aa, Sorghum bicolor
  Clone ID: 9302543.pep
GKGVKLHAIVDSCHSGTILDLPYLCRMSRTGYWQWENHSRPSGMLAKRTNGGLAISISGCSDDQKSADASGFSDESSSIGAMTDSFIKAVKAEPGTTYGRLLSAMRTRIRDGQGSRRLPGRLGSFVRWMIPSSGVQEPQLCSSEMFDIYRKPFLL

SEQ ID NO: 61167 - protein, 171 aa, Sorghum bicolor
  Clone ID: 9302567.pep
SRALIISHSRFTCMPHIFRSMQLKTRCCRQSTAPLTSEDDPVVVREEDGRQVLDAVAGLPAQHRRARRHRRRVPRVGTTRECIWEAVPFQLVLRDAAQPHDVAAEQVRVRTRLVRGRGGEVVADEKRVVGRRRQEQGRRQWAPRQPPCAGGGRRRHAGVPNANGALELEHP

SEQ ID NO: 61168 - protein, 132 aa, Sorghum bicolor
  unsure (1)..(132): unsure at all Xaa locations
  Clone ID: 9302571.pep
GKTNLSHDGLNPAHVPYWWVNNPTLGEFCFTMIGRADIEGSKSNVAMNAWLPQASYPCGNFSDTSSFKLRRSKGSXATLSRFVFVLEIRIKRAFTLLFHTRFLFSLSSXLGHLRYLLTDVPPQPNSPPDNVF

SEQ ID NO: 61169 - protein, 56 aa, Sorghum bicolor
  Clone ID: 9302580.pep
CCKILYSSCTIAFLVNRYLAPVARQVIVLAAAVLVVEVAPHGAERLPGHLAPDAAA

SEQ ID NO: 61170 - protein, 127 aa, Sorghum bicolor
  Clone ID: 9302581.pep
AAAEVPDFQRAFEHFCIHSGGKAVIDSVARLMGFGPYVVEPARSTLHRFGNTSSSLVFYELAYFEAKRRVRAGDRLWMLAFGTGFKACSNVWRALRDAAPDADNPWNGCVHRYPVPPPPPSKTHKHA

SEQ ID NO: 61171 - protein, 107 aa, Sorghum bicolor
  Clone ID: 9302591.pep
GARGTARATATPPLPATPAAAPAPCATTAPSGCSCTPSPSSSLLPPPPPPQAPPTPMPNATAPPPFQHNPRPGGRRHWSPPLSTTLASGPLRDTRAPQPASSGSARG

SEQ ID NO: 61172 - protein, 182 aa, Sorghum bicolor
  Clone ID: 9302596.pep
HEGPFCKTPNYAVEYRGVKTKEERSIEQFEEQKVIEAQLRMRQKELQDEEAKMKRKQSRCSSSRTVTPTTEVEYRDICSTSFSVPSYQCTEQGNECCSSEPSCSSQANMRPFHSRHNRDDNVDVNLEDMMVMEAIWRSIQEQGHLVNPVCGSYFPVIEPPSRERQAFLPAAPLEMPHPGGYS

SEQ ID NO: 61173 - protein, 139 aa, Sorghum bicolor
  Clone ID: 9302602.pep
MMPRTSLDLGLSLGLSLTSQGSLSSSTTTAGSSSPWAAALSSVVADVAKARDAGAHMLYHASASAAALDRAAMRASTSPDSAAALSSGGSGDNTTGTKRERETELERTGSGGVRSDEEDGVDGAGGRKKLRLSKDQAAV

SEQ ID NO: 61174 - protein, 92 aa, Sorghum bicolor
  Clone ID: 9302605.pep
SEESVTTLEADHSDVQQTAEDHDSCLIDDAQNGIQIIGCKSVDTCKEFDTMKETAQSDTSANVSADAEETVEDGGSVCVTDDAQNGLKFSKC

SEQ ID NO: 61175 - protein, 71 aa, Sorghum bicolor
  Clone ID: 9302620.pep
TARLSLRRTLTPSPLPKYAPSPSCSPSRTTPRTRASTGSLQIEAIASRRDPPVLYKLKPSQVAEIHRFSTN

SEQ ID NO: 61176 - protein, 188 aa, Sorghum bicolor
  Clone ID: 9302651.pep
ARGRERENLLVILQVEKLEAELRRVGEENRRLSEMLRAVVAKYTELKGQVDDMVVATANHTGSSTSEGGSAASPSRKRIRSAGDNSLDTAAQHHHRRKPSPPLAAAVAAHDQTECTSAAVSVTAAAFRRAVREECRPKVSRRYVHADPADLSLVSNGIGRDAVINHRFFFCAPNLRSINSRAAFLNKN

SEQ ID NO: 61177 - protein, 108 aa, Sorghum bicolor
  unsure (1)..(108): unsure at all Xaa locations
  Clone ID: 9302664.pep
PCAMACIALNETTAVVEWQWEGVTRNLATADPDHDAIRFTLRLDCESQSGAHFELSIPFRFKDKPAGAGVRLRINPFFIKSFSYSDVPSPPDAVXPIFNTTTSLDFTL

SEQ ID NO: 61178 - protein, 154 aa, Sorghum bicolor
  Clone ID: 9302670.pep
LALAVRETKQQLYLAGPLVVGFLLQNLVQMVSVMFVGHLGELALASASLATSFAGVTGFSLLAGMACSLDTLCGQAFGAKQYYQLSVYKQRAMVVLTLVSIPVSVVWAYTGEILAWCGQDPEIAAAAGIYIRWLIPALFLFGALQCHVRFLQTQ

SEQ ID NO: 61179 - protein, 123 aa, Sorghum bicolor
  Clone ID: 9302672.pep
MGRSPCCEQAHTNKGAWTKEEDQRLIAYIKAHGEGCWRSLPKAAGLLRCGKSCRLRWINYLRPDLKRGNFTEEEDELIIKFHELFGNKWSLIAGRLPGRTDNEIKNYWNTHIKRKLLARGTDP

SEQ ID NO: 61180 - protein, 97 aa, Sorghum bicolor
  Clone ID: 9302675.pep
HEDELKLRSDAREGAQPNHEEWVVDEQCRRTYYAVYIFFGLLTLTYNHTPAMGFNEFDTLKLPSSESLWTMEVSDDDAWRESLSSSKIITFRQAHDN

SEQ ID NO: 61181 - protein, 166 aa, Sorghum bicolor
  Clone ID: 9302676.pep
VVAVKKLVVGPWAGSAGPPHGENRPTRPFCRRCAPGLNWPGRASGAVTLKKLECSKQAITPVATPGIAHNAATGPEPAPGPPRFPAIVGASTNQTPSAAASFAPPAPAPAEADAPPPDCPSYFRWIHEDLRPWRAAGVTRGALEGARRLFAPKFRVTVVAGRLYVA

SEQ ID NO: 61182 - protein, 118 aa, Sorghum bicolor
  Clone ID: 9302692.pep
ARGSGGGARDICAQVLERLVADGHAEASDPDFRDRLAAHFGRLPHSYQLDINVDKAADVLVHQNVLAEAKDPDRRPAFYVRCLRIEDMDPAYDSDASDEGDDDGDDLSVRQDTPYTHI

SEQ ID NO: 61183 - protein, 185 aa, Sorghum bicolor
  Clone ID: 9302709.pep
MMTSAEGASNTMNPTPTSSDAQPAPWYDLVCVGFGAAQLATAIANSESRTPSKVLFIEKKPSFTWGSSSNLSRTRMETPFMYDLATLRNPTTAFSYVNYLLNRKRLIEFANSDRLNPLREEFADYMRWCAEHFKDDVRYGNEVIGVAPETKGDVVQGWKLAIKDNTGKTWVLRTRSLVAPSPSRA

SEQ ID NO: 61184 - protein, 193 aa, Sorghum bicolor
  unsure (1)..(193): unsure at all Xaa locations
  Clone ID: 9302717.pep
ANEARDAFQRVMSQGMRRPIHSIQGLVSVVQEEGLTSEQKLVVDTMARTATVVSTLINDVMEMSAANQERFPLETRPFHLHSMIRDAACVARCLCDFRGFGFAVHVENVLPDLVIGDERRIFHVLLHMVGNLIGRIDVGNVTFRVRADDEAMEDXRWNPWRPSYSGGHSSVKFVIGVKRQQNADSPSSLAQFL

SEQ ID NO: 61185 - protein, 203 aa, Sorghum bicolor
  Clone ID: 9302740.pep
QMVVLPSKEVDPRRLVRKTHKGEFQVEFEEPDGFSVEVELGSNLTNIPSKAVEDQTKSNGTDRKEDVQEKDKASDSTSQDEDGRTCNNDMPGDVEYIDNEKADLMQELILDDMKDTVNLPPIPSLDEFMQGLDSEPPFVDLSVETPQEDVNDSEEPDTTMEPEDLPETEDNASAPEKTESESDKSSAQVNSEPKLESPVHTAV

SEQ ID NO: 61186 - protein, 147 aa, Sorghum bicolor
  Clone ID: 9302747.pep
MIGGYTSPAAVTTDLIQQYLDENKQLILAILDNQNNGKVEECERHQAKLQHNLMYLAAIADSQPPQTAPLSQYPSNLMMQPGPRYMPPQSGQMMSPQSLMAARSSMMYAHPSMSPLQQQQAAHGQLGMASGGGGGTTSGFSILHGEA

SEQ ID NO: 61187 - protein, 122 aa, Sorghum bicolor
  Clone ID: 9302755.pep
AACALDARPVPEAVEAQAHRRRRIGAARRRCRRCLLLLLHHHHHQWRLDAAAFLLRRLVSRQTDGQVEVDVQVAPWRRRRCRRGGPRLVVAATARAGGLRRVGDDVLLLRSLVLLLVVAVVV

SEQ ID NO: 61188 - protein, 201 aa, Sorghum bicolor
  Clone ID: 9302767.pep
IYIPTRTRYQHLLESLCSREGVKEEEADENAGEFAKKLPSEGTMPMFRYIPPAMLFVDLVYMILHRAVDMRIPHDHHYIRDELLDTFRYLLGERRAGERRGRRRGLRMRVGGRGGRRRRAGDAAVAPAPPPANECPEHGPGPCPPWLPLYCDEHGHGPCPRRALPSPPAPDVAGPSNWAGPMAMDVEPAPERRHRPSPRPD

SEQ ID NO: 61189 - protein, 209 aa, Sorghum bicolor
  unsure (1)..(209): unsure at all Xaa locations
  Clone ID: 9302768.pep
NVAVVGSGEKTVEVVDDLLSCPRXGNITVVTEDDSFASLKILDDAKLPQAQLCSIWTKPTSCQIPPVIEAPEAIQPIYMRAYEKQVQSKGEFRLHVIIGKDASAACSRSDLIIRDTATSPFPNSALFQSIDSIILGCRPKGESLEEVQFKRGAIAPGCRLWLVSSKSDGGRTLAKDVSLMAGEIVRQASAGSKEVGDGAASQMQVQARM

SEQ ID NO: 61190 - protein, 38 aa, Sorghum bicolor
  Clone ID: 9302786.pep
ALETASSCHQMTRTSYESFCFLSIWIDRKIRAADSEAV

SEQ ID NO: 61191 - protein, 57 aa, Sorghum bicolor
  Clone ID: 9302792.pep
RSSGYAKCPSSSRSRWPPPAAPTSPRPPPCRPGKSCSPAKAPPFDSGGVHGQNQRPI

SEQ ID NO: 61192 - protein, 59 aa, Sorghum bicolor
  Clone ID: 9302809.pep
LCWKEGSSESGRLHILQTIDAYISDERVGLAEPAEGIELYLCPSHGKTVEILSRYLPKE

SEQ ID NO: 61193 - protein, 106 aa, Sorghum bicolor
  Clone ID: 9302815.pep
HCWSLPPPCSMEQPYLTDYILLANATITTLLPPPRSSKLPANPAAMPYRSRADASASDIVLTAFFLGACFQVLAVPALRAGAGATTDVNRQRGRSLLGATAAAAKA

SEQ ID NO: 61194 - protein, 136 aa, Sorghum bicolor
  Clone ID: 9302842.pep
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVA

SEQ ID NO: 61195 - protein, 144 aa, Sorghum bicolor
  Clone ID: 9302846.pep
TRLSWRGTSVRGERLSMAPSPPQQLSLALADLRALSVLGQGARGVVFHVVPVAAAAGDSTAAAGAGEPMALKAMSRAAARHKGAGPGGTCHGGGGDGHRRIWFERDVLLSLRHPLLPSLRGVVATDTVVGFAITRCPGGDLKSL

SEQ ID NO: 61196 - protein, 86 aa, Sorghum bicolor
  Clone ID: 9302849.pep
GARKTVDGLGFDRPRPRPPVLAPRHPLPPPPVNLHLRVCARASALRVSESVRRSRRGRRKGGDGEAVKRNGGDGTSAFAVIGLSSC

SEQ ID NO: 61197 - protein, 171 aa, Sorghum bicolor
  Clone ID: 9302870.pep
MQSQFGQGSQQQQQQQLQHKNMATSFTPRTGKTPDPKTIRRLAQNREAARKSRLRKKAYIQQLESSKLKLAQIEQDMQRAHSQGIFLGGAPGANSSSGAAMFDVEYARWLDDHGRRMAELHGALHAHLPDGDLRAIVDDTLTHHDELFQLKASAAKSDVVHLITGVWTTPA

SEQ ID NO: 61198 - protein, 57 aa, Sorghum bicolor
  Clone ID: 9302916.pep
KENVVITAYANSNYQAVNNSVLVAGSCAVNDPGVHVVVVEHVDEIRDYDEDIDGQEF

SEQ ID NO: 61199 - protein, 139 aa, Sorghum bicolor
  Clone ID: 9302952.pep
VVIYEMVYGRTPFRGRSRRETFHRVLTAPPELPGEATPLRDLITRLLEKDPGKRLGARGVKRHAFFRGVDWDRVLDVARPPFIPSPDGNDANAGAVVEAEALDVEKVVHELFGSSGAGETRLVKVCSHGGTDDDFSIFF

SEQ ID NO: 61200 - protein, 82 aa, Sorghum bicolor
  Clone ID: 9302956.pep
QTADPSKAKEENEETGIEGSVGPRPSLATTSKINHLPFLLESQFLGRRWSKGKEISLAVIAKAKNGPVWRSLRLSLVNIRSL

SEQ ID NO: 61201 - protein, 37 aa, Sorghum bicolor
  Clone ID: 9302963.pep
CDGCSLSLDIILFCFVHENFEMLYSFQGWHSKDGAMM

SEQ ID NO: 61202 - protein, 200 aa, Sorghum bicolor
  Clone ID: 9302966.pep
DAKRILVPGTHADDIGYQCGGWTIAWHGDSGKITPGTSILEAIQESVGVQTEVVYEKCPTETIIETGGFSYAVVVVGEVPYAEWTGDRTDLSIPFNGSDLITCVASKIPTLVIVISGRPLIIESHVLEQIEALVAAWLPGTEGMGITDCLFGDHDFVGTLPVTWYRSVDQLPINAGDANYDPLFPVGYGLKMFRSDDDSA

SEQ ID NO: 61203 - protein, 44 aa, Sorghum bicolor
  Clone ID: 9302982.pep
MKFGKDFRNHLEDTLPAWRDKYLAYNALKKLIKNLVPPHPAAAP

SEQ ID NO: 61204 - protein, 153 aa, Sorghum bicolor
  Clone ID: 9302988.pep
MLGMARINEWKPVIAMLVFDLISAVTTALIKKALQEGLDRLVLITLRQLVATVFLAPIAYFRERNTRPKLTLEILVYLFFSAAFGAALSQYTFFYGLQYTTATFAITFTNVAPVLTFLIAVLLRVESLNMKNKAGAAKIVGTLTSFAGVMLLT

SEQ ID NO: 61205 - protein, 138 aa, Sorghum bicolor
  Clone ID: 9302997.pep
HEEGHQQQTHHLVRCTSRLQASNQATPIKETPAIALSATIPVIHIIHYKQATSQGARQPGRSRSSEDRPAPPPAAAAASKNVPADRLVVLLHVQHRQRRLPPSRSGPGEQAAAAWPRATAADGPGGGQDDGAAAARAR

SEQ ID NO: 61206 - protein, 68 aa, Sorghum bicolor
  Clone ID: 9303005.pep
MMSSKSSTTVEVGPATASPGWPRRTRPPSSPPPTNTSPATTTSPTFTHLRRTPTSSPLVAAASSPSAL

SEQ ID NO: 61207 - protein, 153 aa, Sorghum bicolor
  Clone ID: 9303007.pep
MSTTAALPAAVLAGEEMAAPAPAASASSDEATAAHSRRKQQRNPASLYTNNVPAAETEIIESLPLETRLMVRRRQYGGFWQAEFILKGLAAAGASSWFQPETSDIFLASLPKSGTTWLKALAFATLNRATHSPSDGQHPLNHRNPHDCVGFLE

SEQ ID NO: 61208 - protein, 71 aa, Sorghum bicolor
  Clone ID: 9303010.pep
RFPHAAEGQPLLVAPAPVAIALPPHHHELIKQRPSPYAPHICSLAPSVLGLVLCASAALCSLLVGDGVVKV

SEQ ID NO: 61209 - protein, 79 aa, Sorghum bicolor
  Clone ID: 9303021.pep
MAAVPYGAHPPHQAPAPLAVVSPLFCASYAVPLTVTKKAISRSGRDFVVTDGNGAEMLRVNGAVFSVHDHRVLLDAGGQ

SEQ ID NO: 61210 - protein, 56 aa, Sorghum bicolor
  Clone ID: 9303032.pep
LQLGAMEHAALARVTHRQPAAHGQARAAAARTWPRLQTALRHLNSWRLLSSAPETT

SEQ ID NO: 61211 - protein, 90 aa, Sorghum bicolor
  Clone ID: 9303038.pep
MAPTSKLSMGIKRASRSHAYHRRGLWAIKAKHGGAFPKAEKPAAAAEPKFYPADDVKPRVPSTRKPKPTKLMSSITPGTVLILLAGRFMG

SEQ ID NO: 61212 - protein, 64 aa, Sorghum bicolor
  Clone ID: 9303045.pep
RRPLDGITPGEWCGAVGSGVDGAAGECSVGGDIDAVRQGAAGRKLASLMAGLVGTAVRRMHQIG

SEQ ID NO: 61213 - protein, 113 aa, Sorghum bicolor
  Clone ID: 9303059.pep
VLLAQSDRFELTCARKRKEVERSLVSRAIFLPSPECCLLLFCFYFFSMASRNPTYCTGSGKQACVGGFRKHQVVREIKGDRQRCVCMCHLYLCLCGSNRVQTVKLMCLLLKKQ

SEQ ID NO: 61214 - protein, 151 aa, Sorghum bicolor
  unsure (1)..(151): unsure at all Xaa locations
  Clone ID: 9303061.pep
RLTKKYPALYSSTXYMFLISSLQGGALTAAIQRRASVWVLTRPLEIVTVLYTXGVMGSGVGYVLMTWCVEKRGPVFTSAFIPVIQIMVAMIDFFFLHENLYLGSVLGSILLILGLYILLWGKKRDASEASSSAADKEEEEEEEDKEKQVRS

SEQ ID NO: 61215 - protein, 49 aa, Sorghum bicolor
  Clone ID: 9303072.pep
ARTRRRTRQQLAIITSREVSVFSFATLFFFFCQSFHVLRLSRAVEAAGG

SEQ ID NO: 61216 - protein, 143 aa, Sorghum bicolor
  Clone ID: 9303085.pep
WYSDQIQKKYDEQPAVDGITVKVFQPSHEEYQRSRNKKHNMKALAEIYLLSMSDELITSGFSTFGYAAQGLAGLKPWIMFKSENHVMPDPPCGRAMSIEPCFHQAPFYDCKAKKDADLGKVVPYVRHCEDVSWGLKIVNQTHL

SEQ ID NO: 61217 - protein, 126 aa, Sorghum bicolor
  Clone ID: 9303094.pep
WQVFRGDSTNASDLLFTAKKSSIFQLKPEVDVFLAGNHSEQVCDFKIRGSYIERSCGFYLGNSDTMVAQINRKYTATNVLLEKDTFVVTVFPHVDYVFITAVVVILDEIHRERFDGTTIFDIVTDM

SEQ ID NO: 61218 - protein, 111 aa, Sorghum bicolor
  Clone ID: 9303102.pep
GMFQSPDHSKVTPKFCKQFGDVGAVIGKALAEYREQVEARAFPDAEHTPYKISSADVDVFADALRNIGFDGAAAAAAAAAGKKEKIVGNGKPQDGDNINNGILSGSAGAAV

SEQ ID NO: 61219 - protein, 68 aa, Sorghum bicolor
  Clone ID: 9303113.pep
ERSYGTLCVTVPMFPTMKHYINSPTRINPSSGIWKVFFVLNTAVVWGSHTALLGQHTAYRSWLLRVTH

SEQ ID NO: 61220 - protein, 213 aa, Sorghum bicolor
  Clone ID: 9303127.pep
ARGVNEPNIEPLGGYDQGYLPPRRCSAPFGLAGVPCTHGNSTTEPYVVAHHLLLAHASAVSLYRRKYQGEQGGRIGLTLLAYWYEPATHKPEDVQAAARANDFTLGWFMHPLVHGDYPPVMRRNAGSRLPVLTAQESAMVRGSFDFVGINQYGALLVEADLGQLKRELRDYYGDTAVNFITLPFESTVRNQEPQLGLRNKEAPWALNKVLEHL

SEQ ID NO: 61221 - protein, 183 aa, Sorghum bicolor
  Clone ID: 9303128.pep
MGKRPIADVVAEDGATTTPELSRKKSKKDKSKKLSKTAEIDATETNGNVEAVEGSEDDEKLSKAERKAAKKAKKEAKEAKKALKAAAEDEPAGQTAEESEEAIKAAEKAARKAEKKRLKALAKGEATESASSSKPSSVQASAEPTATSATATESGDYEESKELTQLPQAEVDAFLAKNTMTIQ

SEQ ID NO: 61222 - protein, 133 aa, Sorghum bicolor
  Clone ID: 9303132.pep
PTPPAARRRDPPRRLPPHHRCHRWPEAAASPPHPCVDVRSAAPPAGPPGVRLRARRSREAACRASRRPSKRPVPVRRLVPAPWWSVDLTNICWVGWPLLARAEADCCEPVTGRPVAGCHLLSADSSRGLTGNH

SEQ ID NO: 61223 - protein, 206 aa, Sorghum bicolor
  Clone ID: 9303133.pep
MLLDRGKVDVDARDKNGQTPLSWAAENGHEAVVKMLLDRGKVDVDARDTEYGQTPLSWAAGNGHEVVVKMLLDTGKVNVDARDKYDRTPLSWAAENGHEVVVKMLLDRGKVDVDARDKNGQTPLSWAAENGHEAVVKMLLDTGKVNVDARDTKYGRTPLLWAAENGHEAVVKMLLDTGKVDIDADFYGLTAYQLSALNHHEQAERQ

SEQ ID NO: 61224 - protein, 199 aa, Sorghum bicolor
  Clone ID: 9303136.pep
MLSHLGMSVAAAAAMLQRAWTFSYGIISGLLPIHVLMLMVVLVAGLAMLWRLHRPRDVYLVDYGCFLGDPCYRVPFAMALEHGRLMTDLIDEESLSFMVRLHEKSAIGEETSLPDSFRCIPPDSSIEASREEAELVIFSAVDKAFARSQVNPEDIDAVIVACSFTTLTPVFADVVVNRYKLGADVQSVNLSGMGCSGAL

SEQ ID NO: 61225 - protein, 165 aa, Sorghum bicolor
  Clone ID: 9303137.pep
GVGGVMLAEQTRSRHTHNADEDNPGTPRPLKRPLLFPLNDFAASLKMGRNLRTRLQQQIVKSEHSQNWKSRPGWTLAGAGAAVAGPVPARSWQRGRAPPGGAASSGGAGRGEQAELRDRQGGAALGACRSSEAQEDDGGAGRRRRCWVGAAALGGHDCTRGQASC

SEQ ID NO: 61226 - protein, 130 aa, Sorghum bicolor
  Clone ID: 9303154.pep
MAAMPTDSMTRRFAVACGVLSQYVRNGAPATTMTPPPPFLKQAPAAGPAAAQEMIVASASAPQQLTIFYGGRVVVLDACPPEKAAELIRLAAAAAQGGSTQPPEQALVDMPIARKASLRRFLAKRKDRSS

SEQ ID NO: 61227 - protein, 204 aa, Sorghum bicolor
  Clone ID: 9303162.pep
TRLSLALPATTGLRRRRRRRRRPASGAGGLRWTLRPRRASARLTAMAEATERRKRAAVVVLGDIGRSPRMQYHSLSLANQASMEVDIVANGGSDPHLSLRENPSIHIHEMKTVQLTGISKISGALALLLKAVVQFILLVWFLCFKIPRPDVFVVQNPPSVPTLAAVKLASWLRGAKFIVDWHNFGYTLLGLSHGRSHIIVKIYF

SEQ ID NO: 61228 - protein, 182 aa, Sorghum bicolor
  unsure (1)..(182): unsure at all Xaa locations
  Clone ID: 9303163.pep
ARGDVVLSSVGHLNYELGADKFVTGKESPAKQALDLTEAPGRYVSYLQSSTAVTSSSSKISSSRRNTNSQEAKDSPVKSASSSPPRNFNIKMISSTRKDGIVDGSLGNTHNLVRYQNSEVIALNNGQKTENFEGVQVAGEPNFHGPLQGISDSNIKEIPQSAGAQVSNITGSERSLDNSLPX

SEQ ID NO: 61229 - protein, 109 aa, Sorghum bicolor
  Clone ID: 9303165.pep
KICLSGEQQQSAGLNPPHSAGTQYLAVSRPQVTRCVTRTIDNSIFTLSGWTDPCSDNDEIDAQSAGPFRCSRLTGGSGTGTAFFVLHWVRLFATIADLDANHSSMSLCS

SEQ ID NO: 61230 - protein, 107 aa, Sorghum bicolor
  Clone ID: 9303167.pep
QVCDALRCSGPHARYTDVFNKANKSKSKPPRHGGGHGRGLFDATDDEMVRRMALDGVAAAVSVVGEVTVDPSGAGNYSTIGEAVAAAPTNLGGSTGYFVIRVPAGVY

SEQ ID NO: 61231 - protein, 176 aa, Sorghum bicolor
  Clone ID: 9303173.pep
HLENNQLTGNVPSYFGSLPKLSELYLQNNKLSGSIPRALLSRSIIFNYSGNIYLGIGKQEKKHVIIIISALLGASLLLAAALCCYMLTRKAMNRDSSSTTEGGPHDDDVVAEKVLPAEQDKKLQKYPSTQLQSSARIATETAHPYRLCELEAATKKFASRIGSGGFGIVYYGKLSD

SEQ ID NO: 61232 - protein, 172 aa, Sorghum bicolor
  Clone ID: 9303175.pep
MAASVDRHLAPHPWPGNAPPKSFDMFRSGGPGGGGKRRAGSDSDSEDEDTIPPDWRSLYLPRLEVEPPVHDPRDEATSDAWVRRHPALVRLTGKHPFNSEPPVPRLMAHGFITPAPLHYVRNHGPVPRADWSTWTVEVTGLVRRPARLTMEQLVTEFEAVELPVTLVCAGNR

SEQ ID NO: 61233 - protein, 132 aa, Sorghum bicolor
  Clone ID: 9303178.pep
MEEEPQPQVEVEVPCYFLCPISLSIMRDPVTLPTGITYDRDGIERWLLTAATCPLTKQPVPADCDPTPNHTLRRLIQSWCALHAADGVDRVHTPKPRADVAALVSRLHDAAAAGSTAPQPQLLAALRELRDV

SEQ ID NO: 61234 - protein, 195 aa, Sorghum bicolor
  Clone ID: 9303180.pep
ARGKEHQTSSLYQGEVQYAADRDDDENSSGCTHPSTIENKGCKPQYLGNHRIRKLLASKVRKAARNKICGGIPSKKIYGGLSNKGSKLNLCGKKISTTRQKVQRTIFKKKKLAHHTTSFAKEMLTEASRTSFATGGQNKSCESENYHVKLRIKSFNIPELFIKVPENATIGSLKRTVMDVVNSIMEGGLRVGVLL

SEQ ID NO: 61235 - protein, 153 aa, Sorghum bicolor
  Clone ID: 9303182.pep
RRLLRLLSRSPTGSMQADERKQQQPPQPQLHVSFATLPLPSKTWHPREKEAQISALPSHADPADAGRQSSLPVPAEPRTAEETTGASAVGSADPDSRGVYWELRPPIPGGSNRPQTSLPFGMPSVPLPLLRGSRTPQAAGCLAESRMRSNVPT

SEQ ID NO: 61236 - protein, 199 aa, Sorghum bicolor
  Clone ID: 9303192.pep
TRQQSSFFNWFTFCLSVGSVAGLILIVWLENTRGWDVGFGLSALLILIALLVSAAGLPLYRNRVPQGSALTRVLQVFVVAFKNRKLGLPDKMEETQQNSHEVDSQEVPCPTTNHSLKFLDKACCANTNTGRDDGPWSVCSAAKVEETKIVLRMLPLVFSSTVAHVSTPLLVAFTIQQGMTTNTKLGKVHVYPAMLFIVP

SEQ ID NO: 61237 - protein, 95 aa, Sorghum bicolor
  Clone ID: 9303204.pep
MRVHPAPRKRTIAVQRCATAAAAAGAVGGKKLRRLPHIFAKVLELPFAADADVSVEEDAAALRFVAAAVVDVDGFSFSPAGGPRAHAVEIHPGVT

SEQ ID NO: 61238 - protein, 174 aa, Sorghum bicolor
  Clone ID: 9303207.pep
MEMIENSPSPQRSASKSSEPSQTPAPESSASKPVKKRKSWGQVLPEPKTSLPPRKRAKTEDEKEQRRIERVKRNRLAAHNSRERKRQEYEVLQHEKDELEANMRAYKEKMAQMEAELRYYRTKYPGEAPTSTTFDLSTPSHDSFSTICPAQIPTSFPSPESMDSMDSPRDSSCQ

SEQ ID NO: 61239 - protein, 64 aa, Sorghum bicolor
  Clone ID: 9303216.pep
RTGGESAKQAKSRRVMDGNGIIGLYKHEDAVRATEGTSGRIAVAVVGAGALGDGDDELALGVGG

SEQ ID NO: 61240 - protein, 93 aa, Sorghum bicolor
  Clone ID: 9303229.pep
KTNNFDLIRTRDSQGDAKYLVLDINYCPGYSKMPGFEPVLTEFFLEMLRSRPVLERPAPGNGSAASAGLGVDEARKAEAEPTSVIPEPRQVQA

SEQ ID NO: 61241 - protein, 174 aa, Sorghum bicolor
  Clone ID: 9303230.pep
ISQQLTEKSDMYSFGIILLELISGRPPISTIAFGDHFRNIGPWAKFYYESGDIEAIIDPSVSMAGEYQDVQSVWKIAEAAVRCIDVEPRKRPCMPEVVKEIQDAMALERAAAAETTNSNRGLGCPFSPAAASVRSGGTMRSHDMVMDNLLLMDDDESTSFSGSAVSKLKYPELR

SEQ ID NO: 61242 - protein, 165 aa, Sorghum bicolor
  Clone ID: 9303232.pep
LGATIDIKGPIGHIEYAGRGGFVVNGERRFARRLAMIAGGTGITPVYQVIQAVLRDQPDDDTEMHLVYANRTEDDMLLREEIDRWAAAHPARLKVWYVVSKVARPEDGWAYGVGRVDEQVLREHLPLGDSETLALVCGPPAMIECTVRPGLEKMGYDLDKACLVF

SEQ ID NO: 61243 - protein, 173 aa, Sorghum bicolor
  Clone ID: 9303235.pep
LRDRPAVSRPATKAALHVLVRTAAWGRNRVKAVDAGAVPVLVDMLFDDGAERRACELVLAALDRLCGCAEGRADLVAHGAGVAAVGRKALRVSEVATDKAVRVLRSVARHAATAAVVQEMAHAGVVATLCVVAQSEQYAERTRERARETLRLHARAWRTSPCLHHHLQALYPC

SEQ ID NO: 61244 - protein, 119 aa, Sorghum bicolor
  Clone ID: 9303240.pep
CTVAAAPELAANTAFAVATYLGRPWKLYSRTVIMQSEVDALVDPAGWMPWDGDYALSTLFYAEYNNSGPGADTSRRVAWPGFHVLNGTADAANFTVGNMVLGDFWLPQTGVPFTSGLIN

SEQ ID NO: 61245 - protein, 162 aa, Sorghum bicolor
  Clone ID: 9303261.pep
RPTTTVRTTTSRPRPRRARWRRRRRARSLPPLLGSRSAACAPCTAVEIAGRLADGTYVMRVQTRGRAHPSTWLTSTWLASTPGHWRRCSSNLPFYLRLCYLPQRTAHVIGYILLLLLLIASIYGIYRSIKPGGYTALRPACVLTESDDTIRSYPSLVWWCII

SEQ ID NO: 61246 - protein, 119 aa, Sorghum bicolor
  Clone ID: 9303262.pep
RIHHELEIGRSSGIFATSVSFSRPSISVISTRTSFFWFSTAIRLTLSTLIEYRSSRRIRAPGASFVSATRFTISCSFSSLQVILTRWGFWVLSHGSASPRGIIQFGADFVLHCRSDRPG

SEQ ID NO: 61247 - protein, 151 aa, Sorghum bicolor
  Clone ID: 9303279.pep
PGVAAVVERKRKDTVAAGGQISIFWLAPQFFLIGVADTTSFVGLLEFFTGEAPDGMKSIGVAFFWCQAGMASLLGTLLVRLVNRVTHSGSAPGWLEGKNLNSSHLDLFYCVVTAVSFLGWLNYLYWAKRYKYRQDPRISTKSPDEDDSTMP

SEQ ID NO: 61248 - protein, 83 aa, Sorghum bicolor
  Clone ID: 9303283.pep
SRLSHLGRTPMRRCSVSSRVRSPPSRRGLALESPARLTGVSVPGVAYFARASLHPPANQPSKIKFILQLPDTKLKLLMITNAP

SEQ ID NO: 61249 - protein, 46 aa, Sorghum bicolor
  Clone ID: 9303290.pep
LINITPSIRLYLSLTNIIGTVEAADINTKLVVSSGQCHQLSFKLYF

SEQ ID NO: 61250 - protein, 157 aa, Sorghum bicolor
  Clone ID: 9303294.pep
MSSRVLLLRSWRATRNSPRAVAPLLTSSARRWGSSLSQRPGSDRVLFPGAVNSKFTTEMSFLKASDLPAIPTYRVIDSDGELVDKSRGPPDVSDEEALTWYKNMLTVSIMDVVMFEAQRQGRLSFYMVSAGEEGIAVGSAAALTPDDVVFAQYREAG

SEQ ID NO: 61251 - protein, 181 aa, Sorghum bicolor
  Clone ID: 9303305.pep
ARGSKQSQAKNQNTPAPNSSRKSLSASVDSSPGDFEIRFSANGSESGLEKTKTAITENKTKIQTTAFNSFVADFDNIKMNSQNSTDNVNMTSKLKEHQLEAEVTLLKEQLKIANLEKEEISLKFDKLSAICSSQRREIQELKQALAAASATPPAKQFRENSKVELTPPSKSLDTPPREKIE

SEQ ID NO: 61252 - protein, 175 aa, Sorghum bicolor
  Clone ID: 9303318.pep
MSVPDKFQGFQSPSAEHWTDFQKNSFEPRPFGEYDVDIKVECCGVCASDRHTISGDWGGCPYPLAVGHEVVGKVLRVGDKVTLAKVGDRVGAGAQVWSCLECHQCKNDNETYCKHQIDAYGADYLDTGFKTQGGYSSHSRVHEYWVYPIPEALSSTQAAPMLCAGITVYSPLKRL

SEQ ID NO: 61253 - protein, 87 aa, Sorghum bicolor
  Clone ID: 9303325.pep
ARGRASDRPIMARELVAMALRFLHEYVRASDLAVAAAVLFVCSAVRSRLSSRPGEPMLWPVVGIIPTLSAHIALGDVYDWGAATLSR

SEQ ID NO: 61254 - protein, 147 aa, Sorghum bicolor
  Clone ID: 9303346.pep
KAEPKSDSNAADGEEKWELNKKSNDKSAQRNDREDRNGSAGRNSHGGRSGRGNFRDNRKKRPNREFEDLPETDDPSEIRAQMEFYFSAQNLATDEHMFMELEGPKNKPVSIHHICSFKRMRRFKPYSAVVEAIRHSNDLVLVNDGEY

SEQ ID NO: 61255 - protein, 117 aa, Sorghum bicolor
  Clone ID: 9303356.pep
HEAGNADTGLDYEPAPDLDHLNDVVRSDLTGWLEWLKSDAVGFDGWRLDFANGYSPAVAGGYINSTAPDVAVAEIWTDLAYEQDGRPRADQDAHRQVLADWVDAVGGPAAAFDYTTR

SEQ ID NO: 61256 - protein, 172 aa, Sorghum bicolor
  unsure (1)..(172): unsure at all Xaa locations
  Clone ID: 9303358.pep
TRAKSRNLVXFFEAIPGVPKIRDGYNPAAWMLEVTSTQMEQILGVDFAEYYRQSKLFQQTREIVEALSRPSSESKELTFATKYAQPFCSQYIACLWKQNLSYWRNPQYTAVRFFYTVIISLMFGTICWKFGSRRETQHDIFNAMGAMYAAVLFIGITNATSVQPVISIERFV

SEQ ID NO: 61257 - protein, 93 aa, Sorghum bicolor
  Clone ID: 9303365.pep
IYLYGGYFKEVSSDKEKGTVHADMWSLDPRTWEWNKVNKAGMPPGPRAGFSMCVHKKRAVLFGGVVDMEVEGDVIMSMFMNELYGFHLDNHRW

SEQ ID NO: 61258 - protein, 90 aa, Sorghum bicolor
  Clone ID: 9303369.pep
RTPVPGESLRDFYKRTNMYWQMAAYEHTQHTGKELRKDGFDLAETRYKELKPILDELAVLEAEQKAEEEASASTSSKKDTKKPKQKSAGR

SEQ ID NO: 61259 - protein, 133 aa, Sorghum bicolor
  Clone ID: 9303374.pep
LLYFTFYGMMTTAITPNHTVAPIIAAPFYTLWNLFSGFMIPRKRIPVWWRWYYWANPVSWTLYGLLTSQFGDLDQPLLLADGVTSTTVVAFLEEHFGFRHDFLCTVAAMVAGFCVLFAVVFALAIKYLNFQRR

SEQ ID NO: 61260 - protein, 119 aa, Sorghum bicolor
  Clone ID: 9303376.pep
VACGSPATEEMPDGETLALPEWVWELYDRGAVLEAADGRLDGQFDVWEMERMLVVGLWCSHPVPRERPSIVHALNVLQSRDATLPALPTNVHRGAAAPTAGFSAYVHSMSSVGSVGEPC

SEQ ID NO: 61261 - protein, 149 aa, Sorghum bicolor
  Clone ID: 9303412.pep
SRAKEADARKMGADGFLATGEKDWTKGHEMSFDIIINTATSFEGFALSEYLSLLDVHGHWNSVGLPGGDGISIRNQDFITNGCYIGTSHLGSRREMLEMLQLAADKGLKSWIEEIPISKEGLQKAMEALKTSSVRYRSCMTNYEEAFGA

SEQ ID NO: 61262 - protein, 165 aa, Sorghum bicolor
  Clone ID: 9303417.pep
PIVQVNKTDFRIARLFEGLTIQSNDIAGTVGYMSPEYILEGTLSTMYDVYSFGVTLLETISSMCKTNPVRHHASVPWAWNVRENQQMGQLFDSSLFEESQLTEIKRCFEIGLLCTQFERAKRPTMASVLEMLNGKKELTTPWQPEYTKERVIDAKRASQNVRSRM

SEQ ID NO: 61263 - protein, 49 aa, Sorghum bicolor
  Clone ID: 9303424.pep
LRASVMLLARARSTCSNKVYSYCVPVACSALMQCCTPVKSVLCLPCRKV

SEQ ID NO: 61264 - protein, 188 aa, Sorghum bicolor
  unsure (1)..(188): unsure at all Xaa locations
  Clone ID: 9303443.pep
NNGFAISTPTLEQYRGDGIASRGVGYGIDTIRVDGNDVFAVNEAMKEARRRALSDGGRPVLIEAMSYRVSHHSTSDDSFACRARVEVEDWKRRDNPIIRLRKWLENKGLWNEDLEQETRDSLRKAVLKEFSEAEQEKKPPVREAFTDVYEELTEEAREQMKELXKRILETYPDEYDLRPYKDGAKGLD

SEQ ID NO: 61265 - protein, 171 aa, Sorghum bicolor
  Clone ID: 9303461.pep
ARGSCLSSQAFPPMSKLDPAVYGPPESAITEEHIIGQLDGMSVRQALQDNRLYMLDYHDIFLPFLDRINAQDGRKAYGTRTLFFLTAAGTLKPIAIELCLPPMTDGCARAKRVFTPAADATSNWLWQLAKAHVCSNDAGVHQLINHWLRTHACMEPFIISAHRQLSAMHPI

SEQ ID NO: 61266 - protein, 168 aa, Sorghum bicolor
  Clone ID: 9303464.pep
MALGSESQAATTADPSCPPFPLLEDDGGHIHEQEQEVPSGAELELPTVDLDAPGEALAAACRGLGVFRLANHGVPASLSARLFATARAALAGAPFHDKRAQPGYFWGTPALSLRVRDVNWVEGFHVALGGHQQPAPGPPLGDLLDLAAEYGAHMARVARALFDALAAP

SEQ ID NO: 61267 - protein, 184 aa, Sorghum bicolor
  unsure (1)..(184): unsure at all Xaa locations
  Clone ID: 9303494.pep
LICWTMSGQVTIHKFAWTTAVSESSVALVIDGSHVLVTPLILGLMPPPMSLFHLAFPCAVNEVSFVTNSSKSHLAAYLSNGSLSIVELPAPDTWEEFEGNGISVDLCCSDFTLNNCMHLTWIDTRTLIGICCYSENYSLTTIGSSETRNLVGKHDSMFFINEIELICSEDSVPGSVSSSGWQAX

SEQ ID NO: 61268 - protein, 42 aa, Sorghum bicolor
  Clone ID: 9303499.pep
MFSLLSHASTVGRRQFSTADKPYDVAVIGGGPGGYVAAIKAG

SEQ ID NO: 61269 - protein, 193 aa, Sorghum bicolor
  Clone ID: 9303500.pep
PTSRMFSLLSRASTVGRRQFSTAAKPYDVVVIGGGPGGYVAAIKAGQLGLRVACVESRGTLGGTCLNVGCIPSKALLNASHHYHDAKHNFSKYGIELNGTLNMNIKEMMAAKEKAVKGLTGGIEMLFKKNKVDYFKAHGTITGKNDVALTPIDGSAKQTINATNIIIATGSVAATLPGIDVDEKSVVTSTGAL

SEQ ID NO: 61270 - protein, 78 aa, Sorghum bicolor
  Clone ID: 9303506.pep
PTTPPTTSSSRDDSTHSLPPSLAPPFFHLQLGETLASKLLTTHLSTPRTASLPRHALFQGSRREYTHSGRTYLRILHS

SEQ ID NO: 61271 - protein, 204 aa, Sorghum bicolor
  Clone ID: 9303528.pep
IKGVVREIIHDPGRGAPLARVVFRDPLRYKLNKELFVAAEGMYTGQFVYCGKKAQLSIGNVLPLGAMPEGAIVCNVEGRVGDRGMFARCSGNYATIVSHNPDDNVTRIKLPSGTKKLVPSDARAMVGVVAGGGRMDKPLLKAGRAYFKYKAKRKCWPKVRGVAMNPVDHPHGGGNHQHIGKAATVRRDAPPGRKVGIIAARRNG

SEQ ID NO: 61272 - protein, 158 aa, Sorghum bicolor
  Clone ID: 9303540.pep
VVKGGEALPQAAGKRRPYQTTHATLVVASELKRPFFGVPESDWIPSFVLTTENPNIPFNSASAIRKLNETHNIYKVFSRKELSDKLLDRLFGGRAATYRNEWAAYPVLTPYPFSEWPRIKLHDKVYYANAFESAVSCLETQIASGHNVANLLLRKLRA

SEQ ID NO: 61273 - protein, 79 aa, Sorghum bicolor
  Clone ID: 9303544.pep
DMARAISGDAYCSVRHRVAASQAAERLSLCYFAFPQDDAVISCAGGRYRPFTYAEFREQVQADIKATGSKVGLERFLLR

SEQ ID NO: 61274 - protein, 202 aa, Sorghum bicolor
  Clone ID: 9303555.pep
FYRTKAKGEQVARSIYPETTIVRPAPMFGFEDRLLHRLASPTNIITANNLQERIRPVHVIDVGMALERMLHDDTTAAETFELYGPTEYSMAEINELVEKEVMKPRRHVNVPKRILKPIAHYANKLLWWPIHSADEVEREFIDQVIDRNAKTFKDLEIEPVELKSMTFEYLKGYRSSSYYDLPPMSEKEKREEKKYLHVIDDQ

SEQ ID NO: 61275 - protein, 179 aa, Sorghum bicolor
  Clone ID: 9303556.pep
ALGIKMNRGMVETDSHFRTNIPNIYAIGDVIAGPMLAHKAEEEGIAAVEIIAGKAGHVNYGAIPGVIYTHPEVATVGQSEEDLKKNNIKYKANKFPFMANSRARTNNDAEGLVKVLTDAETDRLLGVHIIGPMAGELIGEAVLGLEYGASAEDLARTCHAHPTLSEAVKEACMAKPIHF

SEQ ID NO: 61276 - protein, 127 aa, Sorghum bicolor
  Clone ID: 9303581.pep
SNVSKSRGARRAKKGGKIRAGSPGEEMALVEHLKGMALTGGAQNELKSLLVVLIQLGKEERARQVQEAAGNFEVSHTAAVKLAEDTVCSDKVDESTHTLEHYVKMLKAHGSGDSEPGSWRIKALSPP

SEQ ID NO: 61277 - protein, 164 aa, Sorghum bicolor
  Clone ID: 9303600.pep
LEGALRNAASLATAAAKAAQSGSSSKFAEYFKTTSSSTRSVVAARLQAVAREAQSTTSGGTTYYCTDVLGYCETNVLAYTLPSQNIIANCDIYYSDLPALASSCHAQDQATTSLHEFTHAPAVYSPGTDDLGYGYSAATSLSANDALNNADTYALYANAIYLGC

SEQ ID NO: 61278 - protein, 184 aa, Sorghum bicolor
  Clone ID: 9303604.pep
FLDPDMNPRLGSFALAEFLSRNEHGGHHVVVTASSAKGIFGYMSPEYMDTGEATTMADVYSFGVVVLEVVTGTMAVDGRLPEVLLVRKVQLFEQLNRPVEAMADQRLDGRFDRRELVRMARLGMACTRSDPAARPSMRKIVSILDGNDEVLDKFEQRKESTEDWQRRNATNLALVRRFQALGIH

SEQ ID NO: 61279 - protein, 157 aa, Sorghum bicolor
  Clone ID: 9303607.pep
GRGPDGMEMSPLKRPSEDADHEDGRRPAPRTPRIRACAECKRHKIKCEPVENEAKCAKCLRSGTECVPYNMNQRILDEDAAWKAKASAEIGQLRSAVQRLLMHNKLPGLDSPQEESPQPPSGQTVTVTPTNVISESGHTTLVVPPPMDMTRDNSVER

SEQ ID NO: 61280 - protein, 136 aa, Sorghum bicolor
  Clone ID: 9303616.pep
APRRPTSTRRCRRSRPRRRRRRRSPPPAPRRHRRRRQRRRTPSRWRPCRRRRRISSSSSTRGRRSWRPRRRSPRRRRQRGASCGRRPSARRRRGSRRGRLRRQRPASASSRLPPRRRRAGPSSLSRATSPACSAPC

SEQ ID NO: 61281 - protein, 180 aa, Sorghum bicolor
  Clone ID: 9303625.pep
HEALSPLSTRGPLRTRASGYTTLTQPRSHCCPREPFFGLPLSLSRSRALSLSLSLSVQVTLFTSQNCSRAVPTGCSGSNGSVRGSPAQRSRQLRIVCTVAHDIPSTICWPLVTEPSRFFVSPAIDRPARKFLENQVLAPLRSSAFRSISYSTRRFSLLACRLDCLHYPRCLVASTVSAWH

SEQ ID NO: 61282 - protein, 178 aa, Sorghum bicolor
  Clone ID: 9303662.pep
LGFAHDGVAFLTTPDVAALPWFFFGVIPAIIFFISLVQVLYYIGFIQWFIKKVAIFVFWALNASGAEAVVAAATPFIGQGESAMLVRPFVPHMTNAELHQVLTCGFATISGSVLVGYIGLGLNAEALVSSCIMSIPASLAISKLRYPETEETLTAGRVVIPDDDEHKAENALHAFANG

SEQ ID NO: 61283 - protein, 148 aa, Sorghum bicolor
  Clone ID: 9303671.pep
ARGRRGKVLEASEMRRSICHEGGGAAAAAAFSALLLGCVVMALVGGAAAHGPRLPSDYKTLSGNAPAFLPSLQLPRRVPSCMHSSAFTPCVCLKGSVAAGKPNWGILGDDFIASPTTVEGSSALYLSKTFVPTGCCFWELHNSVSVLL

SEQ ID NO: 61284 - protein, 225 aa, Sorghum bicolor
  Clone ID: 9303679.pep
TTSESLSYDRREAANIAIAAATSTLTLIFEEPDLRRAMTAVPIFTHTMVAFSATFLLKMAKTWGGVAQAQSPEWATEPLGLGLNFNINQVVSLSRRSASFLAKVADNLNKKHITRHIVQGINDLLKRIDAVAGTPSASTTQNLTAPSPTTSPIFDPVKAATASQEVSVDPANEYNMYDLIGSYGFGFDETFLGQMAPTDMGFWQTDPFDCWIMYSVESIYIIFKV

SEQ ID NO: 61285 - protein, 112 aa, Sorghum bicolor
  Clone ID: 9303686.pep
DLLRVAKLIAEKVITNEYNAFNAMATDPYYADMSPRSQLIATYALCGFGNIGSLGIQIGILSQLAPSRGGDVSRLALSALISGVFSTLTSASVAGLVVTTQLSHFTRPPASG

SEQ ID NO: 61286 - protein, 43 aa, Sorghum bicolor
  Clone ID: 9303690.pep
WMHYHPMAYLCVHPLAEDSYLSRAVLLMCAISRTSGSSGFGSV

SEQ ID NO: 61287 - protein, 124 aa, Sorghum bicolor
  Clone ID: 9303693.pep
DPYANKEPLVVPGGAFPRLTECRFRDSDLGPVFQRGAAPRLRRLEFCFRVRNTIDLGNDGFDFGLGNLESLEEAVVYVGCQESTEPEAEAAEAALRGAADAHPNRANFDVITFGEELMCFDDDN

SEQ ID NO: 61288 - protein, 160 aa, Sorghum bicolor
  Clone ID: 9303737.pep
GSRRGRLRRQRPPSASSRLPPRRRRAGPSSLSRATSPPCSAPCRRPRSGSARADRLAGPIRAAVAQLAANSVVPGVQDRRRAAAATSPASTRAGRSAAAAAAHGSIWVSAIGRDDALIGARSWHGTELSRTIISCWFIKIFLCFFWGGNCRIEKMVLFIL

SEQ ID NO: 61289 - protein, 52 aa, Sorghum bicolor
  Clone ID: 9303746.pep
ELLHDYRVEHVATFFTQKQLICWCFVISLLLIRSQHPVFLTIIPIHKDTAIC

SEQ ID NO: 61290 - protein, 75 aa, Sorghum bicolor
  Clone ID: 9303747.pep
PWHSDEHERKVASWYNLAISESVETLSLAPFSRVYNWPLEKIKRLATDVKTEAFNKDLHCYNILHIYQARKPSAA

SEQ ID NO: 61291 - protein, 102 aa, Sorghum bicolor
  Clone ID: 9303762.pep
ARGDHGVYYCLVALLPLAYFLLKSLSKKAPCHGLELPPGPWQLPVVGSIHHLRGSLLHRALRDLSLRHGPLMFLKFGELPVVVASTPDAAKEVMKTHDAIFS

SEQ ID NO: 61292 - protein, 142 aa, Sorghum bicolor
  Clone ID: 9303771.pep
RKIDGKSIGKKQMAIEGYKAQSEMVIDSLDRLITAWEDRKESVVVEGVHLSLNFVMGLMRKHPSIIPFMIYISNEGKHTERFAVRAKYMTLDPTKNKYVKYISNIRTIQEYLCSRADKYLVAKVNNTNVDRSVASIHATVFS

SEQ ID NO: 61293 - protein, 82 aa, Sorghum bicolor
  Clone ID: 9303775.pep
GLRSISSLQLRHQFPQQRGHPRRHLLPSATPLKLHEAREVNLMSSSCSCLTSNYIICNDGSCKEAPCSSRCFWPAQLSICNV

SEQ ID NO: 61294 - protein, 96 aa, Sorghum bicolor
  Clone ID: 9303788.pep
WIISTTKLQNLTQYQAVERVNPTLVPTNLDVGTMVTFPIFCQCPAKDDNATALVTYVMQAGDTYSYIAADFSVDTQSLVSLNGPEPRTQQFDEILV

SEQ ID NO: 61295 - protein, 210 aa, Sorghum bicolor
  Clone ID: 9303794.pep
MGEKQAEAAPHMASADRHDQAVVYLEGHSDVHPNVDLVALRRKIDRRLLPYMFCFYVLQFLDKVMLNYAAVMGIKKDLKLAGNEFSNTATWFFIAYLIAEVPNVYCLQKVPAAKWLGGNVFLWGVAAAASGGATDYRSLLVARVFLGIFEATVGPSLMLMSSQYYTRSEQAPRFTFWYMGLGVAQIIGGIISFAFQHVHHASLAGWRIMF

SEQ ID NO: 61296 - protein, 68 aa, Sorghum bicolor
  Clone ID: 9303804.pep
PTSTVSWSLITSISKNFKVNSFQKKLIKEERTKERQITVVLEAKLKVLSDFANHVGIELLFRGVSPQS

SEQ ID NO: 61297 - protein, 162 aa, Sorghum bicolor
  Clone ID: 9303808.pep
MEAIRLAYVLVFLLPFFLLLLRLRKRPATTTAHSPHPNPVLGNTLAFIRNRRRFFDWYTDLLRAAPSGAAVEAWGPFGAGHAVTTASPADVDHLLRAGFDGYARGALFRDATADLIGDGLFAADGRLWSLQRKLASHAFSSRSLRRFTGDVLAVHLRRRFLP

SEQ ID NO: 61298 - protein, 175 aa, Sorghum bicolor
  Clone ID: 9303812.pep
ARGNNPDYEARFLTEDDGDDYIRKTFADSRPDIVDTYLALPIPIYKADFLRYVLLWNEGGVWSDLDVSCEENVRIDEWVPEIYKDKAALVVGWEFDQGWPGRYERQFESWTIMAKPRSPHMMQVIDDILQTLQEKTAEFDVSVNNITMDMMGDTVDFTGPRRLTRSVYTSLGSVL

SEQ ID NO: 61299 - protein, 194 aa, Sorghum bicolor
  Clone ID: 9303821.pep
ARGSGTFIGYVAVSTDEETARLGRRDIAVAWRGTITRLEWVADLTSDQIPLRETGVPCPDPDVKVERGFAALYTDKDAGCRFCRYSAREQALAEVRKLVELYHGRGEQVSVTVTGHSLGSGLAMLCAFDVAETRANASPDDGRVRVAPVCVFSFAGPRVGNVGFRRRFERELGVRALRVVNVHDRVPKVPGVFF

SEQ ID NO: 61300 - protein, 56 aa, Sorghum bicolor
  Clone ID: 9303835.pep
ASVCIWYMTRTLPWGANAFPENCLRTNLRRQCAHANWLDLILNKCPIAGNICCWKF

SEQ ID NO: 61301 - protein, 130 aa, Sorghum bicolor
  Clone ID: 9303841.pep
FGIRKTSNRWAWNVLCTIPGIIGGALLSFLPKSNKAGVLIGIYLVNSIVATLPILYQWTMANCAGHTKRAFASALVAGSFSVGNIIGPQTFQARDAPQYKPAKIAVLATQAGAALRVGMCSFCTISGRIV

SEQ ID NO: 61302 - protein, 116 aa, Sorghum bicolor
  Clone ID: 9303846.pep
DDDDGDVKGMHYLHAAITEAMRLYPPVPFNGRVAVRDDVLPGGAAVRAGWYANYSAYAMGRMEKLWGKDCLEFVPERWLGERGEFVPVDAARFPVFHAGPRVCLGKEMAYVQMKTV

SEQ ID NO: 61303 - protein, 43 aa, Sorghum bicolor
  Clone ID: 9303863.pep
LHVPGPLLVPRECQEQCRILGYDVPKGAMVLVNAWAIARSPDC

SEQ ID NO: 61304 - protein, 135 aa, Sorghum bicolor
  Clone ID: 9303886.pep
PELVLRAVGRLGVGGVYTHLGVALELDHRASPFLKETLDISCYHNLEAHLHLLDGFRGSGEGFELRGRDPALVNKSSDFLREDHMVPPVWYQAENKGMVRTEDGRWVLPPRQRELDQHPEDTDHHLQRLGLTLTA

SEQ ID NO: 61305 - protein, 209 aa, Sorghum bicolor
  Clone ID: 9303895.pep
HEDCGLVHCHSCSSKKALRAALSPNPGKPYRVCDSCYVKLSKVLDSGVSYSRNTIPRIPGDTKAERIDTKANKVAPSSSSDMIRNLDVKAAKQTKKSDYSSQVPAMLQLKDIPFISAPDLQNSSTVANQFPYDSRSTLPFLRMPYLNYSSSLSSESSESLRDANELLKQEVQKLQAEVNSLRQEREQQDTELKKSEAKAHEAMNLATEE

SEQ ID NO: 61306 - protein, 51 aa, Sorghum bicolor
  Clone ID: 9303916.pep
ARGNNNFTATIYAADVGDPIDRNLYGSHPFYLKTRYFEKGGNGSKTPLKQT

SEQ ID NO: 61307 - protein, 116 aa, Sorghum bicolor
  Clone ID: 9303941.pep
MDCDRCSLEEQVKGMPILELLKLKMCKLRRVPPGLAFHARALKKLCIYGVKHLSSLENFASVVHLDVFTNTHLERISNLPKLQKLVIVMCPKLKVVDGMPALQRLNLEDYDMETVP

SEQ ID NO: 61308 - protein, 135 aa, Sorghum bicolor
  Clone ID: 9303944.pep
MAGAEDYDTAAAVAVFHESRAGVCGLVQSGVKAIPPIFLMPTSPSPRSPTTTTAFAIPSVDLSLPRRDTVALVRAAACSCGFFHVTNHGVPAGVVDSAVSAVRAFHDEQPRAARSAFYSIEPAVGGAGAVTYSTI

SEQ ID NO: 61309 - protein, 158 aa, Sorghum bicolor
  Clone ID: 9303947.pep
HEAPVPPAEPLAFPRSVSPYVSRRKSDTAGALRHHPSLLFFRTPQVGPAYGGGAGGALEEGDIAYEYEKRRARKFSVLATLFGHHHHHHHHRSEEKHHHQQEGAPKERKKRSWTWFAGIIPRRRKKQSAAAAAAVSATSPQSAPPRRSSCRADNNRGL

SEQ ID NO: 61310 - protein, 62 aa, Sorghum bicolor
  Clone ID: 9303983.pep
PFNLTCPTAGAPRMVTLASASVSLNSPSTLTFSCPVIAANVTSRHDSGSKDSPSSTYKLPKA

SEQ ID NO: 61311 - protein, 87 aa, Sorghum bicolor
  Clone ID: 9303984.pep
VEHDFIMATYLADRVIVFDGQPGIDAHANKPESLLTGCNTFLKNLDVTFRRDPTNYRPRINKSGSQLDQEQKMSGNFFFLEETPDKS

SEQ ID NO: 61312 - protein, 138 aa, Sorghum bicolor
  Clone ID: 9303988.pep
DKRAYGSMIMAYIRADMLQEAEGLIKEMEDQQMFAGKEVYKALLRAYSYRGDSDGAQRIFDAIQFAGIVPDTKLCALLVNAYCLSNRIDEAVCVIRNMRCAGVKPCDKCIALVLGAYEKVNMLETALEFLTELEEKGV

SEQ ID NO: 61313 - protein, 69 aa, Sorghum bicolor
  Clone ID: 9303996.pep
KRCCRLHGSAGTLHQTSHSSGDRRCTCTCCKNTLHGRNEMVKNLPCSINHVSRRCKHAQLLKQREAINV

SEQ ID NO: 61314 - protein, 142 aa, Sorghum bicolor
  unsure (1)..(142): unsure at all Xaa locations
  Clone ID: 9303999.pep
ERVVGSLEHTDPSLFTVLAQDGVGGLQVRRDDGDEWVDVVPVTGAFLVNIGDVLKVVSNDEFKSIEHRVVIKXSTQNARVSIALFFNPGKRENSDRFGPLPELVTAEKPARYRSFTVPEFMSSRKEYGHNRSSIDLFKVSSS

SEQ ID NO: 61315 - protein, 148 aa, Sorghum bicolor
  Clone ID: 9304029.pep
FESKGLVDANQVLAYFAVSKLGEPPVDGITDTNPEGLTAAFGSWAPAVAARLQNGGLTCKVLQKEAFQKQMLEKLIWISAFMLVGARHPGATVGVVEKDYRSEVASLIAELASAAAAERGLTFDEGIEERLCAYSRAVAHFHTAVKEF

SEQ ID NO: 61316 - protein, 71 aa, Sorghum bicolor
  Clone ID: 9304033.pep
AVLEQQLDGLHVVGVGVGEDEILGLGDAGYDLLVGQDPREEAEDAKDKAKDQHMTHLGGHDGRCGLPMPRA

SEQ ID NO: 61317 - protein, 161 aa, Sorghum bicolor
  Clone ID: 9304035.pep
PASTCTYVVPVPREARKMAAAGIVVVLCIGLLSSCVGLGLARGDFSIVGYSEEDLSSHESLAELFERWLSRHRKGAYASLEEKLRRFEVFKDNLHHIDETNRKVSSYWLGLNEFADLTHDEFKATYLGLSPSGGGGDVVHMHHDDDDEEPEEEGSSSSSSF

SEQ ID NO: 61318 - protein, 159 aa, Sorghum bicolor
  Clone ID: 9304047.pep
MSGWGMGWFGGGQAKKEAPKKAILQLRGQLEMLNKREKHLQNQMDEQDALARKYVSSNKQAAKNALRRKKQFEHSLEQTSSQIMSLEQQIYSIESANINKETLDAMKNAGAAMKQIHAGLTIDKVDNVMDDLREQHAIGEEISEAITSSVANNAIDDGE

SEQ ID NO: 61319 - protein, 193 aa, Sorghum bicolor
  Clone ID: 9304068.pep
ARGFLSPWWDDISKSAQDLVSHLLTVDPEKRYDIKQFLDHPWIRQSDEQTTAAADAPPLATPLATRGGSLSAGEEPLKQNFEYLEDAPGGAGKKQDFRSPGAVNLREVFDVSYAVHRQEEEGKRRKNFTQGYRGGGPMDSLNPLNEDYEEEYEESAYANPPAKLPKSGAPDVSGVEKQMRNTSLSSAAQARQA

SEQ ID NO: 61320 - protein, 66 aa, Sorghum bicolor
  Clone ID: 9304080.pep
MGFPSVCYCVILPQPLILVLQLLDFLRHAVLLCLSSLGLAASPADDDHPAYYAAPPAPADLWALQP

SEQ ID NO: 61321 - protein, 195 aa, Sorghum bicolor
  Clone ID: 9304082.pep
MATRADVEKGGVVRKEPGKVPSPLYPQHEGEREWVPWIVPVFFVANITVFVITMYVNNCPTHTTTPRDAKCVARFLGRFSFQPLRQNPLLGPSSATLTKMGALVWEKVVHHHQGWRLLSSMWLHAGVLQLVANMLCLLFVGMRLEQQFGYVRIGAIYILSGLGGAVLSSLFIRNHISVGASGALFGLLGAMLSEL

SEQ ID NO: 61322 - protein, 180 aa, Sorghum bicolor
  Clone ID: 9304094.pep
ARGVVWQTGSGTQSNMNANEVISNRAIEILGGTMGSKKPVHPNDHVNRSASSNDTFPTVMHIAAVLDIEGELLPALHSLRAALQKKVDEFEAKKIIKIGRTHLQDATPLTLAQEFSGYVAQLDFGIKRVESSLPDLRLLAQGGTAVGTGINTFQGFAEAIAEEVTKMTGTEFKTAPNKFE

SEQ ID NO: 61323 - protein, 76 aa, Sorghum bicolor
  Clone ID: 9304100.pep
GVFDGPCGTQLDHGVAAVGYGTAGKDNGHVVADYIIVKNSWGPSWGEKGYIRMRRGTGKRQGLCGINKMPSYPTKN

SEQ ID NO: 61324 - protein, 50 aa, Sorghum bicolor
  Clone ID: 9304106.pep
VTLSCLCLPSSACLLWVGSRIQPSQSHIANNSSLLLAMAVALSFADKNKA

SEQ ID NO: 61325 - protein, 79 aa, Sorghum bicolor
  unsure (1)..(79): unsure at all Xaa locations
  Clone ID: 9304113.pep
LMRPHFGWMERYSMPAGAPCTARKYLAYQWILXAVALLLLVVGFAVGMAMVFRGSNANDSCHWCHYLSCVPTARWNCTN

SEQ ID NO: 61326 - protein, 101 aa, Sorghum bicolor
  Clone ID: 9304126.pep
LLPQHKRDKRRLLGSNLLREAMASTAPRSLRQRRSKFVTRAPSSLTWRAPPCWVAVARRVPAICANRWFSNPLATRRRFCVVTFDAGGTTVARNSGRILAI

SEQ ID NO: 61327 - protein, 97 aa, Sorghum bicolor
  Clone ID: 9304148.pep
TSLAWARMRYTVFRRTAIYGQKRGHFEALKPPPLFSYLSIHFVLLIITASDLFFLFSFSYPVCYGITPHQMVPTTTTTSPQIYEVLIFWWEGLPQRK

SEQ ID NO: 61328 - protein, 100 aa, Sorghum bicolor
  Clone ID: 9304153.pep
NLLHSSRLLTDGMRSFEKNLVAGLAANEEKIASIMKESLMLVTCLNPKIGYDMASKVAKNAHKKGLTLKQSALELQALTEEEFDTLVKPELMVGPSPYKG

SEQ ID NO: 61329 - protein, 187 aa, Sorghum bicolor
  Clone ID: 9304168.pep
AASPVPSYRFPFAVLRDATNDFDERLVIGAGGFGKVYRATLPDGTSVAVKRASPESRQGAREFRTEIELLSGLRHRHLVSLVGYCDEGDEMILLYEYMEHVSLRSRLYGAGAATAERALGWAQRLEACAGAARGLLYLHTALAKPVIHRDVKSSNILLDGGLAARVADFGLSRAGPELEETHVSTAV

SEQ ID NO: 61330 - protein, 183 aa, Sorghum bicolor
  Clone ID: 9304204.pep
HEALLEQDSLAISPFSFYSMAAAAVQTYTPASYDHRAVDAMTDVDVAAQRLQELNGLDHMKSCIRDVFMKHGVDKVFGIGLLHRHYDVAPNEKIIELGPVSSPWVVGDDEAITGGSVLPHTWRVFDGELKPTEFKFVPQRELSNVDRPVFPAAFVKELIGVLQETGLDEVLGVSLYEAGDPDN

SEQ ID NO: 61331 - protein, 72 aa, Sorghum bicolor
  Clone ID: 9304217.pep
KQKQIDDISSYLMSTEATEGEVAVLVTYFCCVAWHPCVSTKICFHTSSAYNGMNVNIWISTDFARMIFLTKS

SEQ ID NO: 61332 - protein, 63 aa, Sorghum bicolor
  Clone ID: 9304232.pep
MESVKMRAAMATKREYRRMEVGEEGEELDEAEWAHRAEAQMQRRRRGQRYAFSCALFAYLNAI

SEQ ID NO: 61333 - protein, 202 aa, Sorghum bicolor
  Clone ID: 9304242.pep
CAAKASEGVNSRHGICAARSADDGLKAQHGICAVKAADGGLKAHHGICAVKASSDGVTSRHGICAAKVADDGMTARHGICAAKADDGFTARHGICAAKAPEEGLKARHGICAAKAADEGITARHGICAVKAAEGLKTYHGICAARSTEDGVKAHHGICAVRTAEDGIKAKHGICVAKVADEGMTARHGICAARFANGAGIKV

SEQ ID NO: 61334 - protein, 97 aa, Sorghum bicolor
  Clone ID: 9304262.pep
APANAYRVAAGDESGSGGDDDDDSRSECSSLDDPKYVPFQANNISFQKRQALVTYLENNRAGITVYGFVVDRAWLHALFMIEFSLVMWLLGKTVGIS

SEQ ID NO: 61335 - protein, 70 aa, Sorghum bicolor
  Clone ID: 9304263.pep
CFHMHKNMYKYTLTLMRSTLLSSKGHQALSGRAQGRAFPTSGKTIAESMCTVRDIVLHALDKPNLHAQKP

SEQ ID NO: 61336 - protein, 129 aa, Sorghum bicolor
  Clone ID: 9304278.pep
WQGRGELDKIVDRRIAAAVRPQALRKYGETAARCLAARGADRPAMEDVVWSLQFVTRLQDDDGLEFSDVNSLSLVRELMPPLDSRRTSSHQNEAGCEEGEGATDASFTDVDVSVSMRGVFWQMVNVGGR

SEQ ID NO: 61337 - protein, 161 aa, Sorghum bicolor
  Clone ID: 9304304.pep
ARGFNYRAAVLADTRAAAAAAGDPALAGLVESGALVRVPRRRFGPVPAWRPPDFVEPDEVWILGTSHLSPDSVADVERVLRAVQPDNVVVELCRSRAGIMYVSSDSSDEPLLKSNMFSLGGSKFFGAVNRSINLCGQSAFALRLLLAVFSSKISSSANRPF

SEQ ID NO: 61338 - protein, 167 aa, Sorghum bicolor
  unsure (1)..(167): unsure at all Xaa locations
  Clone ID: 9304311.pep
MEQSMMLPSAELSASNGGGGASGLPTLPDFLGRKSKYVRMDDVLPLEQEGEDGGGVCVRERQSSRRYVFACSVFASLNSVLLGYXDLHINEVQQEVLVGCLSFISLLGSLAGGRTSDALGRKWTIGLAAVVFQAGAAVMTLAPSFGVLMVGRLLAGIGIGFGIMIAP

SEQ ID NO: 61339 - protein, 172 aa, Sorghum bicolor
  Clone ID: 9304316.pep
GKLESTAVLKAICAGFKESTEPHVCLTPGMETDECLNNNGGCWRDEKTNVTACKDTYRGRICQCPVVDGVQYQGDGYTDCKAVGLGRCAMDNGGCWKETRQGKTFSACSDPELSGCKCPPGFEGDGFHCQDVDECRDKLACSCPHCSCKNMWGGFDCKCNSGMIYIKNEDTC

SEQ ID NO: 61340 - protein, 148 aa, Sorghum bicolor
  Clone ID: 9304324.pep
MGAAPGGGRVPARAMADALEDVRSILLKPSERLDDKRFTRIAGADFDDASLGLAELLASLASTGFQASNLGDAIDVVNQMLDWRLSHEKPSDDCAEAELDPAYRESVKCKIFLGFTSNLVSSGVREIIRFLAQHAMVDVIVTTAGGIE

SEQ ID NO: 61341 - protein, 190 aa, Sorghum bicolor
  Clone ID: 9304331.pep
LQRTFMKAVENLLKRPRRLIKKADDTRWFFILLANPLLSSPGAYSPHRPAQGVNRDARRPSHPNEGPRPTTRDSKSSHKDQNRHGGAHNHHGIVKRILGLMSNASHECHHHFISWFSRYSPSQFERIVELINGFVTYRLLRQHGRKRSEATHDGDDLVPSFASAAGTTPAELHAAINNRRSPNKKPAKKK

SEQ ID NO: 61342 - protein, 90 aa, Sorghum bicolor
  Clone ID: 9304340.pep
IHPCMYFSRLRCGAYCSMNIFEFDSYTVRNIIPKNMYYGGKRWYILAYSSCALDHAFHESWCMKARQADSIIRSWTPGGDGIRNYILPSC

SEQ ID NO: 61343 - protein, 180 aa, Sorghum bicolor
  Clone ID: 9304341.pep
SFGVLVLPLALGVLYDKHRGIDARPELNGATAPLPIFSFITNYIDPQNFYYPIVEQLVQMVHRVFPFSRGLFEDKVANFWCALNTVIKLRNYPVELLQKAALGATLLSIIPPNLILFLRPRKSALPVAFAATAWGFFLFSWQVHEKSVLLPLMPMTLLLAGKQGMSGEVRAWVGFANLLG

SEQ ID NO: 61344 - protein, 44 aa, Sorghum bicolor
  unsure (1)..(44): unsure at all Xaa locations
  Clone ID: 9304360.pep
LDGGLNQQRMGICDAVAXAKILNATLVIPHLEVNPVWKDSSSFE

SEQ ID NO: 61345 - protein, 66 aa, Sorghum bicolor
  Clone ID: 9304372.pep
RFRQTVRTVPGQGGPAGLQNQQGVPVPLPQGNSQWTAQDPRPQEYQGHGNTGLEQDLQGGLDASRR

SEQ ID NO: 61346 - protein, 132 aa, Sorghum bicolor
  Clone ID: 9304374.pep
RPVLLKVTDTEDEAKERLAEIEAAAAGTTTGAAGKYGDRTVWQELSRPSPVIARMLVTGVGIQCFQQITGIDALVYYSPTIFRDAGISTERQLLAATVAVGFFKTAFIALAIVLIDRVGRKPLLYVSTVGMT

SEQ ID NO: 61347 - protein, 57 aa, Sorghum bicolor
  Clone ID: 9304378.pep
LVLSCVAGIGIAGYLFYKFRLRRYMDSEIMAIMAQYMPLDSQHNENQPLRTEEAQQA

SEQ ID NO: 61348 - protein, 59 aa, Sorghum bicolor
  Clone ID: 9304384.pep
SPTSPEAYSPTSPSFSKSPGSQQSPTSPSYSPTSPSFSPRTPGPGASGNQYSPNSPAND

SEQ ID NO: 61349 - protein, 91 aa, Sorghum bicolor
  Clone ID: 9304401.pep
ASWNAPFQEGQSKLVQWGTALLQSTFYVTMAAWHVVEAFVVPPPGKPDLWVVANVGVGAAGFSICYLWCLWRLLRETEFLASTPKTKAKTQ

SEQ ID NO: 61350 - protein, 186 aa, Sorghum bicolor
  Clone ID: 9304590.pep
HEEKIKVSLAFKDPVDPVALNIPTYYDVVKHPMDLTTMEAKLKEKKYTYVRDFMADLDQMITNSELFNNKQHPVTQAGYNLRAYFLKGMGKMPRGAAAEEPPKPAKAKKPTVNTAQKARRESRVAPPNVKSPAAPTPAATSPQAAWPLQQDGTPLIRRDSSTADGRPKREIHRPSKDLPYANAKPR

SEQ ID NO: 61351 - protein, 120 aa, Sorghum bicolor
  Clone ID: 9304605.pep
GKAIVCPQHLSLRTLGVDTVSGAAGNGAMPGDRREPLPGAARPRRRQVQRNVQRLRLPPGVAGPGRHVRRESRRACRGGGGGTERRRRQRLLLLQRQRRDQEEETGRVPRCQGWCKRHEQ

SEQ ID NO: 61352 - protein, 169 aa, Sorghum bicolor
  Clone ID: 9304642.pep
MPLIRPCMQAATMQVLQLLLPLLLALAPVSILLVVRRATPPPIKARLATLKSAIARARKPIIFVTDFATAHHLLVRGSRSTTAAAAGGGSFSNRPPSMAPSAVLSGRRYHNINSAPYGQLWRALRYNLTSGVLHPTHLHRYAAARRHALRGLVADLSEQQQVAAGVVLA

SEQ ID NO: 61353 - protein, 125 aa, Sorghum bicolor
  Clone ID: 9304677.pep
RTSPWASRSRKTTCARSKRSCSRSRAVHRDPASLHLCTMHLATTTSRAALKARKSKTSLATPSCFRVTCFVCHALFCPALSLRVLMIGPVFIHHFSSLHDMNSLELLGPADPASLPIYQRAKAEC

SEQ ID NO: 61354 - protein, 162 aa, Sorghum bicolor
  Clone ID: 9304691.pep
ELVPGCSKVTGKAGMLDEIINYVQSLQKQVEFLSMKIAASNPVVSFDIVEDLFGRQLKQAAALPAMALPAGQLEPSCLQMSPMQQVHPSAAAGGSTGFGLEMVVNNLYAPAAASCPVSAAPSVSAAAGPSTIEPCLNVNGTAAAGILAPRICSAVLMHNFSQ

SEQ ID NO: 61355 - protein, 155 aa, Sorghum bicolor
  Clone ID: 9304725.pep
ILEALRLHPTTKLAFRQVTEEDQVVHDGHRIPAGTKMVFPLEALARDKTVWDDPDEFMPERFHGCGGGESTKKLLSMAAEMKMMPFGGGRRMCPAISVSLLHISYFMANLLREFEWREADGEHTIQLHTDPAIEMFNFMKRPMRAHLVIRRQKGT

SEQ ID NO: 61356 - protein, 126 aa, Sorghum bicolor
  Clone ID: 9304727.pep
IDAYNKRLTSSDPIVQVEAAKRWTMWEMMTAHLIQNNDNIKRGEDDKFSLAFARIENHYFVNKGFLPSDSFLLDNVDKIRHIKAFIVQGRYDVCCPMMSAWDLHKAWPEAEFKVVPDAGHSANEVG

SEQ ID NO: 61357 - protein, 197 aa, Sorghum bicolor
  Clone ID: 9304761.pep
ARGSFEKWFELKAHGGHATSPPVSLRVAASATVPSSFQKVFSMVMMEPFSLKSCLLPHSIKDQNMSSWTRFVYDCGTELIRLQIREQKAKNGMAAVRELVGVLKSPKKQFQLAEFKENKWTLKDSMLSITHGTDGSLLDLKGDNQLIKLYQGRKLEYERKCCSAHSEDVSAVTAVKFCAEHPYGKAVALLDTESQLI

SEQ ID NO: 61358 - protein, 50 aa, Sorghum bicolor
  Clone ID: 9304765.pep
SRRAPSSGNPRPRRQRAVTLGSEHRVASSHWTPSSESGSATAGWGPEEAP

SEQ ID NO: 61359 - protein, 154 aa, Sorghum bicolor
  Clone ID: 9304802.pep
MASSSTLDLAMGPGVLVPRSAVPYASFARGRGRSASGRRSRNLVLSASFSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRHHMR

SEQ ID NO: 61360 - protein, 152 aa, Sorghum bicolor
  Clone ID: 9304835.pep
AEADVWYTAAGGGGDPGSPCPAASRQVEVEGRSAGGQRGAPRRGVQGGLSQAFGDGPGGRQVAASAPVEVPAWPARFAVPDAEPALLFEMEMGDDDDEGDGKRGAGGWVPPHVYLARRQERASVVEGAGRTLKGRDMSRVRDAVWSRTGFDG

SEQ ID NO: 61361 - protein, 152 aa, Sorghum bicolor
  Clone ID: 9304849.pep
GNATTTTSSSPTAYEMLERYDFPRGILPAGVSGYELRGDGSFEVYFPRRCEFLLAGTWLVRYEPRVRGSVAAGSLTALDGISVKVLFLWLGVGEVDRAGDTLSFYIGPVATSFPLDDFAESPRCRGYDYDGDGDGAAAGDDLFPAAAVAASS

SEQ ID NO: 61362 - protein, 152 aa, Sorghum bicolor
  Clone ID: 9304857.pep
RRKTRLAGLADRCWVIYDGDADADKSAAATPTPLLSVRRHATSGGCKTLARVDAARLALPLPAAAAPSYVVEGSYGQRACAVRDAARGGAVVAEVQRKEAVGDDVFRLVVPGPRLAAPLAMALVIALDDMFRGGSGAGGWSARSLLGRTLSA

SEQ ID NO: 61363 - protein, 37 aa, Sorghum bicolor
  Clone ID: 9304870.pep
AHCAPILWRSWLGNSQTSVPIENKMPTLATKLLQSVI

SEQ ID NO: 61364 - protein, 66 aa, Sorghum bicolor
  Clone ID: 9304888.pep
LVAVAIVAVSFLVAAGDASSVGFDLHHRFSPVVRQWAEARGHPFAAQDWPARGSPEYYSALSRHDR

SEQ ID NO: 61365 - protein, 48 aa, Sorghum bicolor
  Clone ID: 9304897.pep
LWISESDCYFISSYFFEGFLSYLIRGSYIQDTTIHQASLLSLYRSHQC

SEQ ID NO: 61366 - protein, 155 aa, Sorghum bicolor
  Clone ID: 9304909.pep
LRSMETATVVVAPAPVSITQPPQHKLMELKPAFAAVAKPSPARKAKPAKKKLAGGCGGYVLEDVPHLTDYLPELKSYPNPLQDHPAYSVVKQYFVNPDDTVAKKIVVHKSSARGTHFRRAGPRQRVYFQPDEVTAAIVTCGGLCPGLNTVIRELV

SEQ ID NO: 61367 - protein, 94 aa, Sorghum bicolor
  Clone ID: 9304915.pep
EHARTGSSAAAEWITHHAGTRAGGRITQGPAGRMPWRTSILLLRSTSIANSPLFNASVTDLHCTIPLTINSMRFIKQTKNRCKARRGNHHLPSP

SEQ ID NO: 61368 - protein, 166 aa, Sorghum bicolor
  Clone ID: 9304935.pep
MNGWLWQSVTLHTNLGDIKCEVFCDQVPRTAENFLALCASGYYDGTVFHRNIKGFMIQGGDPTGTGKGGTSIWGTKFADEFRESLKHNARGIMSMANSGPNTNGSQFFITYAKQPHLNGHYTVFAKVIHGFEVLDLMEKAQTGPGDRPLAEIRLNRVTIHANPLAL

SEQ ID NO: 61369 - protein, 76 aa, Sorghum bicolor
  Clone ID: 9304940.pep
ILGLRVMTRRSGFGLRITSAGSGSAFDQAEKKAGRSRVLSPNEQIDEQIRRRRGGRWPVDPRPRAEFGTRQLSMVG

SEQ ID NO: 61370 - protein, 119 aa, Sorghum bicolor
  Clone ID: 9304966.pep
VVGYCLAIMKNDLGVNFNIIGQNFMTGLKVVFDREKSVLGWEKFDCYKNARVADAPDGSPSPAPAADPTKITPRQNDGSSNGFPAAAPLPRSAGSRNAAASALGAGGLSLLMLVAATLV

SEQ ID NO: 61371 - protein, 128 aa, Sorghum bicolor
  Clone ID: 9305025.pep
PQTKVLAHAATGGFLTHCGWNSVLESLVYGVPMVAWPLFAEQRQNAVMLSDGVGAALRVPESSKGREEIAATVREVMQGEGKGAAVRAKVAELQKAAAEGLRDGGAAATALAEVVEGWTTTGGQEEED

SEQ ID NO: 61372 - protein, 105 aa, Sorghum bicolor
  Clone ID: 9305092.pep
PIAACSSSSSFLQCSWSSRRSWWCCARLAVSAACMATGAAAFGIVQSDRALVLDRHVQNWLVWIGLLYCYAIVLSMDHAGRPAAAAWYGVGFSISFCVLWESSKC

SEQ ID NO: 61373 - protein, 62 aa, Sorghum bicolor
  Clone ID: 9305186.pep
MGKVHGSLARAGKVKSQTPKVEKQEKTKTPKGRALKRLKYTRRFVNVTLTGGKRKMNPNPGS

SEQ ID NO: 61374 - protein, 60 aa, Sorghum bicolor
  Clone ID: 9305212.pep
RREIAPLIIDEQLGWMSLSIIAIDLQKHMSRRQQQQMAAQHPFQNPSPPRLAVVVACCCW

SEQ ID NO: 61375 - protein, 51 aa, Sorghum bicolor
  Clone ID: 9305245.pep
DQRTVVTKTGLSSPYKGYNRNSTLFNNNIAKSIGPELHTKIDPYVFGKLAI

SEQ ID NO: 61376 - protein, 56 aa, Sorghum bicolor
  Clone ID: 9305267.pep
SFSDHEIQGQKGSICSPLLCLHLSLIALALALALLRFNLGGCFALVVRSFVLRHVA

SEQ ID NO: 61377 - protein, 164 aa, Sorghum bicolor
  Clone ID: 9305292.pep
NSWGKYGIIREVDMWNKRPEFTAWLSEVKQVNLEALSNWEEKQMFKEFMEDHNTATFPSKKYYNLDAYHRKAMEKEKKKGLKVSVTERTVFNDEEQRRLELLKERERRKEEEVEALKRSMQAGLAQDMKEQARLREEMNYQYRLGNFQAAAAIQKRLDPDAPLQ

SEQ ID NO: 61378 - protein, 121 aa, Sorghum bicolor
  Clone ID: 9305357.pep
CWWWVFSCKLQCLVTVVRAVASVMLRMGAFSKSRLLLWCFQSQADVSQQRSSPPCSCLHPPADHPHQTRRLRRPTVSPRGRDRDGCVLCVVAGVEHVAELIEHLAGLPLAAGGHGCMPGFL

SEQ ID NO: 61379 - protein, 136 aa, Sorghum bicolor
  Clone ID: 9305363.pep
FSQLLVGIDIDIFTCMLNRKNQKRMPSSRVAQAQNRPPARWTAMARVKKRWHGDVHFTCRRVPWIFSWSSGLGLLTLTGGRPLGLTKTACVLAPAAACSWERQMLMVVASGCVVPDVCFWSKTETLLWNFAMPSFC

SEQ ID NO: 61380 - protein, 140 aa, Sorghum bicolor
  Clone ID: 9305370.pep
ITLSLLGLAIWSGPCEHHHRPAGSRWCVHFSFLSCNFQCAGARLSRVRPGSSRRIAVGACDDQYRAPASARDTTAMRTSWRTDGGTRAAAVADPTTTWSPPRYIMVAFISGRPPPCAPPAAFTLVVLGQKVMAYVVSPPA

SEQ ID NO: 61381 - protein, 187 aa, Sorghum bicolor
  Clone ID: 9305423.pep
SELRCFDISNNDLNTQDLSWLHHLSLLRNLDMSGVDLSSARDWVQWLNMLPALRVVRLSDCRFSGGVEKTLTHSNLTHIEVLDLSRNSFNFSVHHNWFWGLTSLKELHLSNSEWSGPIPDALGNMSSLQVIDLSQNHILSGNIPRNLASLCDLQILNFEEVNINGDIEKLMERLPKCSWNKLRVPSC

SEQ ID NO: 61382 - protein, 64 aa, Sorghum bicolor
  Clone ID: 9305428.pep
PRFFFFFFFFFFFFFFFFFFFFFFFFFFFFFFFFFRGAYIICHHWKFGSDGGCTSTTETTKEKG

SEQ ID NO: 61383 - protein, 176 aa, Sorghum bicolor
  Clone ID: 9305431.pep
ARGSDSSNQGVKEFLAEAQTLTRIHHKNLVSMIGYCKDGDYMALVYEYMPEGTLQEHIAGNGRSRGFLSWRQRLRIAVESAQGLEYLHKGCNPSLIHRDVKAANILLNAKLEAKIADFGLTKAFNLDNNTHVSTNTLVGTPGYVDPEYQATMQPTTKSDVYSFGVVLLELITGRPA

SEQ ID NO: 61384 - protein, 96 aa, Sorghum bicolor
  Clone ID: 9305460.pep
ARGLVPNSARGFMAAYLLSLKGTKDLSPDQLQKALRKTFSAEKKKSKIRKAWDGTKVIYNVASWGATAVGVYNNRALLTVATTAFRTSCRVISKFL

SEQ ID NO: 61385 - protein, 162 aa, Sorghum bicolor
  unsure (1)..(162): unsure at all Xaa locations
  Clone ID: 9305470.pep
HEESPSITNTTKPYRGSPSSSLSHISPLFTNTPPPPQNKMPFFGGGRREPSPEPVREPTPPPPEPRRHGLFGSRRDPSPTPTTRTSATSRSSLSSTTYHTSPDGGHHNGTGGGGVGGVFRRSTDASSGRRGILHKFGGAGGAVEMDPXIVQARERVMSAEAA

SEQ ID NO: 61386 - protein, 177 aa, Sorghum bicolor
  Clone ID: 9305474.pep
TRPPSTASSAVLTSGGRNVSSSPYGATWRALRRNLASGVLNPSRLRAFSPARRWVLDVLASRVRADGRHGETPVAVMEPFQYAMFCLLVYMCFGGDRLGDDARVRDIEATQRELLANFLSFQVFSFLPSVTKLVFRRRWEKLVSLRRRQEELFFPLIRARREAGADGDCYVDSMVKL

SEQ ID NO: 61387 - protein, 46 aa, Sorghum bicolor
  Clone ID: 9305493.pep
CPKKWMFPNNSSGPQILKVFVAKIFHFAQGINASCSKVHGQFIFYF

SEQ ID NO: 61388 - protein, 79 aa, Sorghum bicolor
  Clone ID: 9305531.pep
HSMACFDKSGKKNGIPINSLDITHCSYAHELFDVSMYLYSTDYLRTYETTTTPSRHEDSTVRLMGRRLFKSVVNRTCTW

SEQ ID NO: 61389 - protein, 174 aa, Sorghum bicolor
  Clone ID: 9305582.pep
TRNNLQLLPLIMLVLLVSKAVGDFFNEGLYEEQARLRGIPLLDSRPKQVMRNMTAKDACKNQKVVCLPRVSRIVDIVSVLRTNKHNGFPVVDRGQNGEPLVIGLILRSHLLVLLQAKVDFQNSPFPRGPGVLNRHNFSDFVKPASSKGKSIDDIHLTEDELGLYLDLAPFLNPS

SEQ ID NO: 61390 - protein, 46 aa, Sorghum bicolor
  Clone ID: 9305583.pep
HEDFVLGFFFFVGHLWHAGRARAAAAGFEKGIDRDLEPVLYMTPLN

SEQ ID NO: 61391 - protein, 109 aa, Sorghum bicolor
  Clone ID: 9305612.pep
LIFHAPITLHHKALLNQRGLTNAGSQILILPFHLLLTCCTSQNALNKNFFLGRKKAYRSKSTAPGTPGSATRRKAESTPGSATRRKVESTPARAPDIVCSPGPLYLQQT

SEQ ID NO: 61392 - protein, 33 aa, Sorghum bicolor
  Clone ID: 9305627.pep
RGELAKALSSCPGVYRVDLLTRQILAPNFDRGY

SEQ ID NO: 61393 - protein, 84 aa, Sorghum bicolor
  Clone ID: 9305644.pep
QGPSIYIASKLTAFLLLNFGNSVSRRRLAIIKIRSSSSRVVHDLITAMKHPGQGIGRALCPSLHPAPHPLQLAAHGQHLPNAPP

SEQ ID NO: 61394 - protein, 57 aa, Sorghum bicolor
  Clone ID: 9305661.pep
TPSKGPPLSRKGWPTGPSGWWGATTILCQGSSTHGKLKVKLPGRPFNNSSHLHKYIY

SEQ ID NO: 61395 - protein, 34 aa, Sorghum bicolor
  Clone ID: 9305666.pep
TDDRFLLTTAKTKPWKFTGGYMNDVFEHFELQVT

SEQ ID NO: 61396 - protein, 37 aa, Sorghum bicolor
  Clone ID: 9305739.pep
SSSAPPPTPTRSVRVGAATPTPTSAETPLPTSCCPRA

SEQ ID NO: 61397 - protein, 67 aa, Sorghum bicolor
  Clone ID: 9305760.pep
VKGQEISIDLHSNPLVSMLEVSHFAFKLQIGCIIILGIFGFSYSYILYVQSILLIVPCHYLLYCISI

SEQ ID NO: 61398 - protein, 96 aa, Sorghum bicolor
  Clone ID: 9305772.pep
HEDGVVLLELISDKKALDPSFSPYGNGFNIVAWACMLLQKGRSREFFIEGLWDVAPHDDLVEILHLGIKCTVESLSSRPTMKQVVRRLKELRPPSY

SEQ ID NO: 61399 - protein, 70 aa, Sorghum bicolor
  Clone ID: 9305777.pep
TRVGLKKDLREDPVAIEEMRKKSMRFVNPQEGDAAAKEIGARKYLECSSLSGEGVDDVFEAATRAALLTF

SEQ ID NO: 61400 - protein, 104 aa, Sorghum bicolor
  Clone ID: 9305813.pep
KNVFSSSTSLPSAPLLFTLPLVLAHFHLGLQNLVTKKMCFLLQRLFLLPPFCLPFPLCLPIFILGSGASLPDGFGGDRRCLTSSIPFLKRPSVALRTRSSGLVF

SEQ ID NO: 61401 - protein, 45 aa, Sorghum bicolor
  Clone ID: 9305828.pep
DGEGWVCMQKNGFGPSGPLCGCFGHPFGQKFQAMFKTPRGVCKKI

SEQ ID NO: 61402 - protein, 56 aa, Sorghum bicolor
  Clone ID: 9305834.pep
KQLGSVFHVSKGLPLSFLEKLFHVLFCPYVFPSVYFLRCDVKKPRLGFWILVNQGT

SEQ ID NO: 61403 - protein, 55 aa, Sorghum bicolor
  Clone ID: 9306432.pep
PHNNLTGETMLQLQACTGAATPSYKTIRIHRFLSRSPLPSKNGFFDSANRNQKLV

SEQ ID NO: 61404 - protein, 70 aa, Sorghum bicolor
  Clone ID: 9306435.pep
MSYEREQASAHMASPVQTCMKQYGVPVEEALEKLKFICEEAWMDIVQGCFDQKYPMALLPKVVSVGRSLD

SEQ ID NO: 61405 - protein, 119 aa, Sorghum bicolor
  Clone ID: 9306499.pep
SSSDGYFDEPCEFGSAELTTFNLCKMSNRSHSSIGNWIQCREILNPGDSDKQVVCGKWRRAPLYVVQSDDWDCFCCLLWDPAHADCAVPQELKTSEVLKQLKFVNMLKNQPVDQNQKPA

SEQ ID NO: 61406 - protein, 51 aa, Sorghum bicolor
  Clone ID: 9306509.pep
YAPIIQHFAESIAGSSTITSFGKENHFVTTNSRLTDAYCRAKFYNAGTREW

SEQ ID NO: 61407 - protein, 196 aa, Sorghum bicolor
  Clone ID: 9306520.pep
ARGKPSPSLDSTSSQSTPGLDGSFSNRSRTASGSVIFQKSLKSITKSYMPSHRKLLKFCNCPVEMAKKSYKDACFRCPRPQAYANEMDSSEEDELDDKLNDIFGLNDDDVTSSASASRDQLKYNLISCKQMVGIFVTVWAKKELVQHIGHVRTSCVGRGIMGYLGNKGCISVSMTLYQTSFCFICSHLASGEKEGD

SEQ ID NO: 61408 - protein, 62 aa, Sorghum bicolor
  Clone ID: 9306535.pep
YGKRAIQGSLIFQQMEKVVTELICQVKGVEMGAKKLRSVSEDPLWIVQFLVFVFIICAPLLI

SEQ ID NO: 61409 - protein, 200 aa, Sorghum bicolor
  Clone ID: 9306540.pep
HEGDLDALLDFLNKMQDQNPCFFYSLDMNEQGQLRNVFWADAKSRSSYNYFGDVVAINVTNFSDQYDMQFVSFMGTNHHAQPVLLGCGLLAGRSLGAYVWLFGTWLRCMNAKPPHSIITNYCHDVAIAIKKVFPNARHRFCLANILNVLPEKLEEMENKDEIISTFTTLAYDYVTVPDFDREWQDTIQHFRLEGNEWLSK

SEQ ID NO: 61410 - protein, 105 aa, Sorghum bicolor
  Clone ID: 9306544.pep
RGANPSTTRVVGTLGYLAPELTRTGKATAAAYVFAFGALVLEVVAGRRPIEPRAEPDELVLSEWAWERYAAGEVEKVVDARLAGTYDFAEAAAAVNVGLWCSHPV

SEQ ID NO: 61411 - protein, 130 aa, Sorghum bicolor
  Clone ID: 9306551.pep
STTSCTRTRRRRSSAPPRPAAGGTVGPRRRWPRSPSRRCPCGRRTSACDASTFLGPLASKMTTSSNLVGPWSLFIAELSIFFSLLHSVPANDRVAVGSILFNLFCLSFLEKSFDFWAKESNTHVVSLDGN

SEQ ID NO: 61412 - protein, 82 aa, Sorghum bicolor
  Clone ID: 9306575.pep
APPELSDLVSMTPLNEELQQQWRIGDLGYACRGGEEWKGRRWGRSGVEREIRRRLHVLVDRPHARARRAAAAADQRRRGASC

SEQ ID NO: 61413 - protein, 44 aa, Sorghum bicolor
  Clone ID: 9306582.pep
PPPLPLLVSSTRLLALSIFSAPLLEAGYSWAWAPRMYASVPPRA

SEQ ID NO: 61414 - protein, 205 aa, Sorghum bicolor
  Clone ID: 9306595.pep
ARGYLTSNKLEANDREGWEFITQLANCCQLQQLILRDNSFTGKLPSSIANLSTTLQYLDLGDNRISGFIPSSIGYLVGLQVLAMANTSISGVIPESIGHLQNLAVLALYITNLSGLVPLSLGNLTQLNVLLLYNGDLEGPIPATLGNLKNVYSLDLSNNRLNGSIPREALKLPALSEYLDLSYNMLSGPLPTEVGSLANLNNLYL

SEQ ID NO: 61415 - protein, 102 aa, Sorghum bicolor
  Clone ID: 9306621.pep
HEAFSPLSTLCLFPYRQLLTSPPSAAPRHGDSAELPPRSLRTRISRPGIPPLLLVQQHGGSPAVLISARAWRPDVAPLLLGRRHCRSPPVMPPNEPVRYSRC

SEQ ID NO: 61416 - protein, 207 aa, Sorghum bicolor
  Clone ID: 9306628.pep
HEVNIGFFNRMFEGLTEAGRIDDALKVYGRMPDKEIKPNMTTFEILVKALCKEEGDLDQARGLVMDMARGSIVPPPEFRESVVNFFKKAGRQEEIEKAFEEKPMLTTQPRTEYLSRTEYHSRNAVGAAQVKQPGFSSAPAAEPEFVYSQPQQSTLSNTPNQQPEFGSSRSWNSSFGAPQAQPGYGAPQPVQAVAGSSQRPRTQFGAS

SEQ ID NO: 61417 - protein, 190 aa, Sorghum bicolor
  Clone ID: 9306632.pep
MADPNLISAGETGGPPPGVSLPVRLLWSKRHPPEDPAVSFQGKTVLVTGANTGLGFEAAVKYTILGADKVILGVRSASKGEEAKRRIMDISGCSPDVIIILQVDLADFGSVKTFVRDLEMVTPKLDVALLNAGLGNPTYEKSGRWELSVKVNVLSTALMAILILPLLRSSAAAGESTPHLSFVNSHGHSM

SEQ ID NO: 61418 - protein, 97 aa, Sorghum bicolor
  Clone ID: 9306647.pep
MASSLAVSLRALAAASLPKPSPAPAPSSPFLDLLAPALPRRLLRLRSARRLPLAPLAASASDSVGVDYAEPADSEQEEEEAFTTEEDEGAEDDAEKA

SEQ ID NO: 61419 - protein, 62 aa, Sorghum bicolor
  Clone ID: 9306651.pep
IEVVLLLYGLGYGGGDRGGGRVARRGRHRSGHRRVWSGWVGRHREGRGLGSRVRIGEELPSC

SEQ ID NO: 61420 - protein, 67 aa, Sorghum bicolor
  Clone ID: 9306663.pep
MRSSIGGLCFDISELGKSFSDFCVEWVRREANSVAHICAHMISATERCLFWLDWIPDWLIDLAAGAL

SEQ ID NO: 61421 - protein, 124 aa, Sorghum bicolor
  Clone ID: 9306666.pep
LLGMSVMQTVARMAAGEEQHPQIMVNAVCPDLCKTDLGRKWTGFMSNIGKTIFYVLFARTAEQGARSLVSATALGPESHGRFWHHDILYPFGDFAQDEVLMHKTWNEIVEAIAQEEPDILPGSS

SEQ ID NO: 61422 - protein, 134 aa, Sorghum bicolor
  Clone ID: 9306804.pep
MASSSATLAFLTLSWAAVLAGASLDTSPVTFHAGYMPLFGGGNLVPSPGGRSVRLKLDRHTGSGFVSKSAYHHGFFSASIKLPDDDTAGVVVAFYLSNADVFPGNHDEVDFELLGNRRGHEWRVQTNIYGNGST

SEQ ID NO: 61423 - protein, 139 aa, Sorghum bicolor
  Clone ID: 9306808.pep
ARGNALKEQLQANPLLGDPSKVLLLTCHSSMASSEHKLIFDKPEPGVRKIVLATNLAETSITINDVLFVVDCGKAKETSYDALNNTPCLLPTCISKASARQRRGRAGRVQPGECYHLYPRSVYDAFADYQLPQLLRTPL

SEQ ID NO: 61424 - protein, 165 aa, Sorghum bicolor
  Clone ID: 9306834.pep
PRLMLVSRGRTRRFVNEGAIVDAIERAGFEVARMDETASWGSVGAVAREVDACDVLVGAHGAGLTNMVFLRAGAVVVQVIPWGKMEPYGEGFFGAPAAHMGLRHVAYSIAAEESTLYERYGKDHPVMADPDVFYRNGSNAKFYWWEQSIRLNTTRFAPTLQMASC

SEQ ID NO: 61425 - protein, 163 aa, Sorghum bicolor
  Clone ID: 9306840.pep
HEENLVTSPTSPGHVGLEGGQSTTKETSSNDVELPTSGILQSNSTNAKSGTGQDAPVDSTPTAMSVEHNKPDKLFASSKRGLEDSIVSVSSSIKESEPFASGRLHLEKDAETLNHLAAVTRDLQDLSEESTGKEDEPTSSSSTDDMDMSSDYILQRCMSSLRD

SEQ ID NO: 61426 - protein, 85 aa, Sorghum bicolor
  Clone ID: 9306846.pep
MPLALAQLQDLRDRISDHLRPWSRSAQFWVRAADIYTSYKVCQLRAGFVKDEDEREAMWEQQHELGAQKMYSLCSELGGLFLKAA

SEQ ID NO: 61427 - protein, 152 aa, Sorghum bicolor
  Clone ID: 9306861.pep
HEAAPLFVLFNILLLWGVYLFVIRRETSSLLDMLINAECALLLWGLYRILSGDPGIVACDSSYLEEAGCKDFVEAICSSEKLPMLSRVRQCTWCKANIRGYDHHCPAFGTCIGQKNHRLFMALLTGFVVAESTYTMCSTKYITRCISSGTIR

SEQ ID NO: 61428 - protein, 156 aa, Sorghum bicolor
  Clone ID: 9306862.pep
MAPAVLSSSGLLLLYLAAVASVAGVLQARAQPDSIGFISIDCGLSGTASYVDDTTKLSYVPDAGFIDGDAGSNHNISAEYMSPMLSKRYHNVRSFAAGGSARNCYTLRSIVAGLKYLLRATFKYGNYDGLRRLPVFDLHVGVNYWTTVNITDADAA

SEQ ID NO: 61429 - protein, 76 aa, Sorghum bicolor
  Clone ID: 9306877.pep
ARGLDQRIVGSREVPIEVQYESFGTYHEIYAHYLVVGNRKKEIRSIYIRTTLGHISFYREIEEAIQGFSRAYSYTI

SEQ ID NO: 61430 - protein, 44 aa, Sorghum bicolor
  Clone ID: 9306930.pep
LITGASHFLGLFFKGEKKGGIPFLHYNKFWVAPKGLNPIDQTWG

SEQ ID NO: 61431 - protein, 118 aa, Sorghum bicolor
  Clone ID: 9306941.pep
VAAADDDDDAECQVAAMTADCAVMTPAKRAAMRRFRRRYLLYTVCHDMYRYNGTVFPECDADDSERHDFHRWGESKRVSPSSRGYKQPRADKAAAVDVAVAAPGRPDTWPVIGTLRVD

SEQ ID NO: 61432 - protein, 198 aa, Sorghum bicolor
  Clone ID: 9306954.pep
WKFRFLGIITAKFLSFLYSPFAGEEIAPATATATATSVAPVHPPLEPICDLSDRRYDGCEMWGDARTASGADKSVVYFIPPPQQLATAAAATWSIRSQSRKIVGVREVIVRSLDASSLHEAPGCTVRRDVPAVVFALGGLTSNYWHAFSDVLVPLFTTARAFGGDVDLLATGAGGQAWFLGKYDRVLRALSRYDVVDP

SEQ ID NO: 61433 - protein, 85 aa, Sorghum bicolor
  Clone ID: 9306988.pep
VSINATAATRETSFHVSSYDALQISHVSSSIRCQVFVLKIGYLSFRLQKFSYVTQHAFVIWVHKFDFRICICGREWIYTCHAINH

SEQ ID NO: 61434 - protein, 106 aa, Sorghum bicolor
  Clone ID: 9307138.pep
DVLIDIAEDFVESVTTFACSLAKHRKSSTLEAKDVLLHAERSWNITLPGFSGDEIKLYKKQHINDIHRERLALIKKSMATDTRIFAAQAAANQKNQTPKPPAPASP

SEQ ID NO: 61435 - protein, 100 aa, Sorghum bicolor
  Clone ID: 9307149.pep
DSNSNPFNIHVENLLITGPSILIVGGSKKNGTSLFRGDNLFRQLFFCLGFHLLNLGPEKLRGVLLTNRCSNGKIALNLLLPYGSMQGQNYRKIEETLQTI

SEQ ID NO: 61436 - protein, 112 aa, Sorghum bicolor
  Clone ID: 9307152.pep
PEVQKRSRVPKHKEISTPGSKSNEGSEKAKRKASALSYQGLRSSKSGVVKKVKVNQQPSSKGKQSKTNETGASARKDKRPAVAARKAKQLAKKRKVDASTLENTHRSKKPRK

SEQ ID NO: 61437 - protein, 136 aa, Sorghum bicolor
  Clone ID: 9307154.pep
PWSLLPLPHLSSPSRPSFGVPRGPKCSADQATCNGKMLPTFYIGGTKCFHLARWHRYCACLWKHWKRKYVVCLDGGSVVSPDIPDSVFSSFSLSPCSGALPPLISKDPVCVSFVCRVKSTDERQQLPIKSTWSICP

SEQ ID NO: 61438 - protein, 146 aa, Sorghum bicolor
  Clone ID: 9307172.pep
REWVDQLEILNHISVQGFLSHCGWNSVLETVTAGVPLAVWPMHADQPFNSRFLVDELKIAVRVHTSDRTIRGLVTSEEISEVVRALMLGEEGVEAGKRVVELSASAREAMVEGGQSWKSLKEMISELSMMKLNGNEEVSLEEQVDA

SEQ ID NO: 61439 - protein, 77 aa, Sorghum bicolor
  Clone ID: 9307178.pep
MAAAEALFGLRVVAQRRKDGGRLAPGVAGEAFSIAYIHAICVVLEIIVSCMFYRSCKRSEADELRELEPEEKGDLQA

SEQ ID NO: 61440 - protein, 166 aa, Sorghum bicolor
  Clone ID: 9307391.pep
HEGLELDLEKYVVPTPNMGSGVVYAANLTENPRSLLQTGSSSNNDTTKDILHSSTKGDSSSNHYVNTMKSAIGGHAPSLEEQRAMFVDRGVGSPNFARPTKETFSMSNFKLDSDSKGMPAAEGAVAAAAVADQMYGPKEDRKLAIVLVGLPARGKTFTAAKLTRYL

SEQ ID NO: 61441 - protein, 140 aa, Sorghum bicolor
  Clone ID: 9307395.pep
MVAKTRRQLAKLTLLLLALLLLLAAILLCVFLIPRHHRRPLPPASPPPGNASNPDDSIVAFDFSPYLIMYKSGRVHRLDGTARCSAGVDEATGVTSKDVVLDSRTGLAARMYLPPKDPGSSGRRHPVLVFYHGGAFVIES

SEQ ID NO: 61442 - protein, 157 aa, Sorghum bicolor
  Clone ID: 9307407.pep
HEVKRKYDLLIKEHDSTHLQQKKALDGFYEKVQRNQSLAEDFRAKFISPSAAQGAAKAHTPPVRRTPQATPQVMRPPLLDSASSIALSSACRPPVPRPRVQAPQVDQASSSLLQLSRPSLPSLQVVQPPNLEQGNLFRTTATTLSHMPPPRGSYGVQ

SEQ ID NO: 61443 - protein, 145 aa, Sorghum bicolor
  Clone ID: 9307408.pep
HEGLLHQYQHQPTPATTFFMPIPSFPNHNQQSPLVQPPPKRHQSIGDDLYLARNRLLSPPAGQGHAFPPLNGPAPFQLQPSPPPPHGAMKTTAAEAAQQQLLDELAAAAKAAEAGNSIGAREILARLNHQLPPLGKPFLRSASYL

SEQ ID NO: 61444 - protein, 197 aa, Sorghum bicolor
  unsure (1)..(197): unsure at all Xaa locations
  Clone ID: 9307411.pep
HEGKKAYGNDDEIARDFCSKVDHIXKKHSGIGVKKLVIDMCGCYAANDSCYINSWLLTAVTPGIEELLLALPVGATYKFPCSLLSNGRDSIRYLLLSGCSLQPTAELPWLKRLTKVELHALCFTKDELGCLLCNSFALERLVIRHCDEIDCLKIPCVLQQLRYLDVICCDDLQVIDNKAPNISSFFYCGGCIQLSLG

SEQ ID NO: 61445 - protein, 82 aa, Sorghum bicolor
  unsure (1)..(82): unsure at all Xaa locations
  Clone ID: 9307414.pep
MSGQSSSSYGDTDHGTDSASSSIGWAPHGRGMTACLIVVNVVLVALVYLYFWRLFSRKRAGASSSATNNPVDHDDDDDASXT

SEQ ID NO: 61446 - protein, 105 aa, Sorghum bicolor
  Clone ID: 9307423.pep
RTGVRCTSVVGLGRTGGGSGRLRLRPGHVVEERWPQADDGPPLSHPLRLHVRRVSRCPILSASPGAQPFATVYLGLRPTPCRTRHSCAGRRRRWRLADRSPRYTP

SEQ ID NO: 61447 - protein, 122 aa, Sorghum bicolor
  Clone ID: 9307434.pep
MEQDAANLSAGAGEEEEEAAVRASGGGFDFDPTEDELVLHFLRPQLRGFPPRVAGAVLEEDPCGAAPWELLARYGLRERGHFFVARGRGRSAVRRAVSGAGAWMRSATRLGQSVTDLGVVVR

SEQ ID NO: 61448 - protein, 106 aa, Sorghum bicolor
  Clone ID: 9307450.pep
QIKFTFLSNSIRLIGFLFLQLHGFRNRVEREKKNKRYVWIATPGRKNSPADSRGYGRTPKKTRPGKEKAAARAKKRVSSAPFSVLSLSLCLTSLLAWVLSFRGALV

SEQ ID NO: 61449 - protein, 181 aa, Sorghum bicolor
  unsure (1)..(181): unsure at all Xaa locations
  Clone ID: 9307458.pep
GRLILVNSVFSALPTFYMCTIKLPPAVIKQIDIYRKHCLWDKGDINRKGKCLVAWETACRPKDEGGLGIIDIQKQNEALLLKFLDKFYNRADLPXVKLTWSKLYANESIPPHARSPVGSPWWKDIMKLFPIFQNISICSPNKGSSVLLWSDNWMDQTAKDTFPQLYSFTRKPKCSIKLFPR

SEQ ID NO: 61450 - protein, 156 aa, Sorghum bicolor
  Clone ID: 9307470.pep
FNNICSQGLFDLFNTKWLFKILKWASYLIGLSENHCCLLCQINCSSSTNMISPSIGNASMNNQRGHVSKKWWYMGCELCKKRLHNEGGSYYCQPCDCRSAIPMYKFSLIAADETAEARFFCHDIVAHHLICRNYNSLLKPISYPPGLPAQMLAIIP

SEQ ID NO: 61451 - protein, 61 aa, Sorghum bicolor
  Clone ID: 9307480.pep
AGWVLEEYQITDPRCYRRADEEEEDQYWILCRVRRSGDHGRRTESEAGAGMPPTSWNKVME

SEQ ID NO: 61452 - protein, 72 aa, Sorghum bicolor
  Clone ID: 9307496.pep
QWHAKPMLLKMYTHIFACMGEPNQFSFAMHFPQLHVCMHVHIYILTYSTLIQRNRLKRKTQKLDRTDIYCWN

SEQ ID NO: 61453 - protein, 53 aa, Sorghum bicolor
  Clone ID: 9307519.pep
PIGQKLIQKLHVQYTPNLTGLPGGFFTSYQGNLKPPQFPYPNKTTNLMESQWG

SEQ ID NO: 61454 - protein, 193 aa, Sorghum bicolor
  Clone ID: 9307727.pep
TRKKAPPGLSDTGALRQCMENLEVFPAEQDEITRKEALQLLRRIISESEPTNSDQTRGRPTVILVPVGSYGLGTWSRTSDIDCLCIGSISPRIFFTLARQRLRKSGEPGIRLLRKVKAKTGTMLEVEVMGIKCDLQYCQAPSVADQWPDMLKRPSSDPAFTLPMQTLLKLKPARDLFYLQRSIPDLAQFRVCF

SEQ ID NO: 61455 - protein, 185 aa, Sorghum bicolor
  Clone ID: 9307735.pep
ARGRNLLTIFNVNEQYLQFEKGWFSDLRKIAVLQLGRWHNLRRHHIEVDSTEFLEGLQLSNQLKYLCLRGISRIIELPASIGGLSNLRILDLHACHNLEILSASITSLQMLTHLDVSECYLLEGMPRGIGLLTELQVLKGFVIGGSTGNYNCRVAELARLDKLKKLTIYIGSKVTVTEDELNELE

SEQ ID NO: 61456 - protein, 156 aa, Sorghum bicolor
  Clone ID: 9307749.pep
HEESIRSYCFLRELEIVNCWEFSALPDWLGELTSLQKLTVHAAKLEVLPQSIRYLTTLDTLVLKKSNFRILEGCTLGKDFDNIKHIKHIRYKPQRPVLSFCRSGPHIVELQIEDLHLVNRAEEAEDLNLIGKKNLRSLSLDWSSYYKESLPNKLVL

SEQ ID NO: 61457 - protein, 137 aa, Sorghum bicolor
  Clone ID: 9307751.pep
RLVNNKTRKGNIDDTSYFSTIVEQLSNQAEYSSSFLKDLSTYMNSNIIVVLRSLQLVSNTFVHTLEEHDMLKIELGNNDAHNRAQESEVLSLQKELRAMSSKCIYCIQQIEIVFDDMVGLGYAIDLATGISSIGSEL

SEQ ID NO: 61458 - protein, 83 aa, Sorghum bicolor
  Clone ID: 9307785.pep
LAVSGSPRFRVYDLDFGFVRPAKVEVVPVTRTGVVAVAESRVGDGGIEVGVSLQPAAMGSYKKCLADAIAWLHQRRHESGDSF

SEQ ID NO: 61459 - protein, 123 aa, Sorghum bicolor
  Clone ID: 9307789.pep
MEDEEENEDEEIQEWLVEKTRKGKLIKQRSATARKPEGAGKFRTALDVLNRLRWDPDMDTNDFIIGYEDRFLGPQEKALSAWKSEQTHEEFIPQHRILWFKRRSDNVIVWHRSERIDLLFKKT

SEQ ID NO: 61460 - protein, 55 aa, Sorghum bicolor
  Clone ID: 9307818.pep
LVGSFSVKPVLDRVKFPLVGLAGSLILCILLYVTTENPKEPYVNTGGRSYPWSVQ

SEQ ID NO: 61461 - protein, 124 aa, Sorghum bicolor
  Clone ID: 9307820.pep
TLLLADEHVAGLQFVRDGNWYRVPPVHGRAALLVNVGVSLEAIAIMSNGIFKGPVHRVVTNSEKERMSLAMFYATDFEKEIEPIAELVDEKRPARYKKIKFRDLVAAHYEYFSRRERVIESLKI

SEQ ID NO: 61462 - protein, 86 aa, Sorghum bicolor
  Clone ID: 9307826.pep
DSTHSKFTYRAEKMDLLFFNIRAVNIGSIFSSITEGEKGSRAVQHQDTIHRNQYPCPKQPTEILSMASFEAKSKDSKEPKINDEAG

SEQ ID NO: 61463 - protein, 125 aa, Sorghum bicolor
  unsure (1)..(125): unsure at all Xaa locations
  Clone ID: 9307892.pep
LXLXSHDGXFCXVDVKKMXVSXWSKKVHLGSPVTSIXFCPTXRVIISTSHQWEAELTKLNVPADWKEWQVWLVLLALFLASAILFYVFYERSDTFWNFPMGRHQPAKPWNMLKESPPVPEDQNPW

SEQ ID NO: 61464 - protein, 130 aa, Sorghum bicolor
  Clone ID: 9307938.pep
AFQGWSEGAITFSPTYKYYPNSDAYYGCATAGQGHRSNKRRAPAWCDRILWRGAGLRQTRYGRCESRLSDHRPVRAVFTVEVDAPRNLNSLRSFFMSERFDRAGSRSPGAADQLLRKDDVVNSARFGDTL

SEQ ID NO: 61465 - protein, 186 aa, Sorghum bicolor
  Clone ID: 9307939.pep
VHSLIAAGQDVPNELMDLAMKDGRFRAKRDSRKGGKKGGKGKGGGGGAGRGRGVRGVDFGLGIGYNAESGSQVPPPRSAAVNSLKTGMMQQFKSSFVSGSSNTPSSSAPSFVRPALRGFVSGGTIGGDARPAQSAPTFVPASRPAQPAPSVPAPRPAGNINENGNSNPESSRDRSRERKRPSGWDR

SEQ ID NO: 61466 - protein, 87 aa, Sorghum bicolor
  Clone ID: 9307982.pep
KIKHLSAVLHKKDKHSRKGLQEMVQRRKKYLKYLRRTDWDSYCLVLSKMGLRDVPEYKALDYKSKATTKAKSKKKSKGKGKKRKVKA

SEQ ID NO: 61467 - protein, 61 aa, Sorghum bicolor
  Clone ID: 9307984.pep
NLKDASDFGVFSLCRLSTIQTADRIIVMENGNIVEDGKHIDLIEKGGLYSRLARRQNDNLK

SEQ ID NO: 61468 - protein, 133 aa, Sorghum bicolor
  Clone ID: 9307989.pep
PSTAPYSLAECVHDLLHLAARMVVMGGRLVFFYPVLRGEDGAASPQFPEHPCFKLITSSEQILSFRYSRVLLTMVKVAPYTEEIEKMAAERHQEFRENHHKWMEEGNLHSAVFEPADGKPDRDSKPKYRGKYV

SEQ ID NO: 61469 - protein, 205 aa, Sorghum bicolor
  Clone ID: 9308031.pep
YLHEECEKVIIHRDIKASNVLIDNEINGRIGDFGLAKLYDHGTDPEATHVVGTIGYLAPELARTSRANPLTDVFAFGIFILEVTCGQRPIKQNTEGIQVMLVDWVLEHWHKGSLTDAVDIKIQGEYDIDEACLALKLGLLCSHPFTRARPNMRQVMQYLNKEMPIPELTPNINFSMLALMQNDELIMHCPSEIGFGTISTISGGR

SEQ ID NO: 61470 - protein, 62 aa, Sorghum bicolor
  Clone ID: 9308046.pep
NSHSNSRQQKLTLHSRVARSYCIILVLINKTGHQTKLNNEFFRTSLFLKQKTKKKNKYWQRS

SEQ ID NO: 61471 - protein, 78 aa, Sorghum bicolor
  Clone ID: 9308063.pep
YNLVWSQTPINNQPGQKMLASKWHDLDCFLLDDLDIQQKINFRNDCPLFQDVFSNNIHYKAKSRIAGLVNELQSTQHV

SEQ ID NO: 61472 - protein, 173 aa, Sorghum bicolor
  Clone ID: 9308064.pep
MSMSSPTQAQTPGGAAAGGVSAVLSLSSREAAPPPVTVAAVAGPGCTDEAGKYHLGVSATSQGQMVMSSKYLKAAQELLDEVVSVSKGVEDANKTTTKSLAAVKKKEDSEGVSGGGTEDGSGAKSGGSGAAEMSTAERQELQMKKSKLINMLDEVSSIPVYIIAQCIYCFNSY

SEQ ID NO: 61473 - protein, 46 aa, Sorghum bicolor
  Clone ID: 9308108.pep
DISYVVFFFLIMPSNVRSLIFAARMKSLLVKPPINTINDQYQSKGI

SEQ ID NO: 61474 - protein, 73 aa, Sorghum bicolor
  Clone ID: 9308126.pep
HGFNTIIVFEPFENCSHQHASPKTWVKVQTGSGCCQKQPDFLTTRVMLHCSLDYQFELVNNTVGMEGTKCTKI

SEQ ID NO: 61475 - protein, 66 aa, Sorghum bicolor
  Clone ID: 9308153.pep
NYLSSAIITLIAGVTRVWHSPGWMPDDLNKGHLDYYYWCLTALSLVNFVVYLYSASKYKLKKVVIW

SEQ ID NO: 61476 - protein, 51 aa, Sorghum bicolor
  Clone ID: 9308172.pep
LSTFDLVEKKGKGAGLIQRSLLWGFVFLSPLIGCLIRMLLVHSGLLITGIN

SEQ ID NO: 61477 - protein, 136 aa, Sorghum bicolor
  unsure (1)..(136): unsure at all Xaa locations
  Clone ID: 9308175.pep
APESQQWFPTLAWTKYETGELVDLVASSSGEEAGDAAAAPRDDEQEHEPRRDEEIVERMCKVAFWCVQQQPEARPPMGAVLKMLEGEMSVAAPVNPFQHLMATPVXPDPWTTTMTGSADAVSATAISETSNEIVSL

SEQ ID NO: 61478 - protein, 43 aa, Sorghum bicolor
  unsure (1)..(43): unsure at all Xaa locations
  Clone ID: 9308183.pep
XCHLXDNCSLCLLLLVVHRLDRGSPSFQTNVMKHWFLKMIWKT

SEQ ID NO: 61479 - protein, 97 aa, Sorghum bicolor
  Clone ID: 9308209.pep
VTLSINPYNNTTQRKHSLGSVHHILLPLLQENGSKGGKNSSQRLYKKCLIRSVLVYTAVNREFVIQSKEEQGSSFHQDDDHAFVPCCCCCCCCISQP

SEQ ID NO: 61480 - protein, 152 aa, Sorghum bicolor
  Clone ID: 9308300.pep
PLIMAGLGTGLAPFRAFVQYRALQKSRGEEIGSILLYLGSRHQREEYLYGEEWEAYVDAGVITHLGAAFSRDQPRKIYIQDRMRESMRDVVQSYIRDEGSFYLCGPTWPVPDVTDVLMEAINTEAKMSGRKVNARNEIEKLKEDGRYVLEVY

SEQ ID NO: 61481 - protein, 90 aa, Sorghum bicolor
  Clone ID: 9308301.pep
AGRKKSLQLAEALRMQMEVQKQLHEQLEVQRQLQVRIEEHAKYLQKILEQQKASNSLPAMTSSIERELFEFKEEKKPKTQADTFSAPLPN

SEQ ID NO: 61482 - protein, 60 aa, Sorghum bicolor
  Clone ID: 9308309.pep
TISVDFKNVRLETLTIFDLHSHVPLKGAVGKKLYCFQAEKALYPPQQSSLLLNSSRVVFV

SEQ ID NO: 61483 - protein, 60 aa, Sorghum bicolor
  Clone ID: 9308327.pep
LAARLLLACSCVIDVSELRGGGGGGGRQQQHTKRLQLLATGAVQEQERDRQISRALSLYL

SEQ ID NO: 61484 - protein, 114 aa, Sorghum bicolor
  Clone ID: 9308331.pep
HEDIVTACSDGTTRIWTADSSRFCSDEELAAYTDLISQYTLSRKTVGGLKLMDLPGVEALQVPGNSDGQTLIVREGDNGVAYSWNSAQLKWDKIGEVVDGPGDAAQGQAHDGVR

SEQ ID NO: 61485 - protein, 85 aa, Sorghum bicolor
  Clone ID: 9308342.pep
TREDVGNSMLPPGDCVKAGTGRTSKRVLAPENKEDTMRCTRQRAAREQMSTTSLIEATEGGLEPEFSANQNQGGTNNIEQGKKFF

SEQ ID NO: 61486 - protein, 105 aa, Sorghum bicolor
  Clone ID: 9308355.pep
ARGFKQDMYVGFSAATGKLASSHYILAWSFRTGGEAQAIDLSRLPNVPKPPAPPPSMSTVIKIVAVSCVATLTTIVLAIACALWLQRRAILAETLEEWERNHPDR

SEQ ID NO: 61487 - protein, 129 aa, Sorghum bicolor
  Clone ID: 9308366.pep
FRLPPLRPPLRLRPQSVLGSIEYSRAVPFQPQIQSPYAYAYAGPRPSLLVVVDTLDFHHRFRIFFLRQRRRRRPAHKVSCYPQIDSCVSFLPPPAGFTSFHFVPMLMLQRGCFQSVAAAEHMHSLRTSN

SEQ ID NO: 61488 - protein, 64 aa, Sorghum bicolor
  unsure (1)..(64): unsure at all Xaa locations
  Clone ID: 9308368.pep
XXRRSYHYYHADAGRRRPPVAPSCSMIGLQAKAARASLSPDSRRADKPSARGACPVRTHLFPSC

SEQ ID NO: 61489 - protein, 140 aa, Sorghum bicolor
  unsure (1)..(140): unsure at all Xaa locations
  Clone ID: 9308410.pep
SSWFNPHKSHVPVAQGHIDQPQPPLSPTNNYVLEHNVVAAMPVHTRWSLESTGVFVATCLVVIILAWLVAPHVGKKAAVICLHMLLGGLCVLTVVISLRFVFPRXPVWVYAILGNLVRVLVPCVWCLGFTNTQRTLLMSI

SEQ ID NO: 61490 - protein, 35 aa, Sorghum bicolor
  Clone ID: 9308459.pep
YPILIKAMATGLQLVSAYWFLRILRMVRYKLGKKK

SEQ ID NO: 61491 - protein, 56 aa, Sorghum bicolor
  Clone ID: 9308468.pep
LRLIVCLAVVTKMQFIVSIGNYSPYANEVVTVQHNHMKEIDILYQILLLFQHITIY

SEQ ID NO: 61492 - protein, 173 aa, Sorghum bicolor
  unsure (1)..(173): unsure at all Xaa locations
  Clone ID: 9308470.pep
ARGRNLFSSGTENEFHMSXLFVFFTAIYCFGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIVVMKGLPFLEAHAEPHMRHLVAGDVVSGPLISFSGVERVGNI

SEQ ID NO: 61493 - protein, 126 aa, Sorghum bicolor
  Clone ID: 9308479.pep
ARGELDEATDGFSDERELGVGGFGTVYKGTKIKGVVAVKRLYKNSYKSVEQFQNEVEILSRLRHPNLVTLYGCTSPGSSRDLLLVYEYVPNGTLADHLHGARAEVDASSRSSTSPPPLTPTLSWPV

SEQ ID NO: 61494 - protein, 43 aa, Sorghum bicolor
  Clone ID: 9308492.pep
IDLGLKQTKRKHLPPSVPNYRLFLLFYVHSFCYAPTYTICLDT

SEQ ID NO: 61495 - protein, 160 aa, Sorghum bicolor
  Clone ID: 9308505.pep
TRSDWTKDRGRNRRYSDIQSYDDEDEDGAPGFKRERRSGGGIDEVGSSVSGVAGEGPSSKVEAMGESELEDTGSKASSNSNAQQKADALQEVEDENEANKMQENSVVSNSDVVEQGLNGEDNSNNGSSDGVQGAETKHLPVSSGEKVSDGRPEDIGVLND

SEQ ID NO: 61496 - protein, 179 aa, Sorghum bicolor
  Clone ID: 9308529.pep
HEVFIDQDEVIPHLEPGMVPSTVDPDAAGYAERANKAKKAVKISARSLAKLDKNEVMKAAAKARASSSVLRPIDARRGHEADVISSGNASVRSSMSVDYSGTKESNSEMKLSPLQNSYPQSLASQDDYDTGTPTASSLSSPVHIHKLASHSQFSVTPQPTPPERPVPAMLRPPVPTTQI

SEQ ID NO: 61497 - protein, 104 aa, Sorghum bicolor
  unsure (1)..(104): unsure at all Xaa locations
  Clone ID: 9308582.pep
QHWQPMLRPAAXALVLPPLTHSGHHFPAASFRWRHFLLLLDDLISHSIFFSLSVRRRSSLFCSITVTSCSVVSTFHPLARSVCSFQVSSAGMLMARAVQCAAWR

SEQ ID NO: 61498 - protein, 92 aa, Sorghum bicolor
  Clone ID: 9308629.pep
LLSIKAIPDEDKDLAKLLTGYQDMVGFLHVHKVAQTNSQVPVILEASTLSLKLRKRRLLVLERLNQAPVDGSTGPSSAASSSCSSQGSQLDF

SEQ ID NO: 61499 - protein, 43 aa, Sorghum bicolor
  Clone ID: 9308652.pep
TRRVFGVELDTIRSTEFKDPDDNHVGIDINRLTYVNATNAGYY

SEQ ID NO: 61500 - protein, 56 aa, Sorghum bicolor
  Clone ID: 9308689.pep
ARGKGGKTREPTSPLLPLCYSSSPDCSQSASARRDGRQGGVPGEEVVGRPRGGGGG

SEQ ID NO: 61501 - protein, 168 aa, Sorghum bicolor
  Clone ID: 9308699.pep
TRARFTGRIKAVLVGERKAEVVRRLFAGGEMPDVGLGDRESDHDFMAICKEAYMVPPDKRAARAAADTLLSRCVFHDGRLVQRPDPAQALFALAYLPLGFLLALFRVFFNLMMPLRLVRHTYRLTGIRLRVRGTPPPPPAPGAPGSLLVCNHRTALDPIILSVALGRP

SEQ ID NO: 61502 - protein, 149 aa, Sorghum bicolor
  Clone ID: 9308711.pep
HEAGVDKDNNNNKLMPLELAIAESVSRGKLVAGSGGTGGGSAVTVPTFANPPWTEVWVLIKRSFTNTGRMPELFVMRLGTIMVTGFILATIFWRLDDTPKGVQERLGFFAMGMSTMFYVCADALPVFVQERHIYLRETAHNAYRRISYV

SEQ ID NO: 61503 - protein, 64 aa, Sorghum bicolor
  Clone ID: 9308721.pep
ILRKLQQLIYDLQSLLYKFHAIWISIAISMKKRNFQHKEACNSKINKKLDIFYKHIAKLCIFII

SEQ ID NO: 61504 - protein, 82 aa, Sorghum bicolor
  Clone ID: 9308729.pep
PKKHGHRHRGASPLTTAAARGPRARRHLPARPPPLQPPPRRPNPVCRRASERGGRSPCLSPPPFGAVPFFGRRGEGGTGLVP

SEQ ID NO: 61505 - protein, 68 aa, Sorghum bicolor
  Clone ID: 9308731.pep
KHEMLHSCWCILFCLIVGLGCLNLKINLVEILSKIYSPKNLKEFSLLYPPLHPDLAQHKPYHSSPPPH

SEQ ID NO: 61506 - protein, 35 aa, Sorghum bicolor
  Clone ID: 9308744.pep
HRRLHCLLHFVNLQLGVQIVEAHSCVKEENIALET

SEQ ID NO: 61507 - protein, 141 aa, Sorghum bicolor
  Clone ID: 9308817.pep
TRGNPNPGVRDPDTGLMYYSVLDAQRDATFSAMDKLGFTSLQAIPGETGSASAGRPKPGPRHNKPLHQPSWELAVGDDGDGVRVDPPAASKANAQAYNNNVINRVLAGRTGTPLRPDADMDVYIFALFNENQKGSGPDDIE

SEQ ID NO: 61508 - protein, 142 aa, Sorghum bicolor
  unsure (1)..(142): unsure at all Xaa locations
  Clone ID: 9308833.pep
HEAELSVLSVVLLQVGMELIDLHLQKCALEKEVESGEAESLSLQNKNQQMLEQNEQLRNGLQESSEREEVLKTEVFIIQEKLSCLRESYQTSQDEISNLTEKNESLSKEYQSLSGKYNSLEDENDTVLEECMMLENLCLFFX

SEQ ID NO: 61509 - protein, 141 aa, Sorghum bicolor
  Clone ID: 9308849.pep
MDSAAAVLAILSKLQSLGFCADLRIPDAAAASDPSEAFDAVLATFLREAYTGGRDARPIPVALGDGRCVDLLRLFLAVRAAGGYAGVPNSPGGWAAAAESAGVDSALAAPVKLVYAKYLGVLDRWIHELVEAHGPFLDVDM

SEQ ID NO: 61510 - protein, 95 aa, Sorghum bicolor
  Clone ID: 9308852.pep
TRPKPKSVARYGALVGWVGRSSQQAAGEDAGRNKYPPAGRRLVGVGYGPDAPARGLRSSAGCERRSYESDGRRGRSFRSEESFGRRRRDRPTTAR

SEQ ID NO: 61511 - protein, 166 aa, Sorghum bicolor
  Clone ID: 9308869.pep
HEERTSSLATEEKHPTGFPSLEVLNICEMYDLQFWVSMREGDFPRLFRLSISRCPKLTNLPRLISLVHVSFYYGVELPTFSELPSLESLKIEGFQKIRSINFPHHLTTLKKLEIIDCKELLSVYAHSLSVSDLKVVRCLKLDLVGSSTEDHIGQKVVNGTNSLTKR

SEQ ID NO: 61512 - protein, 36 aa, Sorghum bicolor
  Clone ID: 9308879.pep
GHMPGDKTGGGSDDAFNTFLSETGAGNHVPRAGFVD

SEQ ID NO: 61513 - protein, 69 aa, Sorghum bicolor
  Clone ID: 9308882.pep
ARGPCRICCVPPRGHYRCRGGAGGDPAAARPLPPTRCLHRTTAESVRGGSDHQPRRRPRARADQAPRHG

SEQ ID NO: 61514 - protein, 43 aa, Sorghum bicolor
  Clone ID: 9308890.pep
FVRFITASLGRGKLPQALRLLVVIQRHELALLTHGLKLCLLIV

SEQ ID NO: 61515 - protein, 149 aa, Sorghum bicolor
  Clone ID: 9308895.pep
NVLDDDSKWEKFGEKNIFGYIFARSYYRCIWRNLTGCSATKILQPDNNDANTLFVMYISEHNHGFSNEPHLELQSQLGTGRKRKEYDVSSDENTSRKQLHDSSVSAASSVPRPATGEATPSSAEELKAKKMGRPRKPNPRVFGPEWSIA

SEQ ID NO: 61516 - protein, 33 aa, Sorghum bicolor
  Clone ID: 9308899.pep
STAPTSLNKCLRALGASAGDLGARILCRCVIWI

SEQ ID NO: 61517 - protein, 128 aa, Sorghum bicolor
  Clone ID: 9308908.pep
EQVTSRCKMICISLFLGLYVRCTQTVSASHQSSWLSSEARRNSGMDISNEIKYNLRLQSVDKRHPIPTTQLCVWSRSLPLGYNSTSGRPTAKESLRYICTRRQVPAPTFLECSVCAFNLKQRHQTLPG

SEQ ID NO: 61518 - protein, 138 aa, Sorghum bicolor
  Clone ID: 9308926.pep
WLHNEGGCLFPTLQAKESTLPTSKPCLPSEISHPTTNEVGPLVQATFWMDAGACIEQQETPPWVDTGASGYQPFLDVIDEMCGLECRLQRLKENMFSFGMDGRTPGVSDMGNQAVVLVPTAELKEKAPHGGLFGHYCP

SEQ ID NO: 61519 - protein, 56 aa, Sorghum bicolor
  Clone ID: 9308954.pep
NLSICSFFIFLRFTLQKNYVQSARMQCDLQTLCVLPILISYCHFLCLCSLWLKTFF

SEQ ID NO: 61520 - protein, 37 aa, Sorghum bicolor
  Clone ID: 9308964.pep
CTNQCKCSESSASLNLLKPSNDHAASNGAALRAARSG

SEQ ID NO: 61521 - protein, 176 aa, Sorghum bicolor
  Clone ID: 9309026.pep
ARGNNALASSASSDHDFLFQRWFISLRSSFLEVLTNVLDILSAHSSYEARGDHLTLSGEFIKDQALALDHCSLRLSDLAKSYDLLAASHMDLDRHSSSSISRLAFMCSLLAFCTTYSVYFPKACNYVESCKLPKRFSHASILQDLHGRVDGSDWQVVSQLRQFMPTSFDELDSLQS

SEQ ID NO: 61522 - protein, 142 aa, Sorghum bicolor
  Clone ID: 9309028.pep
FSHIKACTATIGHPELPSLIRIFEPQTNFRYLLIRFCHSLTQLRFQTSTQLRFQTSTTQILNFRNSQNQTSTSLSFLVGRGFVSHGGATTPQAVGDTQGGLQRTGGRWGRGRLETMPVAARSVGSRGRRTRPAATDKARGGA

SEQ ID NO: 61523 - protein, 171 aa, Sorghum bicolor
  Clone ID: 9309029.pep
TRPKAKSAVAQSERKLKHVSSDGQLNRDRSADCSSQESSVKQNRKGLVGLNLDIPQLHVVRPSKDSPDPLDFSFHSEEHSQTLQRVCSSPAPFFMKDATARADDSRVRSASMKVTGEVSKPMAKPKRRAKSPIPKRAISDVFKEAKAATKRFSSPQRQRKPTSPRSPDDSP

SEQ ID NO: 61524 - protein, 77 aa, Sorghum bicolor
  Clone ID: 9309032.pep
MQTYQEAIAIGRTFAALKDYQIDGNKEMVALGTMNIVGSLTSCYIATGSFSRSAVNYMAGAGSCQSRASRDPEAPLS

SEQ ID NO: 61525 - protein, 69 aa, Sorghum bicolor
  Clone ID: 9309098.pep
HNHLLHLPETRHLMASQRKISELQAFEIETADDFGIRPKAAHELAIRQVGGPLNLSYKSTLSLTVLLSS

SEQ ID NO: 61526 - protein, 128 aa, Sorghum bicolor
  Clone ID: 9309101.pep
LKRSNAVTAEGMRAFANLVNLLSLDLEGCLKIHGGLIHLLDLTKLESLNMRYCNYIADSDIKYLTDLTNLKDLRLSCCKITDLGVSYIRGLQKLTHLNLEGCPVTASCLEAISGLASYPDSILCCSES

SEQ ID NO: 61527 - protein, 61 aa, Sorghum bicolor
  unsure (1)..(61): unsure at all Xaa locations
  Clone ID: 9309149.pep
FFFPPFFFFFFFFFFFFFFFXXSKFKDLFIAKCVQIPQAEQKAASPEQLHLTSTRLPLPRI

SEQ ID NO: 61528 - protein, 84 aa, Sorghum bicolor
  Clone ID: 9309166.pep
TRIGLLCVQEDPLDRPTISSISIMFDGNTVPSQAPARPAFYVEMSGFIGSGTYSHQYPGFINDSTQRSTVMSPNELSITDPEPR

SEQ ID NO: 61529 - protein, 69 aa, Sorghum bicolor
  Clone ID: 9309222.pep
PHGTFRPPLTWFFHRRESCLLKISPPIVTCRHGIKALICLLVLNENCSCGGRPHDQGYFPQQLASQSFC

SEQ ID NO: 61530 - protein, 53 aa, Sorghum bicolor
  Clone ID: 9309243.pep
IHSNIFLLKIEVRFFHYLTSQCFTFTYWKHLGGNPIFDRNGQNNKSKGQQKHL

SEQ ID NO: 61531 - protein, 36 aa, Sorghum bicolor
  Clone ID: 9847159.pep
HEADIHYGTAPIAGFFSEDSATLSDLVVKDQEFIDA

SEQ ID NO: 61532 - protein, 196 aa, Sorghum bicolor
  Clone ID: 9847166.pep
TRPLLISKSTDGTYVIAVDRSNVPPAYVNESSRQQRLSCDDRQLLLQVEAQDSKMPSSKHMELPRLSLDSRNESVKSSLHQKNFGYARTDDSLIDNLKYQESPSHRRASAVVAKLMGLEETLDAPGSARSHRPDRHTRNNYLPHTSRSICHDLSTLQPKIQPTILKTKPSPRIVPEAAAWKQQKINTARYYSKEGP

SEQ ID NO: 61533 - protein, 53 aa, Sorghum bicolor
  Clone ID: 9847177.pep
HEEDNKRTLNEGIRLLKSSKINQTLFALYNVFSALNNNEHRIPYRESKLTRIL

SEQ ID NO: 61534 - protein, 68 aa, Sorghum bicolor
  Clone ID: 9847195.pep
TRNTVTFGGQHALDPLTVLKARINNSGKASALIQHEWRPKSLVTISAEVDTKTIEKSSKVGIAVALKP

SEQ ID NO: 61535 - protein, 186 aa, Sorghum bicolor
  Clone ID: 9847198.pep
TRAKYDFKFKDYAPWVFRRLRALFRLDPADYLMSLTGKYILSELGSPGKSGSFFYFSRDYKYIIKTIHHAEHKFLRKILKEYYQHVKDNPNMLLSQFYGLHRVKMPYGKKIHFVVMNNLFPPHRDIHTTFDLKGSTIGRDYREEDLEKNPRATLKDLNWLRRQRSLELGIQKKRMFLEQLQRDVAL

SEQ ID NO: 61536 - protein, 95 aa, Sorghum bicolor
  Clone ID: 9847218.pep
ACWAQKPNLLYAKPSRNRPHTVTGSSPRFDVYGNDFGWGRPLAVRSGAGNKVDGKVTVYEGRDGGGSMALEVCLSPEALSRLIADEEFMEAVSTV

SEQ ID NO: 61537 - protein, 112 aa, Sorghum bicolor
  Clone ID: 9847233.pep
MSTASAAYSLAQLLLIAHKAVKKSPIVPSRRHAWLLFAGDQVFSLAMMSAGSAAAAVANLNRTGIRHTALPNFCKPLPRFCDLSAVSIACAFLSCVFLAASAVIDVIWLSSP

SEQ ID NO: 61538 - protein, 70 aa, Sorghum bicolor
  Clone ID: 9847238.pep
DLVNGYAVIMIEQLTGLPLWFQPCSFQQLLTVCFCWHRAAVPVSLVPPWYASLIRLLSWARSCRFWRTGN

SEQ ID NO: 61539 - protein, 87 aa, Sorghum bicolor
  unsure (1)..(87): unsure at all Xaa locations
  Clone ID: 9847292.pep
KIQNIVGSCDVKFPIRLEGLAYSHGAFSSYEPELXPGLIYRMKQPKIVLLIFVSGKIVLTGAKVREETYTAFENIYPVLTEFRKVQQ

SEQ ID NO: 61540 - protein, 68 aa, Sorghum bicolor
  Clone ID: 9847307.pep
VIPHTIHHHFSHHIHHHRVVLIPLRVLQLHLGQPTVQCRHHCHLCLPQPTSVLLLMVLMQSMTSLCQR

SEQ ID NO: 61541 - protein, 59 aa, Sorghum bicolor
  Clone ID: 9847353.pep
LRLIRQAASKDDKKKLDQHSFSVQCRLLMTTHKDNAEQHVRNLIVWLPDWGLHKFQEIA

SEQ ID NO: 61542 - protein, 98 aa, Sorghum bicolor
  Clone ID: 9847358.pep
DGLACISRCGCLTYLNLTWCVRVTDAGIVAIAQGCRSLELLSLFGIVGVTDACLEALSKSCSSSLTTLDVNGCIGIKRRSRDDLLKLFPSLSCFKVHS

SEQ ID NO: 61543 - protein, 139 aa, Sorghum bicolor
  Clone ID: 9847382.pep
PTAANPVSVNATLTADISIKNPNVASFAFDRSETDFYYGGQTVGVAYAPEGEVGADRTARMNVTLDVLADRVSPNANTTAIIFGQVYNITSYTEINGRVDVLGIYKRDLDIKMNCTIMLEVGAFSSVQSKATNCVANVS

SEQ ID NO: 61544 - protein, 42 aa, Sorghum bicolor
  Clone ID: 9847436.pep
EGVTDQPSSSQGTKRKRDDDLSGSGDDSEDDGIEDLRPFKHK

SEQ ID NO: 61545 - protein, 87 aa, Sorghum bicolor
  Clone ID: 9847439.pep
AHGSLPVKIPDWSKILGSEYRPGYHYGAGGVGEWSELDDDEDFVDWVPPHELVAGRRRAASLSLNGVVGRTLKVRDAVWKQTTGFQD

SEQ ID NO: 61546 - protein, 66 aa, Sorghum bicolor
  Clone ID: 9847440.pep
KPRDRPIELPGWPGDMHATCNAKGERIRSTSRCMAGGMEYACNMAGAGGVSGSDDFWCKHLHFLAL

SEQ ID NO: 61547 - protein, 132 aa, Sorghum bicolor
  Clone ID: 9847454.pep
WRGGQGHVGRRGTARARPWEGRTAPHEAQGRMAFGSVVVVRMHSRNHGAADGIGTGSSAVGVGRQAGLRAMEFSGQQMRRHVGGGTMNTPTLRRMMGRSHGQRDAPLSLMAADAFFCSLSMSVLLNFVTQQG

SEQ ID NO: 61548 - protein, 97 aa, Sorghum bicolor
  Clone ID: 9847465.pep
SPPPLPAASLADACLPDLTSAFPFLSDGSFFPQFDVGSGVALAPAAFSSSWQSVVPDFYDGLAPWDDGAAAGTAAGGFVGAWGDIAGLDLSWTPPGN

SEQ ID NO: 61549 - protein, 93 aa, Sorghum bicolor
  unsure (1)..(93): unsure at all Xaa locations
  Clone ID: 9847509.pep
AASILLRVALSSSAPSTGPPPPPTAPSEXPEKGRERKRRKPRAPTLTLKRXEEEDEDDGGVHVNKATGEIGGPRGPEPTRYGDWERGGRCSDF

SEQ ID NO: 61550 - protein, 96 aa, Sorghum bicolor
  Clone ID: 9847525.pep
MAKPARAPRPKPPPARASARRLLGLGGLGVAAAAYVGVDYLRYLSPAWHGRLQPALWAALALAAAARAPFYRHWSAELRAALPFLGSIGFMLAAFL

SEQ ID NO: 61551 - protein, 58 aa, Sorghum bicolor
  Clone ID: 9847530.pep
ASPNPCFHIMPSIVLASALRPQLTYALYMIQNVFFVRSILKHSISSSTPCISSNRCLV

SEQ ID NO: 61552 - protein, 82 aa, Sorghum bicolor
  Clone ID: 9847542.pep
MATADGEPQPVATDPAQAPAPAPSPSPAKRKPEADAGADADLAPLKAARPDVDEEAAAVAEAARARVSAADKGKGKMVVEEE

SEQ ID NO: 61553 - protein, 171 aa, Sorghum bicolor
  Clone ID: 9847578.pep
TRLSLVHAVLGRGIHVTKRDLFYTDVKLFGDQSQSDAVLDDVSCMLGCTRSSLHVVASEKGVVVGRLVFADDGDRIDCTRMGVGGKAIPPNVDRVSGIESDALFILLVEKDAAFMRLAEDRFYNRFPCIILTAKGQPDVATRLFLRRLKVELKLPVLALVDSDPYGLKILS

SEQ ID NO: 61554 - protein, 66 aa, Sorghum bicolor
  Clone ID: 9847590.pep
MERGDDCQFMVVHQYDEAAQLMHQLMVAAAGDQQDPNAGAAGRGAGGGGGERKRRFTEEQVRSLET

SEQ ID NO: 61555 - protein, 154 aa, Sorghum bicolor
  Clone ID: 9847593.pep
TREGRKSEPAAFGFPAPVQPGATRVGWIGIGVMGGAMAKRLLAAGYTVTAYARTPSKAEGFVAAGASLADSPRAVAAASDVVFTMVGNPGDVRAVVLDPATGALAGLPRGGVLVDCTSSSPSLAREVAAAAAAAGCHAIDAPVSGGDVGARDGT

SEQ ID NO: 61556 - protein, 110 aa, Sorghum bicolor
  Clone ID: 9847599.pep
EAVRKGRQTRQQQQLECPRCRSTNTKFCYYNNYSTAQPRHFCRACRRYWTHGGTLRDVPVGGASRRSSGGGGKRRRVSAEPSCAASSSPPALPAASLADACLPDLTCGFP

SEQ ID NO: 61557 - protein, 74 aa, Sorghum bicolor
  Clone ID: 9847672.pep
LHETFDPIIQVSTGRDLIPAMVYGRSARDQDYTGMYCAVLTVNNTVVSAGLFRIMGNEIAELPLVATSKDSQGL

SEQ ID NO: 61558 - protein, 64 aa, Sorghum bicolor
  unsure (1)..(64): unsure at all Xaa locations
  Clone ID: 9847675.pep
XLSSPLISSLSSCCLRARRPSLFLLQLPCLNLLLSSPLPECTLEQEGELRQPLSCSVAPFLPRA

SEQ ID NO: 61559 - protein, 84 aa, Sorghum bicolor
  Clone ID: 9847686.pep
TRARRTNELPVEIEQQYIRTHHRRSAFHNLILTPIPPMATANKASILLLAVAVATAACSTTASAQTSRLGKLVVTGVVPCNTGT

SEQ ID NO: 61560 - protein, 61 aa, Sorghum bicolor
  Clone ID: 9847709.pep
MARLAWTRLPTADGEEAGPSTSAAADYELLSAAAIESLDYEVIENYAYREEQVRAAPPAPR

SEQ ID NO: 61561 - protein, 163 aa, Sorghum bicolor
  Clone ID: 9847720.pep
TRVVGCVIMPHNVFLHSALVQSRKIDQNKEYQVREALRYYSIESTIALVVSFMINLFVTTVFAKGFYGSKEAGNIGLENAGQYLQEKFGGGFFPILYIWGIGLLAAGQSSTITGTYAGQFIMGGFLNLRLKKWVRALITRSFAIVPTIIVALFFDTSDSALDV

SEQ ID NO: 61562 - protein, 165 aa, Sorghum bicolor
  Clone ID: 9847723.pep
ARGSHPRGDGQATAAAAEVIASDHRSTGYNRFMLGTSAEKHTTVMGHDHISRIKMHMAEGSFGDRNRCQQPGCNEVVDGRVVYCKTHSGEFSCQQFSHLHSGMESSGLSVPHVNDNQFKGSICIAVPCTEQELHVKHEGNDRGKLKDSSGYTLDQTAQFVFSGAG

SEQ ID NO: 61563 - protein, 110 aa, Sorghum bicolor
  Clone ID: 9847735.pep
MGKGKVHPSPSPAAAAAAGGGAGGEMTAEAVLMRLLPAAVLAAAAPLGAEGKEVLAYLVLASLRSSAPPTPVQTPARGGDGIGKAAGEHHRPELGCGCFACYTAYWSRWD

SEQ ID NO: 61564 - protein, 71 aa, Sorghum bicolor
  unsure (1)..(71): unsure at all Xaa locations
  Clone ID: 9847762.pep
LSRILXDAAISRAARRSWIRTPGALSVYPVLQHSFTSEPKIKSNQRKKKAGRRRKPSNQPSRHYSSHQRNS

SEQ ID NO: 61565 - protein, 42 aa, Sorghum bicolor
  Clone ID: 9847803.pep
TETNYRNRHKTRSLKTGWTEGEAKRIMQPKTVRRSAATQVMD

SEQ ID NO: 61566 - protein, 122 aa, Sorghum bicolor
  Clone ID: 9847818.pep
AQTSRLGKLVVTGVVPCNTGTLIDAATSPAFPDANVELRCGGNVVAGGTTSRNGSFAIEADLTNALAALVGTCQLVVDTPLAKCNASLPAAGALASYLQGSLAGMLGGVFRLAPAGFSFRMN

SEQ ID NO: 61567 - protein, 148 aa, Sorghum bicolor
  Clone ID: 9847832.pep
PATLVGSVVNAAVLLAIYWNQLDGGCKPAGAEEVVAVPTEVVEEEDVTSHRFSPATMSHLLRRGSRQQGETVPVHQDPVKPPAKDVRVNPIPLVVQEDVDGHFDDWNSKVWKTCVYAITLGMLVALLLGLNMSWSASTAALALIVLDF

SEQ ID NO: 61568 - protein, 116 aa, Sorghum bicolor
  Clone ID: 9847839.pep
TRGTSGKKMDDEYQNFLAELGGGSAPESMNKSGGPMLALTGSGGSGGASAGTGSNPPWSTNGGAAATGLNGIKKDYDETNLYIGYLPPTMDDAGLVRLFSQFGDIVMANVIKDQNT

SEQ ID NO: 61569 - protein, 48 aa, Sorghum bicolor
  Clone ID: 9847879.pep
CLSNELSAKNLPKSWSLWQSKPTEDIYLPVVLKCKICSSKECSGVSPV

SEQ ID NO: 61570 - protein, 137 aa, Sorghum bicolor
  unsure (1)..(137): unsure at all Xaa locations
  Clone ID: 9847916.pep
MAGETVLVTGASGFIGSTLVRLLLGRGYNVHAGVLNPDDKAETEHLLALAAGAGEGEGRLRIFRGDLLDGAALIDAARGCSGVFHLASPCIVDAVSDPQKQLIVPAVEGTLNVLRAAKEAGSVRRVVVTSXSCAIMP

SEQ ID NO: 61571 - protein, 165 aa, Sorghum bicolor
  Clone ID: 9847919.pep
MESLGYVLMYFLRGSLPWQGLKAGTKKQKYEKISERKIATSVEVLCRGYPPEFQRYFHHCRALRFDDAPDYQYLKKMFRDLFIREGFQFDYVFDWTILKYQQSQMTIPPRAMAAATDQSSRMASMANNNGLSATEEGKRSGWSDDPLRRQVPPAGINAGSLAKQK

SEQ ID NO: 61572 - protein, 87 aa, Sorghum bicolor
  Clone ID: 9847973.pep
TSAASPSLAAAASRSPSPVHPSALPIYIYIYAFPRAAAAAGRPPVSYLFFYRTLLQGEALDDHAANVIEDEEQQSRPGRWQKASELL

SEQ ID NO: 61573 - protein, 150 aa, Sorghum bicolor
  Clone ID: 9847979.pep
TRVARTVFSRDLTGLDDDGGSREFQEVVTDIMEAVGSPNVSDYFPALAPADLQGWRRRLARLFARLHRIFDEEIDGRLRGREAGEPKKNDFLDLLLDAADDDDNTAGLDRDTLHSSIETEKDLFSAGSDTSSSTVEWAMTELLRSPTSMA

SEQ ID NO: 61574 - protein, 81 aa, Sorghum bicolor
  Clone ID: 9848004.pep
LVNPGDLQCIFISHKCSENGKFSYGYASSPGKRSSMEDFHETRVDGVDGETVGLFGVFDGHGGARAAEFVKQNLFTNLIKH

SEQ ID NO: 61575 - protein, 171 aa, Sorghum bicolor
  Clone ID: 9848019.pep
HEGGGGDRGFDDHRGGRGGSYGGRDQENQRGSEGGYNAGGYGQAPPQGPPSYGGPAGDYAAPPSSYGGNNAYGSDSAVPPPNSYSGGPGSYPPSYGAPPPHQYGGAPGGQGGLPPTYDGGYGGRSMPGGGGSGGAPPPYHGGGGGSGYTGSADPEPAAKVKQCDENCDETC

SEQ ID NO: 61576 - protein, 145 aa, Sorghum bicolor
  unsure (1)..(145): unsure at all Xaa locations
  Clone ID: 9848022.pep
MATMSLRSLAMAMADTALPPAHKLLPTVSLPLLSSSTHAAPLLLRASRRLPLAPLVASSDAVEAGVEWADEEEEEEEEAGEAFDEEAGEVEEEVLASXDEGEGEYAAVEPPEEAKVYVGNLPYDIDSEGLAQLFDQAGVVEVAEV

SEQ ID NO: 61577 - protein, 91 aa, Sorghum bicolor
  Clone ID: 9848037.pep
MNSLFSSSWKRGGGDDGDIESGSVEMSAPPGAAAGASLDRFFEDVESIKDELRDLERIHRSLHDGNEAGKSLHDACAVRDLRARMDADVSG

SEQ ID NO: 61578 - protein, 91 aa, Sorghum bicolor
  Clone ID: 9848048.pep
TQSQRSNQSTTPDDDASTVSGGTVRSRPDSSDGKKTTPVRKADGKTPPRQAGSQQKVKPVSAVKPPPATRKTVGVKPELPARRPTSGHTSD

SEQ ID NO: 61579 - protein, 51 aa, Sorghum bicolor
  Clone ID: 9848064.pep
QNHQELEIVGAPNLSRRGIDEARNHNHGEPMTRFSAIGSSVTAISLHSGPT

SEQ ID NO: 61580 - protein, 99 aa, Sorghum bicolor
  Clone ID: 9848069.pep
ARGSNPSLHYSNPTHRRLLPLGSRAHSSTRRRRKRASKLLPLKRRRHIGGIVVCLSSSSRQRGAEIRTDLGSIPSLFSIQGASSSRGKLLGTWTWHCPL

SEQ ID NO: 61581 - protein, 73 aa, Sorghum bicolor
  Clone ID: 9848117.pep
TRLPFAQPSSADEFEIHLVQSNRPPPFSLAKHKASLRSCCSCSPVLLIVWSVPLRSRGKAKAGMALTLRSSTS

SEQ ID NO: 61582 - protein, 67 aa, Sorghum bicolor
  Clone ID: 9848123.pep
ARGFISPRRMPGPTGPALPTGGGGGRSTGSRRPVAGGVRAVLLLGARRPRRLRRGLRASPRHPRLAR

SEQ ID NO: 61583 - protein, 110 aa, Sorghum bicolor
  Clone ID: 9848151.pep
LAPAASARLNQKHHAAADVRAVKQQAADQARMASAERAYAERVRELARRELELAEREFARARAIWERAREEVERVERMKQIAARRLVGSAASSAAALEITCHACMQRFHP

SEQ ID NO: 61584 - protein, 118 aa, Sorghum bicolor
  unsure (1)..(118): unsure at all Xaa locations
  Clone ID: 9848170.pep
AXLHHQIATFFPLSHTDTAVDATYPKLCKMQLVASSSFDTDTHDPTPNSPCTARLINFTPLTAVAVSQYSIVSIHIQLRLRVFTTRLPRGSHHEAAELGVAEAQRGAEHAADGVRQAV

SEQ ID NO: 61585 - protein, 107 aa, Sorghum bicolor
  Clone ID: 9848208.pep
ASLSKDPSTFAPQINPPCPTLFVANLGPACSEQELIDVFSSCAGFVKLKMQNKLGAPVAFVDFKDSISSTEAINRLQGVILYSSLGEGMRLEYAKSRMGLWKRDKHP

SEQ ID NO: 61586 - protein, 108 aa, Sorghum bicolor
  unsure (1)..(108): unsure at all Xaa locations
  Clone ID: 9848307.pep
ANIQRFXHLFKQVNHNPCRAHNIYDTKSDSSKQQIAQDIQPLLSFGMNTDLQTPAMQLPVSYHPCLFQGQGSVSCQQAAAKRLMIVLGGEDYMKHSCSVNIHLLLLLD

SEQ ID NO: 61587 - protein, 143 aa, Sorghum bicolor
  Clone ID: 9848309.pep
DEHISQEDNREIDGQMQGSVDEDCNRSDEEYDDLAMRDSLENGYLTDDGVFHSGLSKSSSGKFFGSNQGSHSTPKKHQESVGVPETARSSSAAVPAGTSSKRYAARKWKRSLSDSFRSRPRSAPELVSVCKGSPPVPVAPDER

SEQ ID NO: 61588 - protein, 110 aa, Sorghum bicolor
  Clone ID: 9848339.pep
MVRAGSVASEPVLALAAWMAWAEGGVHARPAATLLPYAAQLGAALAWAPLVLGQGHAAAPRAGLACCAAMAAAAVACARGFGAVNPVAGDLAKPAVAWAVILAVVNYKML

SEQ ID NO: 61589 - protein, 134 aa, Sorghum bicolor
  Clone ID: 9848399.pep
KAARVWLGTFDTAEDAARAYDAAALRFKGAKAKLNFPFQQPATTATASTSATLAPTPRQGTRHAAAAPAGAHQQEFPDLSRYAHILQSGGDLDLQAFSGAGGLTPGRSSTTTASASSSSPPAPSVDWFPWRGPA

SEQ ID NO: 61590 - protein, 89 aa, Sorghum bicolor
  Clone ID: 9848433.pep
VHAPNPTNRYFRHVVHCKGCRATVKKYTSLKNAFAALAAAAVAAAVLAATRQWKAVLLAASAVLAAASYACDALVSLLTTNFIRTHRRL

SEQ ID NO: 61591 - protein, 108 aa, Sorghum bicolor
  Clone ID: 9848457.pep
MGIAAAAATTTTSRLLHYHAAAGTDRHHRHQLRYSASPFPLSLRCGSGRREAAAARALLPDRVTPFSYGVDEDADDHPREECGLVGVVGDPDAASLCYLGLQKLQHRG

SEQ ID NO: 61592 - protein, 133 aa, Sorghum bicolor
  Clone ID: 9848461.pep
ARGTYLAKGVGGQQARNTSWPHRPPDPFLVSSMEEQGERQIQLQLLLLPVPAGHQVLRDVPPQAVPASAVEHPQLDLDLSMSIGPRHPAAPTPAPPPLPPPRARSPPTNEIRTAPGLMAVLAPAASARLNQKH

SEQ ID NO: 61593 - protein, 120 aa, Sorghum bicolor
  unsure (1)..(120): unsure at all Xaa locations
  Clone ID: 9848481.pep
SATPASRWAATAAAXASPSPAPASASPASASVRARRSATRASAASWEAGSGSRPRRRAASAAPNRSASPFSCWLRRRLGLEWCWWREGSSELYLSARNIWAGMLIRLGVRGGRCLVCPRA

SEQ ID NO: 61594 - protein, 179 aa, Sorghum bicolor
  unsure (1)..(179): unsure at all Xaa locations
  Clone ID: 9848621.pep
MATSSSCCCVSSHGHGHGLYRPLHRLRTASPARLRLVFPSVPSPRFSSRRIPASPDPPLDVAAGDATREDDWPAPDDDDDQDQEDRDELIGFQIQVSKVGKRNRRLVRARVRVHAPLEAVWATLTDYEGLADFIPGLSECRLLDQHDGFARIYQAXVGEQDLALGFKFNAKGTIDCYEG

SEQ ID NO: 61595 - protein, 69 aa, Sorghum bicolor
  Clone ID: 9848624.pep
MASAKLLYIVVVDDSASSFRYTRSLLHSTLQLMGCKPRHAFEISRRVFDVIRGDHQGHGDTAASARVQR

SEQ ID NO: 61596 - protein, 79 aa, Sorghum bicolor
  Clone ID: 9848706.pep
LDLSRKDRGRETSGSLRGSGLFGGCGGGGGGGAGMDRKRIKDALEKHLERSSPSTSRGGVVPKERERLAAAGKLPASLG

SEQ ID NO: 61597 - protein, 91 aa, Sorghum bicolor
  Clone ID: 9848748.pep
ARGLSILYSLGTKPLQIWDKEVVNGHIKRPQDEDIQSNVLEIIGTNVQSTYITCPADPSATLGIKLPFLAIIMKNLKKYLTFEIQVLDDKN

SEQ ID NO: 61598 - protein, 148 aa, Sorghum bicolor
  unsure (1)..(148): unsure at all Xaa locations
  Clone ID: 9848751.pep
HEAAGQGKSMLLVRFGSTLRSPLAKVLPTWYFHQNACKVFEQDMGFLSSQNEVLLREKVPTRELYLNLRSSDTWVAEYRKWMDRAGHGMPYYFGXTTLSPPPVPAVVEQAPAGAVAGISASFPAKXXVGTVHAPNPTNRYFRHVVHCK

SEQ ID NO: 61599 - protein, 171 aa, Sorghum bicolor
  Clone ID: 9848794.pep
WIGSLFRERLHVWLAKWPQQIALIKLAGEGNWFQQFRVVALFRISPFPYTIFNYAVTVTEIKFNPYLCGSVAGMIPEAFIYIYSGRLIRTLADMKYGNYKMTPVEIAYNAISLVIAIVLTVAFTVYAKRALNDIESSDGITKEDHSPNGSGARVSHRQERADARSIQLDVV

SEQ ID NO: 61600 - protein, 125 aa, Sorghum bicolor
  Clone ID: 9848818.pep
ALPGARAAGARANQHVRRRCRQHGAHGQRRTGGVPPLPPPPQRNSRRRKRVPAGGSIPPRRQMTFASSAPQPAALCIYSSYPILSYIQYYIVFLICSHDHDSEKRKKERKKIQATTITSQSCSSI

SEQ ID NO: 61601 - protein, 120 aa, Sorghum bicolor
  unsure (1)..(120): unsure at all Xaa locations
  Clone ID: 9848856.pep
MSAQMKALFDSTTGGLWRTQALAGKPAGFLFSLRTQDGGQEEAALTSVSQLAHHAMVFVPVGSTFGSGMFDMEXVRCCSPHGAGTFPGADGRSRLPSAAELQMAVHQGTYFAAFAKKLKA

SEQ ID NO: 61602 - protein, 63 aa, Sorghum bicolor
  Clone ID: 9848963.pep
SHDDPLSSLRDLDCTHSNYQTLTRPVLLFIVTTSPCQDWVICAPAAFLGCGSRFSGSLSGIEP

SEQ ID NO: 61603 - protein, 78 aa, Sorghum bicolor
  Clone ID: 9848965.pep
QLRVGILPTIAECLDGFQTLCEMHQAEFTLKSSIIFLLTWKSSSSDTVVLRQLLVDQPNIPKDEVHSIFDIIFADEIC

SEQ ID NO: 61604 - protein, 129 aa, Sorghum bicolor
  Clone ID: 9849056.pep
LSEAQKQQDEQDDDESTIASSKNLTENKKPKTPKENKKRPREDDDVATEEDRVEDLVLSSDEEDDNNQEPEDGFVPVEGDSDEDFVDPDSEYKKQKKAKLKKRNKREPLPHKAPSRTKRNSRPKKKTRH

SEQ ID NO: 61605 - protein, 138 aa, Sorghum bicolor
  Clone ID: 9849087.pep
MEARASPRPSISIGGGFGAGRGDDSAFSFLSKGWREVRDSATADLRLMRARADSLRTLADRELENLLASASTALASAPPPPLAAGAPIAELEFVRTRIQPKISELRRRYASRERELGRRVLEGWAPRGAGGPGRARVN

SEQ ID NO: 61606 - protein, 82 aa, Sorghum bicolor
  Clone ID: 9849107.pep
MPRSSAGASCTAIDHSEQNTKDDEYERLVIRAQHETSGTAILSEQTKSRSFIWWMKVLLGCFLLILVGYVFVKWGVPFAFEK

SEQ ID NO: 61607 - protein, 139 aa, Sorghum bicolor
  Clone ID: 9849163.pep
MASKACAWDAVLVICLAAAVVAGSAAEAAFDENYVVQWGEDGYHLVIRGTEANITMDQSSGAGFRSKSMYGSGFFHMRMKLPSGYTAGVVTTFYLISQPEDGSRDEVDFEFLGDKAGVPITLQTNVFVNGRGDREQRLH

SEQ ID NO: 61608 - protein, 69 aa, Sorghum bicolor
  Clone ID: 9849195.pep
CRKHFRRLTICVLNDVHRLELACLIHYSCDILFFVCFDCCRDVVCIGISFICGLYRLKTVVQYVTCIKK

SEQ ID NO: 61609 - protein, 88 aa, Sorghum bicolor
  Clone ID: 9849251.pep
VGLMVQRPVILPPLEAGSDRCSVKPASRHSCRFRFGEAQAFARAPPTTTNLGRAGQQAKAHHRPRPRETVAQHPHHLVAPARVTSSRY

SEQ ID NO: 61610 - protein, 131 aa, Sorghum bicolor
  Clone ID: 9849253.pep
LAAFARARIVFAGKRTKALRVIATPDTRATLTSPTDAKLMSQKADIAERMIIPMEELAKATNNFDKTRELGGGGHGTVYKGILSDLHVVAIKKSKLIVQKEIDEFINEVAILSQVNHKNIVKLFGCCLETE

SEQ ID NO: 61611 - protein, 38 aa, Sorghum bicolor
  Clone ID: 9849255.pep
LYIPTRVFRMLINKLTRDFHNYLTLGGLVQTLMGYVGG

SEQ ID NO: 61612 - protein, 99 aa, Sorghum bicolor
  Clone ID: 9849282.pep
GCTAGERRGAAVHRARVVRPTGYGLRAVAQPRQTSGAARVSSCLDSAAASVPPVCSPRKGYSRVLSASGAQGGQIRRMQRSGSRRAVGGGGSMRRRPSC

SEQ ID NO: 61613 - protein, 35 aa, Sorghum bicolor
  Clone ID: 9849314.pep
YRRSHHKTDDVCVCACFFLAKIDVCHRPIVPECLA

SEQ ID NO: 61614 - protein, 69 aa, Sorghum bicolor
  Clone ID: 9849323.pep
PLHGARLQRLRRGREAGDRGSHRHGRGSGGTSLRFPEVRCRRGRPAGSAEEARGATARVVGTRESRPRA

SEQ ID NO: 61615 - protein, 57 aa, Sorghum bicolor
  Clone ID: 9849324.pep
KQYSICYATSRISDNFQCNQPTPLYISLDSCRGRLVPCLQHKLTQQVDSSSNYNYTA

SEQ ID NO: 61616 - protein, 104 aa, Sorghum bicolor
  Clone ID: 9849380.pep
PLSKYVATLHQRAQDRMDALDDTTVIVGADSSTFSRRLSEAQKQQDEHDDDESTIAFSKNLTENNKPKTPKENKKRPREDDDVATDEDRVEDLVLSSDEEDDNN

SEQ ID NO: 61617 - protein, 139 aa, Sorghum bicolor
  Clone ID: 9849411.pep
MASVAAAAAAATLAPALACRRRARPGTGLLPPRRAAPAPVRCSLDSNVSDMGVNAPKGLFPPEPEHYRGPKLKVAIIGAGLAGMSTAVELLDQGHEVDLYESRPFIGGKVGSFVDKQGNHIEMGLHVFFGCYSNLFRLM

SEQ ID NO: 61618 - protein, 125 aa, Sorghum bicolor
  Clone ID: 9849432.pep
MAGGGSGSGEASAAGGGKVACAAWIRRREEKAAAAVARVFAAYGRAGAAGSPPALEVLGFDAKECSLSPEPLARAVLGEGGAGDAPRSIAVHPAGDELVCATATGCRLFKLIFEEFTVRIIPRDA

SEQ ID NO: 61619 - protein, 124 aa, Sorghum bicolor
  Clone ID: 9849439.pep
TRHLAIVMEYASGGELFNRICNAGRFSEDEARFFFQQLISGVSYCHSMQVCHRDLKLENTLLDGSTAPRLKICDFGYSKSSVLHSQPKSTVGTPAYIAPEILLNKEYDGKVLSIPLGSLSCPPT

SEQ ID NO: 61620 - protein, 151 aa, Sorghum bicolor
  unsure (1)..(151): unsure at all Xaa locations
  Clone ID: 9849445.pep
SALAQFCVDLTMRASGGLIDPVIGRKEEIGRVVQIICRRTKNNPILLGEAGVGKTAIAEGLALKIADGDVPIFLVGKRIXSLDVALLMAGAKERGELEARITSLLREVRKAGDVMLFIDEVHTLIGSGIAGRGSKGAGLDIANLLKPALAT

SEQ ID NO: 61621 - protein, 201 aa, Sorghum bicolor
  Clone ID: 9849454.pep
TRAKHYADATGFDIVFFLPDSEDDFVSYTEFLRYLGSKSRAGVVKVDAATTLFLVPPSDFLTNVLQVDGPERLYGVVLHIPQISAAAAALRPQLTGTEQQPYYDERETLPTQRKYSIISPNGSGHLDADYRASLHEDSMQRLGHIPGRPRVDEGQAVQPALAGFPANQATGLQVQSSLKPDIMATLAKLLPSVQSSQLVSG

SEQ ID NO: 61622 - protein, 158 aa, Sorghum bicolor
  Clone ID: 9849464.pep
MSKRPKLEGFSIPRPTSYNFERSQPVQRLYRPTDDPDLDDIAFSDDAPSDAPASTAVEGKAEDDEEIDPLDAFMAEIQEEIRAPPPPPKPEALRRADSDDDEDDPVESFLRAKKDAGLTLAADAMRAGYDSDEEVYAAAKAVDAGMMEYDSDDNPIVV

SEQ ID NO: 61623 - protein, 167 aa, Sorghum bicolor
  Clone ID: 9849465.pep
TREFDDGGCSPDADASRCVKRPRPQERNKTLKYKLFASTWNVGGVAPPDDLDLSDWLDGGEDDDGPYDMYVLGLQEVVPLRARNVLGADKKRVGLRWIELIRAALNRRSHSQRQRQQGDGSGKQKVHPVRDGGRGELACRDYRCVVSKQMVGILLTVWVRSDLRRFV

SEQ ID NO: 61624 - protein, 119 aa, Sorghum bicolor
  Clone ID: 9849485.pep
TRQEPRLFRMDISSNIKYGCPREVSHEEVVWAAKQAYAHDFIMALPDGYNTIVDDALLSGGQKQRVAIARALLRDPSILLLDEATSALDAESEHYVKSVITKVSRDSKAKRTVVIIAHR

SEQ ID NO: 61625 - protein, 178 aa, Sorghum bicolor
  unsure (1)..(178): unsure at all Xaa locations
  Clone ID: 9849496.pep
ARGQPSSTRPPPWRCYGSPRGGEPFSPPPVPSTPRALTRRSVRPHLRRTTPKPPSPHPPLAPQTLARRGTRRPRPSRTXRDSLHTSPASPSPPRIPTNLPRPNPSRGAPPSQRTPEDIRRMILNFRSTGGVPSTSSPGAASSPSAPGACPLFADLFKNASVAQGPNAGQGVLGLDAGR

SEQ ID NO: 61626 - protein, 43 aa, Sorghum bicolor
  Clone ID: 9849522.pep
SYLIFISNTMAHLYPITAPTSSDLLYPKALDIWAMLPFQLGLN

SEQ ID NO: 61627 - protein, 206 aa, Sorghum bicolor
  Clone ID: 9849527.pep
ARGPCQSNWTGVFCHKVNDDAFLHVTELQLFKRNLSGTLAPEVSLLSQLKTLDFMWNNLSGSIPKEIGNIATLKLILLNGNQLSGILPDEIGNLQSLNRLQVDQNQLSGPIPKSFSNLRSVKHLHMNNNSLSGAIPSELSRLPLLLHLLVDNNNLSGPLPPELAEAPALKIFQADNNDFSGSSIPTTYSNISTLLKLSLRNCSLQG

SEQ ID NO: 61628 - protein, 196 aa, Sorghum bicolor
  Clone ID: 9849529.pep
TRDMCDKNGDGMLTEDEVKEVIILSASANKLAKLKGHAATYASLIMEELDPDDRGYIEIWQLETLLRGMVSAQAPEKLKRTPSSLARTMIPSRYRNPLKRHLSKTVDFIHENWKRIWLVTLWLVVNLALFVYKFEQYKRRTAFQVMGYCVCVAKGAAEILKLNMALILLPVCRNTLTTLRSTALSHVIPFDDNINF

SEQ ID NO: 61629 - protein, 195 aa, Sorghum bicolor
  Clone ID: 9849531.pep
DTAAKPYEWRKLEPEGEGPPPCMYATASARSDGLLLLCGGRDANSVPLSSAYGLAKHRDGRWEWAIAPGVSPSPRYQHAAVFVNARLHVSGGALGGGRMVEDSSSVAVLDTAAGVWCDTKSVVTTPRTGRFSADAAGGDAAVELTRRCRHAAAAVNDLIFIYGGLRGGVLLDDLLVAEDLAAAETTNAANHAAAS

SEQ ID NO: 61630 - protein, 174 aa, Sorghum bicolor
  Clone ID: 9849540.pep
MEKKGTDMPNENIMLLSLLVGLSIAGFSTGEDQFVYTGFTSSNLTLDGGATVTPSGLLELTNGTVRQKGHGFHPSSLPFYESSGVVQSFSVSFVFAILSTYPESGHGLAFFIAPNKNLSGSFPTQYLGLFNDQTNGDPNSHIFAIELDTVQNYDLQDINNNHIGININSLRSIQ

SEQ ID NO: 61631 - protein, 61 aa, Sorghum bicolor
  Clone ID: 9849569.pep
ERPRGSCKNSYQFIIVNVKKKLQFMQCHCGFSKLHQSYRVTTVSKNGTVKPSCVAAASPRA

SEQ ID NO: 61632 - protein, 121 aa, Sorghum bicolor
  Clone ID: 9849571.pep
SAPITSSPTSVGASTTLAMALTTLVTSSTTTTTCHPLPRYEGRQIDNIDLPEVINQVNHELSESIKVRKFCRRRLDFCPKIKYTFNILYNFRHDVLHNVFDMIILQTTFCLMVSRPVLSPT

SEQ ID NO: 61633 - protein, 94 aa, Sorghum bicolor
  Clone ID: 9849578.pep
QRNGGCTDVNTSTHTYTSLSRTAASSSSSSITISLTSIISISLCQLPQELMQLAHELLRHVLSVLSLLHIRKISCLLPSFTPLSPIFFLLSIGG

SEQ ID NO: 61634 - protein, 162 aa, Sorghum bicolor
  Clone ID: 9849579.pep
MSRRVPCKFFLHGACFKGDYCEFSHDCNDQPDNVCTFYQKGACSFGSRCRNEHVEAHRDCPQPATTAARASPNSSQLVASSRDPRCSGCQTDMCDQTQQICKSTTTLSAHQPAWAVDYHDNDTPDDTTSWPSYQAVQNQTSQHPAHLSNCSSAAVGTCPYGK

SEQ ID NO: 61635 - protein, 181 aa, Sorghum bicolor
  Clone ID: 9849590.pep
TRVKGIQMESVAVVAVPFPAQGHLNQLLHLSLQLASRGLPVHYAAPAAQVRQARARVHGWDETALRSVEFHDLGISEYVSPPPDPTAPSPFPTHLMPLFEAYTAGARAPLAALLARLSASHRRVVVVHDRINAYAAEEAARLHNGEAFGLHCLAASTLAGKTDAGLRLLRERGLAFLDVAH

SEQ ID NO: 61636 - protein, 171 aa, Sorghum bicolor
  Clone ID: 9849601.pep
ARGEIGMNCMLVGNYDRYILIDAGVMFPDYDEFGVQKIIPDTTFIKKWSHKIEAVIITHGHEDHIGALPWVIPALDSTTPIFASSFTMELIKKRLKEFGIFLSSRLKVLRIKKRFQAGPFEVEPIRVTHSIPDCCGLVLRCGDGIIFHTGDWKIDESPVDGKIFDRQALEE

SEQ ID NO: 61637 - protein, 77 aa, Sorghum bicolor
  Clone ID: 9849606.pep
SNQGCVQYWHCLLNLSDALCSIVNARLYSNFKCPFASSSVILNIGEAKVTAWENFCHTSSFSQILATDKTICTWNAT

SEQ ID NO: 61638 - protein, 78 aa, Sorghum bicolor
  Clone ID: 9849619.pep
GFGLLFCIININTIYFFGKTITILYFRFLPQVVKKPKRVSRDHNQSNKFCILNKTKHNFENFSILYFISSRHFALHVN

SEQ ID NO: 61639 - protein, 138 aa, Sorghum bicolor
  Clone ID: 9849625.pep
MLRAATVQARLLLLSRSYVGQAKAASSWPLVRRKPSRLGSVRPFYQMDTRGQDENKILTARGCHSSPESQELAMKSCVPCNSKDLHPMSEDSAKKLLEQVNGWELITEGDVLKLHRAWKVKNFVKGLEFFQLVAAIAE

SEQ ID NO: 61640 - protein, 163 aa, Sorghum bicolor
  Clone ID: 9849651.pep
NYPGIYVSDDTIGNVQSCEHVVYHWHQCPPDTRTTILDEFLKRYKWSPGHEEECQKIFDRKAVRQLMNLFCYEKQRVRQVLASKKTKALSVRRAHDEMELEQDGGREDPDEQQGEASVMVLEHEDPLKWKPFVPVWMKPKWWEMLCDHWAKDENIKVSCQQRK

SEQ ID NO: 61641 - protein, 156 aa, Sorghum bicolor
  unsure (1)..(156): unsure at all Xaa locations
  Clone ID: 9849680.pep
MERLESYLKEHFEVPAKNPSEEAQRRWRSAVGLVKNRRRRFRMVPDLDRRSQDEAQRQSVQEKIRLALVVQKAAITFIDGAKHKEYRITEDIIKAGFSINPDELASITSKHDVKALKMHGGADGIXKKIRSSFDHGISANDLDTRQNIYRVNRYAE

SEQ ID NO: 61642 - protein, 187 aa, Sorghum bicolor
  unsure (1)..(187): unsure at all Xaa locations
  Clone ID: 9849681.pep
HEAAPVTVNHASRGTGPSPSSPTSPHVAPSALVTNQAVXAASPPLLEPLPLLRDVAAADRPGLLLRKLRLVAAVFDLSDSLKHPREKEAKRQALLELVDYVQAPAQAAGANAQARLPDHVQEALVAAISANIFRPLPPALHESAAAIDPGAAPDDEEEPYLDPSWPHLQLVYDLLLRYVVSPDTDTK

SEQ ID NO: 61643 - protein, 175 aa, Sorghum bicolor
  Clone ID: 9849691.pep
HEGQFDLLKFGPGWMKLQKFEFEIESCPSLFDPRDPSCVEHCQYRYDFICESLVDLTLARVSTEKEIGLRCLLRKCKALKKLCLYYVLGVQDTDIVVLSNNCSNLTSISLRLTPQFNEGHVFRTSLTDDSLKALALRCRKLQSFELIFWGCDECWPEIGFTQEGLVLLIQSCPIR

SEQ ID NO: 61644 - protein, 157 aa, Sorghum bicolor
  Clone ID: 9849699.pep
MSHAAVAIGTIVFVIIVAAIIVCAYRRAEACAGGVASSYAVVSDQQIRHATIEKFLLEIRHDKPFRFTSLQLAGFTRNYTTRLGAGGFGTVYKGVLPNGLPVAVKVFDRSLAQRSQEEQFMAEVGTIGRTYHVNLVRLFGFCFDDVVRALVYEYMDN

SEQ ID NO: 61645 - protein, 154 aa, Sorghum bicolor
  Clone ID: 9849701.pep
MHSPVPLLLLLLCTAAAASDHGSQSQVRHVTSAASVSSSPTLTLTRPPRSPAAIPAHIASRRAQAQAPGAARLGLVPVAPAEAELGTMALALNDTRRRLGGSFQLCAPCTCCGGASGSCVLAPCCYSINCNIPNRPFGYCSFTPKSCECIGCNL

SEQ ID NO: 61646 - protein, 198 aa, Sorghum bicolor
  Clone ID: 9849707.pep
HEERINMEASKRASYVKKIHGKTKEAIERRSKYYADWANKHRKKVILEPGDLVWVHLRKDRFPEKRKSKLMPRGDGPFRVLSRINDNAYKIELPEDFGVSTTFNVADLTPFFGLEESESRSTPFQEGEDDEDIPTKHAPSNSTPTSTPTTSAPAQAIDGAITRSRAKKLQQEVNALLCESSINVNENIILPKCSTLVM

SEQ ID NO: 61647 - protein, 143 aa, Sorghum bicolor
  unsure (1)..(143): unsure at all Xaa locations
  Clone ID: 9849728.pep
HEVGLQWLMAVRYLFPILDWMPSYSFSLFKSDLVAGLTIASLAIPQGISYAKLASLPPIIGLYSSFVPPMVYAVLGSSRDLAVGPVSIASLIMGSMLRQAVSPTAEPVLFLQLAFTSTLFAGLVXASLGILRLGFVIDFLSKA

SEQ ID NO: 61648 - protein, 118 aa, Sorghum bicolor
  Clone ID: 9849732.pep
ARGIHGELSVDPARTPEGKSIGDFRRLLDDAYRGRIEFLERLERRTARKRLRLHRHRRGAVVPRAPPGPSHADDDRRPRPRLVIVSRTGSRVIENEADLAALAADVGFDVRVIRPDRT

SEQ ID NO: 61649 - protein, 84 aa, Sorghum bicolor
  Clone ID: 9849740.pep
MMSNLKLGVEVTSAHDLLPKEQGTANTFVEVEFDGQKFRTAIKDRDINPVWNEQFYFNISDPSRLPELHLEAYVYHADRASNSK

SEQ ID NO: 61650 - protein, 67 aa, Sorghum bicolor
  Clone ID: 9849746.pep
AKLESFHLDLPSSSYEFSKNTLSLPKSRNRGREGQRLTEGSHASATQRAEASSVAGDLNDGEVSGET

SEQ ID NO: 61651 - protein, 82 aa, Sorghum bicolor
  Clone ID: 9849748.pep
ARGAEQGAAGICADYVASRPREGNYVFSAFFFSPLLLGYVRLQEDGSGGLLAVAVAVLHELARQSCCQYEQDRIVSTQMAKL

SEQ ID NO: 61652 - protein, 97 aa, Sorghum bicolor
  unsure (1)..(97): unsure at all Xaa locations
  Clone ID: 9849759.pep
ARGKSLRSGTQGALTGVGLSISYPMAINGSPSGVAVMTATPGGPAEKAGILPGDIILAIDDRSTEDMDIYDAAERLQGPEXSPVDLSIRSGTNTRHV

SEQ ID NO: 61653 - protein, 114 aa, Sorghum bicolor
  unsure (1)..(114): unsure at all Xaa locations
  Clone ID: 9849774.pep
TRIKPVTVSFKEGLGQKFRQPSGTGIDFSVFEESDLLKQGDMDVYPLVVKAETALSADHPSEGDDQKMKTPNSQITQAVFEKKENGDYQVRVVCQILWVNGTRYELQEIYGIXN

SEQ ID NO: 61654 - protein, 56 aa, Sorghum bicolor
  Clone ID: 9849775.pep
ARGLLLMTLLASSGSLPAMASTGEALSPPAMEMRPLDTYSPAKLATVAVPPKGRRM

SEQ ID NO: 61655 - protein, 103 aa, Sorghum bicolor
  Clone ID: 9849777.pep
HVHSAEAHRFLQYCFLLQLLAAGTSQQLSPTRTQTNLARQAVTQRCTTISALQRSYSGPRRDRSSSSSDSDEQNCRNPLNRNRVQKSGSLRILVKRKKRTVVV

SEQ ID NO: 61656 - protein, 81 aa, Sorghum bicolor
  Clone ID: 9849787.pep
ARGSIVYNIVHVTSNVTEGDDSAQTNETKVLNSGNATGAIAEENCSTSNDCTDECALPLISTSIRAIKDKEPMLGRGWKFL

SEQ ID NO: 61657 - protein, 80 aa, Sorghum bicolor
  Clone ID: 9849795.pep
DVAQLWFLQLQEDEGTPPWGRFKELLNLRFGPALRSAPLFELTEWRRTGSVEDYSNRFQALLPRAGRLEESQRVQLYTGG

SEQ ID NO: 61658 - protein, 52 aa, Sorghum bicolor
  unsure (1)..(52): unsure at all Xaa locations
  Clone ID: 9849803.pep
ARGLPDGWLCLVXGAFDTQKLSPNFIKLAKDAYTPDLMAASDCMLGKIGYGT

SEQ ID NO: 61659 - protein, 64 aa, Sorghum bicolor
  Clone ID: 9849812.pep
MTVEKSSGGTSTSSTMDRFQKIVLSWDYLRLVTESKGGKQAKVLQRVKNTYDSVAEYLGVFEPL

SEQ ID NO: 61660 - protein, 42 aa, Sorghum bicolor
  Clone ID: 9849835.pep
IAALHYCMHDPSLHLSRDQGADVEPGRRHGAPADAEEVSCAQ

SEQ ID NO: 61661 - protein, 144 aa, Sorghum bicolor
  Clone ID: 9849853.pep
VGFEVVIGDPPFNVDVGEFAREVNAVDVLVGVHGAGLTNSLFLPTGAVFIQINPYGKMEHIGEVDFGIPAVDMGLKYMAYSAGVEESTLVDTLGRDHPAVRDPESIHRSGWGKVAEFYLGKQDIRLDLQRFEPVLRKAMQLLRE

SEQ ID NO: 61662 - protein, 168 aa, Sorghum bicolor
  Clone ID: 9849882.pep
HRDIKSSNVLLFDDDVAKIADFDLSNQAPDMAARLHSTRVLGTFGYHAPEYAMTGQLSSKSDVYSFGVVLLELLTGRKPVDHTLPRGHQSLVTWATPRLSEDKVRQCVDSRLGGDYPPKAVAKFAAVAALCVQYEADFRPNMSIVVKALQPLLNAHARATNPGENAGS

SEQ ID NO: 61663 - protein, 165 aa, Sorghum bicolor
  unsure (1)..(165): unsure at all Xaa locations
  Clone ID: 9849884.pep
TTLPGPTASFEQLKQAFHGRGLSTKDLVVLSGAHTLGFAHCSSFQNRIRLQDQGTDADDPSXSPSFAAALRRACPANNTVRAAGSGLDATSAAFDNTYYRMLQAGQGLLSSDEALLTHPKTRAFVALYAASQEAFFRAFAKSMLRMAALNGGDEVRANCRRVNSS

SEQ ID NO: 61664 - protein, 80 aa, Sorghum bicolor
  Clone ID: 9849906.pep
SSTRRGFKTSSAEFLWKMANRNCVEMNREFHATKARAPAMIPGQYFFAGSKEVYILIAKNHLRPWGSGKAAAARRLGDLP

SEQ ID NO: 61665 - protein, 174 aa, Sorghum bicolor
  Clone ID: 9849923.pep
RSTTSVRWRTWRASSGPSTSRIFLPRSLLHHQSQCLLLFSVRLRRRVRTRLPALHWVPALHSKAGQGTRPTRPTPRSRSRGGLLLHSRRATPRGRGRRRSRGLAQDYGATTPRRQGGLRHHHRQGGVRGAMGPLGTAPRVRRTCGGYSVTSKVPLPPSSRLGRMLDPFALMLDL

SEQ ID NO: 61666 - protein, 73 aa, Sorghum bicolor
  Clone ID: 9849929.pep
RQDRGRVGWSRAHASRSVDSDQNPLLVETDIRTAEKKRIFYGYLAIASDLDELDSDSRKRAFLQSRREFDPNE

SEQ ID NO: 61667 - protein, 112 aa, Sorghum bicolor
  Clone ID: 9849939.pep
FRDVYSPIPPVYNLVLAMLWRHPDKLKVVRLDEVKVVHYCAAGSKPWRYTGKEPNMDRDDIKALVAKWWHIFDDQTLDYNGGEAAADQASLPLRQALAQAGAVKYFPAPSAA

SEQ ID NO: 61668 - protein, 124 aa, Sorghum bicolor
  Clone ID: 9849944.pep
TSPSPGFEAGTPVLPFSLRPASNKPTTGADAAATSSRFVTTVCVSVTASPFLSPATPESQLVSSSSSGYSVGGGGGVAMAGVRNVPDVELASTTNSPMAMGEMDFMFPLDAADFLELGNPASYF

SEQ ID NO: 61669 - protein, 71 aa, Sorghum bicolor
  Clone ID: 9849951.pep
EHIAAIVGITDEDLTQKTTVPVVVELIKVEKVDSYNYCCERIAYVVDMNIKASSCENKLLLTNNKQPAALK

SEQ ID NO: 61670 - protein, 39 aa, Sorghum bicolor
  Clone ID: 9849963.pep
TALTASVALCHGVSDALFPVCLGFTLIVMYDATGVRRHA

SEQ ID NO: 61671 - protein, 102 aa, Sorghum bicolor
  Clone ID: 9849978.pep
DGVDIDQGVMVLCDAEGINPILEVLCENRNEALRQRAVWAVERILRMDEIAYEISGNQNVGTALVEAFRHGDYRTRQVAERALKHVDKLPNFSGIFSKMGAQ

SEQ ID NO: 61672 - protein, 89 aa, Sorghum bicolor
  Clone ID: 9849986.pep
GHLFEIKMSHEADEQLPFIVSFHYYNLTSNGIYSERSSGNHTHFLPCEANIVISKKILFVSHFSPISAKLYLHTTEGQVVQHHRSYHHS

SEQ ID NO: 61673 - protein, 174 aa, Sorghum bicolor
  Clone ID: 9850027.pep
QVQIRRLPKPVIAMVAGYAVGGGHVLHMVCDITIAADNAIFGQTGPKVGSFDAGYGSSIMSRLVGPKRAREMWFLSRFYTADEADKMGLVNIVVPLAQLEQETVKWCRQILRNSPMAIRVLKSALNAADDGHAGLQELGGNATLIFYGTEEAKEGKNAYMERRRPDFSKFPRKP

SEQ ID NO: 61674 - protein, 120 aa, Sorghum bicolor
  Clone ID: 9850034.pep
DLLATNLIKHVTSIIHHVRHSIISRSARVSSPDGLAEFDPCRPIESFHKQKGDGQVPSTIYSSDKSRIIMSAWCRCRRVLAAQRFPDDQACTICLVMGLERAACVLIIQIDSCRRTTCVL

SEQ ID NO: 61675 - protein, 38 aa, Sorghum bicolor
  Clone ID: 9850065.pep
AGSTPTPCGWKRTRQAVKHKTAATTTGVTSRILVAPPG

SEQ ID NO: 61676 - protein, 103 aa, Sorghum bicolor
  Clone ID: 9850078.pep
MLNYCLIHCSSSQWGFSQTTTMSLACLVCHGMSSPSNSLRSYSVSSSEEGSRCGAAVACLARRVTPAGTSSVGTSKLAQRALLDFNAAVLCPGTLLEIGTSMK

SEQ ID NO: 61677 - protein, 45 aa, Sorghum bicolor
  Clone ID: 9850086.pep
SPANSVRGTWTRGSTVIGEARSPRRRHRYGLRRGAPEDLGEHGGL

SEQ ID NO: 61678 - protein, 117 aa, Sorghum bicolor
  Clone ID: 9850095.pep
NQGGSGSGQHQQQQAGAVAAAASTKPAPKLEVPRIYTTLSRKEKEDDFMAMKGTKLPQRPKRRPKNVEKTINLICPGMWLTDVTRSRYEVREKKCPKKQQKNRGLKGIEMESSSDSD

SEQ ID NO: 61679 - protein, 134 aa, Sorghum bicolor
  Clone ID: 9850128.pep
ARGSSPPRQGKGTDRRYASTRRRRLFARSRSVRSARGVDLKQPPHTAFDFLCSAFTRLVRRSLQARLASPGLCCSCSLAPSLRGAPAPARLGRTQEFPRRARARLFAGVPGGGGGGGGAFLDKVGCCLLFSSGW

SEQ ID NO: 61680 - protein, 167 aa, Sorghum bicolor
  Clone ID: 9850129.pep
ARGWYLASGGEDCVVRIWQIIEVEASPKLYRGEDSYEKVEKVPVFKSNIEKRQHQTLAVIPKKVFRISETPLHEFRGHTNDILDMAWSKSDYLLTSSKDKTVRLWKPGCDGCLAVFKHKDYVTCVQFNPIDEKYFISGSLDGKVRIWDVLDKRVTDWADTRNIITAL

SEQ ID NO: 61681 - protein, 36 aa, Sorghum bicolor
  Clone ID: 9850134.pep
ARGCNKRYAVQSDWKAHSKTCGTREYRCDCCTLFSM

SEQ ID NO: 61682 - protein, 137 aa, Sorghum bicolor
  Clone ID: 9850136.pep
HEVDVEASVRSGTTVFQPGLLAEAHRGVLYVDEINLLDDGISNLLLNVLTEGVNIVEREGIIFRHPCKPLLIATYNPEEGSVREYLLDRIAINLSADLPMSFDDRVAAVDIATRFQESSKEVFKMVEEETETAKTHH

SEQ ID NO: 61683 - protein, 153 aa, Sorghum bicolor
  Clone ID: 9850152.pep
ARGPNTQEWRIRPYSRKHQPGIKEVTVRELASAGDAPPCDVRSPVPALVLAMGGLSGNYWHDFSDILIPLYLQAARFDGEVQLVVENIQPWYVGKYRTILRRLSRHDVVDMDKDDRVRCFPGAVVGIRMHKEFSIDPEREPRGHSMPEFTAFL

SEQ ID NO: 61684 - protein, 191 aa, Sorghum bicolor
  Clone ID: 9850155.pep
ARGGSIGRSYRGYFQQFQIFPATNEEKPILANQFSAFVSRPNGTKYSTVLSAPTADLLKEVDKASIGSWDWKLKEEKCTYHALFPRSWTVYDGEPDPEIKITSRQISPFIPHNYRESSFPAAVFTFTVHNSGSTAADVTLLFTWANSVGGKSELTGNHVNSKMTEQDGVHGVLLHHRTAGGHPPVTFAIAS

SEQ ID NO: 61685 - protein, 171 aa, Sorghum bicolor
  Clone ID: 9850157.pep
SCEAGLRWSTSLLPALSSPPSSSPFQVPHRPPPPPPPRQPAPPESSTPSRPAPCFSSVPRTAPASEERRRVRATPMHPKLSRAARRLLCCRGTASSEDLSDERSGSLRWVFSLRELRSATNSFNYDNKIGEGPLGSVYWGQVWDGSQIAVKRLKNAKNSTEVEFASEVEIL

SEQ ID NO: 61686 - protein, 121 aa, Sorghum bicolor
  Clone ID: 9850174.pep
MGDSSVAGALVPSVPKPEPARSGDTSVAAAATTAALALALPEEAGTRAASASPQGPPAEDEGPADRDLLCPICMALIKDAFLTACGHSFCYMCIVTHLSNKSDCPCCGHYLTKAQLYPNFL

SEQ ID NO: 61687 - protein, 166 aa, Sorghum bicolor
  Clone ID: 9850181.pep
TRVDSLKAGKAAVYKARSRLTAGDRTASSSVRLRPSELGEGLPTPAALPTPFPPPSSSRRRLASPPRLAPVVPGRRGASFFSVAGYARDEGGRRSRSAWIQGQRRPSRVTRDKETVLSLGRTCRALHAAVMKIPKYQTPGLNTQDTIQQGQMHTALLINLPRVLSL

SEQ ID NO: 61688 - protein, 147 aa, Sorghum bicolor
  Clone ID: 9850183.pep
HEALAASSAEAALLLLVLLVRLAAVALRCGEGLSLALYDESCPEAEAAVTAAVRQAMANDRTVAAGLLRMHFHDCFVRGCDGSVLLDSTGTVTAEKDGPPNVSLHAFYVIDNAKRAVEAQCPGVVSCADILALAARDAVALSGGPSW

SEQ ID NO: 61689 - protein, 100 aa, Sorghum bicolor
  Clone ID: 9850186.pep
MSPPRRHFLVLTFPLQGHIAPALRLARRLHVAAPDALVTFSTTEVAHRRMFPAKPAAADGGANNDSVEDDGRLEFLPFSDGMEAGYVRSTDPGSFNAYMA

SEQ ID NO: 61690 - protein, 160 aa, Sorghum bicolor
  Clone ID: 9850189.pep
HRSILLRPHRRAQIRPCQRRRTRQRVQRRPKHVKTSPRGTLCSRSWLSSSSKLPGPEKRDISRVLDFTSGFPSISRPPRVISLARQGVRVQPSCGKATAAVVLSQVPRFPSVPSPGPSSLAGDEHPLDYNCILKNKMDQHDSMADSPRRRHNLLRDKVQL

SEQ ID NO: 61691 - protein, 178 aa, Sorghum bicolor
  Clone ID: 9850207.pep
ARGCDIVDALEASVLYKEAAAVAGGPTYMRKLPQRNTRRAASGIPRWASSAATTPESKRPGQTISKGHKNYELMLQLQLGIRHSVGKSSAVPMRALEQGDFDPGEKFWTRFPPEGSKVTLPHSTAEFRWKDYCPMVFRHLRKLFAVDTADYMLAICGNDALRELSSPGKSGSFFYLTQ

SEQ ID NO: 61692 - protein, 60 aa, Sorghum bicolor
  Clone ID: 9850209.pep
MYHYVIFSFDAEQLWVLDSVPGQVETDNSDGEVERVLQTLASLPSSLPSRKWVVDHMLSL

SEQ ID NO: 61693 - protein, 219 aa, Sorghum bicolor
  Clone ID: 9850235.pep
ARGEEPLKRNSSEKDVIDPWPVGNKESPSNGIEDSSEWQAFASVSGQGRDFVTSVERSTSGHGLKLVRPVGVEETMINISHQHSSEINPVDLWPVGNVEAQNAAEMVKETNNDNWQDFTATGQVQDTSLNQTGDMMEVPKASHKETDMDSWFIGNFGEPANTGTVNENNMLDDWQGFTGSDQAQPNSSSTGAEMTSVPFEQHDGSVSVQSWANASSNDA

SEQ ID NO: 61694 - protein, 41 aa, Sorghum bicolor
  Clone ID: 9850239.pep
ARGLSSMRRKKPIPFTQKFPNADPLALILLKRMLTFEPKDR

SEQ ID NO: 61695 - protein, 177 aa, Sorghum bicolor
  Clone ID: 9850246.pep
QHCGVRFHPIMCSRHHCRFCGGVFCNGCSKGRSLMPPKFMTAEPQRVCDVCGVRLESIQPQLMNQISRASQLPTRDVTDLSTLRSWLNFPWAHTMEYEIYKAANSLRSYCKVGGLKPEKAIPDTILRQAKGLAIVTVVKVGMMVTYKLGTGLVVARRVDGSWSPPSAISTCGIGYGA

SEQ ID NO: 61696 - protein, 86 aa, Sorghum bicolor
  Clone ID: 9850249.pep
MEGGVPEEKCALVAELVQVLEMARQLETHMAVVVQQQQQGGGGAGGGADQRYRALVSTMRASIDRAVHMAVSCCAEGRPGTGQLPE

SEQ ID NO: 61697 - protein, 73 aa, Sorghum bicolor
  Clone ID: 9850259.pep
TRQAMAHGSRSPVGCHRVPQLRHHACMPTAAMKVIMAQALWGTSYSGMGMTFFQKLASFSYGFHMHKIKYLEL

SEQ ID NO: 61698 - protein, 195 aa, Sorghum bicolor
  Clone ID: 9850262.pep
HEGFKNQSQIGNAYGTAVVIVMLVTTFLMIPVMLLVWKSHWILVVIFLVLSLTVELPYFTACINKVDQGGWVPLVIAITFFVIMYVWHFCTVKRYEFEMHSKVSMAWILGLGPSLGLVRVPGIGFVYTELASGVPHIFSHFITNLPAIHSVVVFVCVKYLPVYTVPAEERFIMKRIGPKNYHMFRCVARYGYKDI

SEQ ID NO: 61699 - protein, 54 aa, Sorghum bicolor
  Clone ID: 9850272.pep
EQARVWPAPRGRRHGGLLRGLEAAGSRRLGRSALAKRLELSTSIASAPHRRPRA

SEQ ID NO: 61700 - protein, 71 aa, Sorghum bicolor
  Clone ID: 9850275.pep
MSFCSRLTLLNLVVCTLILYLALVSSSWGFLLLLYVFVQISRLIVAGVLYPLLRQFGYGLDWKEAMILVWS

SEQ ID NO: 61701 - protein, 173 aa, Sorghum bicolor
  Clone ID: 9850289.pep
ARGEVQDGHYDSTSQSTDSLRVEPIYESFLCPLTKQVMQDPVSIDSGVTFERDAILKYFNECLSSGKRLVCPVTKMELSNTELNPSIALRNTIDEWMNRNEAAKLDVARKSLTSDSMESDILQALQYVDEICQRSRSSRQVVRRDGLIIMIADLLKNSSTKVRQSALETLSSI

SEQ ID NO: 61702 - protein, 59 aa, Sorghum bicolor
  Clone ID: 9850297.pep
FDQQLLLNSKDKAIDDSSKLYIVFAEMTVQNCRLFFPTNKLKPSIENYYQNKGIMKQAG

SEQ ID NO: 61703 - protein, 118 aa, Sorghum bicolor
  Clone ID: 9850334.pep
MGDAAERRLARVAAHLVPSSSFPVTHATVRPLAPSATAASSSSSPAKDSYRRVHGDVPSEPPEWRAATDESGKEFVDIVYEKAVGEGIAKITINRPNRRNAFRPLTVKELMRAFNDAR

SEQ ID NO: 61704 - protein, 154 aa, Sorghum bicolor
  Clone ID: 9850335.pep
HEGERMNVLNPYVRQFLVGWITVLDSVPDIDMLGFLPDFLDGLFNMLSDSSHEIRQQADAALSEFLQEIKNSPNVDYGRMAEILVRRAGSTDEFTRLTSITWINEFVKLGGEQLVPYYADILGAILPCISDEEEKIRVVARETNEELRAIKADP

SEQ ID NO: 61705 - protein, 177 aa, Sorghum bicolor
  Clone ID: 9850341.pep
STFLFRSPRVAFEFLTLSRSRGTKRRPDGELVELLWQDGAVVAHSQAQAHHHHHHHYRRPLVQVAAGNTGASGVTGEQAPALPWLPCSGGAMGGDVYSQLWQSIAQADGRVVGADAVAGAPRPPARSGNSGVGSSRTAGQEVGSSFSGSNLVAAAMHLDDDIDDVGVAAALPVPLDD

SEQ ID NO: 61706 - protein, 143 aa, Sorghum bicolor
  Clone ID: 9850359.pep
ERRWRQRRGDDQVAYQIGGLTTILGFDGWHQCQRRTEGWEQACRGGLRNAEAESGGGGGLRLSALRRSQRTPLGDACGGSGGGAGSQGIGGSMEWGEAVRREGARGWGSRCQRELGVRGSASGWRPAAWAWAGRRSRGEPESG

SEQ ID NO: 61707 - protein, 110 aa, Sorghum bicolor
  Clone ID: 9850363.pep
MSLKLPIPQGLSFLRSVGWFEDRKVDSSAKQQLSPTLKLQTDKEAYRPGDSVTVTIEICSPASLKDDAGQTVSGEDTPSLLLDVLSFELKGIEKLDSQWFSVPKPLPGSK

SEQ ID NO: 61708 - protein, 161 aa, Sorghum bicolor
  unsure (1)..(161): unsure at all Xaa locations
  Clone ID: 9850369.pep
HEAQVLNLIPKEGEGESFEDALARVRRCLGGGGATDNADSDSDLEVVTESVTVNLRCPNSGSRMRIAGRFKPCVHMGCFDLETFVELNQRSRKWQCPICLKNYSLENLMIDAYFNRITSLLQNCSEDVNELDVKPDGSWRVKGDAATRDLSXWHMPDGTLC

SEQ ID NO: 61709 - protein, 168 aa, Sorghum bicolor
  Clone ID: 9850382.pep
TRVAYRMNVREYQALTSYASLLEENWGKPPGHLNSDGENLLVYGKQYGNVFIGVQPTFGYEGDPMRLLFSKSASPHHGFAAYYTFVEKIFQADAVLHFGTHGSLEFMPGKQVGMSDACFPDSLIGNIPNIYYYAANNPSEATVAKRRSYANTISYLTPPAENAGLYKG

SEQ ID NO: 61710 - protein, 112 aa, Sorghum bicolor
  Clone ID: 9850386.pep
SYHACSQIRTQIGHLRQITQIIPNTEKTRGLTQINHSIEYLIPKFSTSNPAPFLPQMKGKHPLTYSESPRIAPSTSNGGMHHLPYAAVGCGGGGHHRRRIGAASSPTAQPSC

SEQ ID NO: 61711 - protein, 88 aa, Sorghum bicolor
  Clone ID: 9850390.pep
ILLHSSELSNSLHHFPNAPPQHSSPQSPPIPLQSPVSTTVTDASTTCGSNICHLNHSHRCIYPTRGKQHMHFCDSNWCLHNLWKQPSC

SEQ ID NO: 61712 - protein, 151 aa, Sorghum bicolor
  Clone ID: 9850393.pep
RAGGVPARVLQADVARRHCRERRQRQHRGSPQRGRRPRLLLLILLVWAVVAVMRRRGGGQVAAVVGDHDHNVSVGKPRARVLLPWTRRRRHRRRGGGHVARARSLAGRVIASGRRTREAGRRARCKRSAATRAACRVCEGREGKGREGGLV

SEQ ID NO: 61713 - protein, 123 aa, Sorghum bicolor
  Clone ID: 9850394.pep
TRRASGPVRCATTQPPLSRAVSECSACARIVVERHLHTHPFFPLLPSLHPLPLVTPDLATAVDPAPSPSPGDEDDEDPFLPAGFVSAFSAFSLERHPVLARSASTFSGLLAELERALAVDSAA

SEQ ID NO: 61714 - protein, 178 aa, Sorghum bicolor
  Clone ID: 9850398.pep
ARGNDTKAWEVDTLRGHMNNVSCVMFHAKQDIIVSNSEDKSIRIWDATKRTGIQTFRREHDRFWILAAHPEMNLLAAGHDSGMIVFKLERERPAFCVSGDTVFYVKDRFLRFFEYTSHKEVQVAPIRRPGSVSLNQSPRTLSYSPTENAVLICSDADGGSYELYIVPKDSAGRSDYLQ

SEQ ID NO: 61715 - protein, 168 aa, Sorghum bicolor
  Clone ID: 9850403.pep
HEAETLEALRRAPGSRARRFSRRESRGRDKLYLSGSAMDLEIVGRHALLFDDDATAEVVNSGGSLVPWAAVGAAELLLDRHDVRHLLDRVPPRPRRAYSVALLSAPSPDGISETELDRERYLDLPAGDGEYEGSGDAPPSGNGTDTGQADYNAVPFSYGYSAGSDEPN

SEQ ID NO: 61716 - protein, 168 aa, Sorghum bicolor
  Clone ID: 9850404.pep
GTRGRGLDSSDVVARNAARRELSVATVGGATSSLLDPGAGGAGAAAAAGFLLTPLPMPLGSGRPSELGLGYLIMSNADGGFDGLDEATSRATATASAEPRIESASSNPPPVLVSTIAGALLPLSLSGLGVSLYRSTISADQTDERSQGTKVLAKSDGEDTTERSGPRA

SEQ ID NO: 61717 - protein, 99 aa, Sorghum bicolor
  Clone ID: 9850429.pep
MSVKQTPSSSTAAAFYATLARGLDDLDRALAAASSSSSAFLSLPTLRAALALLHAAHAGLARLVASLHLPGGADWLDEYMDEASRLCDACRALRLGAVV

SEQ ID NO: 61718 - protein, 65 aa, Sorghum bicolor
  Clone ID: 9850442.pep
ARGIHHFRRRARLQAPPPLITAPAAPPQSVPRAARGTRVVVGPRPPDPRPPLARSPSPDGAHRRR

SEQ ID NO: 61719 - protein, 163 aa, Sorghum bicolor
  Clone ID: 9850446.pep
HEALMMAFSMARRAAAVPLLLVNGTYKSTVSTYLDSAILQHQLQRLNEHNSLKGGHSNHRSTLEVPIFWFIHNEPLLLDKHYQAKALSNMVVVVQSDDDSWESHLQCNGRPILWDLRKPVKAAIAATAEYVSGLLPPHLVYSHAHETAIEDWTWSVGCNPSAV

SEQ ID NO: 61720 - protein, 36 aa, Sorghum bicolor
  Clone ID: 9850456.pep
PATWRSTPEWRRAGWRAGGASVPLRGAAAGKGQPRA

SEQ ID NO: 61721 - protein, 61 aa, Sorghum bicolor
  Clone ID: 9850458.pep
LKGLNDKWQVTIIYIPNLWGPFPHAHQQPYWRKLFIFFPSSPLFLFFFFFFFFFFFFPSLV

SEQ ID NO: 61722 - protein, 98 aa, Sorghum bicolor
  Clone ID: 9850470.pep
FKIHVFSVNDTALHRSTFQFKKKIDVFSLLYIGVSTVTLPSPRPVQLRRRPIMAPPLPGDPSSPAEPPTVTGNLPEHRVAGSVKHQQREVPSRHPIFY

SEQ ID NO: 61723 - protein, 107 aa, Sorghum bicolor
  Clone ID: 9850483.pep
KHSRFEREVGRGRERERERERERESTPEGSGGPLGPRGRRGAGQGSSAGVDEPLRAERHGRRGAPWGGDIAGGGEPVGAAAARRGDGLESGRPLGEVARASGRPWRR

SEQ ID NO: 61724 - protein, 195 aa, Sorghum bicolor
  Clone ID: 9850495.pep
SSVSTEPKKNENKTLDLGCPGMNLLKISPEANNACPLTKQIKSENDSQLKEPCVKNELSCPTSNGTSRQHNGGIVGHKVAAPSLMVPSGQSLPANAVTKPLITSGESMRSTHVLAVLKESRETSSQTGDCTSSLTIREYHNRPLSMIDNGVNMKPDLENLDNSHRLMASSDFNATLCHSYKDQTFLTPETNTSVM

SEQ ID NO: 61725 - protein, 183 aa, Sorghum bicolor
  Clone ID: 9850520.pep
ARGLELKSSIQDFIICIEMGIASVVHLYVFPAKPYALLTNQSPGNISVLGDYVSSDPVDPFEIKESNRPTKMKLPQFEPDERSVTNIKESVRDFVVGSGEYVIKDFKFTVNQAVRPVEKRFDKLMKKNDKRKKSQDDNWVSAATPERPVRGIDDPLLSGSSSDSGVTKGKKHRRIVSTAAAVD

SEQ ID NO: 61726 - protein, 173 aa, Sorghum bicolor
  Clone ID: 9850528.pep
TRVSMNFLTGAIPSSGSLINFNETSFVGNLGLCGKQINSVCKDALQSPSNGLQSPSPDDMINKRNGNSTRLVISAVATVGALLLVALMCFWGCFLYKNFGKKDMRGFRVELCGGSSVVMFHGDLPYSSKDILKKLETMDEENIIGARGFGTVYKLAMDDGNVFALKRIVKTNE

SEQ ID NO: 61727 - protein, 168 aa, Sorghum bicolor
  Clone ID: 9850532.pep
TSDQTNRSRTSPPPSRRRRSRSPDNHRKDSRRDDGGRDTDGHREQNRRRGQEVNQHRDLQHNIPPKDDRDRINRRATERAVHENLRRIEYDATHGPPGLRQFSPHLRQVMWPRNFKLKKLKKYDGKENPENWITLYEIVVRSAAGDEHVMANYFPVVLDQAGHQWLLV

SEQ ID NO: 61728 - protein, 133 aa, Sorghum bicolor
  Clone ID: 9850578.pep
HEASKRVVAAVVKERAADGLKGKGDVVKVDQLRVERSKAVVVEAPRETTAAVVQAVAESPSRSTEYLISPSPNRRLRRTITSWLKGQHLGSGSFGSVYEAISDDGFFFAVKEVSLMDQGLNAKQRILQLEHEI

SEQ ID NO: 61729 - protein, 155 aa, Sorghum bicolor
  Clone ID: 9850602.pep
PASPTNLLRRLTKKRSETIANVLSRQNHHLWLRARVCLLHIESDMVQHRGRTASMLEVPVPVPGSLPLCTYRDSIRRVSVVSGGLCGSVQLFFPVSCDTEAGDGAYCWSSASSASSPCPSLDAWARCSPVSSSFSGCWEAEDPDAVMELRAIAQQ

SEQ ID NO: 61730 - protein, 77 aa, Sorghum bicolor
  Clone ID: 9850611.pep
MAKFGDVLCAFTLLVLLPCSDVALGQTTDPSEVDGLRAIKGRLVDPMNNLENWNRGDPCQSNWTGVFCHKVNDDAFL

SEQ ID NO: 61731 - protein, 65 aa, Sorghum bicolor
  Clone ID: 9850612.pep
MADPPPVAASASPAQPDQLAATAASVYTPQNPNPNPLLSPQIPPCPTVFDLYAHISSPQQLDQAA

SEQ ID NO: 61732 - protein, 116 aa, Sorghum bicolor
  Clone ID: 9850628.pep
GAAFASALSRAQQRAAAEAGRSVAAPGGAGVMMHEFRRARAAVEDAKDAVERGGDVAAAAAEVGLRAGALRAACEDVLALIDDLFDEVVEARKKLLDLCSGGNCPTHRRTHTTMTM

SEQ ID NO: 61733 - protein, 107 aa, Sorghum bicolor
  Clone ID: 9850654.pep
FEENPRDLDLLKHDKLLSNKEIPAHLRDVPDYLIDPKTKEASNVVKLSRAAMGIDKPQRRKRQGFKGGSGKSRDPLKTFSAEGKRRRRRKDREGEPGRTKKSRKAES

SEQ ID NO: 61734 - protein, 66 aa, Sorghum bicolor
  Clone ID: 9850701.pep
SLHLYMQHLGSSQTSDFSSFRLEQFPSFDSCGLLQCRYNKKEIGSVMKLQNHNFSILKKPGCLEHM

SEQ ID NO: 61735 - protein, 110 aa, Sorghum bicolor
  Clone ID: 9850719.pep
MIQSFIEAYLDASWEPVMSCLYYDIPRGFLKLGGRLDKFECEFHKTYTMQRQWKVPNPELRKRLRKAVIEKVIPGFSKYLAERTTKAKSNRPPKNTALELEELLEELFEG

SEQ ID NO: 61736 - protein, 58 aa, Sorghum bicolor
  Clone ID: 9850734.pep
HNMLTTNILSCDYKVKYTTWVSCTLFYQVKYFLLLKFGLPSISRYATLVFHVSYRRIC

SEQ ID NO: 61737 - protein, 49 aa, Sorghum bicolor
  Clone ID: 9850747.pep
IRLLLFVIRLSCYSSCDQSVYYCSQYPIYSVIFSTSSYLISLGENDVLN

SEQ ID NO: 61738 - protein, 92 aa, Sorghum bicolor
  Clone ID: 9850771.pep
PLVERIEKTVEEGEKTIVREVKEIEEEVEELEKEEASLFQKLAEGLMEVKQDLMNFLQGLSKEEMELLDQLNMEATEVEKVFSRALPLRKLR

SEQ ID NO: 61739 - protein, 62 aa, Sorghum bicolor
  Clone ID: 9850788.pep
PPIQLLPSAAVLASEQAQPCQYFGHSWTMACQRIVSALCQRAPCYVFLKFSLCTLESHPWIR

SEQ ID NO: 61740 - protein, 111 aa, Sorghum bicolor
  Clone ID: 9850821.pep
FFPVDASIFHSFTSQTFQSIYFFSERVLKKERVAVTDHSINMFNTHKRKHGQNKCKPCKTSTSVLLLGNVWFGNQVGWDGLIPVFKDGMFLPSVWLKRDDAISVSYFVSRH

SEQ ID NO: 61741 - protein, 103 aa, Sorghum bicolor
  Clone ID: 9850833.pep
LGGAGPDEEAALRRYGRTIGVLYELVDDVRSASGNGKMRRNASVLRSLGMDRALGIVEELKAQAKTEADRFGDKYGDRVLPLYSFVDYAVERGFELQGAAATS

SEQ ID NO: 61742 - protein, 135 aa, Sorghum bicolor
  Clone ID: 9850835.pep
DDDDDDDDKLPGGGRRVVDTHLVECGGQLLLVSVHDDVVYNSDDDVVGMAGLAVDDGGNKGGDARAVEAHRVEWLGDGAVRLVRVVDIGLNNLFLGRNRAFALSGAEFPCCRANCIFLVDRQGQPDGVVRVLGME

SEQ ID NO: 61743 - protein, 93 aa, Sorghum bicolor
  Clone ID: 9850876.pep
TPLDSGRSPYSSAGVTPEPCGFVRAIGAGLSRGALLVFILYRGRWGVSELPAFYFGPFHPVSWSFLANYSPRQPTWTAWACYLWFNWPSLRSE

SEQ ID NO: 61744 - protein, 51 aa, Sorghum bicolor
  Clone ID: 9850884.pep
EPSYLSSSTPANIKNRLRLSSVSSHQLIIELRMMFASWLYLVVTIRRLIRV

SEQ ID NO: 61745 - protein, 174 aa, Sorghum bicolor
  Clone ID: 9850894.pep
MALSSLFITLPVPKVPSSNSRRLLTARASSAAAPAASASFDLRRYWTSLIADVESELDAAMPMQPPESIHSAMRYAVLPGAGKEGAAKRAPPVLCVAACELLGGPRAAALPAAAALEMLHAASLVHDDLPCFDAAPTRRGRPSTHAAYGTDMAVLAGDALFPLAYTHVISHTPS

SEQ ID NO: 61746 - protein, 122 aa, Sorghum bicolor
  Clone ID: 9850896.pep
MACGGRGGTGWSSLPADLLLTVFALLPSDVDRIRFRAVCAGWGAAAAAWRPRPWLVGSVTDRSGRAAGAMSSFWLSPGGGLLPFAANVPPGLDYLSSCSHGYLALSDPRISPKAILLLNPLT

SEQ ID NO: 61747 - protein, 170 aa, Sorghum bicolor
  Clone ID: 9850906.pep
TRHKNIDCFFSGTTAVAVIKQGRNLIIGNLGDSRAVLGTRDENNELVAVQLTVDLKPNIPSEAQRIRQRRGRIFALPEEPEVARVWLPKYNSPGLAMARAFGDFCLKDHGVISMPDVSYHHITEKDEFVVLATDGVWDVLSNDEVVSTVSQATSRASAARFLVETAHRAW

SEQ ID NO: 61748 - protein, 195 aa, Sorghum bicolor
  Clone ID: 9850921.pep
LTPQFSMNEVAITWRTLQTFPFTTWFVVCGDMLLMVNLTFASVPSLGSSLSFGGSDVDMRFFKVFRLDFSVKPAKWVQMEKLENYALFLSLDRRNPAFSCVNPERWGGKSNCVYVAKLFNDADPEETWTALEVGQSVPHHHIVDLMMYSRHSHRTTVRLVAFGFSPVWFMAPASDRVSLAGYWLVLHRQWRLLFL

SEQ ID NO: 61749 - protein, 35 aa, Sorghum bicolor
  Clone ID: 9850957.pep
SLVRPYIQTEKSTGTAFSLVRLHWSSFITWSMDAT

SEQ ID NO: 61750 - protein, 106 aa, Sorghum bicolor
  unsure (1)..(106): unsure at all Xaa locations
  Clone ID: 9850960.pep
KINSLVKLSPVPVLIMSKTLPMNCTDYYSSPLHHEPIVLCFSIDLHQKKMEKNIKKHHRNKNTIACNLIDSSNPFDQLAQEGFRQAILVRFACSEGHDVGGLGVXA

SEQ ID NO: 61751 - protein, 68 aa, Sorghum bicolor
  Clone ID: 9850979.pep
HVPPKLHGKCQLNLHEKTSLLISTRSYGAQAIQALMNNPGLVRSYNFILDVDEFSLQMFQWNSAFPCS

SEQ ID NO: 61752 - protein, 98 aa, Sorghum bicolor
  Clone ID: 9850989.pep
TRRTAAHLLQKLLYYFPPQDKDLSSYLVGDKSILGDAGVHSMEDVEALPPPPEMKVPDLKFKGDVSYFICSRLGAGPKVIADESQALIDSVTGLPKGV

SEQ ID NO: 61753 - protein, 191 aa, Sorghum bicolor
  Clone ID: 9851008.pep
VQILSVFMSLDLSNNDFQGIIPNNIGNLKFLKGLNLSRNSFTGGIPPRIANMLQLESLDLSSNQLSGEIPPAMALMSFLEVLNLSYNHLSGMIPQSSQFLTFPVTSFLGNDELCGKPLLRMCANHTPSAAPTPGSSKELNWEFFSIEAGVVSGLIIVFTTTLLWGNGRRWLYWQVDKFLPDVLQPGRGRRH

SEQ ID NO: 61754 - protein, 175 aa, Sorghum bicolor
  Clone ID: 9851009.pep
QHIKMSAPVQTGMPKTTESRRSRRSSSRDGASKQNLRENELTRTKRRPRAKHQLSIGPSYSAEQMHSRGYVERPLNYLVATSSTWIHPHICVTSASKQLKDLLELENLNSLAHIQHTGKNQHVQEDIQENKSDESIASAQTRSGGFPMINGWLINQGVRAAIVVIACGAMFFNNR

SEQ ID NO: 61755 - protein, 112 aa, Sorghum bicolor
  Clone ID: 9851020.pep
SDAGLGMAMFSLGLFMALQPRIIACGNKVATFAMAVRFLTGPAVMAAASLAVGLRGTLLHVAIVQAALPQGIVPFVFAKEYGVHPDILSTAVIFGMLIALPITLVYYILMGL

SEQ ID NO: 61756 - protein, 92 aa, Sorghum bicolor
  Clone ID: 9851027.pep
DQQHHLHLRQTYHQLSMISTDLVFFTCSTVEHLIYNIQNTKWKKITTAKGKRKRNEGYYQPQKTSSADGISNSLKACETTTSSPFFIRLNLK

SEQ ID NO: 61757 - protein, 171 aa, Sorghum bicolor
  Clone ID: 9851035.pep
QFFRAALKIAAEIDSDPQAWLSPRTNLAHAYRRLRLWKDAHIEFDEVLRQGGKDAAIFCAKALIYLEEGRPEKAIVPLHEALAINPQDGTATELLNKALEETSTIDFADGDELEAFEQELELGKAAAREQVSNKLPKLRRDVKGKAKASRPRVLVDEDEKGGSMMEMTDDD

SEQ ID NO: 61758 - protein, 79 aa, Sorghum bicolor
  Clone ID: 9851049.pep
RSTLEVVIPNSAVASLTMRAGSKLAQISEISGATVTLAEDRPDILEKVVRISGTPEQASKAENLLQGFILSIPDDIPSA

SEQ ID NO: 61759 - protein, 73 aa, Sorghum bicolor
  Clone ID: 9851054.pep
WLNQWINDRDHGKKEKTRLVETECRRAENVDLRCLGTGSPLHRNRGLDNLFGLGSYVSEAKFATPYWKSILSL

SEQ ID NO: 61760 - protein, 124 aa, Sorghum bicolor
  Clone ID: 9851069.pep
PLLETNSDVCTLKEKLEDEYLEIPEDSVKRVFAGLILREIKDFWRVALLLSIISYPEAENAADTLNKQDELHQRKETYIIVEHFITDLDLDGVWKLKPVLDGKSIMGVMQVKGGPLIGKWFGEW

SEQ ID NO: 61761 - protein, 95 aa, Sorghum bicolor
  Clone ID: 9851071.pep
YDLRQTGFIEREEVKQMVIAILMESDVKLSDDLLEAIIDKTFEDADADKDGKINQEEWKEFVLRHPNLLKNMTLPYLRDVTTVFPSFVFNTAVED

SEQ ID NO: 61762 - protein, 113 aa, Sorghum bicolor
  Clone ID: 9851139.pep
PGASNNAMLRLHMELKGPFPKKMLRKGAFTMQHFDQDLNFHATEEDPVTKTAVRRLILNIKPKDVGSLISNSPGEDPKMLSSFKDLLEKIFILDPEKRITVSQALSHPFITGK

SEQ ID NO: 61763 - protein, 59 aa, Sorghum bicolor
  Clone ID: 9851169.pep
RPHMTYTCMMPVIGAWSTWHIYSHYSANVIHGVGHLEGAGALRRAGEVATLVYHVAHDA

SEQ ID NO: 61764 - protein, 146 aa, Sorghum bicolor
  Clone ID: 9851212.pep
HEGLLLIAVVAAIVFCFVCSGRTGRRNDQRGSGASPSAPSGVSATGTAAATGGSQPSALSANTAKVGDSFAYDQLANATSGFGEERLIKHGHSGDLYHGVLQDGTAVVVKRITSRVARKDAYLAELDLFTKGLHERLVPFLGHCLD

SEQ ID NO: 61765 - protein, 179 aa, Sorghum bicolor
  Clone ID: 9851224.pep
HEAGTFPSWIFHIKSLTVLEVSQNENLCGELPEFIEGSSLQELSFSGTKLSGKIPDSMANLRNLTALDLSYCQFNGSIPHFAQWPMIQSIDLSGNNFIGSLPSDGYSGLHSLTRLDLSNNSISGVIPASLFSHPSLEYLDLSQNNLTGNLILYQNISCNLESIDLSNNRLQGPIPKLLS

SEQ ID NO: 61766 - protein, 194 aa, Sorghum bicolor
  unsure (1)..(194): unsure at all Xaa locations
  Clone ID: 9851225.pep
ARGHGQTVFTQSMGKLSSLDLQGIISETDVSPTPTDSGSTQAGKTVIPFDDHKASNYRSGKTVSSQHIKMSEPVQTGMPKTTESRRSCRSETGVSPTPTDDSXSTQAGRTVISFDDHKGSNYRSGKTVSSQHLKTSEPVQTGMPKTTESRSCSSETGVSPTPTDSCSTQAAVIPFDDHKASNYMSGETVSSQHI

SEQ ID NO: 61767 - protein, 108 aa, Sorghum bicolor
  Clone ID: 9851226.pep
MYFQYFFYFIPYCHALLLLRFTLVEKHGYKSPTTKKTHLLVKKKFGSSICLFCLRLTLLVASLGKSPPAASLSFLAPQITPRTRALSVLDPDADVLFLPATRFTFSAP

SEQ ID NO: 61768 - protein, 68 aa, Sorghum bicolor
  Clone ID: 9851237.pep
GKIHVTVRRSNASRSDIYSRRSMGFSSTTPRPIYLTNAEIYSLQSLRNPTPRGSSFNHTDFYSMVGRS

SEQ ID NO: 61769 - protein, 70 aa, Sorghum bicolor
  Clone ID: 9851244.pep
ARVKAVARFGVAPLKTAPVDSVLSLIDLKKGLLILHDYSMCCVSLSSHKIFCLSYSSGLFYVVRFIVSWL

SEQ ID NO: 61770 - protein, 157 aa, Sorghum bicolor
  Clone ID: 9851252.pep
HEGQTPGRPHVSCRYLAAHCLVKQSRFDEAVALLGERNPTHLINNASNKRKMNTAPLGRAVGHRGRMARDEAAEDEATNRKYEAAMCYLRGICYAKQNAFDRAKECYKDAVRIDVQCFEAFQQLMTNALLSPDEEWAFLESLDFDAITVSGDVSSSQ

SEQ ID NO: 61771 - protein, 52 aa, Sorghum bicolor
  Clone ID: 9851261.pep
HEGGDGSRVYTVVVVETGDAEGMRVVVGKHRHAWVVGKADEVKAVTVIGKVF

SEQ ID NO: 61772 - protein, 170 aa, Sorghum bicolor
  unsure (1)..(170): unsure at all Xaa locations
  Clone ID: 9851262.pep
ARGENGVVTLMQSHYVEKILSRFGYSDCKPVSTPYDPSLILRKNKRIMRDQLRYSQIIGSLMYLASATRPDISYAVSKLSQFVSNPGDDHWRALERVMRYLKATASYGIHYTGYPKVLEGFSDANWISDADELKATTGYVFTLAGGAVFXKSCKQTIITRSTMEAELAAL

SEQ ID NO: 61773 - protein, 105 aa, Sorghum bicolor
  Clone ID: 9851266.pep
SSSHQIGRTSAQNPKRFEQSERRTIQLQLLNPTAMDRSRSKRGYHYDQDSPPPRSKQRFDRRSGGGGGGQNANSSYHRRGPPSGGGGSDRRAFLPPDAAPPPPPP

SEQ ID NO: 61774 - protein, 86 aa, Sorghum bicolor
  Clone ID: 9851271.pep
LNKKTKKILIFFILELQLAGLDNETSTGENCFFGCAFICDETIDTFKWVFESFIEAMGGKHPTTIITDQDAAMKAAIEQTFPEEPR

SEQ ID NO: 61775 - protein, 167 aa, Sorghum bicolor
  Clone ID: 9851285.pep
TRGCLTSSEKARNFPESVDQANEISKALPMSQNNIAPVIAQADCGVEISSGGIMQVAVAASCNGTTAKKVNVKSSKKLVRYPVVNMWLGSRQLLFTSRKPGKKAKHKRSRTVRRVVGCKDAANVSCLNEQLTSTSATARSETVECTSSRQKRSHASARSKDDTQSSK

SEQ ID NO: 61776 - protein, 144 aa, Sorghum bicolor
  Clone ID: 9851286.pep
HEGTRKYRWKEDLQADLAAGITVGVMLVPQAMSYAKLSGLHPIYGLYTGFVPLFVYAIFGSSRQLAVGPVALVSLLVSNVLGGIVNPSSELYTELAILLALMVGILECLMGLLRLGWLIRFISHSVISGFTTASAIVIGLSQIK

SEQ ID NO: 61777 - protein, 175 aa, Sorghum bicolor
  Clone ID: 9851291.pep
PLHQKVFKEAINLDEYPTLIEEAKMILKKCKGLPLAIVTIGGFLAKQPKTPIVWRKMNEHISAELEMNPELGIIRAILMKSYDGLPYHLKSCFLYMSIFPEDYSISRRRLVHRWKAEGYSSEVRGKSKGEIADAYFMELIERSMVLPSKESIGSRKGISSCKLHDLMREISISKA

SEQ ID NO: 61778 - protein, 153 aa, Sorghum bicolor
  Clone ID: 9851330.pep
HEAPLRRPQPGATVSAAPPAILVRIRSSRLPHRSLLRFTSSSKRSRLTIPHHLVLEPPEMYHAMRLRCLLLRPPMWSNSSSLGISATGVSGGSFVRRFSALGAPRPPGPARRLCRFYGSKGGVGSAEARGAAAASAAAGSSGRCFEQEHARLG

SEQ ID NO: 61779 - protein, 59 aa, Sorghum bicolor
  Clone ID: 9851347.pep
MDARSVPGPPQRPTPSAPLPAGCSCLPKTSSTSLTKSFTAVHDFRVSDYSLLEGMGFGR

SEQ ID NO: 61780 - protein, 32 aa, Sorghum bicolor
  Clone ID: 9851363.pep
SWRSAYGYGVLLDGGNQLPCREDHSTNCINIP

SEQ ID NO: 61781 - protein, 171 aa, Sorghum bicolor
  Clone ID: 9851369.pep
ARGLHEIIVLINSFQDFLAFSGTCHSWRAAVSSFPPVYAFSFPPLHLEPDGPYVPPHSKCFKSLDLSNCKWKLSDLTKKNLSLHCSVPQNTPNEMDYLGCSHGYLIFTYEEHCLLVDAYTGAKVMPPKLPCNNKLGYSGIGILTAPFSSPNSRLLLFSWVSMFEWQVGTTS

SEQ ID NO: 61782 - protein, 178 aa, Sorghum bicolor
  Clone ID: 9851375.pep
HEVHLRHRGVVVDEYLPHVRRQGREILFSNRRRRLYTNSKSRDPYSYEYKSWSYIDFDHPTTFDTLAMDGAKKRDIMDDLDTFRNSRDFYRRAGKPWKRGYLLYGPPGTGKSTMVAAMANYLDYDIYDVELTVVHTNSDLRRLLIETTSKSIIVIEDIDCTLDVTGDRASSSKPRRRE

SEQ ID NO: 61783 - protein, 126 aa, Sorghum bicolor
  Clone ID: 9851394.pep
RGFVFALIAFIQSLFLTNSHLVILYNISFLESNNCMPTHLLQLFHKGIQFTLPKVPWRLATFYINNTFWILWMWHYLTVLSHSIVLAKGGNRFKRLTSKPWLTRAQPKIALDTGAETPAWRSSSKP

SEQ ID NO: 61784 - protein, 97 aa, Sorghum bicolor
  Clone ID: 9851402.pep
EWLSAGNRTCPQTQQVLSNTIIIPNHLARSMISQWCTDNGITLPPVENQDEDLVTNNERKTFSKIFERIASASNLSEQREAIKDLRLLTKCNSSLIA

SEQ ID NO: 61785 - protein, 157 aa, Sorghum bicolor
  Clone ID: 9851562.pep
RQDSMHLRSEASKLQSLRQELAAKVQGLLKELEHQKSESQKMTAMVAERDALYQELLQARANLEFEKKAKPELTAQVQAMEKDLVAMAQEAEKLRADIAKRNTPSSFSTRGTYGASLSTPAMGLQGMYDGSYPTVGSRYGSGTGAWSSHDPHGYPHL

SEQ ID NO: 61786 - protein, 122 aa, Sorghum bicolor
  Clone ID: 9851579.pep
LCCCCCCRARVPGRVPLMPPPPRLAAAASVDASQFLKLSERSRPPCAILALLGLGLPVPPQDSLGDLSSDRAASRGLCGFGERRWLRSVVVSSLRVIPPCACCCRDSSAVAGGELEKKLKLN

SEQ ID NO: 61787 - protein, 157 aa, Sorghum bicolor
  Clone ID: 9851588.pep
MPMEAPLAKPAFAAVPMEVPPHKGMAMSVPMPVKAAPAKAGVMAMDMDLIEGHEEEGMVGAGVKVAKEKVKEMVMSGGGGWEVVGISGMGGSGKTTLAMEIFRDHKVRAYFNDRIFFETISQSANLETIKMKLWEQISGNLVLGAYNQIPEWQLKLG

SEQ ID NO: 61788 - protein, 184 aa, Sorghum bicolor
  Clone ID: 9851599.pep
TREDVYKDVQFIWDNCTKYNSKGDYIIELMKRVKKGFMKYWLAAGLYSDVPDSGGNDNTGDEDAKGHSKSKAKNKRRRPGNDRHKSDCICAVCQVTRRKKERDEILAIIDNETAAMDSNTSEQHDMEGNSGGNNLGNHDTCSSQEQPSQTYVYKETSEANDSGIRMEDAGKFSTDQTPSLLLPD

SEQ ID NO: 61789 - protein, 148 aa, Sorghum bicolor
  Clone ID: 9851634.pep
LLLAPRLLLLPSSKHLPFLLLGSSAGRRRRRRGGRAGRGGRRAGLPPPPERVSTSTPARTIGPALPARIHATARKPSVRAAATDDGSLPTRPCRGGSINRSIDQSIGRATTAARWWRRRWKRRWLRLTARVVLVGIGGGGWGRRRLGR

SEQ ID NO: 61790 - protein, 140 aa, Sorghum bicolor
  Clone ID: 9851663.pep
EKKIIIAFSIVDHIKRLFYSEQGANSRRDDPEVKSLIEEIEKMRESFESIERPTLSIESEQAKPLPVDGSKLSPSPLQAPSTPKAAHVDSPKSPMKPEQHFDSDAELATLGSELGKEDKEYSGEEISGWEFDELEEDLKS

SEQ ID NO: 61791 - protein, 152 aa, Sorghum bicolor
  unsure (1)..(152): unsure at all Xaa locations
  Clone ID: 9851672.pep
WVVRPDFTPGLSKAWLHEFQQRVAGKGMIVSWCSQQQVLAHRAVACFVSHCGWNSTMEGVRNGVPFLCWPYFCDQYLNRSYIINVWSTGLPVTPDADGIVTQEXLRSKVEQVVGDADIKDRALVFKDAARRCIAEGGSSNDNFKKLVNLLSE

SEQ ID NO: 61792 - protein, 117 aa, Sorghum bicolor
  Clone ID: 9851695.pep
SEYSAGLGFAENGTSKADSGKLGSTDGSPAGRSSSDASQDFFGQVPEFHQWSVPELPSPPTASGLHWQGGPRHGATTTTDTNTAAVSVPDISSPENPFRCYAATAAGQPPAKRRRRC

SEQ ID NO: 61793 - protein, 149 aa, Sorghum bicolor
  Clone ID: 9851721.pep
ESKQTLWNASERDKILEALRHSQTRAREADMAAKKAHNEKDDVIKLLFRQASHLFACNQWLKIMQLENIVLQLKHKEHQIAAIIPELPWLTLKEKPTHGQEQRDWTRRKGRRQKKGGGFFDTILFAVGLGLAGAGFLLGWALGWLLPKL

SEQ ID NO: 61794 - protein, 139 aa, Sorghum bicolor
  Clone ID: 9851736.pep
MSSWLRSAVSRAVEAGGRSGVARAVKGYADAVAHHAGQAVADILHDRMGTQNYKSFKKTVARLEEAAVSCHGGERIELLKRWLGALQDVDAEHGGSDLEASEAHDPSGEMDTLKAPMVLFYDADIDGAPMNFHDVFLYS

SEQ ID NO: 61795 - protein, 92 aa, Sorghum bicolor
  Clone ID: 9851742.pep
ARGCNEALFPTARAAPGWWVAELAALSPASFRKVVTALRCRRAGPEVVAAAAVAYAERVLAGVLAPAAPGRRDAVVVVARNADADADRRALL

SEQ ID NO: 61796 - protein, 44 aa, Sorghum bicolor
  Clone ID: 9851746.pep
ARGTFVNTDVDHALVVTALDASGGAVAFGGGIHLAFIPDGLADD

SEQ ID NO: 61797 - protein, 60 aa, Sorghum bicolor
  Clone ID: 9851750.pep
LKFAYKINGFKNCILCKIITDQCKMINRVLISNIFPFLKKRLEEFPRKIAGIKKIEERKR

SEQ ID NO: 61798 - protein, 129 aa, Sorghum bicolor
  Clone ID: 9851752.pep
GIDTDVNHASCRIVTESEPNQLPDGKIQDEEAEDDKKFMDEATLDHNTSDGEVTNMEVEMHVGKKSLIDYCNFTRTPTRPRSVRAHRNAACIPGETAVVETVDLVSSGQASQMVIGEPAERSLTNIASE

SEQ ID NO: 61799 - protein, 170 aa, Sorghum bicolor
  Clone ID: 9851760.pep
MEASGSRGRSGSAVPKRRRGVGAATGSGSTAQSLNDDILRSVFSRLDDHFDLARCSAVCGTWNRIIETAHLMKDLYYKRNPSVRGSSSNISVKSYFEMLAMDEHASSFSRGPAEAFQWIGHPIRATLCRMKSGSILTGVGDKILRLWSAESCKLMNEYNVPNSKTLVDFD

SEQ ID NO: 61800 - protein, 93 aa, Sorghum bicolor
  Clone ID: 9851771.pep
MKVLCSACEAAEARLLCCADEAALCARCDRDVHAANRLAGKHHRLPLIPHADVSAPNCDICQEAHAYFFCVEDRALLCRACDVAVHTANAFVS

SEQ ID NO: 61801 - protein, 44 aa, Sorghum bicolor
  Clone ID: 9851794.pep
SVLNLRLGSCYIVLCIQWMTIYFLFKTIMDPSIPNYKSCLKLKF

SEQ ID NO: 61802 - protein, 102 aa, Sorghum bicolor
  Clone ID: 9851797.pep
MAAAEARAAWQRAANRCLVQEDRKRAPKLACCPPSAEQHGTNNGNCRNSADRPICSLVPLRWNPMHSNLPPDFRWWVQSQPNFGIQKDIVSERLRSLGTDIH

SEQ ID NO: 61803 - protein, 80 aa, Sorghum bicolor
  Clone ID: 9851802.pep
ARGPRKTLPKALVSAVSMTSLGYLLPLLAATGALDVAPDSWGNGFFADAAGMIAGNWLKYWIEVGAVLSSIGLYSATLSN

SEQ ID NO: 61804 - protein, 163 aa, Sorghum bicolor
  Clone ID: 9852001.pep
YLAIHPDVVVAGPQPRPLKGAVLIHPWFWGSEAVGEETTDPAARAMGAGLWFFACPDTSGMDDPRMNPMAPAAPGLHTLACDRVLVCAAEGDFLRWRGRAYAEAVAAARGGGGGGLGDANANAGGGVELLETMGEGHVFYLFKPDCDKAKEMMDKMVAFINAP

SEQ ID NO: 61805 - protein, 88 aa, Sorghum bicolor
  unsure (1)..(88): unsure at all Xaa locations
  Clone ID: 9852003.pep
ELILREWREEWDPKPASPSSIRXIHFGKLLDDKDQLKQYHFSAEAANVVHMTVRPADIVEEEEPKGGNKSTSGGGRSREGGSGCCVIL

SEQ ID NO: 61806 - protein, 178 aa, Sorghum bicolor
  Clone ID: 9852070.pep
ARGDDDVGYSFSGGHIKGRVSFFSRSGCRDCAAVRAFFRQSGLPYVEINLDVFPEREAELASRAGAAARVPQIFLNEKLLGGLVVLNSLRNSGEFERRVRDLAGRRCPDSAPRVPVYGFDDEAGAGKGEEAAEDAMVGIVRVLRHRLPIQDRFVRVKLVKNCFSGTDMVDGIVNHLDC

SEQ ID NO: 61807 - protein, 151 aa, Sorghum bicolor
  Clone ID: 9852084.pep
MASSKPSLSLPFPIPAPDPSDEVVREFGPLLRIYKSGRIERPLVAPPVDPGHDAATGVQSKDVHLGSYSARLYLPPVAASSAKLPVVVYVHGGGFVAESAASPGYHLFLNRLAAACPALVVSVDYRLAPEHPLPAGYDDCLAALKWVLSAA

SEQ ID NO: 61808 - protein, 131 aa, Sorghum bicolor
  Clone ID: 9852086.pep
SNDLRHEPPSLPEARRSVCPCLVVFSAMADTNPADVNMSSAQPAKGSLAESKDAVPMKTLPQSSSTETDAAAASNTAKTTTSTSSSPGAIVNTTTDSATAIPATSDASDSIEPSAKGKEKQSALPPVDKNQ

SEQ ID NO: 61809 - protein, 179 aa, Sorghum bicolor
  Clone ID: 9852114.pep
ARGSAEMVSSPRYSNADQGAMFSPSHKAAILNQFQQQQQALLSPINTGVYSPKADNQQLPSHSSLLQASLGMSSPGRMSPRCVESGSPMNSHLAAALVQREKQQQTMRSLSSRDLGPSAARASALGSPLSSSWSKWGSPSGTPDWGVNGEELGKLRRSSSFELRSGGDDPDLSWVHTLV

SEQ ID NO: 61810 - protein, 89 aa, Sorghum bicolor
  Clone ID: 9852224.pep
MNHRKSPDASFASKQKLEEDLWRDLVDNPANWWDNRTDKPTPKHPDFKNKNSGQGLWLGTKSPQWARDALPSLKFKGGSKGTRKETLLS

SEQ ID NO: 61811 - protein, 70 aa, Sorghum bicolor
  Clone ID: 9852240.pep
TFPLWMHGMFSTVMVLSLKVESPCLMSVTSFHHTLLCLEILHTIVHTYHSFSLFTLLFMTILVANMPAFI

SEQ ID NO: 61812 - protein, 119 aa, Sorghum bicolor
  Clone ID: 9852244.pep
PDGRHSSLIINQKDEDEFEMSESLAVSGTPLLALPDELVATASSGSTSGHVVTSANENWLTAPKNDATRITQLWESMLSASTDSGRGGMQVGRNSALWFVGLNREWVARQKMNLQKQSN

SEQ ID NO: 61813 - protein, 158 aa, Sorghum bicolor
  Clone ID: 9852271.pep
KDRGLGSVFKRDDQRLNQLREKDARERDPNFISDSYSECYPGYQEYNNEIAGSDDEDDLSKMDMGGRAKGRLHRWDFETEEEWAKYNDQKEAMPKAAFQFGVKMQDGRKTRKQNKDQKLTNDLHKINKILARKKGEKDGAEDGGHYDDDLPSSKKQRG

SEQ ID NO: 61814 - protein, 162 aa, Sorghum bicolor
  Clone ID: 9852291.pep
YQKLCGSITAEFNDCSKQVIEIISLLSMPEFSRSDLADLLKGVQAHEKEKLHLTAKIQVLKKAGRPSERLVNHEDCRSRSMAQHVCVHVKEITEAAGTEDAEADAEYDAALKEAIQGVQEAVTSINEHMEEVRYEIDGLEADTIGSKWSEVEEAFPGTLSIK

SEQ ID NO: 61815 - protein, 98 aa, Sorghum bicolor
  Clone ID: 9852294.pep
HDDDASILDDFDFYEEREKALQENKARLHQQHLPSSIVVEPKKPLTVPTDLVSHITKSFAQAVRLGEAKTVSPLAEKVSGGDSSIPVKPVEVKQSGLS

SEQ ID NO: 61816 - protein, 200 aa, Sorghum bicolor
  unsure (1)..(200): unsure at all Xaa locations
  Clone ID: 9852298.pep
KRPAGRTKFRETRHPVFRGVRRRGNAGRWVCEVRVPGRRGCRLWLGTFDTADAAARAHDAAMLAIAGAGACLNFADSAWLLAVPASYASLAEVRHAVAEAVEEFLLREVVQEDDALSATSSTPPSSPSSSDDGSTSDGGESSESDSSPAATGASPFELDVFNDMSWDLYYASLAQGMLVEPPSRXTAFMDEGFADVPLWS

SEQ ID NO: 61817 - protein, 143 aa, Sorghum bicolor
  Clone ID: 9852299.pep
QAQQYYRLYKETIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISSNNIEIGIIRSDCEFRVLSPAEIKDFLEEVE

SEQ ID NO: 61818 - protein, 97 aa, Sorghum bicolor
  Clone ID: 9852338.pep
NEYSLKVLQIPQQLLKTFTDPTETLVGISLKMGQSHILNSNVQPKSQLPHPVYCSFEGVLTVCQYPFENSGRLHSYHAATAMLHKLCGVQELISSIQ

SEQ ID NO: 61819 - protein, 97 aa, Sorghum bicolor
  Clone ID: 9852380.pep
ISLAEFWYNTSEHSALGKSPFEVLYGHSPRHFGLTDDMVSPVSDVTKLLEERSTMLAAVRQHLLRAQQRMKHQADKRRSERSFQVGDFVYLRLHPAC

SEQ ID NO: 61820 - protein, 178 aa, Sorghum bicolor
  Clone ID: 9852392.pep
FLAEDMSARVGDFGISRIISASESIIPQNSSTTIGIRGSIGYVALEYGEGSSVTTFGDVYSLGILLLEIFTGKSPTDDMFRGSMDLHKFSEDALPDKIWEIADTTMWLHTGTYDSNTRNIIEKCLVHVISLGLSCSRKQPRERTLIQDAVNEMHAIRDSFLKFARALVVEDEAGTLSQ

SEQ ID NO: 61821 - protein, 103 aa, Sorghum bicolor
  Clone ID: 9852455.pep
ITSRRLAFFAFFAGWSIATSAETGPAFQLALSLVSCIYFLNEKMKNLVRASTTGLGVFVGGWILGSFLVPVIPAFIIPPTWSLELLTSLTAYVFMFLGCTFLK

SEQ ID NO: 61822 - protein, 133 aa, Sorghum bicolor
  Clone ID: 9852456.pep
TNYTYPDAVVPAPPPCAAAQVPSASASASAREESCSSSFSTRDDDYHPLAVTVAVAAPPAPSQSQSPSSLDLGLGLFPAMVAAQPYLFLNPMQLAPVKREAERSCYSGSSSPSPSVLGLGLDLNLPPPAEMVM

SEQ ID NO: 61823 - protein, 151 aa, Sorghum bicolor
  Clone ID: 9852470.pep
MRGSAAALLLLPWMLLHAAAASNGSCARSCGNLTVQYPFGFSPGCEIPLGCDDQANGTAWVGGARELGLLVHNVTARAVELALPQDCSRGLNASIQALFSRSYAPGSQNALVVSKCSPASPAHTTNCSDGDRYLDRWCQCNTTGEPIRCVL

SEQ ID NO: 61824 - protein, 88 aa, Sorghum bicolor
  Clone ID: 9852471.pep
MAAAAAADSDPAAAVAAMSTCAHCQREIPSSNIDLHSVHCARNLQKCQHCGEMIPRKLMDEHYDESHAPINCSLCKETIERESWDIHK

SEQ ID NO: 61825 - protein, 99 aa, Sorghum bicolor
  Clone ID: 9852496.pep
ARGESQFWKLYKEDPASCAIVMKTSVGLVYLLACLLEPFMPSFSDEVLRQLNLCPEENLSFSEEKGEIAKAKTPWDFVPAGHKIGKPAPLFKELKDEDV

SEQ ID NO: 61826 - protein, 151 aa, Sorghum bicolor
  Clone ID: 9852499.pep
MAAATAAGAAAAAAAVSLIACYLLLHKGRPNLPWVPTVGFSRASGRRARRRGLVEAIGNTPLIRINSLSDATGCEILGKAEFLNPGGSVKDRVAVKIIEEALESGDLVYGGTVTEGSAGSTAISLATVAPAYGCRCHVVIPDDAAIEKSQI

SEQ ID NO: 61827 - protein, 170 aa, Sorghum bicolor
  Clone ID: 9852544.pep
MMHHHLSRVLTRRLLLLPVPLPTAATSPYAAALSTPHRRAYARRAKPPAPPAADAGDHTASPAAPADSDAKATWQREKLPGELPRPPTIPFQPRVANAVHLVGTVCAPVHVQQLPDGRFSAVSVLVHDHGINLPKFWVPIVFKDDLAQVAASHLKENDLVSVSGKLTCDS

SEQ ID NO: 61828 - protein, 49 aa, Sorghum bicolor
  Clone ID: 9852563.pep
ILQDAYNKAEELLLLSLNEWATTLVASSSLHPVWVEVLGDPLLRRLLLR

SEQ ID NO: 61829 - protein, 162 aa, Sorghum bicolor
  Clone ID: 9852596.pep
TRVQFDKLANVNRLDEISNYTSLYTLLIVGGPANYPPSILNDVLQNTLQTVQRLRVLDVSNFGLSELPESIGDLIHLRCLQLRGTKIRRLPESVCHLYHLQTLGLRNCYYLEELPTDIKYLGKLRHIDLHLDNHQPTQLKHMPEGIGSLIGLHTLSRFVIST

SEQ ID NO: 61830 - protein, 77 aa, Sorghum bicolor
  Clone ID: 9852607.pep
GGEAMAEDQPTPAASAAEEAAMDADTGGERLSAAALVGLLRRFLAVQQRRAEAYSTLRRGFSEYMANGGELAYQKLC

SEQ ID NO: 61831 - protein, 143 aa, Sorghum bicolor
  Clone ID: 9852610.pep
HEADTLSPNSFLFGPRPEWFRSSEGTGSFPSPAASPQPSSGVPGTYGQSNFPMASGMASPHQKPFYGLGSTADSYGRGFSHGGMFPQASNYGGSFTSFGFNGRSSISIEKGRRRGRGNALICSCNGPLDFLNEQSRGPRATKP

SEQ ID NO: 61832 - protein, 171 aa, Sorghum bicolor
  Clone ID: 9852611.pep
IAIARGVIAFLVAAMVDFRHARSLLAAGVLLAGVVVAVLGAGEDDEHFVYSGFTGAPLALDGTATITASGLLELTNGTAQLKGHAVHPAPLRFQRTPGGPVRSFSASFVFGIIPPYSDLSGHGIVFFVGKDSFANALPSQYLGFLNTNNNGNASNRVFGVELDTIRSTEFK

SEQ ID NO: 61833 - protein, 42 aa, Sorghum bicolor
  unsure (1)..(42): unsure at all Xaa locations
  Clone ID: 9852629.pep
DQMNKNISEPFPNVHKTSXDXSKWFYFYGFIPAFFVVEDSFI

SEQ ID NO: 61834 - protein, 54 aa, Sorghum bicolor
  Clone ID: 9852636.pep
MSFRDQESGGEDAGRTSSASDLRKPLLNTGSWYRMPPSGGMMGSRQSSLMERLG

SEQ ID NO: 61835 - protein, 192 aa, Sorghum bicolor
  Clone ID: 9852646.pep
TRLVILVLDIFYPLSYEGLNIFWKNSMNKLKVLLLFILACDILVFMLNPGPFRVAPYIRVVFLIMTIRELRMCAVTLVGIVGTYLNVLALSLLFLLFASWLAYVTFEDTPQGKIIFTSYGTTLYQMFVLFTTSNNPDVWVPAYKSSRWNALFIVIYVLLGVYFLTNLILAVIYDSFKEQLAKQVAQMDSIRK

SEQ ID NO: 61836 - protein, 200 aa, Sorghum bicolor
  Clone ID: 9852648.pep
HEGHTRLLEIQRELSKNVQISQSPADVVLKREVIHVDSLGKKVDGSNFGNCTNEVLQVRAYGQLYIHLGINIRSGRLLLQSSKNILLPSALLESEEALNKGSLTASEVFVSLKTRSILHLFAAIGRFLGHKVYSQSQVPLKIPKSVLYGSDFTVMGFPQCTNAYYLMIQLDNDLTPVFHLLETQTDESNKSSTDSTTDAN

SEQ ID NO: 61837 - protein, 152 aa, Sorghum bicolor
  Clone ID: 9852659.pep
TRVYCKDGTCKPNERKHMMVVILLLHLNCFAQYALCGLNLGYRRPQRPVIGVALTISVAICAPAVAGLYNNLSPLGKDYEAAQPEADDEESQLQRKTPETERRYTLVPRQGHGSGSSPSSPQWVGGLLGDMWEDMSLAYLSVFCSCCVFRWN

SEQ ID NO: 61838 - protein, 139 aa, Sorghum bicolor
  Clone ID: 9852661.pep
MLTIGSSFCGSNHVQTTTGGAGTDVVVVVARARGAATDTSSATRSRSCTTRNEHPCPGAAAAAAAAHRSGKRKQSVDATDAEDVEFESADVTCEPAHKTATAKRRRAAEVHNLSERRRRDRINEKMKALQELIPHCNKT

SEQ ID NO: 61839 - protein, 133 aa, Sorghum bicolor
  Clone ID: 9852667.pep
VNVTSMMTQTLQGKVMAYTPSSFPVQQQILPEDIEMLQLDNMNQNTSPIRAIIIEKIEACLRNMEEFCDLCPDSCLKASRIIDNMLYKNAPQLHFYLDLETVEGRVNDLLRSFPYRKQRDPCISSAVPSTKDL

SEQ ID NO: 61840 - protein, 183 aa, Sorghum bicolor
  unsure (1)..(183): unsure at all Xaa locations
  Clone ID: 9852690.pep
ARGLSGTIPGALGSISGLEQLCLAHNNLSGPIPTVLQNLTSLFKLDLSFNNLQGEVPKEGIFRNFANLSITGNNQLCGGIPQLNLVPCKTDSAKKKRRRKLKYLRIALATTFALLLLAVVVALVRLIYRKQTRRQKGAFGPPMDEEQYERVSFHALSNGTNGFSXANLLGKGSFGTVYKCAFQ

SEQ ID NO: 61841 - protein, 160 aa, Sorghum bicolor
  Clone ID: 9852716.pep
ARGTQHSTAQHGNFYCLSRPAASSSVFLLRCASPPPNSKPQSRRNPLPAREISSRFSAHGSLNSSSSCSLARSLTSTQLLAWPAGLLLLQSIHGGWSARSSAPSFRSLLGGCTDLPPKVPLSSRRIEFFLKFRVFVPPGAAPSGPGSSRPRQQTRQRSEA

SEQ ID NO: 61842 - protein, 160 aa, Sorghum bicolor
  Clone ID: 9852721.pep
HEDRRTGTSHLRRCREYSLKRGATSDLTPRKSADRGIPPRRRLLSSGAFLSPRRYSSSSSPAPFSPSGGLAGAAEAAQQDLTVCSIQRPSAPSGQIRLFACAGDAAAAADRAAVASDKGEAARQAEEQRRRMGCVTSDGRRSSGGGRRRPQSRERGHLRP

SEQ ID NO: 61843 - protein, 61 aa, Sorghum bicolor
  Clone ID: 9852729.pep
TFALNTAYVLIHIQLAKTLFYELNKKSNTLARKNSSSQKNSTFMAKKNPWTLALPARGFFL

SEQ ID NO: 61844 - protein, 72 aa, Sorghum bicolor
  Clone ID: 9852747.pep
KWGRKYLQDGTVDWSSQETTSTDLAVHHIYLAAPAEADTVEFEESTVMAGSSCRSTNRQIPRYQSPNRQHMG

SEQ ID NO: 61845 - protein, 180 aa, Sorghum bicolor
  Clone ID: 9852770.pep
NSSVVPMVQGPPPQMTASVPVSFPDHSTTFHNVNPTLPPPPVLNHLPPAIPSGTMNAPASSSQAISFPSGPARGLNYYQSLIHQHGGERQEPLQQHGRQFAMHHQPVASQASATDIVSSGTMAARDNKQRPTKPCAYFNSARGCRNGANCTFLHDMSAARKEQPKGSKRIKLDSRIAGRY

SEQ ID NO: 61846 - protein, 137 aa, Sorghum bicolor
  Clone ID: 9852782.pep
ADEGSVFLEAMVLQELEDVVFQLTKRTRVCFRDAFFRLAESSRAKCSAATANGTTPSSQTGAQQAADQGNASSRMSTPCCPERETNAIDRTVADLTMKLPRSVPLDEVRRCPDDDDSAAEAQSATTSTWTTTTTAAA

SEQ ID NO: 61847 - protein, 175 aa, Sorghum bicolor
  Clone ID: 9852789.pep
TSDAYQATGCYNLLCSGFIQISNQIAMGASIFPISNYGGSQYDINILVWKDPKEGNWWLQFGNDYVLGYWPSFLFSYLADSASMIEWGGEVVNSEPDGSHTTTQMGSGHFPEEGFGKASYFRNIQVVDSTNNLKAPKGVGTFTEQSNCYDVQNGNNGDWGTYFYYGGPGKNSNCP

SEQ ID NO: 61848 - protein, 98 aa, Sorghum bicolor
  Clone ID: 9852790.pep
GTHSLKPQVQAGRQLNQANKRPSLLLSYQNLETSITLSSHLGRRAINYAPREKCLLWSRHLLRLSMHGPSLVHMRNTRSTTAISGAAPSTVVPLGGWT

SEQ ID NO: 61849 - protein, 143 aa, Sorghum bicolor
  Clone ID: 9852831.pep
HGADPTTTRIVGTLGYMAPELTVTARATKATDVFAFGALLLEVVCGRRPIDPVSGVNLLRWVRDLGARGDLVRAVDERLNGRYDMEEAKLLLWLGLMCSQTRPEARPSIRQVCQYLDGEMEMQEAAVLVFSDVVSSFDFGSLP

SEQ ID NO: 61850 - protein, 99 aa, Sorghum bicolor
  Clone ID: 9852844.pep
SAAAACIPHVVHTTVDPMENIIHSSGGIIYIIGSILIIYSMLIIQMLTHTHFSVHLMCCYTLYVQRSTVSLTRLLLGWEWELIIIQSVLFNLWLSGLLP

SEQ ID NO: 61851 - protein, 150 aa, Sorghum bicolor
  Clone ID: 9852854.pep
PKRHAVFLAHACKAEGSKGCRIVSHGCQSEERQPGVRPQARNTLARGSEQGREPRARDRHPRPPRAGHSLHRPAGWPAAATCVPSLHAATDDESSWESRGIFLPSRSREHTRTPVTFVLYYCTAATTRNPTSSAPLPYVWSSSAYLRTLR

SEQ ID NO: 61852 - protein, 71 aa, Sorghum bicolor
  Clone ID: 9852859.pep
PRCGHPFHARCVDTWFRFHTTCPLCRATVLADAAPPEEPAPAQTANQPPPQQIQHRTDTTNSTDAHTDSPV

SEQ ID NO: 61853 - protein, 68 aa, Sorghum bicolor
  Clone ID: 9852887.pep
RLKQTNGFSNAKCISFSFTCSLAQLPGWPHAVRRACTLAEGVEWSGGGIISLCFCFHKFFMGGTDEMI

SEQ ID NO: 61854 - protein, 131 aa, Sorghum bicolor
  Clone ID: 9852913.pep
LLTRKKPFNLDAPEDEKSLALRFIYVTKEGRLEEILDDQIKNDENMEFLEEIAELAKQCLEISGVNRPSMREVSERLDRLRKVMQHPWEQQQNPEEMELLLGESSLASSEIVNSGILSIEKKAARNLESGR

SEQ ID NO: 61855 - protein, 114 aa, Sorghum bicolor
  Clone ID: 9852925.pep
WIGATWLIDSENLDWIICPAVRASRHLVIRRGGRLARNREMGKTTGCISPSIFRSPIPKSSLSLSLFTPHLIHQDLNPSLSLRLLFAVARIMVVLLLLSTLGMGKFITQAGIFR

SEQ ID NO: 61856 - protein, 150 aa, Sorghum bicolor
  Clone ID: 9852950.pep
RVIAPILTFLFYCVVIPLSVMVPEVSIPVWGMFYIPTAITVMNAIRNPWSIHLVPIWILFENVMSMHRMRAALTGLLETMYVDEWVVTEKVGDHVKGKLEIPLLTPVKPTECVERIYVPELLVAFYLLLCASYDVVLGTGHCYLYIFLQA

SEQ ID NO: 61857 - protein, 133 aa, Sorghum bicolor
  Clone ID: 9852955.pep
AYDRAAFRLRGSKAILNFPNEVAFGAAARWAAAPAAAPQPSVTVAGNKRGRARSPQEQDAGCLLVREVKKERVQEPAAAAAGCGWDGKDTAASGGGADYFWEDESLKGAICSLPPLSPLSPHPHLAVPQLSVS

SEQ ID NO: 61858 - protein, 64 aa, Sorghum bicolor
  Clone ID: 9852958.pep
LALYLVLLIVLINCQSGEEPSLDDDDMTPRIHIPVYLDVDSCIYIYIYIYIYIYIYIYIYAHAT

SEQ ID NO: 61859 - protein, 197 aa, Sorghum bicolor
  Clone ID: 9852987.pep
PEANAKAMESVRADKLREVKAGHDGTWVAHPALASIASEVFNEHMPTANQIFIRPEVDVKRDDLLNPVVPGKITDDGVRKNLHITLAYMEGWLRGVGCSAINYLMEDAATAEVSRTQLWQWVRHGVSTAEGTKLDKTTMLSILDDVTNELIKSAPASNKFELAAKYLRPQVTGEDYADFVTTLLYDEITSIGPSWKL

SEQ ID NO: 61860 - protein, 148 aa, Sorghum bicolor
  Clone ID: 9853011.pep
MQRTGSSMAARCSGGCDGREDGAVEALVQWQKVSDFLIGASYMSIPLELLHFATCADLAPLRWVLLQFGAFIVLCGLVHLAAVFTYARPDSRRLLVAITAAKALAAVAASVAAVSLPTFIPQLLRLKTREALLRDKARQLDRDVALVM

SEQ ID NO: 61861 - protein, 107 aa, Sorghum bicolor
  Clone ID: 9853020.pep
LAAIDFIVCDESDVFVTNNNGNMAKVLAGRRRYMGHKRTIRPNAKKLNVLFQTRNQLGWDTFSRKVQKVQRGLMGEPDDIRPKQDDFHEFPSSCICLRKPRNISVTT

SEQ ID NO: 61862 - protein, 199 aa, Sorghum bicolor
  unsure (1)..(199): unsure at all Xaa locations
  Clone ID: 9853053.pep
LFRKMAKDVLFAKDISLVKKIHMLYSFFSVRRVVAPTAACILFNVIIPISVTVPELYLPVWGVAYIPMVLTIVTVIRHPKNLHIMPFWILFESVMTLHRMRAAVTGLLELEGFNQWTVTKKVGNDLEDTEVPLLQKTRKRLRDRVNFLEIGFSXVFLFLCASYNLVFHGTRSYYLYMYLQGLAFLLLGLNFTGTCSCCQ

SEQ ID NO: 61863 - protein, 96 aa, Sorghum bicolor
  Clone ID: 9853066.pep
IQSRQETSTIQVCEESSELCCTASKHMEDDNVDKACVSDTDPIPVTENIVELDDEGVDIPTVRDTEWDNPHSSEVSDVREVTTEPEENSLDIPVDT

SEQ ID NO: 61864 - protein, 143 aa, Sorghum bicolor
  Clone ID: 9853073.pep
QGGSSQHAVIQIEQPGEEETSPLVSAASTNNAALDEEHRQSSSSEPLDFEMFESTRGIKLGLGDFVFYSVLVGRAAMYDLMTVYACYLAIIAGLGCTLILLSICQHALPALPISIMLGVTFYFLTRLLMEPFVVGASTNLVMF

SEQ ID NO: 61865 - protein, 99 aa, Sorghum bicolor
  Clone ID: 9853075.pep
ENRPLMVGEDLTEGEAHVLEEYGWVRNTGLGTMVNYRDRVVHDRWTEKCVADWRAKIGKLLMVGYAEGQSVTTHGPKKIVDLLEATGDAELEIKLEDPY

SEQ ID NO: 61866 - protein, 154 aa, Sorghum bicolor
  Clone ID: 9853076.pep
FREDGRSTALRLVDMEAAYVTVEFFRKLPQDPADPSSKVGPNKPPVEPSPTPDRYGDGHFRNIASNVSQYIRMVGDELLQKIPKAAVHCQVREAKRSLLNHFYVQIGKKEGGEFGHMLDEDPAMMERRQQCLKRLELYKSARDEVDSVAWSSSR

SEQ ID NO: 61867 - protein, 173 aa, Sorghum bicolor
  Clone ID: 9853079.pep
SLVSNYSAAIRSLYALGARRLAVVNVGLAGCLPVARLLDATGACAEDRNRLAAGFNAALRSLLADDLAASSSSGLPGLAYSLADSLGLMADTFADPRASGFVDVADACCGGGRLGAEATCAPNATLCADRGQYYFWDNVHPTERAAALRAHAFYDGPAQYTTPINFKQLVHMS

SEQ ID NO: 61868 - protein, 63 aa, Sorghum bicolor
  Clone ID: 9853082.pep
RAGNQRGAHDHGGERRYQGRVGAGTVQRPHAMTTTTTVQRHAHTYMAKLFPLFCSNFSITFIV

SEQ ID NO: 61869 - protein, 157 aa, Sorghum bicolor
  Clone ID: 9853097.pep
AHAPAELELSWVVIDPSSGRAVNVSSRRPVAVDRHWYTGDTLVRYAVVLGGCKFEATVTCSQETGHVREISLTVEDADGAAVSGEGTLRLLAAAMAGPRKGAEEEQVETAKRRYEDFVRSKRGRKESKARKEVLVDLCCSAVSAVAVLSFIATVVLR

SEQ ID NO: 61870 - protein, 76 aa, Sorghum bicolor
  Clone ID: 9853106.pep
FVSLRGHHQTCCKWALRPMTSEIEPSSSRLGSVRTEEAPLASWLLVGPSHRCLIDALLLCLIQCAALKLQLDRLKY

SEQ ID NO: 61871 - protein, 88 aa, Sorghum bicolor
  Clone ID: 9853116.pep
ARGALLLGVMELEWWVVGETCRCSRHANCNRVTTPIAGQQAFRCECPEGYDGDGFADGTGCRRARAIRNGLYHGLGYALSTGRNHIVV

SEQ ID NO: 61872 - protein, 128 aa, Sorghum bicolor
  Clone ID: 9853124.pep
MDQQEESCVPPGFRFHPTEEELVGYYLARKVASQKIDLDIIQEVDLYRIEPWDLQERCRQHAGGGHDEQTTEWYFFSYKDRKYPSGTRTNRATAAGFWKATGRDKPVLSSSCTRTSRCGGGSRVVIGM

SEQ ID NO: 61873 - protein, 53 aa, Sorghum bicolor
  Clone ID: 9853130.pep
SFTAFMGRHVWPDVKSEQDDILDEQARLLFTTELAASIVIMRDEEQKLWTREN

SEQ ID NO: 61874 - protein, 103 aa, Sorghum bicolor
  Clone ID: 9853133.pep
VYHTYIASFEGRPIHHLRSLTLDSPSLVPSFRLAGGFSSGFRVRGELASAMKRKSPWSLLQLLCCAAMVVALLLSQQGSQVAISVPLSVIYIGTSCRSARGLV

SEQ ID NO: 61875 - protein, 123 aa, Sorghum bicolor
  Clone ID: 9853135.pep
SSSLAREHAPRSPPPPGATWPPCAEKSVGKEPALLLGDDDAAAAPASSCSSSSSAAAAPATDSDGARLTSKPRVVDASKCPAERESPFQRSISPRAGGKYRREGTNPGSTKIRRRRCMRVSLV

SEQ ID NO: 61876 - protein, 91 aa, Sorghum bicolor
  Clone ID: 9853140.pep
MDEAMSPSPRAGGGAGGIHWEAHGRLLTACLVALNVFLVLLVYVYFWRFFSRSRSRGGGGEDDDDDASSVASSPPASPKARDRREVELAIT

SEQ ID NO: 61877 - protein, 101 aa, Sorghum bicolor
  Clone ID: 9853147.pep
ARGAPAASAPLGKGKGRVAELEQELHEYQYNMGLLLIEKKEWTAKSKEITEVLTQKEEILKREQAAHLNAISKYERREENMRKALGVEKQCVADLEKALRD

SEQ ID NO: 61878 - protein, 105 aa, Sorghum bicolor
  Clone ID: 9853174.pep
HHRGEGAPHRGARGLAGAVDQPLVPPPLLQLLLLLLPPLEHPQGQREPDAARAPLHARRPPAGAARVLPRRELLDPPQELLIVPAVAPDAVDARAESAPDRVPRA

SEQ ID NO: 61879 - protein, 40 aa, Sorghum bicolor
  Clone ID: 9853175.pep
TRLDQMVNLIVEKLQSWGIDRKVTAVVLDNCNGGEIVARE

SEQ ID NO: 61880 - protein, 98 aa, Sorghum bicolor
  Clone ID: 9853196.pep
ARGRDWPRHADPCAAWAGVGCRAGRVVSLNLVGLRRTRLGRLSPRFDVDGLRNLTRLEAFNAAGFGLPGSIPAWLGAGLAPTFQSLDISDCAVSGNIP

SEQ ID NO: 61881 - protein, 156 aa, Sorghum bicolor
  Clone ID: 9853201.pep
MMTKYSPARLLSIRSLLLCLPAVWVLAATAGVPPAHRPASCQSRCGEVDIPYPFGVGDDCAINDGFNLSCSLVNGTERPFSGPFEVTKISMADAKAWIKMNISWWCYDSDTSQMRQGTWGGNFTNSAFRFSHEDNKIFVIGCNTLAYITSEYYSIG

SEQ ID NO: 61882 - protein, 78 aa, Sorghum bicolor
  Clone ID: 9853202.pep
PLLRSGGHRLATGGGDKRRRLRTSGGGGRGEGRCGVAEPAAICGRRRASGDADLRGGAHDSSPHGDGDLAFPLGGPRA

SEQ ID NO: 61883 - protein, 101 aa, Sorghum bicolor
  Clone ID: 9853214.pep
ARGSCLRLPATTHTYDWTAHPALLLHPIHAFILPHPRPLLPPSRRLRPHSRPTSPPCIFPALQRRATTTTNIATTIHHSRCHSNPPKPPTPVPALEITSDS

SEQ ID NO: 61884 - protein, 189 aa, Sorghum bicolor
  Clone ID: 9853221.pep
ARGSTQSSPAAAEMSDSNEFAELLWENGQAVVHGRRKQTQAAFPPFTCGAASSSRAQEKQPGTDPVALLKTGLFGDFSSGLDATRDNVDLDDTVPWINYPIVEEDTAAPALAESYSPDFFSELHAAAVAAAATNLSALPPPVQHTGNNNNRSTPVATTSRGPEPAKETHRIPIAGPATRPEPQAEFAAT

SEQ ID NO: 61885 - protein, 192 aa, Sorghum bicolor
  Clone ID: 9853241.pep
ARGAGALKKGMEQGYAQECDFVAIFDADFQPDPDFLLRTIPFLVHNPKIALVQTRWEFVNYNICLLTRIQKMSLDYHFKVEQESGSSMHAFFGFNGTAGVWRVSAIREAGGWKDRTTVEDMDLAVRASLKGWQFLYVGDIRVKSELPSTFKAYRHQQHRWTCGAANLFRKMAGDIVRSKGVTVWKKLHLLYS

SEQ ID NO: 61886 - protein, 126 aa, Sorghum bicolor
  Clone ID: 9853247.pep
MALLREHLDLIRAHLLDDHHVAVTVSSDDSASLQSSSPSPSQSPPGRSRPLPALSVSLPPRPPAVDLQQQHLWAPAPPPMQIHRQEQQHYCYPPEPEEEEDDFRRYRGVRQGPWGKYAAEIRDPAR

SEQ ID NO: 61887 - protein, 111 aa, Sorghum bicolor
  Clone ID: 9853250.pep
YRQQQKLCMEQEEVGLALGLSLGSGHHQQLKEQPPPSSHPCALLEPTLSLSSLPAKDGLTTTPMRRIAAVKRELHVEEDDEATDRALIYSVASSAVVTADDDEGCNSRKKL

SEQ ID NO: 61888 - protein, 158 aa, Sorghum bicolor
  unsure (1)..(158): unsure at all Xaa locations
  Clone ID: 9853252.pep
TRNEEEAVSKYLHSVPPKYIQIALSIETMLDLSIXLEDVTGRLRAVDERMEQATATTDSGKLLLTEEEWAARMKEKKSGEASSSRGGDGKRRGKASSEKKKKKIDPNACRRCGKTGHWAKECPNRKQEKKAEAHLAQADDDDEATLMMATFCALHDVE

SEQ ID NO: 61889 - protein, 106 aa, Sorghum bicolor
  Clone ID: 9853264.pep
MNSMDEINLLRQAQRQHQHHLMVRGIGEEIDLEIGPGDDPSFSGASLVAVTSTHDAVVHADDHKSLLIPCSQTGAADGLAPQQQHLAQGEEEHDGMLRQPSGHTKK

SEQ ID NO: 61890 - protein, 172 aa, Sorghum bicolor
  Clone ID: 9853277.pep
MSQSRSILDSIAILGAGNEASRRILTQDAVKFLAILHRSFEPTRKHLLKLREQRQIETDKGRLPDFLPETQHIRDDEKWKGAAPAPGLVDRRVEITGPTDRKMVVNALNSDVWAYMADFEDSNGPTWDNMIHGQANLYDAIRRQVDFRLGEKEYKLRTDRALPTLIARTRGW

SEQ ID NO: 61891 - protein, 112 aa, Sorghum bicolor
  Clone ID: 9853295.pep
ARGRRHEAEWLAWFLVPAPLPRSSSWSSPLPTRSAPLRTSCLLSLLSHPVPDMHGGEGHFTVFRQKAVLSNDPTARLEATTHFRKLLSSVVPLFVKLLNSHIKNFQKQAIWL

SEQ ID NO: 61892 - protein, 87 aa, Sorghum bicolor
  Clone ID: 9853296.pep
NWLTDLSSDDERQDVAGIHVRVEMPAWGAHEPHPALPAGLWSGITLCHLPIRRRRILPRRWQIQSAVIVHRCSSSVLQRPADPALLV

SEQ ID NO: 61893 - protein, 105 aa, Sorghum bicolor
  Clone ID: 9853298.pep
LLICVNMSSSCLGVVYEDQTESLPSSGGRPGEILQLLRLPYSESGANSQAQVAEPLLVEQTGKKREGRRGGAVAGEKRRGWCALGSGHGQAGGGGPGSGMFPPRA

SEQ ID NO: 61894 - protein, 102 aa, Sorghum bicolor
  Clone ID: 9853303.pep
PMSETYCSWVQPQHARRLLYVFFPVSEYNLLMVLGKVHDLNIYNKAKLITCKLTFSITYCGRPVYWFSTETAAKVLTCLDLKFIWLFVSYGICMMLFWVKTN

SEQ ID NO: 61895 - protein, 135 aa, Sorghum bicolor
  Clone ID: 9853305.pep
MGRKPDAAAKSYYSGGGGAGASSPRAARKAPPSPVFLGTALFVLGFVSLFTGHVVTDADWARIRSRWRSKQHRNYEPIDIWESKYSSMYYGCSGRSADFRSAVPENSSTGYLLIATSGGLNQQRIGITDAVVVAW

SEQ ID NO: 61896 - protein, 177 aa, Sorghum bicolor
  Clone ID: 9853309.pep
HEGDLASLEGKKFEGVLEEFASHAFSLRCFLECLQSGGVSANEITDNAGEAKTPRSSVHDIDNAADHLAKVNIEGVADNNHNEVSEHNQCVGDLDSSDGNILSPALAIPEHAESMAKNDEENDSTVQLDVSTESRVLKNKRKYKVDILRCESLTSLAPATLERLFLRDYDIIGSMVP

SEQ ID NO: 61897 - protein, 186 aa, Sorghum bicolor
  Clone ID: 9853314.pep
TRNRFTGKLPPDLGKYSGLLIVEADYNELTGAIPEGLCTGGKFRFLTAKSNKLNGSIPAGLANCTALKSLALDNNQLSGDVPEALWTAPLLNFVTLRSNQLSGSLPVTMPSNLTTLAMENNKFGGSVPATAVALKKFTADNNQFSGPIPASIGDGMLQLQTLNLSGNLLSGDIPTSVTKLSQLTQM

SEQ ID NO: 61898 - protein, 172 aa, Sorghum bicolor
  Clone ID: 9853334.pep
HEEWPKDRIMVQVLDDSTDPFIKNLVELECEHWANKGVNIKYATRTSRKGFKAGALKKGMECDYARQSEYIAIFDADFQPEPDFLLRTVPFLLHNPEVALVQARWSFVNGTTSLLTRVQKMFYDYHFKVEQEAGSATFAFFSFNGTAGVWRTIAIRDAGGWKDRTTVEDMDL

SEQ ID NO: 61899 - protein, 189 aa, Sorghum bicolor
  unsure (1)..(189): unsure at all Xaa locations
  Clone ID: 9853345.pep
MASNGSSSTVVDEMQSSLDRVRRQLSSTSTRHLLQGPLLKRSDTLRKWNERWVILDPTTGKIEYKVRRSDKDVRGVIMFDSTSTVTLSPMNFHGLAKYDGCCFYIGTPQKKEYFLCAETPSAARAWXTQLVLQAHKEAVNSLXENGPAKLGTVATVVAVANATAIEATKEVEAAMKISLRAALGSTTNK

SEQ ID NO: 61900 - protein, 109 aa, Sorghum bicolor
  Clone ID: 9853350.pep
NRASPSLCRDAGPYWLAGGASGRRRTTSSQLGSRGSAAVAATQGHPSSSPVSCCSGAQPPVYCSVYSPTNLNLVSECFMIIVLFISNWINNSVKKHMNNSPTLTMLQTW

SEQ ID NO: 61901 - protein, 158 aa, Sorghum bicolor
  Clone ID: 9853353.pep
MKLKNYMRFSAFFVIFSMGGAILTAVLRRLAAPLDAPTALLLLFNGAAVGVLSVFASAVPILVRQGYMVALAVIVAAWLSRLPEWTTWIMLVALAVYDLVAVLAPRGPLRMLVELASSRDDELPALVYESRPTVGPATSSSSYASAMGSVEMQTMTDS

SEQ ID NO: 61902 - protein, 181 aa, Sorghum bicolor
  unsure (1)..(181): unsure at all Xaa locations
  Clone ID: 9853356.pep
ARGSDFALVRQEIADETDRLTGKTKQISPVPIHLSIYSPKVVNLTLIDLPGLTKVAVEGQSENIVQDIENMVRSYVDKPNCIILAISPANQDIATSDAIKLSKEVDPTGERTFGVLTKLDLMDKGTNALDVLEGRAYRLQNPWVGIVNRSQADINRKVGMLSAREKEXEYFETSPDYAHLA

SEQ ID NO: 61903 - protein, 173 aa, Sorghum bicolor
  Clone ID: 9853358.pep
MVERFVLCLIIVLSMEVALSAAAGVFESKPPPAMYVFGDSTLDVGNNNYLPGTNVPRANRPYYGVDFPGGVPTGRFSNGYNTADFIAKCIGFVSSPPPYLSLVAPPASSGGLLVPTALTIGVSYASGGAGILDSTNAGSTIPLSKQVQYFNATRSKMIAAAAGSSDALINKSI

SEQ ID NO: 61904 - protein, 136 aa, Sorghum bicolor
  Clone ID: 9853363.pep
MMMAQPEPEGGQQQQQQRRNAGGGGRGDEAWRRWAMLVATVWIQALTGTNFDFSAYSSALKSSLGISQEALNYLATASDMGKALGWSSGLALLYMPLHAVLMLSAAMGLAAYAVQYLCLVASVAVPYPLVFLVCLI

SEQ ID NO: 61905 - protein, 163 aa, Sorghum bicolor
  Clone ID: 9853371.pep
MVAQNMARRSTTVEDLPADVLACALRRLDGPSLAAASCATAGLRALAADPETWRALCHARWPSLAARPDLLLSSSSAVSPQRLFADAFPFPCDASSAELLPVPVTSELVSAVDVYHRGEPLLSRVVETSTSSSWFLTSPFCVDAVECKSHAAVAVPAHAPAEL

SEQ ID NO: 61906 - protein, 91 aa, Sorghum bicolor
  Clone ID: 9853407.pep
LLQTHGGDGGEGLWEALAELWCELIVSMAPHGSIVAHQKELGKGGEFITHIWTLLYHAGIDDKFSGSSATAAAATDAPPSRDDNYGRNIPC

SEQ ID NO: 61907 - protein, 100 aa, Sorghum bicolor
  Clone ID: 9853434.pep
GRVILKRSRILFMDEATASVDSQTDAAIQKIIREEFTECTIISIAHRIPTVMDSDRVLVLDSGLVAEFDAPSKLMGRPSLFGAMVQEYASRSSSLKETVG

SEQ ID NO: 61908 - protein, 178 aa, Sorghum bicolor
  Clone ID: 9853445.pep
RNEKLLPETTTNNGSGTSSSHGVLVASLSPWYYERLKDEYNGRLAGGVHQPSHEGRQRWRDEAHDVKALSEMYLLSMCDVLVTSGFSTFGYVAQGLGGLQPWVMSRPSPFEEWTEGQAAPEPPCQRALSVEPCFHSPSYYNCTVRRDVDLDKVTPYIRRCVDVSWGIKLVNQSSDHQW

SEQ ID NO: 61909 - protein, 153 aa, Sorghum bicolor
  Clone ID: 9853447.pep
WDAAQRTSFNFLFHDCTTLQPLDVELDPVDDVHELLGRKARRVNGKDGVVFVLRSLPENGRKLFQLLVIEVLSAMDDGDQQLGAENPGVEYRMVYNKAVEDFICSSEMAFRTLLKEFHDHQIITSRKDAFGTELLTIPFRREELEAILEELMS

SEQ ID NO: 61910 - protein, 76 aa, Sorghum bicolor
  Clone ID: 9853455.pep
TTMMHTSQDAKDKEINILQKGLLLGQAVQSSTLLTWELSSLIVYPFLVYNWEPYALLPSLMLGFWGCQVFVLSRLT

SEQ ID NO: 61911 - protein, 142 aa, Sorghum bicolor
  Clone ID: 9853458.pep
SSKLLSVGKYARAVPADTRYMDPVYMKTNRFVAKSDVYSFSIVLLELITRKTVDYGQDKINSLPIVFDKFFKQKGNGREMYDRNILSHDGVQCQYCIECLDKIGALAIQCLKYDVDERPTMKEVVNELTKAAKLLDKCKQIP

SEQ ID NO: 61912 - protein, 168 aa, Sorghum bicolor
  unsure (1)..(168): unsure at all Xaa locations
  Clone ID: 9853462.pep
IPPAPRGVPQIEVXFELDANGILKVSAHDKGIGKQESITITNDKGRLTQEEIDRMVAEAEKYAEEDKATRERIEARNGLENYAFSLKNQVNDDEGLGGKIDDEDKETILEAVKETTDWLEENSATATSEDFEEQKEKLSNVAYPITSKMYQGAGGAGGEDEPPSHDEL

SEQ ID NO: 61913 - protein, 118 aa, Sorghum bicolor
  Clone ID: 9853470.pep
ADLCPLLAITLILNGIQPVLSGVAVGCGWQQFVAYVNIGCYYIVGVPLGAILGFVFKLGVKGIWGGMIGGTCMQTAILLWVTLRTDWNKEVEEAQKRLHKWEDKKTTEPLLAGVGNGN

SEQ ID NO: 61914 - protein, 134 aa, Sorghum bicolor
  Clone ID: 9853485.pep
LFPGKDYVHQLLLITELVGSPDDTSLGFLRSDHARRYVRSLPQHPKQQFRVRFPTMSSGAMDLLERMLVFDPSKRITVDEALCHPYLASLHEINDEPVCPAPFSFDFEQPSLTEEDIKELIWRESLKFNPDPIH

SEQ ID NO: 61915 - protein, 106 aa, Sorghum bicolor
  Clone ID: 9853503.pep
SNLARNWSSGGQPGGPGLHQLANHRTAAPIFSKGHKCVTFGNNLQRANNRLTVCTEANKHDCNPVRLHMFEQQTLFSPGSSKDTGNHKPGSLRKEWIYNMTGINTR

SEQ ID NO: 61916 - protein, 166 aa, Sorghum bicolor
  Clone ID: 9853507.pep
NIKESIVSMAGARGTIGFIAPEVFSRSFGVVSTKSDIYSFGMVLLEMVGGRRNVQVNANNSSQVYFPEWLHDHLSNGGTLETFEVTSTTEEVATKMALIGLWCIQMMPESRPSITKVIDMLERSVTEIEIPPMQFFSCTSEPSIHSINTTSAEDTQNLSFLSHVNK

SEQ ID NO: 61917 - protein, 55 aa, Sorghum bicolor
  Clone ID: 9853573.pep
IIWIISYWQIPRIPVCLAGFTSTIFVDYNHRLVCSMCCLLTVDYKNNLILYLVVS

SEQ ID NO: 61918 - protein, 62 aa, Sorghum bicolor
  Clone ID: 9853581.pep
LPLKLPSVNLVHPNIYRGSGDFIPAVQKGNNRGIFCYPKSFSSPFIRSIDSQIFNYSHNVFH

SEQ ID NO: 61919 - protein, 95 aa, Sorghum bicolor
  Clone ID: 9853592.pep
LKVRKKTKRKKTQPALLRHPACKQTTPFEGQGKQRQRGYIIIIQAQGTKPMMGGGVLRDILRCCCCFSFPLTEGRRVYGTVHTRKGELCRIRRSY

SEQ ID NO: 61920 - protein, 89 aa, Sorghum bicolor
  Clone ID: 9853666.pep
VLVWLVRIMWMNIRCDTGCVGALSSASVFIRMENTPGVPPSLQYPGVRMDGFNSYIVNTEDGFRWTKKGVLSFVVYSFNVLRIRICRKT

SEQ ID NO: 61921 - protein, 113 aa, Sorghum bicolor
  Clone ID: 9853676.pep
LNNLVHHFFIGLNNLLKAYEDKSAFAMCIFSLALGPGEEPITFVGKTAGKIVPARGPNDFGWDPVFQPDGFEQTYAEMPKSVKNEISHRGKALALVKEHFASASYTVQSDNSA

SEQ ID NO: 61922 - protein, 98 aa, Sorghum bicolor
  Clone ID: 9853698.pep
TLYFVFVFDSSENELAMLDLIQVFVETLDKCFKNVCELDIVFNFNKLHTILDEMILGGQVIETSSEQIMKSVEEIERLEKQSSTTSFIPKSITERFTR

SEQ ID NO: 61923 - protein, 125 aa, Sorghum bicolor
  Clone ID: 9853720.pep
NRVQFGGDEVVKAKDGAGSATLSMAYAGFRFAEKVLKAVKGEKGLVEPSYVYLPGVPGGKEIAEKTGVDFFSVPIELGPNGAEKAIDILGNITEKEKKLLEAAVAGLKGNIKKGVDFAHNPPQKL

SEQ ID NO: 61924 - protein, 155 aa, Sorghum bicolor
  Clone ID: 9853739.pep
MTSASELFTARRGARGGRLSDPDPDPDPDPHADALRDQHGIGGRRRRRGCRPRRQLDAAGDVRQHLHTGAPPPRRRGSYTDQILSYIDNNNIGDSAARRNRLDRLMFRTNERLPGAVLQAQARVLERLRGVSLGSSASRPSISLDEFSASDVFRI

SEQ ID NO: 61925 - protein, 58 aa, Sorghum bicolor
  Clone ID: 9853740.pep
AAPGGVGAAAAGGHWNGWMPAPVHGNTLTLAEIGVWGLEGSEGGERERGTKLWIVPRA

SEQ ID NO: 61926 - protein, 174 aa, Sorghum bicolor
  Clone ID: 9853744.pep
TRASRNLLSYLESDRSNVGTFLGSLDNNFITNPLEYNNNSGELSNIGHASESDDGRVIMGIRHSSRPHFGVQFHPESVATHHGRQIFRNFKKMTGDFGLCSSWLQERKVNSARHRDSIPKDLLRTKRMELSEPVGSCVLGKRGTGKKCLRLRWKKIENFLCPTVGSEDIFAVLF

SEQ ID NO: 61927 - protein, 152 aa, Sorghum bicolor
  Clone ID: 9853745.pep
ARGQPLLHAYEARKEDPAACDGEAHGFGPAEPDGGASFVRTCFNGLNGLSGVGLLSIPYALSEGGWLSLALLLVVAAVCCYTGLLLQRCMDASPAVRGYPDIGALAFGRGGRLAASAFLYAELYLVAIGFLILEGDNLDKLFPGTSLSLGLG

SEQ ID NO: 61928 - protein, 159 aa, Sorghum bicolor
  Clone ID: 9853748.pep
TRANGRYGDASTSFVTDYMKHEHKIPSKGSDNQQDLCLKDCNYLIVGDSEAKAERVESQQYEAQYKPAEDTVTVAKVWGCDGTLLKSKKHGKELRDVCLSFALCKLLRRKFAGVATAESERPKAQLLVFDDLISSGRDRTFRVVRTELGFSRDLLYTKY

SEQ ID NO: 61929 - protein, 163 aa, Sorghum bicolor
  Clone ID: 9853756.pep
TRLLTVSIFMQAARNNVLLAVPAFLYAINNYLKFIMQLYFNPASVKMLSNLKVLVIAVLLKMIMRRRFSIIQWEALALLLIGISVNQLKSLPEGSSALGLPVAAGAYLYTLFFVTVPALASVYNEKALKSQFDTSIYLQNLFLYGYGAIFNFLGLVITAIIQG

SEQ ID NO: 61930 - protein, 152 aa, Sorghum bicolor
  Clone ID: 9853788.pep
TRAVLTERVLLLNGGKDDVADLFCEPFPGATWLLPRPGWFSPFRKLDDYDGDSKESLGNMLQRGAAGVSADGNMSWLSPPHPPSYVYLHLAGEYGFHDKLFYCGEHQRLLRGVPWLLMRADGYMVPGLFLTPPFVGELEAMFPEKDAAFYHL

SEQ ID NO: 61931 - protein, 90 aa, Sorghum bicolor
  Clone ID: 9853802.pep
MAGGDEAHGGASGRLESILTAEADASSPWPWARRAWAAASIELRLLTRLAAPAVVMYMINYLMSMSTQIFSGHLGNLELAAASLGNTGIQ

SEQ ID NO: 61932 - protein, 85 aa, Sorghum bicolor
  Clone ID: 9853806.pep
ARGGVFPDGSVTYGGYSKMLVAHKRFVVRVPDTLPLDAAAPLLCAGITVYSPMKHHGMLRSAGASLGVVGLGGLGHVAVKFAKAF

SEQ ID NO: 61933 - protein, 131 aa, Sorghum bicolor
  Clone ID: 9853818.pep
RPPCVCVPLLCASPPWPRPRHPPTPPAPRPPPPSMRMYIYTHRRHHLHSAPIRIRSPAAGGYLSLLATPSLLSGRRETTTRRDSLNNKDGRTNAGRTTTMRLRMQASKQSSLIDALAEIEREDNAPREPRA

SEQ ID NO: 61934 - protein, 102 aa, Sorghum bicolor
  Clone ID: 9853837.pep
HEALFYDKSACKALDDLSALLRCLRVWSVEQPITTIDVLMPPSECYYTDLFFQVYSKEGNHGPSFHEKLLAVGGRYDRLVEQAWDKAYVSYTRCLLYVKGDT

SEQ ID NO: 61935 - protein, 154 aa, Sorghum bicolor
  Clone ID: 9853841.pep
PAMSPSQVSSVSLAIFLLILPAFSTSSCLTKLPCDSTIEIRPPFFVGTPGLDPACRESINVSCGNLGPELGLLTPSKLLLKEISYNTSTIQVQDVELSVLTNLSCSLMFSFTPPVSDFVGSYSDLEKWFSLISCGDSNLTLFRSMFGDDKAVHQ

SEQ ID NO: 61936 - protein, 158 aa, Sorghum bicolor
  Clone ID: 9853844.pep
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLQHLPKTGFDYDFFLYQWAFAIAAAGITSGSIAERTQFVAYLIYSAFLTGF

SEQ ID NO: 61937 - protein, 211 aa, Sorghum bicolor
  Clone ID: 9853875.pep
TRERSKTKPIRNDRIQSTKPVPSALTVDKATSVRGSCSVTPNPSKIADNLPDRSFKKPSDRSGSTANNLATSLKKMVRQQTAPKVVRHYPSESTLFPYELFVKLYGKVELNPFGLHNVGNSCYANAVLQCLMFTRPLTTYLLEGLHSKNCSQKGWCFMCEFEKLIVEGKRRKTALSPTGILSHLHDIGSSLGPGKQEDAHEFLRYAIDAMQ

SEQ ID NO: 61938 - protein, 164 aa, Sorghum bicolor
  Clone ID: 9853883.pep
HEDDSATCGEEIESLEREIGENRASERWTDAMIALVGLLRYAKCVLFSATPRPSSDSKPDPEVDEEGEPPAPPPDFRCPITLDIMREPVVVASGQTYDRESIFRWFDSGKSTCPKTGQVLTVLELVPNKALKNLIAKWCRENGVAMESSEASKSEPAQAVAANK

SEQ ID NO: 61939 - protein, 164 aa, Sorghum bicolor
  unsure (1)..(164): unsure at all Xaa locations
  Clone ID: 9853892.pep
ARGSLSALGDAFASLSAKKEPVLSGNSRITQILADSLGSSSKILLIVHVSPSASNLSRTLSTLSFSARARNAELSLGNRDTIKKWKDVANDSRKELHDKEKEVLELRQEVIGLKHSLKEANDQCTLLFNEVQKAXRVSSTLQADLKSENLMLAEKHKIEKEQNN

SEQ ID NO: 61940 - protein, 112 aa, Sorghum bicolor
  Clone ID: 9853897.pep
LIKKPEGLEGRGMESRWEMKSKAMALVLSSSRSMNHGTSNNSMMDPVAKSSPHSLCAPCVAPAATARQRGVANFSLSLSFYPAQAHMCTDSLGKGMNRPGSGRRARHVVTSC

SEQ ID NO: 61941 - protein, 38 aa, Sorghum bicolor
  Clone ID: 9853902.pep
PERSRTGRRWSRRRIALADSVLSEASISGNDRTIVHAG

SEQ ID NO: 61942 - protein, 158 aa, Sorghum bicolor
  Clone ID: 9853904.pep
ARGSAPLPSLPKISRSAETLGRRHLWSKLRAQCQDEIEPVNTAAPHPCRGAGTPCCRSPGRPCTLSLRAAVNVTQYILLNLKPYKPPFPSTVRRRSQPLPPVQTAAASQREPTSLERAPDGGRLRRRRFSGRRERPVAEAAAAPRGGHRAPSAAWRRR

SEQ ID NO: 61943 - protein, 181 aa, Sorghum bicolor
  unsure (1)..(181): unsure at all Xaa locations
  Clone ID: 9853906.pep
HEAEVNELEWSFDRNPEVLIPIANGSEEMEIIILVDILRRAKINVVLASVEKSLTILGSQRMKIVADKSITSASDSIYDLIVLPGGPAGAERLHRSRILKKLLNLQMQAGRMYGGVCSALKVLQQQGLLEDKTVTAHHAVASELTCQVIDQPKSVIDGNLITGKGLGTVVDFALAIIXKFF

SEQ ID NO: 61944 - protein, 148 aa, Sorghum bicolor
  Clone ID: 9853911.pep
MPKPWRPVLASATKCCAAEDAAVAPDGLARCRPQQSELSRRLASFRRLSSLANSPASGGTTVVVDKDGSVKQQQGEEMVEGPLQLHSFGLGELRGVTHDFSSSFLLGEGGFGAVYKGFVDAGMRPGLSSQPVAVKQLNAAGFQGHREW

SEQ ID NO: 61945 - protein, 156 aa, Sorghum bicolor
  Clone ID: 9853914.pep
HEGGMARFEVIEKLGPDVKCRCTDPGLLLPRANLTIWRDGSVVRERNAMLPTISSKDWIDIDFGIAEGVDFVAISFVKSAEVINHLKSYISARSRGSDIGVIAKIESIDALKNLEEIIRASDGIMVARGDLGAQIPLEQVPSIQKKIVRMCRQLNK

SEQ ID NO: 61946 - protein, 121 aa, Sorghum bicolor
  Clone ID: 9853917.pep
MPALVDEETAPGRLLLLSNRLPITIKRSEDGSYSFSMSSGGLVTGLSGLSKTTSFQWYGWPGLEVPENEIAGMKQRLKDEYDAHPVFIDDELADKHYNGFSNSILWPLFHYHPGEITFDES

SEQ ID NO: 61947 - protein, 162 aa, Sorghum bicolor
  Clone ID: 9853920.pep
MAQATVIGHQLSGDSPSLVVKALFPFLVPFLLLFVLLRYFSTGATINNNNQRKRPPPSPPALPLIGHLHLVRAHPHVSMRSLAARHGGEDLMLLRLGTVPTLVASSPRAAQAVLRTHDQSLASRPSSIFGDILGYGPSDVGLAPYGNAWRQAKKLVTTHLLS

SEQ ID NO: 61948 - protein, 157 aa, Sorghum bicolor
  unsure (1)..(157): unsure at all Xaa locations
  Clone ID: 9853940.pep
TRLAVDYPVDKVSCYVSDDGAAMLTFDALSETSEFARKWVPFCKKYNIEPRAPEWYFAQKIDYLKDKVQTSFVKERRAMKREYEEFKVRINALVAKAQKVPEEGWIMQDGTPWPXNNTRDHPGMIQVFLXHSGGLDVDGNELPRLVYVSREKRPGFQ

SEQ ID NO: 61949 - protein, 73 aa, Sorghum bicolor
  Clone ID: 9853953.pep
KINNKIYHEDHKLKKSCNVWCLLSVLSIGELRGIWANANALPSLMDGCLAKHSRAIPSSGIFIKHLTCICSSC

SEQ ID NO: 61950 - protein, 187 aa, Sorghum bicolor
  Clone ID: 9853960.pep
TRAPTAGLKRGRRVAFESSESSISETSSDSEEEVLKHGLSENSTGPAQQTRRSSRQKQEVRCNEDSDDGDVEDDDNTVEDDFVGSPALKRLRSGLVHGDYCTKTAKLNEGTAGRNGLSNCSNIKDTKNSGTPCEEKTSDGVEHMKRETMHARENSDGKEEAFPSANPECSSVRSQDRDSKHAGLSSG

SEQ ID NO: 61951 - protein, 198 aa, Sorghum bicolor
  Clone ID: 9853969.pep
HEGNIKWPSRWDAYLKMDGAKVHWFSIMNSMMVVFFLAGIVFVIFLRTVRRDLTRYEEMDKEAQAQMNEELSGWKLVVGDVFREPSCPKLLCVMVADGIQITGMAVVTIVFAALGFLSPASRGMLLTGMIILYLFLGIIAGYVGVRVWRTIKGTSEGWKSVAWLTACFFPGIVFIILTVLNSILWGKKSTGALPISLF

SEQ ID NO: 61952 - protein, 190 aa, Sorghum bicolor
  Clone ID: 9853986.pep
ARGFTLQTFKKYADDFNEQYFKKEVSGDSVPSVEDIEGEYWRIVEKPTEEIEVVYGADLETGTFGSGFPKFSPEVKSDVEHKYAESGWNLNNLPRLQGSVLSFEGGDISGVLVPWVYVGMCFSSFCWHVEDHHLYSLNYMHWGAPKMWYGVPGKDAVNLEAAMRKHLPDLFEEQPDLLHNLVTQFSPSLL

SEQ ID NO: 61953 - protein, 48 aa, Sorghum bicolor
  unsure (1)..(48): unsure at all Xaa locations
  Clone ID: 9853994.pep
XRGSIKIPDDEYAMVCTDNRTTAFRLLAECYSFQPGKQVLPVYDYDSE

SEQ ID NO: 61954 - protein, 131 aa, Sorghum bicolor
  Clone ID: 9853996.pep
ARGPTPHAHLLAHAPSRRASDPTPTPPAPAAGAPYRGYLPHAVASPRAAVSARRRLPIVVQFHGGGFVTGSNTAAANDAFCRRVAKLCDAIVVAVGYRLAPESRYPAAFEDGVKVLKWIAKQANLAMMTKV

SEQ ID NO: 61955 - protein, 188 aa, Sorghum bicolor
  Clone ID: 9853998.pep
TREREKELNIERIGFLPRLEVTNEEHPLSSGKSSLWNQYFQDSEILEQIDRDVKRTHPDISFFSSKSNQESLRRILIIFSKLNPSIRYVQGMNEVLAPLFYVFKNDPDPSSSASAEADTYFCFVELLSGFRDNYCKHLDNSSVGIRSTLSKLSQLLKRHDEELWRHMEVTTKVYPQYYAFRWITLLLT

SEQ ID NO: 61956 - protein, 76 aa, Sorghum bicolor
  Clone ID: 9854008.pep
ARGQPYRSSSLAERVLALVVQVRATMTRWQTGSLAEGGGVAELWPLGLWLSSNRGIENLRYTGTSTQELPGLVISD

SEQ ID NO: 61957 - protein, 147 aa, Sorghum bicolor
  Clone ID: 9854011.pep
HEGAAASLLLAYFFWRCTGKGKGGRRRHRRGATESGGGEDGSWWTERLRAAHNRLAPVSLFQKPIVKVKLADLMAATQDFSTSHIVVAGSSRAGTAYRAVLRDGSALTVKRLHSCPLSEKAFRAEMGRIGQLRHPNIVPLLGFCVVE

SEQ ID NO: 61958 - protein, 163 aa, Sorghum bicolor
  Clone ID: 9854012.pep
TRAWSGAASRSRAIEVAQELAECISLPDRTTAQLSVARSLAKADSVSIEPYSEDDWEILESRADLAEETILKQVGIVYEGMKFPLWLDGHNIVKFVVVSSFPEKTVVQLVPGTEVAVAPKKRKEKPSQDLQKQSALNEPVKTKALLRVQAADRKYAHTFKYKG

SEQ ID NO: 61959 - protein, 194 aa, Sorghum bicolor
  Clone ID: 9854021.pep
TRIIPPHGTSEAGQMGTYVHLYKLQRGITNAIIKDISFSDDSDWIMISSSRGTSHLFSISPYSGSTRFRYSDNNPAENDYIVDSSVNHTAHWSQNSATSLSLSQKTLFVSGPPVTLSVVSRIRNGSNMFKGAVHGAAAFATGASSPISGAIASTFHNCKGGDINSDGSSRMKYYLLVFSPSGSIIQYVLHLSAE

SEQ ID NO: 61960 - protein, 140 aa, Sorghum bicolor
  Clone ID: 9854030.pep
SPSPPGSWWATSRRLRWLGLWQGDDQIASASQRRKPFGSAPGAWRSPSSSFASTPTKRDSGRPLRPPRKRPSVRAKRRAGARGRWTVGTGAEPRSHLTGGVGRGERSRRSEATDSPGRGRVGLLERRGGSELGSLRKPRA

SEQ ID NO: 61961 - protein, 131 aa, Sorghum bicolor
  Clone ID: 9854051.pep
MVKAVVAGASGGIGQPLSLLLKLSPLVDELALYDVVNTPGVATDLSHISSVAKTTGYLPKEDGAKAAFKDADIIVIPAGIPRKPGMTRDDLFNINAGIVKGLIEVAAEVAPKAFILVISNPVNSTVPISAE

SEQ ID NO: 61962 - protein, 164 aa, Sorghum bicolor
  Clone ID: 9854091.pep
VTTALPAVLNATMVHRDKILEVSVGLTTEICRFIDGERFAGELRRAGVADERAYVERLASILRQYRYPEIRVPRMRRFVVQQVIWLMTNSGGRGDDGGGYVELLREVGMQRLLESVADTTSELECYHVFSGSVGISKHRESFSDIVDSALVLIAGSGDRARDED

SEQ ID NO: 61963 - protein, 66 aa, Sorghum bicolor
  Clone ID: 9854155.pep
MMGSRRSKRVSWATGANLCKVRLFLSEDSPSQAGLRPQDNLQAKGSWLMHAAGPSSDDSLPPGFES

SEQ ID NO: 61964 - protein, 117 aa, Sorghum bicolor
  Clone ID: 9854164.pep
ARGRNDTFTLWNADIPASTVDVNLYGSHPFYLDVRHPASGGGAAHGVLLLNSNGMDVEYGGSYLTYKVIGGVLDFYFFAGPAPLDVVDQYTQLIGRPAPMPYWSFGFHQCRYGYKNL

SEQ ID NO: 61965 - protein, 152 aa, Sorghum bicolor
  unsure (1)..(152): unsure at all Xaa locations
  Clone ID: 9854170.pep
ARGQENKPPPPAAAGGRRGXPLLRRCKRDGYTHGLRPPQMEALRAMCGALIPSLPVDPEGDQQQPARGKGHDDLERFYRASAADGVIPDEVAEMVTRCVWEAMLLMRVILWMLSTRVGTLALCGRLCLCFSDNGKFFPFVCKFADMPVKRKE

SEQ ID NO: 61966 - protein, 187 aa, Sorghum bicolor
  unsure (1)..(187): unsure at all Xaa locations
  Clone ID: 9854175.pep
ARGIPERNVVSWNTIVAAFTRAGDMVSAHAVFDRMPIRDAISWNLMISGYAGSGNVESARTLFDLMDRKDVVSWTAMVSAYAKIGDLDSARVLFDQMPDKNLVSWNAMITGYNHNSRYDEALRTFQQMMLEGRFMPDEATLVSVVSACAQLGSVEYCNWISSYIXKSNTHITVALGNALIDMFAKCG

SEQ ID NO: 61967 - protein, 188 aa, Sorghum bicolor
  Clone ID: 9854202.pep
HEANIGDSRAVLGSRDSGGGGGMVAVQLTVDLKPDVPSEAERIKKCRGRVFALQDEPEVPRVWLPFDDAPGLAMARAFGDFCLKDYGVISVPEFFHWSLTEKDQFVILASDGVWDVLSNQEAVDIVASSPSRSKAAKSLVEAATREWKTKYPTSKIDDCAVVCLYLDGKMDHERDSTASMDNISLEGS

SEQ ID NO: 61968 - protein, 39 aa, Sorghum bicolor
  Clone ID: 9854207.pep
LILGRTYDHHIYDLAEVGVENYKSMESYVYDKKLAPKLG

SEQ ID NO: 61969 - protein, 186 aa, Sorghum bicolor
  unsure (1)..(186): unsure at all Xaa locations
  Clone ID: 9854209.pep
HEAQLQHCFSYCALFPQDYKFEEVELINFWIGLNVLHSSHGDSKRVEDIGESNLRELVNHGFLEKEGEKDGKSCYIIHDLLHDLARKVSSHECLNIYSSQSQVRSLQVQPSIRHLSINIEDTSVKDRFILKSCVEDFNALFTRLKVEKLRTLMLFGEHHGCFVKAFGGLLXVAKALRVIFISEASY

SEQ ID NO: 61970 - protein, 156 aa, Sorghum bicolor
  Clone ID: 9854218.pep
MSPICIYLFGCLAVIFLSHHRLLYSVAAVDFLYNGFQHAAHLSLDGSASILRGGALQLTNDSNNLMGHAFFDSPVRALSGNNAVVSFSTAFVFDIVTVGHSGGHGLTFVVAASKVLPGARAEQYLGLLGKNNLGNSSNHVFAVEFDTVQANGLLNE

SEQ ID NO: 61971 - protein, 68 aa, Sorghum bicolor
  Clone ID: 9854244.pep
GVCCKPCQRVRQIYHYTKGHFAFQQQQQENFLDYIQDDMGTELDGFHKKNYQGQLKIIVQFVMSVRCT

SEQ ID NO: 61972 - protein, 175 aa, Sorghum bicolor
  unsure (1)..(175): unsure at all Xaa locations
  Clone ID: 9854256.pep
HEGQNALRVSGIPGSIESVTSLLYTGRGPPVSGMHPRLPGAPADADHGASPASRGYDHLPFNLLGLLILKRLARDHDNCGKIGNARGLLAKVINFTQASPVLLRNPHVIDSQVSAVKRALKVVKMLVSTTGNTGKALRESVAENVFTVSNLRDILRYGQQHRELQKLATDVLTXL

SEQ ID NO: 61973 - protein, 112 aa, Sorghum bicolor
  Clone ID: 9854382.pep
MVMVVVIRYFGGIKLGTGGLVRAYGGVASECLKDAPTCLVKPKARVGMEVPFDLLGTVYHQLQHFQAEDIKQDYDTGKDGTVMVMFEVEYEKIENLGNAVNSACSRKIELYL

SEQ ID NO: 61974 - protein, 185 aa, Sorghum bicolor
  Clone ID: 9854401.pep
CCEECTTSLVAARIEAEERLNNQRLREEQDAAYRAALEADQARERERIEELERREREAAEAERKRKEDEEALARAAQEAAEKEAALARRRQEKAMALGAEPEKGPGVTRVLIRFPTGERKERRFHSSTTVTSLYDYVDSLDCLKAEKYSLVSNFPRVTYGPEKHSLTLEEAGLHPQASLFIEIEQ

SEQ ID NO: 61975 - protein, 128 aa, Sorghum bicolor
  Clone ID: 9854404.pep
HRMHEGSCVTERVKCHFEDCKCSFSKKSNLDKHVKAVHEQRRPFVCQFSGCGKRFSYKHVRDNHEKSSAHVRTEGDFVEADEQRPRSVGGRKRKPVSVESLMRKRVAAPDDGPAHADGTEYLRWLLSG

SEQ ID NO: 61976 - protein, 130 aa, Sorghum bicolor
  Clone ID: 9854424.pep
LSFFPEAVTIVLCFAVKLFSACQTREQSSPLDFTFTFRIVAAAGFTLMTGLYAAFMGTDHYGLYLRTAMFILLLAVLSSLSRLAIPLQPRVGGGIIEFGTTGVALAFPLLALLAAIPLVLLVFVDHYVNR

SEQ ID NO: 61977 - protein, 225 aa, Sorghum bicolor
  unsure (1)..(225): unsure at all Xaa locations
  Clone ID: 9854442.pep
TSGDNPINAAHYQGTNNFHAGTNTDTIPVSNNATYMVDRCLVLLPSQIPGNRCYVDASIXPDQSVYTPREAGIGIFLVNTQVHPPHNIFIKAAMKNASSVLMAEAAALALAAAVIKALQLDHTAMLSDNQQLVHFLNGQDQEHPPDRXVKPFTQLIKTSLQGIASSIKRIRRTQNQMADLLARQALTCIRANQITFNGDCSFAPHEQECPLMTALHNVTVNVMVS

SEQ ID NO: 61978 - protein, 59 aa, Sorghum bicolor
  Clone ID: 9854456.pep
PWVISSRGWWEMKKVYMDRQNVTVNIKRFGELLRAARTHLKNTTACSKGAGGGATAALR

SEQ ID NO: 61979 - protein, 118 aa, Sorghum bicolor
  Clone ID: 9854472.pep
MAAPPPSYPAALKPEIGPDGLARDSPVIAYTEKVILEEQLQLKKYIQENYSKIRDVEKELESLTLEMKLTAGPKKAALEHLRKKIEISTEKIRLAKVKEEQAKKAWEVAAQVVKDEED

SEQ ID NO: 61980 - protein, 158 aa, Sorghum bicolor
  Clone ID: 9854477.pep
HEGLLTLWFNHGATSEVQTALQKGFSLVKIEMWLVVLPQIIARIHSNTRVVRELIQSLLVRIGKGHPQALMYPLLVACKSISILRQRAAQEVVDKIRQHSGGLVDQAQLVSKELIRVAILWHEMWHEALEEASRMYFGEHNIEGMLAVLEPLHAMLER

SEQ ID NO: 61981 - protein, 129 aa, Sorghum bicolor
  Clone ID: 9854489.pep
TRLLYAVAFSQSSTFFTKQAATLDRRIGRHGLQVPPAALQSFISITIVVFIPIYDRVLVPVSRRYSGKPSGITMLQRIGTGMLLSLLSMVIAALVEKHRLGVARDAGLVDKPKVPLPMSLWWMVPQYVL

SEQ ID NO: 61982 - protein, 167 aa, Sorghum bicolor
  Clone ID: 9854490.pep
ARGFLLLVRYSVSRKQQRARKRQQLDDEDEDDDDHHLPLPPSPPALPLFGHLHLIGSLPHVSLRSLATKHGPDLMLLRLGAMPVLVVSSPRAAEAVLRTHDHVFASRPHSLVTEVVLYGPSDIGFAPYGDHWRKARKLVTTHLLTVRRVQSFRHAREEEVSTVMAER

SEQ ID NO: 61983 - protein, 200 aa, Sorghum bicolor
  Clone ID: 9854515.pep
ARGSWANSTDCCQWEGINCGNGGVVTEVLLPSKGLKGRIPPSLSNLTGLLHLNLSCNSLYGSLPAELVFSSSIIILDVSFNSLSGPLLERQSPISGLPLKVLNISSNSFTGQLPSTTLQVMNNLVALNASNNSFTGPLPSSICIHAPSLVILDLFLNDFSGTISPEFGNCSKLTVLKAGRNNLTGGLPHELFNATSLEHL

SEQ ID NO: 61984 - protein, 178 aa, Sorghum bicolor
  Clone ID: 9854528.pep
MGSFMGKLPATCQICCQTIYNVTNTFMPPQMPTIRQHHGLLPIQQSSQQSSRTQAHMFGPQHPPHMMNRFDNFGMPEFSDPRARSSMHHGRQGHHFPFQGSEFGIMKMGNGRSRFRSKYMSTEELENILRIQHAATHINDPYIDDYYHQACLASRYVDGRSKHRFYPTLIRDPSSCAR

SEQ ID NO: 61985 - protein, 161 aa, Sorghum bicolor
  Clone ID: 9854531.pep
ARGHVVLLPYPSQGHVHPMLQFGKRLAYHGLRPTLAVTRFILATCAPDAAALQGLGGAGAGAGAVRLAAVSDGFDRGGFGECGEVTAYLSRLEAAGSETLGELLRDEAARGRHVRAVVYDAFLPWAQGVARRHGAAAAAFFTQPCAVNVAYGHVWSRRLSV

SEQ ID NO: 61986 - protein, 154 aa, Sorghum bicolor
  Clone ID: 9854547.pep
MVAKKQAPFDELSLVEARGGGGGGGDDAEWRDDDGRPRRTGTVWTASAHIITAVIGSGVLSLAWAIAQLGWAAGPAVMILFAVVIYYTSTLLAECYRSGDPVAGKRNYTYMDAVRSSLGGAKVTLCGSIQYANLFGVAIGYTIAASISMLAIKR

SEQ ID NO: 61987 - protein, 146 aa, Sorghum bicolor
  Clone ID: 9854548.pep
HEEKASLVPEVQVDTTLIDKLTAENENLKALVGSLETKIDETEQKFEEMKKAREEWLKKATDAESKINELTNTMQSFQEKVTTMEAENQLLRQQALLRTPVRTIPENASPKSNLTNGSPRIDEQKTPHGTPPAPKDYGSFGQPRAS

SEQ ID NO: 61988 - protein, 52 aa, Sorghum bicolor
  Clone ID: 9854565.pep
AALSPFPHLSLTNPLESWIEPRDLQDRPPAAAVEREAAAAQERNPRLASRQA

SEQ ID NO: 61989 - protein, 183 aa, Sorghum bicolor
  unsure (1)..(183): unsure at all Xaa locations
  Clone ID: 9854576.pep
ARGVPPAFAPDAEAAQGQGLKSRYCDKCCMFKPPRTHHCKVCKRCVLKMDHHCVWINNCVGYANYKAFIICILNATIGSLYSFAIFLCDLLLKEHDFDILYVKILYILAGVLLFFLSLTIGSLLCWHIYLLCDNMTTIEYREAVRARWLAKKSGQKYRHRFDLGIRKNIQMILXPNILCWLWT

SEQ ID NO: 61990 - protein, 74 aa, Sorghum bicolor
  Clone ID: 9854586.pep
TPPAGAPGGGGTSATASAGTASFRFQPLRRRNPPSHAPAQQHRPPAPPREKAKPGSLATSVTGRRRKGGRKPRA

SEQ ID NO: 61991 - protein, 152 aa, Sorghum bicolor
  Clone ID: 9854589.pep
TRRRGRAWCWVLTILVAVTGVMLIVADTILLIVANRSNMLLSVLLGPVVLLVGVAVSTGAWMLEEPSSDSELGKRYDAAMKVTFDMATVGTIVSFTLQGGVAFSYLKTPGTGSNNHQVKRDPPLDLAACYATSTLSLIAMMVCAMPLALLPN

SEQ ID NO: 61992 - protein, 198 aa, Sorghum bicolor
  unsure (1)..(198): unsure at all Xaa locations
  Clone ID: 9854595.pep
PSRGYLVNDTVVVEAEVAVRRMVDYWTYDSXKKETGFVGLKNQGATCYMNSLLQTLYHTPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSSRKESFYDLQLDVKGCRDVYASFDKYVEVERL

SEQ ID NO: 61993 - protein, 159 aa, Sorghum bicolor
  Clone ID: 9854602.pep
TRNITAKAVRGDEESVALQAIEFWSSICDEEIDILDEYSSEFTADSDVPCYYFIKQALPALVPMLLETLLKQEEDQDLDEGAWNLAMAGGTCLGLVARTVGDDIVPLVMPFVEENITKSEWRQREAATYAFGSILEGPSADKLAPLVNVALGFMLSALT

SEQ ID NO: 61994 - protein, 174 aa, Sorghum bicolor
  Clone ID: 9854603.pep
MMGVSQAAAVVVVMALAVAVALPASAFPSGLPPGAPPFPNPWAAFQNLSGCHMGEERQGLAGLKDYLSHFGYLPPPPPSSPFSDAFDQDLESAIATYQRNFGLNATGALDASTVSQMVSPRCGVADVINGTSTMAKSSSSSADDAHGRHLYAYFAGEPTWPPFRRDLKYAITAT

SEQ ID NO: 61995 - protein, 162 aa, Sorghum bicolor
  Clone ID: 9854621.pep
GTRLFFSSPHSSHEYDRQKLLASSAASTSSPPPLHSIPAQLPQLYISPRPIWSLPGVGEVSCFSAAQRAGGRRGSKGSKENSGGGVACGGEGGRRRKREPPREREPEDDAAAAASQALRPLLLLVVDPEVPAAVAAAQEAGRRRREGAVRLPARAPARAHRV

SEQ ID NO: 61996 - protein, 55 aa, Sorghum bicolor
  Clone ID: 9854630.pep
HEELLQAGTDFAALVAAHDSSMELVESAAPASERELPLSRQPWNKNADGRACNGD

SEQ ID NO: 61997 - protein, 145 aa, Sorghum bicolor
  Clone ID: 9854632.pep
HEAELRSSIISLGQMDEHGAEVLIRNGVLRIKDQDGRLLAKVQRTRNRLYLLDLKVEQPVCLAAACAEEPWLWHGRLGHLNFDALGRLGKMVTGMPSIKHAGELCDSCLAGKQRRMAFTKMAKYRAAERLELVHGDLCGPITPAT

SEQ ID NO: 61998 - protein, 140 aa, Sorghum bicolor
  Clone ID: 9854978.pep
ARGSQLPADLQAKIFQKAEEGARKCIVATNIAETSLTVDGIFYVIDTGYGKMKVYNPRMGMDALQVFPVSRAAADQRAGRAGRTGPGTCYRLFTESAYQNEMLPNPVPEIQRTNLWNVVLLLKSLRVENLLDFDFMDPPP

SEQ ID NO: 61999 - protein, 125 aa, Sorghum bicolor
  Clone ID: 9854986.pep
MAMQARHHSHDYFLSRAGSLFLDEYAGCVPLPTSPAVGIRDMPLLSDFAGSELSFGYSFLPRKRARMEDHRVVLPPAVMQGLVQVQVQLPMTSSNVMGSGAVTSTSGREIDALLRVESERMRAAL

SEQ ID NO: 62000 - protein, 152 aa, Sorghum bicolor
  Clone ID: 9854987.pep
HEAQSKHGEAYPVTIGSAIVDGDRLPAGGSFSSWHGKVDMEHELLKVSYDIYTRHVPPRVNFMNMTSPITIEERLITAEGVYDPKTGVLCMIGCQELEGSTETDCQILITVHFASLDAKAQGRGRGVIGSLRAKTTDPLFFSKMDIALFGRY

SEQ ID NO: 62001 - protein, 91 aa, Sorghum bicolor
  Clone ID: 9854997.pep
ARGGEQHSQPQQAEQGRGQGNQDNQSPAAGNGTADSDNNVSYDSKKVFIGGLRDNITEEEFRSYFETFGTVTDVVVIYDSATSRSRGFGLV

SEQ ID NO: 62002 - protein, 86 aa, Sorghum bicolor
  Clone ID: 9855001.pep
PSEEYFYVVGAKGIVFPISSVVTSIQQYFSLITNQPTVLSAMTYQPNEQLVIFRLLAFGLSKSKTAPISQKPRSSWLLASGSFFGF

SEQ ID NO: 62003 - protein, 149 aa, Sorghum bicolor
  Clone ID: 9855005.pep
ARGLPSGISSLVELQYLDLYNTNIRSLPRELGSLSTLRFLLLSHMPLEMIPGGVICSLTMLQVLYMDLSYGDWKVGASGNGVDFQELENLRRLKALDITIQSVEALERLSRSYRLAGSTRNLLIKTSSSLTKIELPSSNLWKNMTNLKR

SEQ ID NO: 62004 - protein, 100 aa, Sorghum bicolor
  unsure (1)..(100): unsure at all Xaa locations
  Clone ID: 9855032.pep
MWGFASNAWASGLGKRSPPNCTSSSAAGSDDEASSCTSREEGLECPICWESFNIVENVPYVLWCGHTMCKNCILXLQWAVIKVPTVPIQLPFFICCPWCN

SEQ ID NO: 62005 - protein, 126 aa, Sorghum bicolor
  Clone ID: 9855041.pep
ARGAPNASVNFFSYKNRIPGIGNFVLEVNGQMQRRQWSPEAGKWILFCSEPHDGCDVYGSCGPFGVCSNTSSAMCECPAAFAPRSQGQWKLGNTASGCVRRTKLDCPNDGFLKLPYAVQLPVGSAE

SEQ ID NO: 62006 - protein, 68 aa, Sorghum bicolor
  Clone ID: 9855050.pep
DRSKTKLVPLDLRTVSELPSARFTKCAPHLNLKPCLSQATRSKPLLIVRSKENKILNYSKCPSSPYGT

SEQ ID NO: 62007 - protein, 174 aa, Sorghum bicolor
  Clone ID: 9855053.pep
TRHRLVINSLNAQGRGQHGGTSMPYQTIMNGLHHLNVMPPVSSQGMPPRVGQSAGPPGWYVPRGSVSNGQPPAYASSGSGHYQYERSGPSQYEQGNHGRQQSHPYARDGLHDTRGRAPPAYGYQQSNMYPLGPGLYGQPPSAYPGVHGGGYQPPPYGGGQQWQQQPYSSYAGRR

SEQ ID NO: 62008 - protein, 198 aa, Sorghum bicolor
  unsure (1)..(198): unsure at all Xaa locations
  Clone ID: 9855059.pep
ARGSFSLSIQSQTPYTSIFSFGDSFTDTGNFAIIAGPTTPGLLITKPPYGMTFFGHPTGRISDGRLAIDFIGKFPSFVSAPMLDDDDXRICLFDARKRARVAEALGLPLLLPSMAANQSFKQGANFAVAGATALDRTFFVNDGDTAVTAYNISVGDQLRWFDAMKPTLCDSTQACREYFAQALFVVGEFGWNDYGFML

SEQ ID NO: 62009 - protein, 102 aa, Sorghum bicolor
  Clone ID: 9855061.pep
HEVRASDASSDSPDPSGPRTQVPTRPTPSRLGHRTPLRLGSKTSTARHPYLRHDRRVGFHTAAGQGDNYSNHPGHCSITFSLCALTSFTAAYSRTVEREWER

SEQ ID NO: 62010 - protein, 130 aa, Sorghum bicolor
  Clone ID: 9855088.pep
MTAPSDNSPFFSKPFFEPVPPIKVFPGGDNQTVAKPTLVIHQPVESEAPPHTVVAVPEAETPVPALSAPRDEWDILKAIVYGGLVESIMSLSVVSAAAASGSKTLDIFILGIANLIGGIPVIYHNIADLR

SEQ ID NO: 62011 - protein, 182 aa, Sorghum bicolor
  Clone ID: 9855089.pep
ARGPTALYRCASLQYLDLSQNNLTGELPADIGSLGKNLTTLCLYSNGFNGSIPAGLGALTRLQTLWIASNPFVAGELPPSFKNLTNLVSLWAQQCNLIGDFPSSVLEMKELELLSLANNMLTGSIPAGVWSLKNLQQLFLYGNNLTGDVVVNDLAATNLNYIDLSENYKLTGAIPEAFGALK

SEQ ID NO: 62012 - protein, 131 aa, Sorghum bicolor
  Clone ID: 9855097.pep
MEEKVLLAVAVAVLLVVLSKLKSLLVTRAKLNLPPGPWTLPLIGSVHHLVTSPSIYRAMRDLAQEHGPLMMLRLGEVPTLVVSSPEAAQAITKAHDITFADRHLNATIGVLTFNGTDLVFGTYGERWRQLR

SEQ ID NO: 62013 - protein, 192 aa, Sorghum bicolor
  Clone ID: 9855104.pep
ARGFYVMEGFLKEQKTAESIGMHDMWLSKSKELDAFSYRSVLPSLPWLDADRAKNLVESMLTMKLTEFPYCGCIVKELMQTRNIKWAMPVLQESSPGKLSATLLNSLLQVYGWLKNWRKLDAVLCKMLKMHDTLSISSYRFLVCRMCEQSRFSSASSLRALFQYADKSRELIACNILIFYLFQRRNSSQIHD

SEQ ID NO: 62014 - protein, 124 aa, Sorghum bicolor
  Clone ID: 9855107.pep
MAQVLQEVHQYGLHEQLHESPPQAALIYSLLLAACPVIILLLLIRRYATTSPSAGATAARARQEELLGKLPAPPRKLPVVGHLHLVGPLPHVSLRDLAAEHGRDGLMLLRLGAVPTLVVSSPRA

SEQ ID NO: 62015 - protein, 180 aa, Sorghum bicolor
  Clone ID: 9855115.pep
ARGHVEVDDRSVHNIYKLLVNSGLAFGARRWVGTLDRQCERLASVMASNIPTSDIGVITSTEGRKSMLKLAERMVMSFCGGVTASAAHQWTTLSGSGAEDVRVMTRKSVDDPGRPPGIVLNAATSFWLPVPPKRVFDFLRDESSRSEWDILSNGGVVQEMAHIANGRDHGNCVSLLRVNS

SEQ ID NO: 62016 - protein, 100 aa, Sorghum bicolor
  unsure (1)..(100): unsure at all Xaa locations
  Clone ID: 9855141.pep
MAIEAMMLSGLNSGVVLSLIAVLWTVVWQNLQHLQLQQFFARHLSRHARRLAAMVDPYLSVTISEYEGGRMKRXDAYEEVKAYLXDASARGVRHLRAEGA

SEQ ID NO: 62017 - protein, 129 aa, Sorghum bicolor
  Clone ID: 9855164.pep
MLSGVKLVPREQIQSDQRRRGDRGSDSDSSDGKRPSKHSKRGRDKKEKKKRKSSRRQRRRSKRYSSEEFSASDTDDSIGEEEEEDVSRSKRRGKDRRRRRNFSDDDESESSESDRGRAPRRGKQRRNDE

SEQ ID NO: 62018 - protein, 44 aa, Sorghum bicolor
  Clone ID: 9855184.pep
EEMEFQGIFRNLKTSNILLDENWDAKLSDFGLARHGPAQGLTHV

SEQ ID NO: 62019 - protein, 73 aa, Sorghum bicolor
  Clone ID: 9855192.pep
MRMGKYEMGRTLGEGHFGKVKLARHADTGRTFAIKILDRQRILAMKINEQIKREIATLKLLKHPNVVRLYEVS

SEQ ID NO: 62020 - protein, 84 aa, Sorghum bicolor
  Clone ID: 9855229.pep
SRGSSVPPCVSDGKGRRGVASAWPRPCQAGVPPRRQRCREGEQGEARAGARARTGTWAEGEGATGATPWPRPSPPGKDRGRQKN

SEQ ID NO: 62021 - protein, 92 aa, Sorghum bicolor
  Clone ID: 9855238.pep
ARGMLVLFYFWSQLHACPCIGTKLTTLLGAKLRLPGSVIYHTGSINNIGSSVEIQVILIRMGRRPVSVGLNSPKALLRQTIMLYVTISPYSP

SEQ ID NO: 62022 - protein, 138 aa, Sorghum bicolor
  Clone ID: 9855249.pep
QTDPLLPPAPAPPPAPPTAPASSPRPIQLGRRLVSRPPPCAGSMADGAIVVAICQYGGEFASGPSGNLIYRGGEAHAVDVTRDSSLEGFKDELSKVFHVDVTDMSLKYFLPNNMKTLITISCDRDLQRMVDFTANAAH

SEQ ID NO: 62023 - protein, 151 aa, Sorghum bicolor
  Clone ID: 9855260.pep
KVRHPNLVTLIGACKDAQTLVYEYMPNGSLDDRLACKDNSKPLSWQLRTRIASNICSALIFLHSNKPHSIGHSDLKASNILLDGNNIAKLSGFGVCQILSDQFKATTTLYRYTHPKGSFGYIDPEYLISGDLTPLSDVYSFGIVLLRLLTG

SEQ ID NO: 62024 - protein, 103 aa, Sorghum bicolor
  Clone ID: 9855271.pep
RILYILLCGVPPFWAQTEQGVAQAIIRSAIDFKRDPWPRVSDNAKDLVRGMLNPDPKRRLTAHQVLDHPWLQNIKNAPNVNLGETVKARLQQFSVMNKFKKHA

SEQ ID NO: 62025 - protein, 36 aa, Sorghum bicolor
  Clone ID: 9855280.pep
HEERHYLATARTLTEAHHRSMAAKALLYRPAVQSAV

SEQ ID NO: 62026 - protein, 37 aa, Sorghum bicolor
  Clone ID: 9855289.pep
HLCFLTVKLHHLPLWNQCHIRSLPKQMSPYSLGHMVT

SEQ ID NO: 62027 - protein, 138 aa, Sorghum bicolor
  Clone ID: 9855292.pep
MWPGRRRAEKLRDRWDEVLDKVIDHHASMAADGAPAPDESDFTDVLLSVQEEYGLTRDSIKAILADMFAAGAYAPYLVLEFAMAQLMLHQDVMARLQAEVRSIMMPTNKGQQVITEEHLTGMSYLKAVIKETLRLHPP

SEQ ID NO: 62028 - protein, 72 aa, Sorghum bicolor
  Clone ID: 9855304.pep
ECKFVFVSHDCACQFYVGHGCKVCVWTVLIWTGWSMIEIINYILFKSMNGLLILFILAKTIQVIIVLKGLTD

SEQ ID NO: 62029 - protein, 78 aa, Sorghum bicolor
  unsure (1)..(78): unsure at all Xaa locations
  Clone ID: 9855326.pep
FKNAIYEXNYIQIICTLYTNNSGANSYHKHSQDASPMGSASYLTTAIHVGRCRKGSGSSDCYNGSPKNNLEFKLHIVD

SEQ ID NO: 62030 - protein, 112 aa, Sorghum bicolor
  Clone ID: 9855356.pep
SGSQCQNPLLMDLMASICNMPVLVPRYTNAAVVHGAAMLGAKAATAAEDGSTEDLWSIMDRMSKPGRLVKPGTLKGEKFLFDAKYRVFLDQCKTQQEYRKQVDAAVDQWLKK

SEQ ID NO: 62031 - protein, 153 aa, Sorghum bicolor
  Clone ID: 9855363.pep
PYLRAVVKETLRVHPPVPLLVPHQSMADCDVDGYTIPAGTRVIINAWAISRDPRSWGKPEEFVPERFMDGGAAADVDFRGNDFQFTPFGAGRRMCPGINFGLATIYIMLANLVYCFDWKLPAGVEKEDIDMMEVFGLTVHRKDKLVLVPRPHV

SEQ ID NO: 62032 - protein, 108 aa, Sorghum bicolor
  Clone ID: 9855366.pep
GLFIKHVQTCAVTGKGISDLESAVIEVRGIEHVPSEGRRWTVNQRQFEQLLRTKEAFLRLESSINEQLPMDFWTVDLREAALALATISGEDISEEVLSSIFSKFCIGK

SEQ ID NO: 62033 - protein, 126 aa, Sorghum bicolor
  Clone ID: 9855378.pep
APEVFSRGFGVVSTKSDVYSYGMVLLEMVVGRKNIKETTGNSSEAYFPDWIYDRLAKDFQSQDVACVSDETARHMTLVALWCIQTSPGNRPSIRCVIEMLEKNITELEMPPKPFLSCPSPPSHFSS

SEQ ID NO: 62034 - protein, 89 aa, Sorghum bicolor
  Clone ID: 9855386.pep
RIPTVICTDSYSLYECLVKLGTTKEKRLMIDIMALRQSYERREIHEIRWIHGNDNPADGFTKSSPNKALEELVSNGAARIRMNGWVSRT

SEQ ID NO: 62035 - protein, 142 aa, Sorghum bicolor
  Clone ID: 9855391.pep
MSSARSTVGVKRMGELDEKTFLAACKEKIADEEELAILCSKWEDEIRHPEWHPFKVIHVGGEAKEIIMEDDEKLQALKAELGVKAHDVVVKALREMNEYNPSGRYPIPELWNFREDQRAPMGEAVAYIVKRWKANKKKHTYY

SEQ ID NO: 62036 - protein, 124 aa, Sorghum bicolor
  Clone ID: 9855392.pep
ALFTSLAVVVVQITVVRGETKSERRVVEVINKLMWIASVCTTISFIASCYIVLGRHFQWAAILVSLIGGVTMAGVLGTMTYYVVKSKRQRKIRKKEKMSRRSGSSSWYDHTELSDTELNPVYAL

SEQ ID NO: 62037 - protein, 126 aa, Sorghum bicolor
  Clone ID: 9855395.pep
MHRQKANDHVLHSSLESSIDKSPYVNLMEDGMVAAVTEDGPGNDGSPLNHAVDEEQLSNEQGDDVHSNKLHEIIAPVKRSINQLTRYQGRSVWLLAYIAFVTSWPLLGSLAFITFRKKFRNPLRDK

SEQ ID NO: 62038 - protein, 147 aa, Sorghum bicolor
  Clone ID: 9855412.pep
DKVSVLASKFPDLKTFRSCDLLPTSWMSVAWYPIYRIPTGPTLKDLDACFLTFHYLSTPSKDTDPSTPACPSFGGLNCCMNAAGKLTLPVFGLASYKLKSSIWSSNRPEEQQLAASLMQTADDWLRHRQVYHPDFRFFLTHYNTALR

SEQ ID NO: 62039 - protein, 182 aa, Sorghum bicolor
  Clone ID: 9855448.pep
GKGADQSGGYYSQLMKEYDGVIISSDLAKMSSLPLSREAGANQPLYIIIAQGENSRLHIPSLSEEHASKVIVLADSPVTAAPAGVEVAVLRQIDLESILQLLAQRGLCSVLVDFREATESFASLLNDFQEDKLVQKVVVEILPFWFASEGLSNLAFGGSQSFPLKNLEHREVNGGVLMEGYV

SEQ ID NO: 62040 - protein, 63 aa, Sorghum bicolor
  Clone ID: 9855449.pep
RHRGFVVYIFVFKILASLKITVRFNHNDHFCSVKLRSSTLLKKAVMMMQISDTAIYCKTISTL

SEQ ID NO: 62041 - protein, 84 aa, Sorghum bicolor
  Clone ID: 9855475.pep
AGLGITLFGMAYMFVHDGLVHRRFPVGPIANVPYFRRVAAAHKIHHMDKFEGVPYGLFLGPKELEEVGGLDELEKELARIGRTI

SEQ ID NO: 62042 - protein, 177 aa, Sorghum bicolor
  Clone ID: 9855489.pep
DWKEEIYLWLPFSLTEESGIIYDEKQLEREKGSFLNAVDVPGSSQARRYDCELKNKHRDLSHLTTVPPLHELLQSHSKEDYPNYLLEANVILQSPLKSRVKQIIHKIVDDEECLASHNGNLELCLPSKEVLECDLLGPLFQTNVSAADKSSDAEGLVTAKRPASNVYVRRPKDNTTL

SEQ ID NO: 62043 - protein, 151 aa, Sorghum bicolor
  Clone ID: 9855498.pep
TAPRWATVMANLFAVIQIAGCFQIYCRPTFAHFEERVQAKKNRSCRSCLCRLTYTSAYMAMITLVSAAMPFFGDFVSVCGAVGFTPLDFVLPALALLKTRTMPDNPGLQCAVKMISAAVAILFSIIGALACIGAIRSIALDVKTYKFFHDM

SEQ ID NO: 62044 - protein, 104 aa, Sorghum bicolor
  Clone ID: 9855526.pep
ARIKKIFFGIAAYKINKKCKMKKRAPNLTSFYTIKKRTRDLNPFLFLKEKEVFRDLSTYSRHLSTYSRLSRFLMNIYPNPSQNICINIYSVDPFFLCQEPDLNW

SEQ ID NO: 62045 - protein, 54 aa, Sorghum bicolor
  Clone ID: 9855530.pep
TKKMTLPLIGHNPFYTNDNSIITPSFSTSSAGATLHISSMIHIQTSYASTSVTK

SEQ ID NO: 62046 - protein, 174 aa, Sorghum bicolor
  Clone ID: 9855539.pep
RNKLSNLISLIQVDTKTIKAQIWDTAGQERYRAITSAYYRGAVGALLVYDVTKVMTFENVKRWLKELRDHADSNIVVMLIGNKIDLRHLRSVAVEDAASFAESEGLFFIETSALDATNVEKAFQTVLAEIYRIISKKPLSSEESGSGSGNLREGQSIQVSATNSSALTSRCCSS

SEQ ID NO: 62047 - protein, 147 aa, Sorghum bicolor
  Clone ID: 9855544.pep
SKTHVIYRTYAPVHFRGGDWKTGGSCHLETLPDVMPVKSLDEWADLLQPVNDFLGSNLRSKLVGLDLLNVTRMTAQRKDGHLSVYLSPSGPVPRYKQDCSHWCLPGVPDTWNELLYALVMRKHEKMGQNASLASTRTLHTEDGNVFS

SEQ ID NO: 62048 - protein, 97 aa, Sorghum bicolor
  Clone ID: 9855554.pep
KGHIGRERRGTCYSAALALGEAATAEFFERLRRFAKKTSWEFFSSRRVDAVCCPLVDFFFSFFCSTFHGRREWSLESIWPLVLYFLLFLLSNSKPMI

SEQ ID NO: 62049 - protein, 123 aa, Sorghum bicolor
  Clone ID: 9855574.pep
MGGAAQLVVVTVLLATAAAASAAGPRPSEVAVGALFTYDSTIGRAAQLAIELAVDDVNADAKVLKGTKLNLIPMDTNCSGFLGTIKALELMEKNVVAVIGPQSSEIGHVISQVVNELHVPLLS

SEQ ID NO: 62050 - protein, 92 aa, Sorghum bicolor
  Clone ID: 9855589.pep
RPCAQVFLSSTSSVSTVKYLAVVSIALTCTYLQLFDEMLKGFFVANFAFLCVIYAYFNKFYLPSLNHYRPIYFMKVTVNAFGGNNCFYSLLF

SEQ ID NO: 62051 - protein, 113 aa, Sorghum bicolor
  Clone ID: 9855598.pep
MMSFLSKDTHAQTRLNWPWRSQSPLSAQLLVDIPPEIELSDYRRLPSSGSESPSGLLHGEGIKEEHIPDLDIFFERLYEYFCAKGLRCIITKWIIEVLNVLFMVCCIGFFFLF

SEQ ID NO: 62052 - protein, 175 aa, Sorghum bicolor
  Clone ID: 9855621.pep
HEAGSARACIIDETGDIKGLASEPIKLWQPETGYYEQSTSDIWSCICNCVKQVLNESKVDPDKIKGIGFDATCSLAVFSHDTDEPVAVTGPDFDNADGNDRNVILWLDHRPIEETEKINATKHNLLKYVGGTMSIEMEIPKVLWLKNNMPKELFDRCKFYDLADALTHMATGNET

SEQ ID NO: 62053 - protein, 59 aa, Sorghum bicolor
  Clone ID: 9855624.pep
MDKSGAAADDVERGDYEQEHDRRGTVWTATAHIVTAVIGSGVLALAWSVAQLGWVAGPL

SEQ ID NO: 62054 - protein, 162 aa, Sorghum bicolor
  Clone ID: 9855628.pep
ARGNLVVSSARAAEAILRTHDHVFASRPASALFDDLVYGSSNVAFAPYGEHWRQVRKLVTAHLLTVKKVNSYHHARQEEVCLVLDKLREAATMDAEVDLSEMMNAFANDIICRAVCGKFSREEGRNRLFRELNHTTTLLVAGFDLESYFPGLARSLGRLFVS

SEQ ID NO: 62055 - protein, 177 aa, Sorghum bicolor
  Clone ID: 9855631.pep
TRLPGQLRPDYGGGGGGGAPGTIAAIVTSLGGGPAAVGIVRLSGPDAVAVADRVFRPAGARRASAPWQPRSHFVEYGLALDADGSVIDEVLVVPMLAPRSYTREDVVELQCHGNDLCLRRVLRACLEAGARLADPGEFTLRAFLNGRLDLAQAENVSRLISAKSAAVADSALAGIQG

SEQ ID NO: 62056 - protein, 181 aa, Sorghum bicolor
  Clone ID: 9855643.pep
HEGDGDERDVFEKYILTSPEMCTEQMQKLRIAMQEEAAKQEKAAAAAGNGKAKGRRGGRDVVDLRTLLVHCAQAVASDDRRSATELLRQIKQHASPQGDATQRLAHCFAEGLQARLAGTGSMVYQSLMAKRTSAADILQAYQLYMAAICFKKVVFVFSNHTIYNAALGKKKIHIVEYGIQY

SEQ ID NO: 62057 - protein, 123 aa, Sorghum bicolor
  Clone ID: 9855647.pep
HEGDSTSLTIYTTLVAADNKTSRCQNVSAGPLIDLSGGSRRQNKLILKVALSVSICFILTCLACIMYRWKKIYQVSFQMVNSKKRYDGNESNIEDILKGYDSLIPKRYKYSEVKKITGSFKHI

SEQ ID NO: 62058 - protein, 127 aa, Sorghum bicolor
  Clone ID: 9855655.pep
TRPFLFCLKDMDRHGVKFDNLTNTLVKGDTIVPVVRKWGHAWMLLEQPERTVAQHHLTDGELRQIHRRFGHPSVQRLHKVLQRAGHETAISDIEEINKFCRSCQLNSKAPGRFKFTLHDDHEFNHEI

SEQ ID NO: 62059 - protein, 139 aa, Sorghum bicolor
  Clone ID: 9855658.pep
FSTKQCIGTDGLKHSLKAVGNQTVIYCASPPRPLPQPPPPPPPIFFFSRRHAPWIPVAVVGSEDDGPTRRETEASAEGTWRDKQEWGGGELGIGGCWDWTLSSAPESGWPPSFAPVSGLGFQGRAETQRGAFGCLFSLV

SEQ ID NO: 62060 - protein, 153 aa, Sorghum bicolor
  Clone ID: 9855694.pep
HEDKFISRSLARVYSDSALIRDFDLRVDRVQHLAAEASTSPPFLSPSSLSSDSSVSSKYSSDSPSLSPTTSSPPSLGPSPASSNPPHALVPSSRSPLSHQSSNEGPSKPSGMESIRSPSKTSSIAERRGGFTRLKLPSLQKDLVLPPRVPSSI

SEQ ID NO: 62061 - protein, 100 aa, Sorghum bicolor
  Clone ID: 9855697.pep
ARGSISAATVLCGATLLRGWNFQEHTVRLVVKLLSPSDPIDYSGRESQLIKLGPMLNVILSGISAVDYAPIFSFHGLIPELAAALMAICEVFGSLSPSVC

SEQ ID NO: 62062 - protein, 159 aa, Sorghum bicolor
  Clone ID: 9855706.pep
ARGRKRRRVAERGDWKMTPFVVDLGFGEEPILRGLTEENIIGRGGSGRVYRVTFTNRLNGSAGAVAVKQIRTSGKLDGKLEREFESEAGILGNLRHNNIVRLLCCLSGAESKLIVYDYLENGSLDKWLHGDALDTGGGHPMGRARSARRAPLDWLTRLK

SEQ ID NO: 62063 - protein, 137 aa, Sorghum bicolor
  Clone ID: 9855707.pep
TRALSTNQADSASGVPGITVDKSVEFSYEELFNATEGFSMSNKIGQGGFGAVYYAELRGEKAAIKKMDMQASHEFLAELKVLTHVHHLNLVRLIGFCTESSLFLVYEFIENGNLSQHLRGTGYEPLSWAARVQIALD

SEQ ID NO: 62064 - protein, 106 aa, Sorghum bicolor
  Clone ID: 9855708.pep
ARGIRPPPIATPVARPPPVHPNHHAVPHNPNHNNPVFHRPPPPQPQPQHMPAPGPAWADSPVSAYMRILENSLFSATPPGAAAAAAAAAAAAAAGQGPTPPHPHHP

SEQ ID NO: 62065 - protein, 97 aa, Sorghum bicolor
  Clone ID: 9855725.pep
MADEAETEKATLAAEDGGNPPELSKSARKKLQKQERQAERKAARKAAEKERRRADVERRRREWEDALAAAPSDEARAEMVAARRETRRERVGQRAEE

SEQ ID NO: 62066 - protein, 110 aa, Sorghum bicolor
  unsure (1)..(110): unsure at all Xaa locations
  Clone ID: 9855734.pep
RPPPPPLQQQGATPEQPSREPPPPPRASSPAPSPPXRPPPAPSPPRPTRPPPAAPQPPPSLRYASPRRPXDPXPPPPPPPRRSRLRRDRWSGAGDHWRRRAWRAGRRRGG

SEQ ID NO: 62067 - protein, 100 aa, Sorghum bicolor
  Clone ID: 9855736.pep
MASLFGNGGYSYSSGSEGEDEDEGTEGYRKGGYHAARPGDRFAGGRFVAHRKIGWGNFSTVWLAYDTLHSRFVALKIQNSARDYAHAALHEIDLLSAVAK

SEQ ID NO: 62068 - protein, 139 aa, Sorghum bicolor
  Clone ID: 9855738.pep
PSLQAARDLVVRRSRLRSRGSQSVRPHLPYGVRSRNLFFLLLTSSSLGAGWRAGPPRGSRCRLSGSSCLGPPHSSAWWRALSSTIGSTISSSCLDSTLALLASRSKTRCVAQCNVCKITDPSLLYYFSIKIMYYDLYNL

SEQ ID NO: 62069 - protein, 118 aa, Sorghum bicolor
  Clone ID: 9855743.pep
MHLEGLHELFLSKFVLSTTDFPARVKVHFSMKLSYRTPEYDHDNETLDSEATEPLTENEVANHPRKLWDDDCSWAEWYSAEDPVKGFELTAIWGERTFEETLEMAEVENASCFDADSW

SEQ ID NO: 62070 - protein, 61 aa, Sorghum bicolor
  Clone ID: 9855744.pep
CYYSCPPDCYLQRILFDLISLLLFSSFLSHYIQYIFSLEYQCLRVYVFLSMMMLVVWAAGR

SEQ ID NO: 62071 - protein, 141 aa, Sorghum bicolor
  Clone ID: 9855746.pep
TRQPLTISGILAQILVLPAGRFMAAVLPNREVRLLGGRLGSFNLNPGPFNVKEHVIITIFANCGVSYGGGDAYSIGAITVMKAYYKQTLSFACALLIVLTTQILGYGWAGMLRRYLVDPAEMWWPSNLAQVSLFRALHEKE

SEQ ID NO: 62072 - protein, 162 aa, Sorghum bicolor
  Clone ID: 9855755.pep
GRGAGGARGTGAVALALVAAQAAVDPHALLVRRLVGGAGAEDLDAALDLVHLHPRLPHGGRRSGDGGAPGGLHRDTPPSTGGGGIGNRAPGLHCFMPWPCCGASWLCSVCAWLLALGGSWCSFPSDGAAGCPLPKFLPCSAFCCTQISGLGREWASRVPPSC

SEQ ID NO: 62073 - protein, 181 aa, Sorghum bicolor
  Clone ID: 9855772.pep
HEGIARYNISINATANSTLPPIINAVEVFSVISTTNVPTDSQDVSAITAIKAKYHVQKNWMGDPCVPKTLAWDGLTCSYAISSPPRITGLNLSFSGLSGDISSSFANLKAVQNLDLSHNNLTGSIPESLSQLSSLTVLDLTSNQLNGTIPSGLLQRIQDGSLNLKYGNNPSLCSNGNSCQT

SEQ ID NO: 62074 - protein, 117 aa, Sorghum bicolor
  Clone ID: 9855776.pep
MGGGRLPVACSAVLVLLAAAGCVWAPRAAAAREYAAIFNFGDSLVDAGNLVVDGIPDYLATARLPYGMNYFGYPTGRCSDGRLVVDFIAQELGVPLLPPSKAKNATFHRGANFAITG

SEQ ID NO: 62075 - protein, 153 aa, Sorghum bicolor
  Clone ID: 9855808.pep
TRLLRISSPGATGDGDDDSLLGLPNIAQNEPILFFIWDHVARLHTGSPAARADSAANLASLARDSQHFAKLIIEEDGVPPLLKLLKDGTDEGQEAAARALGLLGCDAESVDKLVQAGVCSSFAAALKEPPMRVQAAVAEAIASLADRSSTCQD

SEQ ID NO: 62076 - protein, 54 aa, Sorghum bicolor
  Clone ID: 9855817.pep
QTLDFSYNKDLGGPLPACIGSLSNLKNLFSGEIPKELGQLCKLIFLSMNSNKFS

SEQ ID NO: 62077 - protein, 125 aa, Sorghum bicolor
  Clone ID: 9855843.pep
MDWSSGLLLIISCLPAAAWVLAAAARSPGCPTMARCGAIDVPYPFSLDPQCAIHAGFWLNCSTAADGATTLLDKNSEVTKISVEDGKAWFKTPISRQCYDSTSGDMFYNNAWVNYTTEPYVLSAD

SEQ ID NO: 62078 - protein, 89 aa, Sorghum bicolor
  Clone ID: 9855847.pep
MPLRLDIKRKLAQRSERVKSVDLHPTEPWILSSLYSGSVCVWNYQTQTMVKSFEVTDLPVRSAKFIARKQWVVAGADDMFIRVYNYNTM

SEQ ID NO: 62079 - protein, 103 aa, Sorghum bicolor
  Clone ID: 9855859.pep
TRTPHTNQPCRPRSPALPSFRRQFLAGVVPSPALPPPSAQDSELMDEQVENFVGHDKGGLAQVPYDGEQPNPYDDVAKQYSEELGDQYNEQPGAQYDEGSANP

SEQ ID NO: 62080 - protein, 162 aa, Sorghum bicolor
  unsure (1)..(162): unsure at all Xaa locations
  Clone ID: 9855865.pep
HEGGYRAHAVHPRPELQATKKPWPLRPCRRRRPAPQLPAPSPSPLAARPAKSSKEIMAPAPTPVPSPSPSPTPSFPTLPSSAAPHASPRXQSLPAPSTSPLGARLQVRPSSFFKFFLACLQVRPSSFFKFFLVRQVSPGAPPGAANPLNSLRLCKTDPFFNL

SEQ ID NO: 62081 - protein, 98 aa, Sorghum bicolor
  Clone ID: 9855869.pep
FNRIDAQRGFSHSREIERGGTNGSIEAELERVLDFEAAKCYPTGRPDCYAYAWPAGEARDRTDAGVGRYVRIRTSVAEGRGAGARRAAAEAAEGPGPG

SEQ ID NO: 62082 - protein, 163 aa, Sorghum bicolor
  Clone ID: 9855875.pep
MRPTPALAAGGRTVASFLSATEWMLPSPATQVHTISVLPSRLEFAFSNLTTSLRNGGGNGSETGNPKFQIVRDDLLHPLANGNKARKLDALLPVLRHCGATDIVTCGGCQSAHAAAVAVHCAEWGIRPHILLRGEQLDVPTGYNLISLMFGNVTYASRSLYAQ

SEQ ID NO: 62083 - protein, 159 aa, Sorghum bicolor
  Clone ID: 9855880.pep
ARGFCDEPGLGKTVTTLSLILKTQGTMAYAPQGVDVSWCMHKPDKKCGYYELSASCSSNRNSSSSASRKLLGEDVITDYQSPDDSVCSTRYSRKRGRLLSPDPTKVMLHAAIENSPSSSHSKEHSMPATHILKFTKNSRQVRKNLMDAYSDVSVGNKRK

SEQ ID NO: 62084 - protein, 158 aa, Sorghum bicolor
  Clone ID: 9855884.pep
TRLGPLSDVDLTKSSIKPHYNPFASTFDKTDPSLDIGDPVSPNAIGSVSTTEHMNTVSPFGRSRTHAHESSAEPVPIKQKLFRQEFASGAPYDPLLDSIEPSSSSINKVDLRKEKNWSAADSRDASKLMNLEVDSENMYGLGVVAESEVEGLGEVAED

SEQ ID NO: 62085 - protein, 104 aa, Sorghum bicolor
  Clone ID: 9855887.pep
VSCLRMARHSTSVFVEETQATLKSKTETAGGYGPSSGPLTASSRSPDAMAMQHTASSSGRGVAGRSPRRRPRGCCKLSCFQFFFFFSTRLRAPSRLFSCGSVGL

SEQ ID NO: 62086 - protein, 91 aa, Sorghum bicolor
  Clone ID: 9855889.pep
MGCVASKNAVSVTPAADSSGGLRDRSQPRAQESAAPVPLPVPVSSSLRSTSSAARRSEKVKEEAEEPGKAAVVVPAASRSFRLRSLRKSLE

SEQ ID NO: 62087 - protein, 38 aa, Sorghum bicolor
  Clone ID: 9855895.pep
MGKRWIPLEANPDVMNQFIWGLGVPEGDVQFCDDYGLN

SEQ ID NO: 62088 - protein, 83 aa, Sorghum bicolor
  Clone ID: 9855901.pep
SPCEVPSYSLQEQEYNTFAVSTRPQGHQYGGSKPEGVLTGILTQVAKGDPRIDISKSRNRSGLNTTAAVSITSLPKKNPVENT

SEQ ID NO: 62089 - protein, 168 aa, Sorghum bicolor
  Clone ID: 9855915.pep
HEAAAVEPLRWDQVVKVVPSMDAVVKVFCVHTEPNFSLPWQRKRQYSSSSSGFIIGGRRVLTNAHSVEHYTQVKLKKRGSDTKYLATVLAIGTECDIAMLTVEDDEFWKGVSPVEFGSLPALQDAVTVVGYPIGGDTISVTSGVVSRIEILSYVHGSTELLGLQIDAA

SEQ ID NO: 62090 - protein, 52 aa, Sorghum bicolor
  Clone ID: 9855936.pep
HRHQHAHHDPHRVRAGARAVGRPVPGRSRGRSQQPAVATKMSHAFTSRDPRA

SEQ ID NO: 62091 - protein, 43 aa, Sorghum bicolor
  Clone ID: 9855937.pep
TRKPKPSEGRTARWTETIHIHRRAPRSHIRSSWSPLLVGDPRA

SEQ ID NO: 62092 - protein, 115 aa, Sorghum bicolor
  Clone ID: 9855939.pep
HEGGFSCDPSMVHAGCGGLLGTCHSKDCAGVDLVDPLSAEVSESSMISLLQSDIRQALKAAFANMDGPLSVIDWCRGRGNAAESVTADAYSFQYSTGDTLEPSSSLPIGGDSLSP

SEQ ID NO: 62093 - protein, 163 aa, Sorghum bicolor
  Clone ID: 9855940.pep
SSSTLLPKKAYCDASNLVSPVLEVFALAAGTATGSGSGSRRKWPWLKGMDPEGGSLVGSIVGVSRHTRRQLTDGIRRRRPGPRRPGPEQAGRAGSQKDPRTAAAYCGAQSGRCDTRAWMPGPQRAAGARTRAVDSAPSCSPVDLGHRLEDGGSEGEAVVRPSC

SEQ ID NO: 62094 - protein, 137 aa, Sorghum bicolor
  Clone ID: 9855994.pep
HEGKLLPSLANDGHRVLIFSQWTTMLDILEWALEVIGVTYRRLDGGTAVTERQTIVDTFNNDLSIFACLLSTRAGGQGLNLVGADTVIIHDMDFNPQMDRQAEDRCHRIGQQKPVTIYRQTHIRHFLLSLLKAHLCQ

SEQ ID NO: 62095 - protein, 168 aa, Sorghum bicolor
  unsure (1)..(168): unsure at all Xaa locations
  Clone ID: 9855995.pep
TKGTPTEATLLELGLILQGDLYGEYNKLARVKVKPFNSVKKKMSVLIQLPNGGLRSFCKGALELILGQCDTFLNSEGNLAPLSEMQKQNVLNIINSFASEALKTLCIAFKDLSEIPDDHTIPXDGYTLIALFGIKDPVRPGVRDALMTCMAAGIKVKMVTGDNINTAK

SEQ ID NO: 62096 - protein, 108 aa, Sorghum bicolor
  Clone ID: 9855999.pep
AVPEEGGRDVRVVQGEGGEVEGQEGEREEDGLGGVPVGEVHPADRVRVLLRRLRAAWLRRGGFRVGVAQADVGPGRGGQDRERQRQLRQRHLFFFFLFFFSFFQKSLV

SEQ ID NO: 62097 - protein, 110 aa, Sorghum bicolor
  Clone ID: 9856005.pep
RQLVGLIRGKNTVHDIILWVEEQIIPTNGTEFALDVVSHTLLDMGSKSFTHLITVSERYNKIISKLCPNEEMQLLLMNGVSAYWKNSTQMTAIAIDRMMGYRLISNLAIV

SEQ ID NO: 62098 - protein, 161 aa, Sorghum bicolor
  Clone ID: 9856006.pep
HEDLFVSPWMGIVVNLQCELMKGKEFSRESEERLTAQLSRFRPLQATILGDEKDQPFCAIIEFAKYLSGFKDAMAFENHFILEHYSKPDWKKRNCRKDDLYGWIAKTDDFNSPGPIGEYLRKNGNLKSVADLEREGLKETGKRVVHYALQIEDTNEHMLEL

SEQ ID NO: 62099 - protein, 93 aa, Sorghum bicolor
  Clone ID: 9856007.pep
ARGTDIHVAARGGDAVALRRALSVAAAAVAATGEGPEDLEAARRAVAAEPNEAGETPLVAAAERGHLEVVVELLRHLDAEGLAAKNRCGYDAL

SEQ ID NO: 62100 - protein, 86 aa, Sorghum bicolor
  Clone ID: 9856010.pep
DDAGQRVALRGHHRRRAEQQLDGRLALGDGLRHPFANRYARLEAFGFCDLGAALRSVRKEDKMRPDARPGQRRAGHLAGAERRPSC

SEQ ID NO: 62101 - protein, 171 aa, Sorghum bicolor
  Clone ID: 9856023.pep
HEGFTTNLISYLTLQLHLPLVQASNIITNYNGTANLTPLIGGLIADSFAGRFWTITFGSIIYQLGMVCLTLSAALPSLHPPPCAKHAADCQRASSYQISVLYLSLLCTSIGTGGTRPCTMAFGADQLELNDAHSRHKPKWSFFNLYFFAVELAKLAAVTAVVYIQDNVGWG

SEQ ID NO: 62102 - protein, 145 aa, Sorghum bicolor
  Clone ID: 9856028.pep
TRAAAAARQQKTPPAETPTPAPVNEPERRAADAPSKPRPVSAPPPASTAKAADAVTAAPPAAALDEAGNLDRFLSSTTPSVPVHYLPKTSMRGWRIADVTNSRPYFCLGDLWEAFKEWSFYGAGVPLVLSGSESVIQYYVPYLSG

SEQ ID NO: 62103 - protein, 94 aa, Sorghum bicolor
  Clone ID: 9856036.pep
HEGEFLFSGLGYLRSRMSSQHTVVIEETEGWASNQLYDAARTYLATRINTDMQRLRVSRVDEGKSLMFSMEEGEEMADVHAGAEFRWRLVCRDG

SEQ ID NO: 62104 - protein, 152 aa, Sorghum bicolor
  Clone ID: 9856064.pep
ARGLAVFTITSYCLASFKSAGAPISIRWGSYPMVGKSDLDNYTFCAYCNKPKPPRAHHCRSCKMCVVDMDHHCPFIGNCVGASNHQVFVIFLISVVISCSYAAGMTIYASYKIWPSVDFPNLASNRHSMSFWKILLEIITTVAGSAFFLSAR

SEQ ID NO: 62105 - protein, 174 aa, Sorghum bicolor
  Clone ID: 9856089.pep
TRVTCFVPPDTEHPAARAPAAPVPVPVPETALDEEARAAAARRIAEKKARKRSERRTYLVAAMMSSLGFTSMAVAAVYSRFSWQMEGGEVPVSEMLGTFALSVGAAVGMEFWARWAHRALWHASLWHMHESHHRPREGPFELNDVFAIINAVPAICLLAYGFFHRGLVPGLCFG

SEQ ID NO: 62106 - protein, 46 aa, Sorghum bicolor
  Clone ID: 9856102.pep
RRSLQPSHGCLSTSPLFFFEKHQAAYLQVWRTKGEDELDGVLLPRA

SEQ ID NO: 62107 - protein, 45 aa, Sorghum bicolor
  Clone ID: 9856103.pep
FVALAWHRLRFVVLACSTGAYQVLDQHMVPWNEQVSAESMERLLV

SEQ ID NO: 62108 - protein, 131 aa, Sorghum bicolor
  Clone ID: 9856106.pep
HEADIVPSATPADQPIVPSASTSQRREIALKQVSYLIIILYFTNISSSNNPSPVLFQEQDSPDSLFSFAIEISNDEGEEASSSQAIGISSAEIRAKLEDLSSLLHQDTAQWVDDSDPAKALFKALRGQIPA

SEQ ID NO: 62109 - protein, 143 aa, Sorghum bicolor
  Clone ID: 9856113.pep
SSLVKRAAAAACSFTVTHVVTGESRRRTGGSGGGGRGGGDWERHVAARGLPRGDDDRHAGGLRPLAVCCCLPWLASCTGVCSLVIGTLVTWCSSLVVASLWRWNGEKHTNYRLLAESIFGPWGYWYVSFFQQVASVGNNIAIQ

SEQ ID NO: 62110 - protein, 103 aa, Sorghum bicolor
  Clone ID: 9856140.pep
TRNVQCPRDTHFWVYDDGRYEEEGQNNIKGKIWESALTRFACTLFSLPVPPGNSNGTRDEIPYTARTVPDYLDQKRIQKLLLLGPPGAGTSTIFKQVCSDSVH

SEQ ID NO: 62111 - protein, 61 aa, Sorghum bicolor
  Clone ID: 9856144.pep
RRRLLLTGDWRNGEVRCVAVADHTPQTTAVRARAWVVVATACRLQRRAVWLPQCLRRICLV

SEQ ID NO: 62112 - protein, 111 aa, Sorghum bicolor
  Clone ID: 9856158.pep
AAAASPATASSALSSLPLAARRSRRFTGEPSGIAAACLPACLPACLPSRMKRQRAVTEIPRQEGGRGADFSRPRRAPAWSVGDWRAQWLVRGARCGAGTGRGGAVPGSSLV

SEQ ID NO: 62113 - protein, 42 aa, Sorghum bicolor
  Clone ID: 9856165.pep
RLARDNIKDKDTSCSQFFFDSRFMRLMVKDYKLAKIDNENKD

SEQ ID NO: 62114 - protein, 32 aa, Sorghum bicolor
  Clone ID: 9856193.pep
WNPLLAFHSVAEIIRITIAYSVGQMFHAKKYT

SEQ ID NO: 62115 - protein, 80 aa, Sorghum bicolor
  Clone ID: 9856223.pep
PDLKEGLQRLIDPALGEDYPMDSILKMTVLARACTQEDPKARPTMRSIVVALMTLSSTSEFWDMNAIQENQGLVNLMSGR

SEQ ID NO: 62116 - protein, 47 aa, Sorghum bicolor
  Clone ID: 9856227.pep
QLLACAFDKIGSMTTNTITKERKKQETVVMAELDQRTRRLSSLKMDE

SEQ ID NO: 62117 - protein, 92 aa, Sorghum bicolor
  Clone ID: 9856243.pep
LLQIAGHKDILEGDPYLKQGLRVRNPYITTVNVFQAYTMKRIRDPSFKVTPQPPLSKEFADENKPAGLVKLNPASEYPPGLEDTLILTMKGI

SEQ ID NO: 62118 - protein, 68 aa, Sorghum bicolor
  Clone ID: 9856252.pep
WKTKGKADSHLHQIMLESQYFIVTKVKDIYITECKSASSNYINEPCLCVNPPKPIMAAMSGCTSTGLC

SEQ ID NO: 62119 - protein, 88 aa, Sorghum bicolor
  Clone ID: 9856268.pep
ARVWAVFMLVVAIKCYQQRMVEFGWSSSTVEDAQESAVNEAIGEEPRAKHRAQVQEFGAPVVPRHRRGPVSSEFARERLRVRGGIQPR

SEQ ID NO: 62120 - protein, 86 aa, Sorghum bicolor
  Clone ID: 9856352.pep
SILDPLLTSMVGSDFDVGQINSPQYNLQFILTAPTRSVHRLWRKFDDRFMRPMFGGRGFVPFVPGSPVERSVPEPHLGTVTEAEHS

SEQ ID NO: 62121 - protein, 110 aa, Sorghum bicolor
  Clone ID: 9856360.pep
RDKSVVWSWSDVGTPASLEDKHAVHAVVMQHGRSVCVINQYDDLGFLDLRSTAGGVRWRSRSKLLATGGKTKALVSEEVCYPKLATYGGQLFASTGDTVSVFSGPDHVLT

SEQ ID NO: 62122 - protein, 143 aa, Sorghum bicolor
  unsure (1)..(143): unsure at all Xaa locations
  Clone ID: 9856370.pep
TGNQPLSHAGSQVTHNMHIPLNYADAVIGAAGASISYIRRHSGATVTIXESRGAPGEMAVEIIGTAAQVQTAQQLIQNFMAEAAAPGPAPASNPPAPPVDPSYGSYPPPYGAPPYGSSVAARPPLQYNGGSYGGPTYPPRYGY

SEQ ID NO: 62123 - protein, 82 aa, Sorghum bicolor
  Clone ID: 9856394.pep
FAVKNFALLVLALPNHILFNRFMWDYVRQTDAKLLLTLPLNLPSIIMTDILAIRVLGLLGAMYSLAQYMISRRIRIAGMRYI

SEQ ID NO: 62124 - protein, 70 aa, Sorghum bicolor
  Clone ID: 9856413.pep
SLLATFLVQIVNRATRHGHQAGWLEATSLNSSRLDLFYWVVAVVGFLAFLNYMFWAKRYVYRHNPRIVVR

SEQ ID NO: 62125 - protein, 53 aa, Sorghum bicolor
  Clone ID: 9856445.pep
NQQVTYWIRILLMIHRGKKEATKTRKVLIHIISSRNHDTVKSLHFSHSGCASM

SEQ ID NO: 62126 - protein, 87 aa, Sorghum bicolor
  Clone ID: 9856446.pep
TAHANLMRKREEEDRNAQEITLRVFCKRQTTAGDNDGGGGGGGGGVAAIGESSRPRFLLLLLLLLRRHTPAATKATIEGDLSATFIS

SEQ ID NO: 62127 - protein, 62 aa, Sorghum bicolor
  Clone ID: 9856451.pep
NTVRVFLFLKAMFCEFKLLFSPEQSYCIFSNPKQKHKKRFHVAVDLVSNTFSSGLISSGTLS

SEQ ID NO: 62128 - protein, 105 aa, Sorghum bicolor
  unsure (1)..(105): unsure at all Xaa locations
  Clone ID: 9921261.pep
TRRRAGPGRGGAGGDPNXNPIAGREEATGGGRGGGMTRGKQKIDAQRRNAERNQKSKGSQLEARAVGLKVVCPICKVQLANEKQLIDHYGSKHPKEKPPSTSTTE

SEQ ID NO: 62129 - protein, 137 aa, Sorghum bicolor
  unsure (1)..(137): unsure at all Xaa locations
  Clone ID: 9921270.pep
XRXKTLSILNIAHSITRPVALRAARTILFTTWSLIGLWAVSQPLSPSRGPPRVYDQSSTCSGISSAGSISPGRCAVDPPWRSQTAQRRAPAQIPAPRQGAPLPRRLTDRQGITFTFTRTQSQALSQQRPVCHIQPNQ

SEQ ID NO: 62130 - protein, 78 aa, Sorghum bicolor
  Clone ID: 9921286.pep
AKRTGSSLNVQVQQHQQFTHLYVNKQMQRAAAAAAGLQQLMALSSSHCTVYTGVLCSIQSAVTGQRQVVYISLYVSCV

SEQ ID NO: 62131 - protein, 89 aa, Sorghum bicolor
  unsure (1)..(89): unsure at all Xaa locations
  Clone ID: 9921309.pep
LTSGTPTGPMPSSSARSPTRAAASRRHRRRPRSKPPPPSRPPRTGTPRRPPPSRPPLGQQGDRPRDAXAEAAAGGQRRRPPSPSLSPSP

SEQ ID NO: 62132 - protein, 201 aa, Sorghum bicolor
  unsure (1)..(201): unsure at all Xaa locations
  Clone ID: 18065185.pep
HEANAMQANANSLQQLKQQHQEHQMMQSQQMKQRQQMMHQIQQKQMLQQQLPIQQLQKQQQQGQMPVPQLHSGNDVNELKVRQGAAIKSGMYQQLSQRNYYHQQIKQGGVFPISSPQNLQASSPQISHHSPQVDQHSLLQSQVKTGTPLHSANSPFVPSPSPPVAPSPMPVDSDKPLSNLSSLTSAGQAHQXTSLAPQTQS

SEQ ID NO: 62133 - protein, 80 aa, Sorghum bicolor
  Clone ID: 18060869.pep
FVRGKAGASRSMLTCFLCSTFMVYHIYFSTWCLHSLVISYPRSFCIQSLHLYWPTIWYRVVGNRGCMVQSGREQRMLSIY

SEQ ID NO: 62134 - protein, 74 aa, Sorghum bicolor
  unsure (1)..(74): unsure at all Xaa locations
  Clone ID: 15724432.pep
MTTKTSSSDHLRYLLTDVPPQPNSPPDNVFRGDHRNALFXLNSRIPLVRTSSESVVRRPGKAPEGTVPGPSPGR

SEQ ID NO: 62135 - protein, 102 aa, Sorghum bicolor
  Clone ID: 15724461.pep
SLYTGQVMQEEPNKNYFSVLTVAPKVVNAAWELIRSFLIGYLAGPEYAEGWLMRLARVAGLVLPGLPPHSPRDYVNSTTLGARLLRTQADELNLNSHSTGPS

SEQ ID NO: 62136 - protein, 88 aa, Sorghum bicolor
  Clone ID: 15724472.pep
TWTTETYWDQQKSYLQVSILMKSSYLKSQLLYMPMMTLILQSKTIFLEGLSFGWRIPSLKMHEGMVLYVVVFLEVQRAKERHKGCLWA

SEQ ID NO: 62137 - protein, 51 aa, Sorghum bicolor
  Clone ID: 15724478.pep
IYRAIMAPSASMATPMYRATDSSPMLRREALGRPATAALLLVAALLSPVKV

SEQ ID NO: 62138 - protein, 76 aa, Sorghum bicolor
  Clone ID: 17886467.pep
LLKDFFFQETLILCTDKNIHPLENIPSPVSVLDATFYQDVMSPSLRGISNSFKSENFICQAILHTTLSTILGFQSI

SEQ ID NO: 62139 - protein, 53 aa, Sorghum bicolor
  Clone ID: 17886473.pep
MRRWSLRGPMSPSGPCSSSSSSFPGFDLFGYPLQFSMGVALFREFDTVPPLFE

SEQ ID NO: 62140 - protein, 114 aa, Sorghum bicolor
  Clone ID: 17886491.pep
MKASFYFRHIFLCQRRSREALRKVVGEPYRQVEARSVSRERVQIWFLLSKKKKTWMIPPRLARYSLFFFYSLFFWSLIKSLLTGPFSHDASFLSYTYCTFLVSHQLAGLAQAAA

SEQ ID NO: 62141 - protein, 47 aa, Sorghum bicolor
  Clone ID: 17886526.pep
GDIPLGKNLKGIPFIAALGFEIIAAYLMPPMEFGSVDFGEFEPQLVF

SEQ ID NO: 62142 - protein, 155 aa, Sorghum bicolor
  Clone ID: 17886528.pep
MRSEVTDSDKTNQATMKNKAAMLASKITCFNCHEEGHYAHGCPRKKSSGELGLHDVACPKKKPARELELCDITCFTCHKKGHKSNTCPKNCPKKGRCGELKLSDVICFKCHNKGHYMNGCPEKKPLGELELSDVICLKCHEKGHYTYSCPQLLFL

SEQ ID NO: 62143 - protein, 66 aa, Sorghum bicolor
  Clone ID: 17886533.pep
SQAEIIWPRDQIMLGRIVEILLVHSHGLLVPFRFFFSGSDIRHLMYIMCCVRYRRFGLHAGDHHLI

SEQ ID NO: 62144 - protein, 123 aa, Sorghum bicolor
  Clone ID: 17886544.pep
GICDVAPINESPCTVQQRRSNNNYKKSKSEGSLLHQELVVIPSLHSPERLILFLFVCYLTSCAVGCTGSLISISNGSLSIHPEKSSSSSSAAAAAGAAGFASIGLADFSSCTSEDSLVIIEGG

SEQ ID NO: 62145 - protein, 66 aa, Sorghum bicolor
  Clone ID: 17886555.pep
LPLVKCPVLVAWGEKDPWEPVELGRAYASFDTVEDFVVLPDVGHCPQDEAPDLVNPLVESFVQRHT

SEQ ID NO: 62146 - protein, 110 aa, Sorghum bicolor
  Clone ID: 17886561.pep
HLGEQGVGVAQPDPFRPEKVQGQQVQQANRGAEGYFVQAPGAGTDVAWRPQEGEGSVQGQCVFCITCAQFCFGGQKKRRLWDAFYLGLASICWYWHTPACIAISPIAINS

SEQ ID NO: 62147 - protein, 84 aa, Sorghum bicolor
  Clone ID: 17886570.pep
LKFFYKQLTSWTKNFDFLTFSPLSSIYSWGGYPFPMKPPTHQPGNMPIQTSAFQFHFRACILRLQEMLVPPKPIPSSKHVPSKP

SEQ ID NO: 62148 - protein, 76 aa, Sorghum bicolor
  Clone ID: 17886572.pep
RKSSSLILNLFKLMERSGIPDISADESGGLKLQEKFRLDLDDEEAIHFFQDLINESVSALFPQMVETIHRWAQYWR

SEQ ID NO: 62149 - protein, 114 aa, Sorghum bicolor
  Clone ID: 17886574.pep
IQTSTLPINMRSSWHRLSPSNSSHHMCPNIQQSNRLLQGVGQVAAACHLKNLDTVEGVDVDESTNCQRSIKLPAVRGGGATGTENLDEAAETVTANVLALSKTGGLVVAVVATA

SEQ ID NO: 62150 - protein, 152 aa, Sorghum bicolor
  Clone ID: 17886584.pep
SSKAPRLVYGSKAGEVFAAKYLAVSLCFMLAFVCNVQAIRLYAHASFLLGGLPPGLGGDGDEAEAQARGEEFACYVARTVNRGSYAWSLGLRAFYVSLALFLWTFGPIPMLACSVLMCGLLYFLDTTSSGDHGHVHGQQGTAGAGARKDSTV

SEQ ID NO: 62151 - protein, 87 aa, Sorghum bicolor
  Clone ID: 17886591.pep
LGDYKLIPYTAYDTFLPVVLAVKQAPGSLIIHALERRRRLGHRHGILGRRPAARPGVRRDDHRRRRRQSAGARRRRGDASERGVGRR

SEQ ID NO: 62152 - protein, 152 aa, Sorghum bicolor
  Clone ID: 17886610.pep
DNHDGSIDVPVEDGDTLLHLACLYGHLPCVQLLLERGASLECKDEEGAIPLHDACAGGFTEMVQYILNFAANKDGCVARMLDTVDSEGDTPLHHAARGEHLDVVKLLIEAGASPKKENTYGQTPADMADQDTEVRTLLTAKQIEASTHMSGN

SEQ ID NO: 62153 - protein, 46 aa, Sorghum bicolor
  Clone ID: 17886623.pep
LGILWAIQSILLSFFLEELGAFLPPAIEHFAMYLIEIEKLKRAVFH

SEQ ID NO: 62154 - protein, 133 aa, Sorghum bicolor
  Clone ID: 17886657.pep
SGGAGDAAAEAYLEREICDIVCGEGADRRERHEPLWRWRDRLGRAGLAAVPLGANALRQARMLVGLFSGEGHCVEEAEGCLTLGWHGRPLFSASAWRAAEENNQSDSCNADGSRSSGSGSGSGSEESNISCSS

SEQ ID NO: 62155 - protein, 135 aa, Sorghum bicolor
  Clone ID: 17886662.pep
RWPWRPRPTAAAESALRLLAEAARCGDGKAAIAADAAEVAAAVMGRMIRVGPTGREAAVVALWLCCCAGGGDRRMREAVASAPEAVGKLLVVMQGDCAPTTSRMAGELLRAVRMEQEKKGMAAAYDSRTIHVMPY

SEQ ID NO: 62156 - protein, 107 aa, Sorghum bicolor
  Clone ID: 17886684.pep
TRPILGIKFAPDQSVEQLGLSGVLVLDAPPNGPAGKAGLQSTKRDPYGRLILGDIIPSVNGTKVTNGSDLYRILDQCKVGETVTVEVLRGDHKEKIPVVLEPKADES

SEQ ID NO: 62157 - protein, 66 aa, Sorghum bicolor
  Clone ID: 17886701.pep
GGTIEHCTHDSDIQRDQGQLMHGGCHSVHKNSAKVNSSRDQNCYSYANPVIFFIVSGPPFGLPEGF

SEQ ID NO: 62158 - protein, 35 aa, Sorghum bicolor
  Clone ID: 17886703.pep
KPIWELEIYPGIRGHQTSTPLLISHQYKICSWKGS

SEQ ID NO: 62159 - protein, 126 aa, Sorghum bicolor
  Clone ID: 17886719.pep
DGLKYTQSHEWVKTADGVATVGITDHAQDHLGEVVFVELPEPGTTVSAGASFGNVESVKATSDVNSPISGEVVEVNSKLSETPGLINTSPYEDGWMIKVKPSSPGEADVLLDAAKYTKHCEEEDAH

SEQ ID NO: 62160 - protein, 87 aa, Sorghum bicolor
  Clone ID: 17886725.pep
PGEEEEEDVCAICLGEFADGEKVRVLPRCGHGFHVPCVDAWLLSRGSCPTCRRPVMDGKPKPAKGGGRGGGQSRRPPDSDTIAVVIA

SEQ ID NO: 62161 - protein, 80 aa, Sorghum bicolor
  Clone ID: 17886770.pep
RHAGPNHNRFPKAITGPGPGRDSGLRIFWPKQLISGIHFALDVANVAAWHLSVYSSWVCCKIYRGILILVRLYVCSYQNS

SEQ ID NO: 62162 - protein, 128 aa, Sorghum bicolor
  Clone ID: 17886775.pep
KIFVHITTTRKTRFQATSTYSIQRDAHFLQLSKSSLGFMFLKMPVTKAVLIIIVSCNMTFLFVLVRQSRPMHIHYQRDELRFSSTFHCIAFHPRLSVSSPYLIEISSFPLRPRYQVKIKGLNFYMRRG

SEQ ID NO: 62163 - protein, 40 aa, Sorghum bicolor
  Clone ID: 17886778.pep
IKYVSVGFDLGGKLKVISWNAKINQPINNDLHIIASPPTV

SEQ ID NO: 62164 - protein, 194 aa, Sorghum bicolor
  Clone ID: 18051743.pep
QRCKELHYLFVLLNTCYSHLPTSCGKVYWALLMWPQSRITMLLWARYKKSFITPLAQSCLVNDRINASRVNGIGLSEKTRLLAPGALHRISREMHREPRHSLLLRLLGRYHLLFILWMGPGCKAMLSTRNKPDFMLDILLALKNVLHSFDVRSLHLQIFFADRPGNTDSDGFDVIRNLDIGRMRNERSINKRFR

SEQ ID NO: 62165 - protein, 146 aa, Sorghum bicolor
  Clone ID: 18051753.pep
GTSAFKLWTDNAPVKTINTATRAPAKGASRELLPFCGINRVGGLDTQPDFEREDEVPDIDAIPELTMSQESNDSAESYDGSRKRIFDEEEDELVESRAMDVQSTRVMAIPVSRKGAGLRGFVSENQNSGTDFDEADFLVPEMDMAN

SEQ ID NO: 62166 - protein, 134 aa, Sorghum bicolor
  Clone ID: 18051758.pep
NYLAFRSSPLPLSVVFMAHPLFPPPSRLRPGKFLPPLACERVQSDDLYEPGFLLLLTSRVSLQLCRMRRGFRRALFSVYGSVMVVMEGWPAFTSRALEGCEREAARLFSAEPARMEEWRWMMSLAASNEKPSPR

SEQ ID NO: 62167 - protein, 101 aa, Sorghum bicolor
  Clone ID: 18051770.pep
IIDKTSCWHSQFRVRKSTSKFQQNLTRNTRVPKNMTIHADPHFYSSHRAGTAMPTPFNFQDQGKPTILQVMDSEHMLMSLAQTSVSVNLVLAELLVVVTWQ

SEQ ID NO: 62168 - protein, 92 aa, Sorghum bicolor
  Clone ID: 18051780.pep
YSPQTAALTRSTAAPAVEVTERAHAPCFSLLLSPLSLSLSLSPRCNSSNWQRWQAPCLCKKNRQACFLLLFSTDILDVSPADSLVYLFSICW

SEQ ID NO: 62169 - protein, 155 aa, Sorghum bicolor
  Clone ID: 18051782.pep
VRSRKPPPARAAEGQPDIVTGLAAELTNVRKTATVDLDVLTTSVSSLSHGLSRIKALLGTDQLAAGDDKGQRFVAVMAPFVCQAEEVIRELEDGERRVLAHVRDITEYYHGDVGKEEASPLRIFVIVRDFLAMLERVSKEVRGARGCHGSNQTLP

SEQ ID NO: 62170 - protein, 45 aa, Sorghum bicolor
  Clone ID: 18051785.pep
GKLASFVFNGVLKAYGEEAKFFPFGREAGPMPPKPVVLSNVGVVA

SEQ ID NO: 62171 - protein, 75 aa, Sorghum bicolor
  Clone ID: 18051786.pep
CLFGCISSLRGQYFAFPHNVSEFDITRSPRSFLDRFKFALSVTRSYRKMQTGPSMKKICLLLRLRRAGVVPHPMH

SEQ ID NO: 62172 - protein, 106 aa, Sorghum bicolor
  Clone ID: 18051804.pep
KGNEEIGVAVNTARKTRKKKWICLGICVAIIVVIVIIVLIYIFVIKGQNNNNNKKRSIEAAIGSLPVMHTAVLPARLARRVAADNTASLLNSVGGGRFHLPQLPRN

SEQ ID NO: 62173 - protein, 82 aa, Sorghum bicolor
  Clone ID: 18051808.pep
MATGTAPVAFDHLFKIVLVGDSGVGKSNLLSRFTRDNFTTEEKSTIGVEFATRIITMPDGKKIKAQIWDTAGQVTHTAGCTH

SEQ ID NO: 62174 - protein, 166 aa, Sorghum bicolor
  Clone ID: 18051817.pep
MKGALLTAAALLGSAQAGVHKMKLNKVPLADQLATNSVEDHLQSLGQKYLGASRPKNVADYAFATNTVNVEGGHPVPVSNFMNAQYFSEITIGTPPQSFKVVLDTGSSNLWVPSQQCGSIACYLHSKYDSSASSTYKENGTEFEIHYGSGSLSGFVSNDVVSIGDL

SEQ ID NO: 62175 - protein, 170 aa, Sorghum bicolor
  Clone ID: 18051828.pep
ARGGGQVSRVTKGMAVLDAGGAGMILANDRMDGEDIVADAHVLPATMITYSEAVSLYAYMASTANPVANISPSKTEVGVKNSPSVAGFSSRGPSGTLPYVLKPDIAAPGVDILAAFTEYVGPTELASDKRRSEYAILSGTSMSCPHVSGIIALLKAARPEWSPAAMRSAI

SEQ ID NO: 62176 - protein, 34 aa, Sorghum bicolor
  Clone ID: 18051841.pep
MEDEFQALVVDNGSGMCKAGFAGDDASRAVFPFI

SEQ ID NO: 62177 - protein, 168 aa, Sorghum bicolor
  Clone ID: 18051842.pep
MADSFRNAMINRSLGDIRNNLQFLVESNVITTAQHDAIAAQLPVSAENSNRTLPAVPTQQLSQMNIQSEPTPPPEKKASNVGYYADAPVNAPPPAYPSAPAAPAGPPVLCYASAMYQYNAQDAGDLALMPNDKVAVTEYMNNEWWKGRNERTGMEGIFPASYVRKEEK

SEQ ID NO: 62178 - protein, 192 aa, Sorghum bicolor
  Clone ID: 18051849.pep
TRLIFTSIISYLPASFGRTVAQAFQDGNYVGLLTIILSFFLLVLGIVYVQEAERKIPLNYASRYSSRTGGLQRSAYLPFKVNSSGVMPIIFSTSSLALPGTLARFAGLDFLKKAAIALNPGGALYLPTNVLLIAFFNYYYTFLQLDPDDLSEQLKRQGASIPLVRPGKSTAAYIKTVLSRISVLGSAFLAVL

SEQ ID NO: 62179 - protein, 128 aa, Sorghum bicolor
  unsure (1)..(128): unsure at all Xaa locations
  Clone ID: 18051857.pep
MGTWRYGVILDAGSSGTRVHIYRWLNSDTARKSASKAQLQSLPEIETDKQWTKKIHPGISTFGEHPHDVGPEHLEKLLGHALSVVPAAEVPNTPLFLLATAGMRILPPLQRXTILKEVCDFARKTTKF

SEQ ID NO: 62180 - protein, 190 aa, Sorghum bicolor
  Clone ID: 18051859.pep
MAAQKHTIVVTGAILRPKDNIDPTSPPPRLNIVDLIKNDIQWSLYLRALLHLQSLNGRQKDGSVEPMSWFGLASIHGSPRVPWDNAELRRHNNEEVNYCAHGVVTFPTWHRAYMAVFEQAIQQAAVEIAHDLSSEWKEAALELRAPFWDWALQPVPPEEVFQDLEITIARDGGDPEVVRNPLYLYEFHDG

SEQ ID NO: 62181 - protein, 61 aa, Sorghum bicolor
  Clone ID: 18051867.pep
HSSNSRYISRVFQQVHKFDQLNQNIKENAITFNEALRPMLYSPYICSSMYNQENRPSATRI

SEQ ID NO: 62182 - protein, 153 aa, Sorghum bicolor
  Clone ID: 18051870.pep
HEESHHSPWSPKVAIVYYSMYGHIQKLAEAEKKGIEAAGGQVKIFQIAETLSEEVLAKMHAPPKSDYPIAEPTDLLEYDAVLFGIPTRYGNFPAQWKTFWDKTGSIWASGGYWGKYAGVFVSTGTLGGGQESTVIASMSTLAHHGFIYVPLGY

SEQ ID NO: 62183 - protein, 180 aa, Sorghum bicolor
  Clone ID: 18051872.pep
TRLARSRASPAALSRGWQATAARAHVAQFHSSRLLQAETVKVPQMAESISEGTLKSWTKQVGDSVSADEEVATIETDKIDVQVNAPMAGKIVELLASEEDTVTVGQDLFRIEPGEGGESSSSSSSEPKEESTPKEEESKPEKSDKTEPADQQGVDKSVPEAPKPSKADKKAPPPPDAPSA

SEQ ID NO: 62184 - protein, 159 aa, Sorghum bicolor
  Clone ID: 18051876.pep
ARGLVPRKCGVNRYEKTGVCLIGAETVKVNTIAPHFGEEPCLQGHSGSGAVFFSGCNLRCVFCQNHDIAHQRNGFDLTPEQLGEWYMKLQEVGRCHNINLVTPEHVVPQVVLSILHARELGLRLPIIYNTSSFDSLESLQLLDGLVDIYLPDFKVWGNE

SEQ ID NO: 62185 - protein, 198 aa, Sorghum bicolor
  Clone ID: 18051880.pep
MKYGTGDRQLMSSRHRYPVPASGQLATGSSSYTANSSVQSYHAMGSSRSPYVAPGSISSLKFHSSPNLPSQAAGTHFHIFSSGCMLDFVTPAELSCETSLSSLELDTLRWQKLAEGRDLYSPNYRWHYCTMNPEGTHAWLLGSPVESANDGNHNGEYLSDVLAIDLRKYGILGNELASDTRSKMMPSSDANVSSHLSG

SEQ ID NO: 62186 - protein, 51 aa, Sorghum bicolor
  Clone ID: 18051885.pep
KIGLHQCWLVTQTGDNVMLSPLICAGGNNHSHFCKRFIRRTDGENHFTNDS

SEQ ID NO: 62187 - protein, 56 aa, Sorghum bicolor
  Clone ID: 18051889.pep
MQKRLDTENVIDPLEGMPASDKWGLKGLTTVMNNYPDYHAMVEGMDPNSLGLDINS

SEQ ID NO: 62188 - protein, 76 aa, Sorghum bicolor
  Clone ID: 18051890.pep
MASGGSSSSSSRAWTQRQNKQFECALAVYDRETPDRWHNIARYMGGTKSADEVRRHFEQLVHDVTQIEAGRVPFPR

SEQ ID NO: 62189 - protein, 177 aa, Sorghum bicolor
  Clone ID: 18051896.pep
MRCSPQLSHRDFVAVLSRCSTRAHLEQLHAHAFVAGRAAAQTTTFHLIRFAAFRLSCLTYARHLFDATPHPSVFLYSAILSAYVSAAATASSYAHAHAHARDALALFLRMLRHGRPAPNQFVYPLVLRAASGVGVGIVKSIHSHACKSGFCGHDIIRTSVLDGYSRHGMMADARKLF

SEQ ID NO: 62190 - protein, 37 aa, Sorghum bicolor
  Clone ID: 18051897.pep
ARGSVNTIRFLAIDAVEKANSGHPGLPMGCAPMGHIL

SEQ ID NO: 62191 - protein, 149 aa, Sorghum bicolor
  Clone ID: 18051898.pep
MERFRNLLGGGGMGLGGVTPGTDNTSLIDNSETVYISSLALLKMLRHGRAGVPMEVMGLMLGEFVDDFTVKVMDVFAMPQSGTGVSVEAVDPVFQTKMMDMLRQTGRPESVVGWYHSHPGFGCWLSSVDINTQQSFEQLNPRAVAVVVD

SEQ ID NO: 62192 - protein, 162 aa, Sorghum bicolor
  Clone ID: 18051901.pep
ARGGNDYNSPLFAFRPISEAHDFVPHVVESIGSGVEKLIAEGAVELVVPGVLPIGCFPVYLSIFRKQADGYGGRSGCIRDLNTLSWVHNAALRRKVEELRGRYPDVRIVYADYYTPAIQFVLHAEKYGMLKQTPRACCGAPGVGVYNFNLTSKCGEPGAYAC

SEQ ID NO: 62193 - protein, 71 aa, Sorghum bicolor
  Clone ID: 18051912.pep
TPAPSQSLLPPPTNSYCTCSDPLTNSPPGMTCLCVLPIKVELRFGIALYTFFTLVPELAQDIACGVVMNQR

SEQ ID NO: 62194 - protein, 171 aa, Sorghum bicolor
  Clone ID: 18051913.pep
HEAPIETSQKFAPHQKAKLPEPYDFRVPEKVEVEKLNGKYKKAADFAEKRLHVLNKIASELLDGEEKFLDEENKLIERAIEFIVESEHKFKELIEKEEDQKAKLEVALNSRIYEFQDAQGKADVAREGIKKVEDEIKQEANELVGLNKEKENAAGEIEKIMTQFKNIKLRE

SEQ ID NO: 62195 - protein, 100 aa, Sorghum bicolor
  Clone ID: 18051923.pep
MAAKTTVTITYRRPGTQPPIFIAGEFSDPPWSPQEMDYTTDEDGEHTFKKDIEAYAGSSVQYKFRVGLGDWWVLNENAPTATDSAGFLNNVAEMPAVIDA

SEQ ID NO: 62196 - protein, 107 aa, Sorghum bicolor
  Clone ID: 18051924.pep
LSVVQCIGAEKRLRRVLLCQVPSCCRHPPFSLGVQGVAKEAAVVALLAKSLPRSREGKRKRPRPHGKQSIWRNKIMPSAVAYLWQEGNHAGIRQFLRGSQGKHLFLS

SEQ ID NO: 62197 - protein, 142 aa, Sorghum bicolor
  Clone ID: 18051933.pep
HEDKPKPAPPPPPPERPRRRAAAAGGGGGGADETPQCRVVTPLVSEPEAPAELPRWQLRCMWELGSVLNFLHVFRPLLNITAEFTAEELEAALITPNEILDDVHMPLLKSIPPVTRMAMGRGTWVTVLCRKLKDWWHWVAEG

SEQ ID NO: 62198 - protein, 165 aa, Sorghum bicolor
  Clone ID: 18051935.pep
MSKPLAFGLNFSKKPGASKPPPPKRRPMFGGDDDSDDEGTVREGKAEEIGEFDNLSRAQAAKANITKLGKLKSGPPTQPPKLKSKGQPNVMFGDLSSSLASRRNAEAATEVDASVYEYDSVYDSLKPKKLVTKEDQEKQPKYMKNILQAADVRKRDALIAEEKKI

SEQ ID NO: 62199 - protein, 133 aa, Sorghum bicolor
  Clone ID: 18051942.pep
MILRKTRTHHTGNSNLASRPETARPMTQSGQNRLDFLSTAKGKFFDATTTKTPRNAQTPFEQTRTFYDQHGKPQRVKTQVSFPRNLLLEDPEKMKMPFTGESHLIHDKNLEKYRDYDSPAFVDKIKKEVLGTA

SEQ ID NO: 62200 - protein, 175 aa, Sorghum bicolor
  Clone ID: 18051944.pep
ARGENRPNKPIYHCSDCGICRRGMGLGKDFFHCKTCRACITTSIESSHKCIERSTDCDCPICGEYMFTSPKRVVFMVCGHSIHKKCYEQHMKSSYKCPICNKSLVNMETQFRNLDLAIMSQPMPPDFRDTKAKILCNDCSARSTVAYHWLGLKCSICRSYNTVELQIMGRNIEGL

SEQ ID NO: 62201 - protein, 149 aa, Sorghum bicolor
  Clone ID: 18051945.pep
TRVWTKLGGKAFSRINRSVVALASFNGEKRNFACTGFFIGWNGSTKILTSASLIRNSVDENNIVENLRIEVLLPSSTEIINGTLEHYDLHYNVALVSVKNRHNLRPANTLPSWSMCSDVAAVGRCFKSHALMAMNGKLISSTSALDCCL

SEQ ID NO: 62202 - protein, 106 aa, Sorghum bicolor
  Clone ID: 18051948.pep
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKI

SEQ ID NO: 62203 - protein, 91 aa, Sorghum bicolor
  Clone ID: 18051959.pep
MLSRRFARAAAVTPLAGVRALSSTAILNGRTPSLGDVNPTHAEVDKFSQKQKEFRDHLVEAQKKREARRSEEVKEPEPSRKAGPLTNLIYG

SEQ ID NO: 62204 - protein, 176 aa, Sorghum bicolor
  Clone ID: 18051975.pep
MADAPQAAEAPSKNALKKAQKEKEKAEKKAAAKARELAERQKKEAADAEDVSKDLYGELPLNNSKDSDVTGIPRVDLSTASEHEDKEITFRCWVENARVQSAKLAFLNLRQNLETVQAVIAANDKISKQMVKFCGSVSTESLLVVTGLVKRVKEPIKSATIKDFEIHIQKLFVEAV

SEQ ID NO: 62205 - protein, 153 aa, Sorghum bicolor
  Clone ID: 18051976.pep
ARGATPPDLASCVQPPPDLQPASQAPPVSDRPVSGRSGRYGLRGGSRSRRARAMPRDLSRSRSRSRSPRRRRRRSPSPARYRGRRGRRDRSRSPIRSRSPYRPSYRRRSPSPSPRRRKSRSLSPRRRKSPSPSQKRYRRKRSPSVTSSPVTAS

SEQ ID NO: 62206 - protein, 121 aa, Sorghum bicolor
  Clone ID: 18051983.pep
MDRSGEASHRGRSSYSGRGWRGRGRGGGRPSPSPPSSTGSPAALNPTPTPAVPVDDAAPIVGTCPDMCPARERAQRERLRDLAVLERVGGDPTRTSPSLAVKKFCRTISSTNILPSDIRPL

SEQ ID NO: 62207 - protein, 123 aa, Sorghum bicolor
  Clone ID: 18051989.pep
HEAKRGNDSLWPSDPSPAEIEQAKIVLHKCGGLPKVIVAVADFFAAGWRFNPIHLMKVLETNPAFTCLRDMFAWVNSYFVSCPDSLKPCIFYLSIFPVNHKIRRRRLVRRWIAEGYSTDTKES

SEQ ID NO: 62208 - protein, 132 aa, Sorghum bicolor
  Clone ID: 18051990.pep
ARGSVVAVELTIPHRFYISSPPHARTPVRRRRNHTRDLFGSPPPSTFPPRLFHPPHHTSSDARRGRRAAAAASAAGGGGAGAPGPAGGRATAGSRSLGAVPHAALGVRRVRAAGSRGRRRPRTIRVRRRQRR

SEQ ID NO: 62209 - protein, 105 aa, Sorghum bicolor
  Clone ID: 18051993.pep
LTEPPMNPLANREKMVQVMFEKYGFKAAYIAIQAVLTLYAQGLLTGVVVDSGDGVTHMVPVYEGFSLPHLTRRLNVAGRDVTRYLIKLLLLRGYVFNRTADFETV

SEQ ID NO: 62210 - protein, 136 aa, Sorghum bicolor
  Clone ID: 18051994.pep
MTESSSANGHDALEEKLGRLSKKPGVKASIILDRTTGAILKTSGQIDALQTSKTRTTSTATSFSNEGPALEESETKGVEQFAANVWNYVNSSGSLVQELDGEDELKLLRLRTRKQELVVVPDPKYLLVVVHDTPPA

SEQ ID NO: 62211 - protein, 113 aa, Sorghum bicolor
  Clone ID: 18052040.pep
LLCFKTSSDKKYTCIAIFHILQLMVAVLYKWLNCGYTQWKIVPLIHHWVTRLTLLIEEAMLPNAGKKEIRPDGTQCRKRKGTKKIKNIEKHIKEERSNNYVSKLPMVVYYKCW

SEQ ID NO: 62212 - protein, 179 aa, Sorghum bicolor
  Clone ID: 18052043.pep
AFGLLIRYRGNPSSDNKSGVIGAQILLGIAGGMFPYPAQASLQAYVTHERLAVMTGLYLALYQVGSAFGNAVSGAIWTQVLPVRLAQSFSSFGNETLAVYAYSQPLSAIIDFPVGSPERDAMIDAYKHVQRLLTITGICLCVPLIAFSLCLRNPKLTDQQNLVEDEKPGAATERSSASA

SEQ ID NO: 62213 - protein, 102 aa, Sorghum bicolor
  Clone ID: 18052045.pep
AAYLARWIAKSLVNAKLARRALVQLSYAIGVAEPLSLFVETYGTSEKSSDELVEIIHKNFDLRPGVIVKELNLIDPIYFQTAKNGHFTNQSFTWEKPKELKF

SEQ ID NO: 62214 - protein, 166 aa, Sorghum bicolor
  Clone ID: 18052046.pep
SPQQPRAVIRRISIQSLILHTCLSCTILGRVCGNTHKTIRSSKDKNVKHPLHRNRHPTEKVRRQGAGAPEQQRSGNRRTKQRLCVYILVVANRLEESNSTHGKESQDGADTLTDRDDDNIITRRLATLLANGGLNIGSDVPRVEAEAGGVGSLAGLNDGTGSVAAG

SEQ ID NO: 62215 - protein, 102 aa, Sorghum bicolor
  Clone ID: 18052047.pep
PRHLVNNANLGRLINSDEIQSVVRAGKYVSYRRHHKKNPLKNLGAMVKLNPYTLVARRAELRAEALRKEKKASVVSKKRNTVKSDPKRKEQSRALFAKNASD

SEQ ID NO: 62216 - protein, 190 aa, Sorghum bicolor
  Clone ID: 18052050.pep
RGEFESSIEAGLDGITFNAKSNSRETLKSSMEARLARMEARLADTETSLADTKARLVNTEARLEKVINWVETMETKFMSDLQAVREQFRERTKKRFNYFLEQFLNSTRLDDAIDGRLEDRIDDLRTEILELFHDKERDFEKGLEELFENKFSEVREFFEDKLSGVEETFGMKLEECVADTTWEVRFNKKK

SEQ ID NO: 62217 - protein, 121 aa, Sorghum bicolor
  Clone ID: 18052052.pep
AEGDYVGEYAGECIAAKEVSARERVVVAAGTSSYLFNLNAGTDGLDADRLGNKLRFVNHGGDRSNLHVTTRIVNGVQRIAFFALCDIPLGTELLFDYGKHYPKLTPLSPQVIRGMKTKEEV

SEQ ID NO: 62218 - protein, 47 aa, Sorghum bicolor
  Clone ID: 18052053.pep
WTRSGGAPPPPPGSLCSRGSCSPGGPSAEAIIPGLLIPAFRFQFVRG

SEQ ID NO: 62219 - protein, 39 aa, Sorghum bicolor
  Clone ID: 18052054.pep
LLKSDPVQNSEYIESCNNNKLKQKSQEDHFVPVMKIIPL

SEQ ID NO: 62220 - protein, 84 aa, Sorghum bicolor
  Clone ID: 18052060.pep
LPANGYLVLAFESDNPGAWLMHCHIPFHVAAGLGVQFLERESEIKARDGFAEMKRTCDNWSSWRYQFHPNGILFPGDSGLRRRH

SEQ ID NO: 62221 - protein, 124 aa, Sorghum bicolor
  Clone ID: 18052061.pep
PGQPSVPTLLSPPCATEQLNNLLPFFPVHIMITTLSFLSLILFINPRAHARTHLILEVVFRSLSQWILLLTIDGYCCWLMGLPPWVSRHMYAWEDYNEPLFFCFFYQLSRASYADDNYEHLFHA

SEQ ID NO: 62222 - protein, 170 aa, Sorghum bicolor
  Clone ID: 18052063.pep
TLSELAGEGHGVLVDGDDRHQRVPVVDANVPPDTEGATRGEEQAQEVARHAFQHVPQRVEVPHSDARAIVTLHQPAHKGEQENAQRSLPQRSHSSFVQRMSVLAVKPRALQPEPCDGERTKHGHQRNHLIVAQKNHDEADQRRIDAQADSKLRFGGMEGHGSLALARQRG

SEQ ID NO: 62223 - protein, 117 aa, Sorghum bicolor
  Clone ID: 18052107.pep
MATTLTALLKEAAAAFPARRAVAVPGKLELTHAALDALVDAAAARLAVDAGVLPGHVVALAFPNTVELVIMFLAVIRARAVAAPLNPAYTQEEFEFYLSDSEARLLITNAEGNAAAQ

SEQ ID NO: 62224 - protein, 112 aa, Sorghum bicolor
  Clone ID: 18052159.pep
HHQKFRRNQETHGQETRTAALITHSPNPGQLPGSNKDDAFSAAIKNHQLNDEKSQEKALTLAHGHLQRSSSFQAPMERGGRGNPRTKSKWSPQFPTEALKLAANKQELKVQV

SEQ ID NO: 62225 - protein, 177 aa, Sorghum bicolor
  Clone ID: 18052165.pep
TRDDVAIKILFCGMCHSDLHSIKNEWGNAMYPMVPGHEIAGVVTEVGKNVTRFNPGDRVGVGCMVNSCQSCDGCAEGFENTCGGGIIFTYNSVDRDGTVTYGGYSSSVTVHERFVVRFPDGMPLDRGAPLLCAGITVYSPMKYHGLNKPGKHVGVLGLGGLGHVAVKLAKAAFGMKV

SEQ ID NO: 62226 - protein, 51 aa, Sorghum bicolor
  unsure (1)..(51): unsure at all Xaa locations
  Clone ID: 18052171.pep
MRECISIHIGQAGIQVGNACWELYXLEHGIQADGHMPGDKTVGGGDDAFKT

SEQ ID NO: 62227 - protein, 159 aa, Sorghum bicolor
  Clone ID: 18052222.pep
HEACAGSGLSDAISLLEPLTSDVVDFVRQGALIAMAMVMIQTNESFDSRVGAFRRQLEKIILDKHEDTMSKMGAILASGILDAGGRNVTIKLLSRNKHDKLTAVVGLAVFSQFWYWYPLLYFISLAFSPTAFIGLNSDLKVPKFEFLSHAKPSLFEYPK

SEQ ID NO: 62228 - protein, 93 aa, Sorghum bicolor
  Clone ID: 18052255.pep
VTKRNRASSRRRKSANLPTEGVPNAATDLNLPCAISEARVVDAGSMDKGRRKSTPRPKQLIMSEGDADKNSTFTRLANCLSFARMKGINRNKR

SEQ ID NO: 62229 - protein, 63 aa, Sorghum bicolor
  Clone ID: 18052257.pep
GGLGSLTVGLVSRAIHWGIVKAGFRVFYLFIKLPGILYLGGFKEPRLPGKPLGFVAKLLEKLS

SEQ ID NO: 62230 - protein, 61 aa, Sorghum bicolor
  Clone ID: 18052284.pep
FSIYSFSTNAHHTHGQKRTNFPPPQGVYLISHQWRGSPLPGQSVDLMSHRCSYLSVVDLDS

SEQ ID NO: 62231 - protein, 113 aa, Sorghum bicolor
  Clone ID: 18052302.pep
ATSYQKTGHRIENPAAHQFQPNQYAPSRASSTIPTVSFIRSIRCSCCLISDILNFLSFSSTALAFDFSSTPNAFLNIGPLGCSFDSSSTASHRYGYICFPFSVSSLPLPSPWL

SEQ ID NO: 62232 - protein, 124 aa, Sorghum bicolor
  Clone ID: 18052303.pep
SLAARFPNSAFVNKSYAVKVPGVPASWSYRLNLQRVCFRTAYVASTTGLALLFPYFNEVLGVLGAVVFWPLAIYLPVEMYCVQRGVRPWTRTWVALQAFSAVCFVVGTFAFVGSVEGVIRKRLG

SEQ ID NO: 62233 - protein, 146 aa, Sorghum bicolor
  Clone ID: 18052333.pep
YSTVIDGLGKAGKTDEALELLNVMVNKGMSPNTIIYSSIASALSKEGRINRVIQMFDNIQDVTIRSDAVLYNAVISSLCKRGGTDRAIEFLAYMVSSGCMPNESTYTILIRGLASEGFVKEAQEMLTELCSKGALRKHFMKHFGIV

SEQ ID NO: 62234 - protein, 51 aa, Sorghum bicolor
  Clone ID: 18052345.pep
LVRNLTCDQTCLETCKEHYYFTLYPCQYSILILQKNRTFIVHAGGGVTSCS

SEQ ID NO: 62235 - protein, 61 aa, Sorghum bicolor
  Clone ID: 18052366.pep
AAAAGRPTLASTVRGLLKEGGWAACYRGLGPRWGSMSLSAATMVTTYEFLKRLSAKDGSLG

SEQ ID NO: 62236 - protein, 133 aa, Sorghum bicolor
  Clone ID: 18052377.pep
CDSQGVRDIYEADGADTIAASEPLVVLVNKGTASASEILAGALKDNKRAVVYGEPTYGKGKIQSVFGLSDGSGLAVTVARYETPAHTDIDKVGVIPDRPLPASFPTDEDGFCSCLRDSTAACNLNAAQLFARS

SEQ ID NO: 62237 - protein, 96 aa, Sorghum bicolor
  Clone ID: 18052399.pep
LKATKESMAGGWLHTGDLAVRHPDGYIELKDRAKDIIISGGENISSIEVESVIFSHPAVLEAAVVARPDDHWGETPCAFVKLKDGASATEAEIISF

SEQ ID NO: 62238 - protein, 179 aa, Sorghum bicolor
  Clone ID: 18052406.pep
MIHCCVQKLIDGGGKTVVVSGLTPMGCATGNLVLFAGQNATADYEPATGCLNDLNLLSKEHNQQLRQALARLRARRSGVRVRIIYADFYAPIEDFATSPDSYGFNGTDGALNACCGGGGGRYNFNLTAACGMPGVSACSDPSAYVNWDGIHLTEAANRRVADGWLRGPYAHPPILDTHC

SEQ ID NO: 62239 - protein, 101 aa, Sorghum bicolor
  Clone ID: 18052408.pep
EPWDDRHGGGSGDGRGGCVLAGLAVGNKWTRCPSCRAMIDKIDGCRRMVCRCGTSFCYVCGSPVSEKGSRCRCFFGKREDPALTLQKAGLECKSGVSIDKC

SEQ ID NO: 62240 - protein, 107 aa, Sorghum bicolor
  Clone ID: 18052426.pep
SDVKEFSEVLASKSGGVYEVACEHAHSCCVLLAKVDKFKINGKWHTWIDYDRFHELVTSGKPFKSRDYMAMTPSWAVYGAEEGGFDPDQSRFKKERRHGTAAHKSLS

SEQ ID NO: 62241 - protein, 115 aa, Sorghum bicolor
  Clone ID: 18052443.pep
HPVFINVWAICRDAKYWEDAEEFRPERFENTNLDYKGTNYEFLPFGSGRRMCPGANLGLANIELALASLLYHYDWKLPDGVKPEDVQVCEGPGLIAKKKTGLILHPVTCIAPADA

SEQ ID NO: 62242 - protein, 75 aa, Sorghum bicolor
  Clone ID: 18052449.pep
GADLLNVPFCFSSMMSMASALTNHWVVSGSSRHDMSNRSDDCFKVLTWNHNVIKGKQFLPREKVALTGWQITRAV

SEQ ID NO: 62243 - protein, 115 aa, Sorghum bicolor
  Clone ID: 18052541.pep
ELSSENCFTPLNRRWDMWVFLLIQIAQQKRMMLSIKKLWLICALRNSRFCIGCIPELTDRLMDCQASNANWQPINKCSIDSSTINKCSLITNQQTILSVTAFQPCIYDIYMSQTI

SEQ ID NO: 62244 - protein, 67 aa, Sorghum bicolor
  Clone ID: 18052560.pep
KTCHGTIASFFVDNSTFFFFLLFTCLQVDMAALKQMGESDLKDMGVPMGPRKKILLAVGPQLKQRHK

SEQ ID NO: 62245 - protein, 77 aa, Sorghum bicolor
  Clone ID: 18052570.pep
RLRSQLQNYSVVGRYLSHKPAVSARLGTQARQFTAQQNCCNTKIFLFPSTPCLFANIIGDSRTVVASLLILIIFCFS

SEQ ID NO: 62246 - protein, 44 aa, Sorghum bicolor
  Clone ID: 18052600.pep
AIREWLDSGHRTSPMTNLELSHRDLLPSHALRSAIQEWLQTNGD

SEQ ID NO: 62247 - protein, 72 aa, Sorghum bicolor
  Clone ID: 18052611.pep
WTRHLLSLACAREVVLLCCSFIDHCGLQWAVGQQLHNAHNRKRPMLCAPRLAMHARNASLCSINIVRLHIIV

SEQ ID NO: 62248 - protein, 83 aa, Sorghum bicolor
  Clone ID: 18052628.pep
VNQKNNNAWYLHASHAYIYDYMLLCLPTYNKVMVYVKYACADMLLLFVLNPRRFVLVRVGTAAASCSSRHHQIVVVWSTLSRQ

SEQ ID NO: 62249 - protein, 67 aa, Sorghum bicolor
  Clone ID: 18052644.pep
CSTHYQPQFASEYSKLYIWSSKFMLSFVVINVYIGSALVHDSSWHMLFQLIQILTYSTCINFTSFPS

SEQ ID NO: 62250 - protein, 128 aa, Sorghum bicolor
  Clone ID: 18052649.pep
MYQPYNARYGPYNGYMPQPVPAQPYFPAPYFAVGAYPYGSGYPSQGVMTNVPGMMSRRIPPAYGTYPQMYPGFNLLYRAGYGGAATSFQHGINGGSDNKKDQTSVDMQQVDNTSSVATMLEHMKLGSQ

SEQ ID NO: 62251 - protein, 86 aa, Sorghum bicolor
  Clone ID: 18052657.pep
YVGGTVVRAMPHVYDVIRRQGYVPSLKPSNVYASPLDDRFGVAWDIVVPCGAALLAVLLFLQQRLRSSDTLLFRSRRTGEYQMVST

SEQ ID NO: 62252 - protein, 105 aa, Sorghum bicolor
  Clone ID: 18052667.pep
HELVLTTKEYMQCVTAVDPQWLAEMGPMFFSVKETDTSLVDHKKRQKEEKTAMEEEMEKLRQEQAEAARMEKEKEREKRAKQQQQVAMPGLKKGATYLRPRKMGL

SEQ ID NO: 62253 - protein, 137 aa, Sorghum bicolor
  Clone ID: 18052711.pep
ERARSRPAIHSEQQTPWLSSSSRSNGNAGYSNPTRRHLPPPVDMSPTNANHSNHGVPLLNAERVQASLRKSLSFLVHLTAKFPLVFIFLLIVLYAIPASAAVLLLYVLITVLFALPSFLILYFAYPSLDWLVREIFA

SEQ ID NO: 62254 - protein, 162 aa, Sorghum bicolor
  Clone ID: 18052733.pep
GEATVSGRSKKQGEENLAVSNIANISAGLDCVSANTDLSTGSRRSRRVSSGRRSKQHTEGNNIAVPDDLNASSSAPSSSRKRKSTTGNSVAAKKRLRVSISVSADNEVETNKITNSVAVGEEGVVKKRRRRSKLVCNEGADNEVGANKIMDSVAVGEEGAVK

SEQ ID NO: 62255 - protein, 117 aa, Sorghum bicolor
  Clone ID: 18052738.pep
ARGDGRRRCRLPVGAHARPWPWPPRRRPRLSALATSGSTSPAPPACPWPPPLPPPLHRSGAAAGSPSPRAPKLVQGLGRGPGPGTWRRSGPGCPCTSRAPTTCSSLTPRAPSPAPST

SEQ ID NO: 62256 - protein, 66 aa, Sorghum bicolor
  Clone ID: 18052748.pep
YPLQRLPVSKQQFIETVKISSGLKQPNTSQTKKRGIVFYSSIRMHVRFTSAEQTRSSSVPSSKTYS

SEQ ID NO: 62257 - protein, 128 aa, Sorghum bicolor
  Clone ID: 18052762.pep
ARGKLVVSSIQDVARKLGDYAKIVSVSTNYGTKDPANSTEMLSSDSRNDVFVPEDLFLPGTLYYLQRDIEDINGVEDESYMLWKGDPGENFQRILLSGNLISDHRCESIYYALRDVLKTLPPSQAQDE

SEQ ID NO: 62258 - protein, 119 aa, Sorghum bicolor
  Clone ID: 18052770.pep
MLVRLGFVVVASVAALTLQRANNGGRHNKDNDQARKREDKARNSEHGEREEEDGEKEEEEEVKTISGIINSARSLDDDDDDMLSEIESLLSGDIDIPIPRDRFDVNGRPRYNAYMANEA

SEQ ID NO: 62259 - protein, 191 aa, Sorghum bicolor
  unsure (1)..(191): unsure at all Xaa locations
  Clone ID: 18052776.pep
HEGILHLREMELKRQAVDSSYGRKTYMAYIAEGLGSMVDWDEVMKFQRKNGSLFSSPSTTAVALIHKYNDPALQYLNLLVSEFGSSVPAMYPLKIHCQLSMVDALERMGISQHFVSEIESILDMAYSLXCWLQKDEEIMMDKATCAMAFRLLRMNGYDVSSDVLSHVAGPSTFHDSLQGYLNDTKSLLELY

SEQ ID NO: 62260 - protein, 141 aa, Sorghum bicolor
  Clone ID: 18052781.pep
TNSSPPSPAWPRSARPPPPARGRRLTPPTARRARPPTATAAELPPLPPAPDPDPAPSPLAPTPALASPHPTPTPMPAPRPRGAPTASVPPATTSTPTRTRTPAPAPAAAPLPRGVAANVPQASTPTPTRTLTPLAALRPRG

SEQ ID NO: 62261 - protein, 164 aa, Sorghum bicolor
  Clone ID: 18052782.pep
TRVGRRAAGNIWTCFAHIITAIIGAGVLALSWSVAQLGWVGGPIAMLCFAFVTYLSAFLLSHCYRSPVHSDDGSQKRQRNYTYMDAVRTHLGEKRTWLCGLLQYLNLYGTAIAYTITTATCLRAIVRANCYHSRGHDAPCGAGGDHLYMLLFGAAQVVLSFIPN

SEQ ID NO: 62262 - protein, 197 aa, Sorghum bicolor
  Clone ID: 18052787.pep
ARGKGDRKPDVSDLPHYTLGGGVCTFPDFLKAELKSSLDHLNNPCIADSREGWYHPRSIKEYYELINSCFFSDSVKVVVGNTSSGVPGYKDQDLYNKYIDIGGIPELSNIVRRESGFEIGAATPIARTIEILEEECESISSPNGSVVFRKLANHMSKVATPFVRNTASIGGNIVLAQKYPFPSDIATILLGAGATVC

SEQ ID NO: 62263 - protein, 113 aa, Sorghum bicolor
  Clone ID: 18052792.pep
MDTAVELELEQKPAVGYWSVVGARPCDACAAEPARLHCREDGAFLCPGCDARAHGAGSRHARVWLCEVCEHAPAAVTCRADAAALCAACDADIHSANPLARRHERLPVAPFFG

SEQ ID NO: 62264 - protein, 120 aa, Sorghum bicolor
  Clone ID: 18052808.pep
ESNCSARVIGSEAIAALARQVLTDVEGAAAALQVGVRQRCWLLLRDGRQHRSRFGRHRGGLVPRGDGRGWWWLRVGTRSLRCSSGWQRWWLGEPRWAAVVSCSSVASCPGHVAAGVAAGS

SEQ ID NO: 62265 - protein, 190 aa, Sorghum bicolor
  Clone ID: 18052812.pep
HEAPAPAATSDDAPPGGGGEGAGAGRLSALIRSLCAAGRTAEAARALSAAAARGGAGVVAYNAMVSGYCRAGQLASARRLAASVPVPPNAYTYFPVVRALCARGRIADALSVLDEMRRRGCAPIPPMYHVILEAACSRGGGGGFRSAVRVLQDLHGRGCALDVGNCNLVLNAVCDQGGSVDEALRLLRDL

SEQ ID NO: 62266 - protein, 113 aa, Sorghum bicolor
  unsure (1)..(113): unsure at all Xaa locations
  Clone ID: 18052827.pep
MDSKLGVQHGHHRHHSHNNGISKPPVHHHHHAGGRKGSAGSGRQGGGGGKGIKVVYISSPMKLTASAEEFRAIVQELTGRDSXVADHDLDCGAYYAAAGAPSSSSSSSSYSSF

SEQ ID NO: 62267 - protein, 117 aa, Sorghum bicolor
  Clone ID: 18052848.pep
VSTVTWSIMYCSMCLLSCVYLLPFKSVLRFVLQYTLFYIQHFSFQCFALSLLLHISQSCLNGQDSSCRTCKSQRSGTTQHTVHRAPGSSELLVPACLVWYACANAMATANQVALPRA

SEQ ID NO: 62268 - protein, 112 aa, Sorghum bicolor
  Clone ID: 18052880.pep
MELLPLLTWLLLAHAMAYLAWTAAARRRQSRCYLLDYVCHKPRDDRKLSTETAGDVIQRNARLGLTDYRFLLRVVVRSGIGEETYAPRSILEGREDTPTLKDSLEEMDAFLD

SEQ ID NO: 62269 - protein, 75 aa, Sorghum bicolor
  Clone ID: 18052892.pep
TRQLRVPAVAMAFAGGATLKLATQNVLIDVDDSTTCLAFAPTDSTTIIGNTQQQTFSVVYDVAQSRIGFAAGGCS

SEQ ID NO: 62270 - protein, 172 aa, Sorghum bicolor
  Clone ID: 18052893.pep
ARGTYQPYDGILALKMALAEFMRQIMHGSVSFDPSQMVITSGATPAMEILSFCIADPGNAFLVPSPYYPGWDRDIKWRTGVELIPVPCRSTDNFNISITALEIAYKQAKKRGVRVRGVLISNPSNPTGGIVPRETLHDLLVFAADKNIHLISDEIFAGSTYGSDKFVSVADV

SEQ ID NO: 62271 - protein, 192 aa, Sorghum bicolor
  Clone ID: 18052908.pep
TRALRNKLEARGSIFNTSSDTEVILHLIATSLSRPLLARVCDACERLAGAYSLLFLTADKLFAVRDPHGFRPLVMGRRRNGAVVFASETCALDLIDATYEREVQPGEVVVVDRRDMSVASACLVPHRPRRSCVFEHIYFALPNSVVFSHAVHERRTAFGQALAEESPAPGADVVIPVPDSGFYAALGFARAS

SEQ ID NO: 62272 - protein, 202 aa, Sorghum bicolor
  Clone ID: 18052910.pep
TRRERHNKALKTPLKEMVVVHPDNDFLEDITGKLKEYVMEEINVKTVTPCNDPLVYASLRAEPNFSVLGKRLGKDMGKVSNVVKKMTQEEILAFEKSGEISFFGHCLKLDDIKVVRQFKRPENVSEKEIDAAGDGDVLVILDLRADQSLFEAGVAREVVNRIQKLRKTAQLEPADPVDVYYESVGNDKNTLGEILKSQDQYI

SEQ ID NO: 62273 - protein, 135 aa, Sorghum bicolor
  Clone ID: 18052921.pep
MDAAAIAGQQARRRIRPPEPLVMAAAPPTPAAFRCPISLEVMRSPVSLPTGATYDRASIQRWLDSGHRTCPATRLPLASTDLVPNLLLRRLIHLHAATLPPSPSPEEVLSQLAAADADGEPAAAEKAVRSLAAKI

SEQ ID NO: 62274 - protein, 179 aa, Sorghum bicolor
  Clone ID: 18052935.pep
TRFFLKIFINTGVMLSYVSNLAFSGLPVHLSWRVMFAAGVVPTVFLAAGVLTMPESPRWLAMKGRVAEAKAVLDRTSDTPAEAEQRLLEIQDVVTNSSSGVGGGGAWKEVATKAGVRRVLAMVLTLQFFQQASGIDSVVLYGPRVLAMAGVTSNTLLLSLNVLFGVAKAGSILVAMALA

SEQ ID NO: 62275 - protein, 166 aa, Sorghum bicolor
  Clone ID: 18052942.pep
HEVEFSGAGTGAVTIRHSLLPPPFSSCMPIASKLVYFQRRPSPAPPDDPGPEPPDPRRRPCRDHHRRRRRSSLSSSHHKPGQDHVPGHQRDAAAKPLGSVGNIAEHAAGMSSSTRLHRSISDHGRLPDAVHQARERLLQRLNSVDLSGRKQKTWPSESFWAGLTRT

SEQ ID NO: 62276 - protein, 99 aa, Sorghum bicolor
  Clone ID: 18052943.pep
PLHLASFHHQRLLEQHMFSIACFGLSVLRILRPPAPSARLCRCGCFSSLVIPAIAQLESTAAYVVGRLGSWRGQIQRQCSSQVEGETSQSHHPAWSPRA

SEQ ID NO: 62277 - protein, 189 aa, Sorghum bicolor
  Clone ID: 18052949.pep
MAAAAAAASSSAAACFLSPLPPPRRPRHFLRHLARAAATKPAPAPAPASASSPWPWARRLGSLVPGETAGRLLSSAAGSLIVALASASLVLGDAGAASAFVVSTPRKLQADELATVRLFQENTPSVVYITNLAVRQDAFTLDVLEVPQGSGSGFVWDKSGHIVTNFHVIRGASDLRVTLADQSVYEAQV

SEQ ID NO: 62278 - protein, 164 aa, Sorghum bicolor
  Clone ID: 18052964.pep
HEEHTVRNAIRSKSGAIAALRELLSHNLLRSTLLLWFVYYACSFAYYGIALLSSQLSDVNRSCKSGLIFEVHQNDGNLYKDTFITSLAEIPGLILSALLVDRFGRKATMWSLMFACCAFLGPLVLHQNELLTTTLLFGARACGTGTTTILCLYAPEVYPTSVRS

SEQ ID NO: 62279 - protein, 179 aa, Sorghum bicolor
  Clone ID: 18052968.pep
ARGADEARSMDLADRYLNSECVMQMLQADQVGLAEKTAVLFTKDGDQHNNLHDMQCMWYELASGESYYRQGDLGRALKNFLAVEKHYADMTEDQFDFHSYCLRKMTLRAYVSMLKFQDRLHAHEYFHKAAAGAIRCYMKLHDSPTKSSTEENDEMSKLPPAQRKKLRQKQKKAEARAKR
